United States Patent 9,328,346 (POLYCOMB-ASSOCIATED NON-CODING RNAS) - sequence listing, part 123

SEQ ID NO: 191325 - RNA, 14085 nt, Homo sapiens
uugugaggaccaaauaauuuuuauucacauacaucuaguucaucuaccuaaaguguucagaacaauguucagcacauauuaagcuugauauaacuguuaccuaugaugaugacgaugaugaugauaaugauaacuguacagucacugucuuucugaaguuguuuggugaucaagaauguguuuagaacuaucucuuuauuagacaaagucauaaaccaaaaauuuccaacuuccuguacauguugaaagcuuuaaauaaggauccuuggauacaaaauaugguccacauggcugaaaauuaauucuaugacacaauauuauucuaaagucauccuuauuuugaaagccuaaagauuuucuuuuauggcuauaaaaauaccaccaagcuagacauuuuaauucuguugagauauacaaauagaauuaccacagcagccuacaccuucuaugauuucuaaacacuuaaacaucaaugguuuugggaagaugcuguuguccuucaaaguucauuaaaaguucagaugccuuuugugaaagcccaacuuuucuucuaccugcuaaauugucuuuucagaagucuugccggauguuuucuuuguuugccucuccauguugcugcuuaauuugauagauuucauuuucuagcugaacaauaguccguucaaucucauaauucuuacugaccagggauacccaacuagaaugggggggaagaaaagaaaaaaauuacucaauguaaaacuucucuuagaagauuuuauuuuaaauguauacacauguucacccagagcuauaacacuaaccuucacuuuuuuuuuuuuuuugagacggagucucgcucuuguugcccaggcuggagaacaauggcgcaaccucagcucacugcaaccuccgccucccggguucaagggauucuccugacucagccucccgaguagcuggauuacaggcacacgccaccacagcuggcuacuuuuuuguauuuuuaguagagaugggguuucaccacguuggccaggcuggucucaaacuccugaccccaggugauccacccaccucggucuccuaaugugcugggauuacaggcaugagcuaccaugccuggccuaaccuucacuuucaacuuuccauuaaaaaaaaaucaaggcacaauuguggaaaaguagguaaaggguacauggaaucucucuguauucuuuuuuuuuuuuuuuuuuuuuuuuccagagacagggucuugcucuguugccuaggcugaaaugcaguggugugaucacagcucacuagccuggaacuccugagcucaagcaauccuccaaccucagccuccugaagagcuuagacuacaggugcaugccaucaugccuggcucauuuaaaagcauuuuuuuguagagacagggucucguuauguugcccaggcuggcuugaacuccuggcuucaagcaauccuccuaccuuggccuaccaaggcacuaggauuacaaugugagucaccacaccuggcucucuguauuauuucuuacaauugcaugugaaucuauaauuaucuaaaaauaaaaguuuaauaaaaaagcaaauuagaaacagaugagagaacuugcaaaccagaagaaagaggaaagagugaugaagauaguauuuaaucaacaaaaaggaaagaggcaauaguuuauuaaauugaggaaaaagcgugaaaggguaccaacgagacugguaagacguacauggagacgguggaacaagaaugacuugaguaaugaagggagaaagggaauggccaagcaaaaaggaagagagaaaugacacaaauauucaagauuauauuguauaaagguauacauguguguauguaaaagaacauuuuuaaaaaugcauaaaccugagguacaaaaaaauuaccaaguaugaaaucucccucccuacaagauuuuauaaaauaauuuuuuuccuuuuuuuuuuuuuaaagacuaggucuugcucuguugcccaggcuggagugcaguggugugauuaugacucacugcagcuucaaccuuccagguuaagcaauccuccugccucagccuccagaguagcugggacuacagacaugugccaccgugccuauuuuuuuuuuuuuuccguuuaaaaggagaauaaagguagaguucuauucaaggccaaaaauacuagacuaaaaacaggguauucuaagaccagaauccuuuagcaaugguucaauuuagcaaaggauccuucgccaaugguucaauucucguuuauaguucucuuuaacaccuuauaaagaggcagagacggggaagggugaauucagaaaauagcauuucuuuguuaccuguggcaucccauuugaaugcuauuugaaucauauuauugaaucgaccuuagaaagggcuaaacaauuuaaaagaugauggaauuauagauacucacuuugacuccauuucucucaauuuagauccagcugugaguugcauguucuuucucugccaguuuaaaucuugaauauguuuucuguaaaaaauuauuuauacaacccaauuacauuuuaauguaagaccuaaaucaacagaaaacucuauaacacaagagaauaucuuaaucccaugagaacaauauuauguacaguuauaggcuaacuguagaaauuaccuuucuucuaauuauuuuuugauuacaaguuucauaaaacaugcucauugugagaaaucacacacacacacacacacaagcacacacagauuacaagucucaaguccccccucucaugcaugucuccuuuuuccugauaacuccuguugaguuuuugcuggguguccuuccaggcuuuccuauauguguguguagaaauugguuuuaaaaaucagauuauauguguuauucugcaacuuuucccacucuaaaagugccuuucuauguuugcagacuugcaagcugcaaguggcagagauguuuucagaccucaggccuauuucuccucuacuuagguagggcaaacccagugucagauguugaacaaagagaguggaucaauuguuuacuuucaucuggcugcagucucuuugcuuucuuuuuccuccuauuuucuauuuauuaaagguucacuuaaacuucauucuguaauaggaaaaaacaauuuaccuuaacuucugaaguuccuucugugcguguucaaucauaugaacuagauuucugaaggaaaagaggaaaaucagauuaaaauacauuaaaauaguaccaauuaaaagugaacuuuuucaaguuuuucugccaaaaaucauauuuauggagcucugugccaagaacuauguuggacacuccauaaucgaggacugucacucaugcuggaaugcaguggugugaucauggcucacugcagccuucaccucccaugaucaaguaaucuuccugccucagccucccaaggagcugcaauccucccaccuuggccucccaaacugcugggauuaccaugcccugccugaucuuggaguacuuagguuacuuuuuuuuuuuugagacagucucguucuguugcccaggcuggagcgaaguggugagaucucagcucacugcagccucugcuuccugguucaagagauucuccugccucagccucccaaguagcugggauuacaggcauguacugccaugccuugcuaauuuuuguauuuuuuuuuuuaguagagaugggguuucacuaugucggccaggcuggucucgaacuccugaccucaagugauccaucugccucggccucccaaagugcugagauaacaggcgugagccacuguacccagcuuuuuuuugcggaggggagggacagagucuugcucuccuguugcucaagcuggaguguaguggugcaaucauggcagccucaaccuccugggcucaacugauccucccacuucaggccuucaaaguagcuuggauuacaggcauaagccaccaugcccggcuaauuuucauuacuuuuuuguagagacaggguuucaccacguuguccaggcuggucuugaacuccugggcucaagcaaucuccccaccucagccuccaaaguguuggaauuacaugugugagccacacggccuuuugucacuucuuaaacugucaugacuucuugucauagaaaagauggaauauaucugaguacccacuuauuuuauuucucaacccccuuuuaucucuauauuucugcauauacauucaccuugucauucucuccuccugucuacugcuaacuagagagaggugagaaaaagaaaacuguuguagaaugagauaucaguccauauuugcauguaacauaugcauagcaaaauaaaaaauagauaccaguccaggucagcuguaacuagcacaggggaaaaguucaauaauacagaguaccauauaauuauuuuagagaaguaaugaaacagauuuuaaucucuuuuuuaaguuuaaauaacaacuuuauuaagauauaauuccacaucauaucaauuuccucuuaaggcaguggaucaaucaccuacaggguccauuuuuaccacaucuggcccuaauguguucuugcucuaaaucuaauauuguuuccuggcuuuugugacucaaauuuucuguugcucaccugaguuauucuccuaccucuacugacugguuuccuugcauuagcugcaauucucucaagauucagucuuuaaacagcugugccucucuaggcuuucccucaggucaucccccuuuccuugacuucgacaaucacuccaugcugagcacuauugauuuuagugcucuauuccagacuucugaccacuaacagggagcuuuccuuugaauuggcucucccugaaaguuuaguuugucuucucccuucucccacccuuccucuuaaauauacuuugauaaaauauaguacaucuccucuggagaaguguccacugaauuuggaggagacaaaauaugcuuaggggaaugugaagcacuauagagcacuuugugauuaaauggaaaacaagugaugugcacaauaauucuguguauaguuacucagaagagggagacaauacuagaagcagaauuucaaucagggaagaagacaaguaagcaaacuagagcugagcccuaaacaagcugaauuuggguauaacagguaaagacaagggcaaguaaaggcccagaggcaggauuugcaauaaucaccagagaaaggacuaguuuggguugaguuaaaagucuacaguugagguaguaaggaaaagcccuugaauaccacguuaaaaagccuggcccagccgggugcucacaccuguaaucccagcacuuugagagguugaugcuggaggaucacuugaggccaggagcucaagaccagccuggccaacauggugaaaccccgucuccacaaaaaauacaaaaauuagccaggcgugguggugucuauaaucccaccuacucuggaggcugaggcagaagaguugcuugaacccgggaggguugcagugagcugagauuguggcacugcaaucuagcuugggcgacagagcaagauucugucccgccccccgcccccaccuccaaaaaaaaaaaaaaaaaaaaaaaaaaaaacuuggccucuaccuugcagguaauagggaauuauuaaagguuuucagguaaguugacagcaguguucuuuucaaugucauauuuuuuccucugcaucuaugcucuccauuccuggaauguuuuccuuguuuccuucuaaacaucccaauuucaccuuucuucaacaaccuucaacuuaaugccccaucuuuuuuuuucuuuuuuuugaaacagacuacaaguguguaccaccauaccuggcuauuuuuuuuauuguuuucuauagagacaggguuucacuuacguugcccaggcuggucucaaacucuuggccucaagugauccuccugucucagccucccaaagcacuaggauuauaagcgugaaccacgccuggcaaugccccaucucuuaacgcuuaguuuacagaccacagcacacaauguagcacuugcccccauauugccaaaaauggacuauugguuacuuggcauaaaacuuauuaucucuuccauuagauaaagcuucuugagaagaaucacauuuuuccauuuugugaaacagauuuauugaugucgcuuacauuucuuaaucacccuaaucccauucuuucuucuuuuuccccccuugcaauauauagauauauaaaagaaaguuaguuguuggcuuuguagaguuucccaaauucuggauuuuguccacuggaucauuuuuauguggcuacaaauauuaaaugcauaauucugaagauuugagaaacaguauuaucauuucaugguuuugcuuuauuuuauauagcuauguuucaggaaacauacucuaacgaaaguuguacauacuguuaugaaguucaguggccuuuuucucuuaaauugugaauagacacucaggaaauuuuagggcacaaaggggccaugcagauaaucuaaccacggaauuuugcaagcaaggaaucugaauucuagauagacaauaaauacuaaagcuagagcuaguuacauggaacagaaacaggaugucaguggcuuguuuugacaacaaauacuugcucaaauuuauuuguaaucccaaaauuacuacuuguaguguuuugcagucauucauggacaugugcacaguggugaaaaaucugagcagcugagcaugcacauuuucagcugaggaugaacaaggaggugcuuugccuucuuguuuuagcucucauacagaaauaaccagaggaugaaguucaaguuccaagucugggaucuguuaguggggcaguuucaagaaaguuacuuuacauuucucaacuuuguuuucucuuuuauaaaauaaagaagucuaccaggaugaguuuauuuuaggauuuaagauuauaaucuauuugagagauauguauaugugugcacaugaauauguauauauuuccccuaggagaaaugguacaguauuugcuaauucaguguucauaggacuuaaagaacauaacccaugacuaaugagaaucaacuguuuaagcaacgcuugauaacauucuaucaaguggugcucugcaaaugggaccucagaacuaguuuuguuacaauauuauacaauaaaugucguaguuugguuuagguccuguuaguacucuugaacuuugagguggguuucaaaauaguggccuuucauauggguugcaguucuagaacauaaucccaagacaaagucuagcuauauuauuuuuaucacacuuccccuacccauacuuugugggguuuuuuuguuuguuuuuugagauggagucucgcucugucacuguggcuggagugcaguggcacaaucucagcucauugcaaccucugccucccagguucaagcaauucuccuaccccagucuccugaguagcugugacuacagaagcgccaccauggccggcuaaucuuuuuuuuuuuuuuuaguagagaugcgguuuuaccauguuggccaggcugguuucaaacuccugaccucaggugauccacccgccucggccuccugaagugcugggauuacagguguaaaccaccgcgcccggcuuuucuuuuucuuuucuuuuuuuuuuuuuuuuuuugagauagagucucauucugucgccuaggcuggagugcaguggcaaaaucuuggcucacuacaaccucugccucccaggcugaagcaauugucaugccucagccuccagaguagcugggauuacaggcacacguuaccaugcccagcuaauuuuuuguauuuuuuuuuuuuguagaaaugggguuucaccauguuggccaggcuggucucgaacuccugaccucaagcaauccacccaccucugccucccaaagggcugggauuacuggcaugagccacugcacccagcaccucccauacuuuuaaaauguacuaaaacuuugggugagauggaaagaaaagagaaaaaacaaaaaaaacagaagaugaagaaaaagguucuuacucauuguauacuuuccaggcauuacauccaugcugugacauuaguuccagauucucaauucuaacugcuugaugcucuaacugggccauagaauuguuuacacauucuugccaugcaguaaugucauuuuuuugaccagaggagggggcuggaagcucauaucugaaauuaaacaacaaaauaaaauaaaaccaucuauacugccaagccuuuacaucucuucucaguagaaugucccaugagucuccauauaguauaaaaacuacagaagacuaaggauguaaaccuugcaauaauaagaaaccgauauaugcuaacaaucaauuuacaaauaugauuuagcaccauuauguucacuucaaugugaacugguuaaauaagcaacauuacauucacauaaaagauuguuacauuagcuauuaaauguuacugaagaauauuuaauaauauuaagaugucaguaauauauuaaggggaaaaagcaguagacaaaaaaguuugcuaccauuuuuguaaaauacucacacccacccauccacuaacauacccaugcgccgguagagaaaaaaaugagaagcgauaugacuccuucuauucucucuucauacuacccagucaguccuucaacacugccucucucucucucucucucucucucuauauauauauauauauaguuuuuuuuucaagacugggucucccucuguccccaacgcuggagugcaguggcacaaucucggcuugcugcaaccuccaucuccuggggggugucaagcgauccaccuaccucagcuuuccaaguagcuggguccacgggugcgugccaccacacccagguacguuuauuauuauuauuauuauuauuauuaauuauuuuugguagagaugggguuuugccauguugcccaggcuggucucaaacuccuggauucaagcaauccaccagccucggccucccaaagugcuggaauuacaggugugagccaccacacccggccaacacugccaauauuagccagcaaauacauucuucacaaaucucagcucauuacugaguuacuacaaacuaaauuuuaauuuccauuuuaauauucuuaccguuucauacugagcaauucaauugguugucgagcagccagucuuucaaauucauuucucauuaugucagucugauguguaaaucagaaaaaagauuucuaagaucauguugacaacuaaaaauuaacaaucaccaaagaacagauuuaagcuacacuacccauuauaaugaauuguuuaccuuucccuaauucuucucugaguuaaaugcucucuagaaucugaagcacacacacacacacucacucacucacuucacauucaggaaaaguggcauguauuaaggagcccacagagaaaaggauuaauccuaaaccagugguucuuaauuccagaagcauaucagaaucaguucgacagugcuaugguuugaauguuuguccccucugaaauucauacagaaacuuaauccccaauguaauaguauuaagagguggggucuuuaagaggugauuggguuaugaaggcucaauccauucauggguuaauaaguuaucaccagaguggguauguuauaaaagccaguuugucuuucucuugugugccccuaccuugccauguaaugcccugugcugcuucaggacuguacaccaaguccacaccagcaagaaggcccucaccagaugcagccugugaaccguacacuuuccagccuccagaaauccaagaaauaauuuauuuauuuauuuauuuuuuuuuugugagacgaagucucgcucuugucccccaggcuggagcgcaauggcgcgaucuuggcucaucucugccucccggguucaagcgauucucuugccucagccucccgaguagcugggaugacaggcaucugccacuaugccuggcuaauuuuuguauuuuuaguagagacaggguuucaccauguuggccaggcuggucucgaacuccugaccugaggugaucggccugccucagccucccaaagugucuuuucuuuauauucacuaucuucucuagcaauuuuacuguucgcaaguaaauguaguauagcuguuccucuuuagggccaacguccuaacccauuuccauucugcacauuuccuacccugaggauaaagaacugcuuaaaauauuucuuuguaguaauacuucgguuauuccauguaauuuuaauuuucugaggguuucaacuaucuuaacaauuagacuaaauaaguaucaaaggccuuacagaagccugcaugaauguuuaaaaguuuuuauuaggccgggcgagguggcucaugccuguaaucccagcacuucgggaggccgagguggguggaucacgaggucaagagaucaagaccauccuggccaacaaguugaaaccucaucucuacuaaaaauacaaaaauuagcugggcgugauggcacgugccuguaaucccagauacucggaggcugaggcaggagaauugcuugaaccugggagguggagguugcagugagcugagaucacaccacugcacuccagccuggcaacagagugagacuucaucucaaaaacaaaaaaacaaaaaaacaaaaaaacaaaaaacaaaaaacaaaaaauuucguauuaagcauuucuuucugcagaaaguauuuugcaggggcuacugcuaaauuacacacaaucuuaagaaaauguaguuaccuaguuuccugcaaaaaaaaaaaccagggcauucuagcuagaaaauucugcagugacagacaaggaguaaacagccaauuaaacacgaggcaguauaaaaaugcaguauaaguagucuugagccauguagcauaggaggaacccuuaacuaacucacaugcucaguaagugauaaaucuggaauuuuagcucaucucucuccaaagacuaagccaguguucauggagcggcaagggcaaucccugcucauggaguagucucaucuuagcuuugagaggccuuccucaaccacccaaccuggagucgcccagucacuuuaucacuaucauucucugugcagcauuuaucaacaauuuuucugaucuauuuauugucugucucaacacucuagauuuuaagguucaugaguauggacccugccgauacuguucuccaauacccagaauggaacagaccuucguaaauaguuguuaaaugaauuaaugaaagaguaauuucagaggcaguuugaagaacaguuaaggucuuagucaauuagccucucuaagcugcaguuuucccagcuaaaaaauggggauagcaaacauaguuauauaguuuauagagcuguuaugugcaccaaguaagacagugaacccaguaaauauuaccaacuauuacuaagaaaggaugccaggugugguggcucacaccuguaaucucagcacuuugggaggccgaggcaggugauucacuugaggucaggaguucgagaccagccuggccacaauggugaaaccacguuucuacuaaaaauacaaaaauuaguugggcaugguagugcgugccuguaaucccaacuacuugggaggcugaggcagaagaauggcuugaacccaggaggcagagguugcagugagccgaggaguugcacuccagccugggcaccagagcaagacucugucucaaaaaaagaaaggauuaaauaaucaguaaacuaauuacaggagaaucacuugaaccugggaguuuacuaauuaaaucaucaguaaacuaauuacaaagguauuuaagagagaaggaaaaaaacuggcaaaaguauuuuaaaaagucugugauugaaugcaguuaucugaaaccuucagaaaucaguccaauaaggaagcauuacuguacuuaguucuuaaugugguuaacaucuacaccuagguacaaauauuuagaaaaagcauaggaaaacacguucauaggaacauacgucuucuacuuaaaacucagccaaggcugggcaugguggcuuacaccuguaucccaacacuuugggaggcugagguggguggaucacuugaggccaggaguucaagaccagccuggccaacaugguaaaaucccgucucuacugaaaauacaaaaauuacccaggcaugguggcaggcaccugcaaucccagcuacucgggaggcugaggcaggagaaucacuugagcccggaagguggagguugcagugagcagagauggcaccacugcacuccagccugggugacguaaugagacuccgucucaaacaaaaacaacaacaaacuuaacuaacaauuuuuucauguuacuuuaauguaaauaauaucuuuuuuuuuuuuuuucccuuugagacagggucucacucuauugccaggcuggagugcaauggcauuaucauggcucacuguagcagucuugaacucccaggcucaagugauccucccaccuuggccuccugaguagcuggggcuacaggugcaugccaucaugccuggcuaacuuuuuaauuuuucuuuuguagagaaagggucucacuauguugcccaggcuggucucaagugauccucacaccucagccuccuaaagugcugggauuacaggugugagccaccacacccagcuaaauacugccuuuuaauaauacaauccuuucauaaauaaacgauuagguauaaugggaaaaaauccuccaagcuguacauacugaaauacuugaauccaauaauuuagaaaugauaucuuacauuucauuuagcuaacuagacccuaacuagaauccuggguguacuucaagguuauacauuuaaaauaguaucauacucaauguguggaguagaacagcaucugacuccuuaggcaaucauggacacucccuucucuaauccucuuguccuuauacauacccuccgcuauagguccuuuacauauuauuacacauuuauacauacuauuguaaacuuuuuguuuuauauaucuagcuccucacuguauuguauuuuucuguauucagaaacccuaucuuuuuuggagaggauguuugucuuaaauaaagaaaagaaaaauuaaaagaaaacaaaauauauuaaaaaagaaaccccauauaucucuaugaucucagaaucuagaauggcaccuagcacuuguaaaguauucauaucagugaaaauuauugccuacauuaaucagaaauguguuaauaaaaacaucggauagauuacagaaaaaaggagaaggcugagaaaaaaguaguauacacuuggauaugguuuguccuuucagucguaucacauacauuugguaaauaacuagacuuuaauaugccacucuccagugguucuaaagagcuuagguaauuaggcuuauacauauuaaaaaacccuagaucacuugcuguagagugaaucuuggcaggagagggucccuuugagaauuuacgcauggauccuaucucaaagaaugguagccacaaauuuuugcauuaagugaguuguggagccccagaaagucuuccuauggaucuuagaauaagaaccucggagaagacuuaucuaucuaguuguuuucaauagacugacaccuauacaguagguaaguaguagcuaugcaggcaaugguuaaaacuggaauuuaaagcucucaauccaaaauaaagguucacaggaauucucguucacaccuaggcucaagacauacuuacuucaaaggcagaauaauccggggcugucagguagcucagguaguucuuaguaggucgguaucugcgaguuuccuccuccaccagcgcugcagccuaagaaagagaauagggaccaggguagaaguggcaaauuguaacauguuucuuucaguaccgagccagcuagcagugagucagcuacaaagacaccccgcacucaccgcuucccgcacaccaggggcuucauaaccuugaucaaaauacggcagcgcauccaccacaaccucuccagccaccaaaccugugcccgccauucugaggaccucagguuugccugcguuuucugcgucugcguaaacucaguuau

SEQ ID NO: 191326 - RNA, 26321 nt, Homo sapiens
ucaaggcuuuugcauagaacaagauuuuguuuucagaguuuucuuccuuccccuucccccaauuguuagcagcuugaugugucauucuccccagcaggggaggggguggaauggcuuggguuguaaacucccucccccagccuuccugucccuuggaggggcaguucagcuggguucugguucagggucaggcaggcaguuaaggcuuggcuggugcgagaaggcugggugcugugucuucagagcucauuccuccacucuggcuccacuugcagagacaggcccccuucacccucccgcuccugggggagguagucauggcuguggggcccuggaaagagagaaaguacacugugucuuccuuaccaccuccucuggcacuguccccacccuggcccagccauaccugagguagaggggcugagcuugcucagaccuugcaguaaauucugucccuguugcagguccaguuuggcagggaagggacacccgguauacccuccguuuucuuuacagaacuccaggaaucugugggguacagaggagugccagcagagacuggaggcuaagccacgguccugucccaucugagcuguacuugcucaaccucuggaugucauuuaacuuauaaauacaauagugaugcugugaaaauggacacaucugaggauuaacugagcgauaagcaagcgcuuaaaaaagauccaccugcccuaggcaggggcuguggccacuaagagggagaauggggugggaaugcucacacuuuccagucagggucauggcccaggagaaggggguuccccacgaugaugagcagggccuuggcccgggucacagcuacauugaaccucuggaaggaagaagugguguggucaugggagggaagagccccgagaauggaagaauuccugccaccccgaccagcccucaaaccuugggguucuuaaggaaacccagauuaaaguccagauccagcugcacaaagcucuggcugcuucgcacgguggagaugaggaugacgcuucguucuuggccuuggaauucuucuacugaacccaccuaguggggaaagaggcagggccugagaccagccaggggugucaaaggggugcccuaccccagggagcuugccuuccaaggaggguacagagaggucacugggcaauuguagaucagugagugaaccagugcugcgacacggcccagggaaaggggaugggagguaggcuguggaagcugaaacaugaagguugaauccugcugagggcuggggccugcaaaguguucuaaggaaagaaaacagcauugcaaagaacacgggaacucagagcagugacuuucaaacuuuccugaaaacaaucacuaaguaucuguuaagaauauacaacccugggcccuaacccggacccccgaucagaauuuccaagagagaggccuguaagucuuagagcaguguuuucaacccuggcugcauauuagaaucaccugagaagcuguaaaaacuaccagugcccuggcucugccccgauagcuguaugagcugguggguggggcccuggcaugggggcgggguauuaaaagcucuccaggugauuguuaucugcagccaguguugagaccagaaccuuaagagagaggcuacuggggguggggguggcagcaucacaugacaggccacggaauuuggacuuuauccuuagggcagaggccucaaaccugccucagucuaagaaugacaggagguguuuguuaaacaugcaggcuuccugaucccaucccagacccuuaaguuggaaucuccaggagugagaggcucagggagagcucgagcucuauucaaggcagcaggggugggacggggacgugggcuggaguggaagcuugaggaagucucuggaagugggcaagugggggcacacggaaggcagggagugacuguggaacagcaugucaccuucaaguccuugaugucauccaguccucgaagcucccugucaaguuuggugaugcaguaacggauuuucuccaccuggaaggaggggacaggugccuuucucucgugccauuaaccuaaugcaagagggagccuggcaggaggccagggagcuggggaacaaagggaggcggcagcugaccuuggugcucuucugagauacggagccagcagaggccuaagcuccuggagccucugccuaguggucuggauauuaaggagguaccaucugggggaggggccccacccuugcugguaacugaggaccugaccuguuuccgguacggggagaugacgcccacacuucgagggcucaggcgagcuuugcccuucuuggaggagggggccaggagcagcuucagguaggaagucacuguggcagccucuucaggguugaagaaggaugggcuguugccuucacgcucaucuuugcccauuacgccgugaaagaugaugggaaagcccuggacauggggucgggggaaaccgucagccagaccacccucccucuauucccucccuucccaaacccuuccagagaguaagagauccuaggccaaggugacaaagggaggggcugcaccuucagugggagggaagucaggguacagggguggggccugcccugcucagccucaccugucgagguaggcccgcccagcggcagaagcguucucgauccacgacaucagcacaggccugcagcuccccuucauaauagagcugguuaggaauguccaggauggugggaugagaccugggaggccggaggaggaaaagcaagaccaagggucagauucccucugcccuacaggggcuccgcucuacccacucugggcccacacacaauagccugcuaccccgcuggcucccuggauagcaggacacuccuccauaauaucugcugccaggcacuguaaaccacagaaagcagaaccaaauauaguuccagagagcaucuaguccagggacuccacagacccaugacauuuaaaacuaaauaauuaggggcccauuuucagguuucaaauuuaccaaggacaguacgaaaccaaauucuccuugacuaucacguuauuugaugagaccauguguuaaaucaaaaaauauaagcagugaugacacaauaacuaacauuuauugagcucuuagugacagcauaaaacuuaucuaagcauuuuagauggcugaacucauucacuaaaaguauacagcucuuuaauuugaauaacaauagguuuaugaaaaaacuguaucuucccuauuuuucuuucuuuuuuugagauggagucucgcucugucacccaggcuagacugcaguagcgcgaucucagcucacugcaaccucugccucccggguacaagcgauuauccugccucagccucccaaguaacuggaauuacaggugccugucacuaugccuggcuaauuuuuguauuuuuaguagagaugggguuucaccauguuggacaggcuggucucaaacuccugaccucaagugaucgggggugggagccugaccuaccuuggccucccaaagugcugggauuacagccaugagccacugugcccgaccuccucccuauuuuucuuaucucuccuuggauugccugaaaacuucaucugggacugguaccagacacacccuagccucuaggaaccacugaccacccccuaagaugcagauaagcugacugguguagugugaaaccacuggcuaagucacgcagacaacaagcagcagugcuggggcuagaaaaaccuccugccuuccaguuuagucuuucugcaucacacaaccucugagcaacaggacugacagcaagccagacucuccaguggggucugcaugcaggaugugaaagcauaggauauggcaggggaggcaagggcaugggaauaccuguaguugcggagcagcuugguuaugaacugggggucauagccaucagggcccuucuuguacagggaguuguaggugagcagccgcuccagcagugaguaucccaguccaugcuucugggucaguggggaacgcagcacaggccccagcugccgagggucuccugccagcaccagcugcccuccuggaucaccuguuuccuuuacuuccaucagcccugggaagcagaagaggugugggaagaaagguaaguggugcaaccucucugacccacacaggguguauaccugcagccccaccugagucccucaccugcuauagcuaccagacucucaggcuccaugcaguggccagccucaucgaugaagaugugugugaagugaucaaugggaaacugggccgagaccaaccugggaggugucaggccaggcaggggucauauccaggcacccaacuaccaaaccugaaugcuuucccaggcuggcuucucagcacccaccaccccacuccggaaaccauucuuccccauuuccccagcccgguaccccuuuaauuacacuuacgauucagagacacacccacacacacuccccaccugccggcagugaugagggugguaauuaagacccgguauuccugcagcuucuucuuggcgggaaauacauacucccccuucuuugcgucccaguugcagcagggcuguggauugugaagggaccagaggaaucagcuuggcuccacucauucccaccgugauucuggcuguggguacccccccucaaacaauuauuuuuauuuuuuuuaauugagacggagucucgcugucccccaggcuggagugccauggugugaucuuggcccacugcaaccuccgccgccuggguucaagcaauucucgugccucagccucccgaguagcuggggcuacaggcacgcgccaccauacucagcugauuuuuuuguauuuuuaguagagacgggauuuugccauguuggccaggcuggucucaaacuccagaccucagguaauccaucugccucgccccucaaaguguugggauuacaaguguaagccacugcacccagccccccaaauguuuuauccaccccccucacuuacagacaaacugaggcccagggagggguccuguccaacccaaggucacauagcaaguaucagaauccaggucuccuagcuuccucgccucagugucugcccugagagccuccccggcauuugccauucuuuggcccucugcacuucccuaguaccuugauguccucagguaccaugcggaugucccugcugggggccaggaggcgguagauggagcuaggaagguggacccggagccuuugacagaguaggucagccccugaguuggauggagcgcaggccaagaugugggcuuugggcaagugcuucaccaccugagaugcagauaagcgcagugugggaggcagguuccugagacucagccguacccaggcuggggcagggcaagucuaugaugacugaaaugugaauggugacuccaagauucaugcagugcccuacccguacaacagugcuccacagccacauuuacccuaacuucccacuuccccaauccccacccuuuuuuuugagacagagucucacucugucacccaggauggagugcaguggcacaaucgcacugcagccucaagugcccagcuauuuuucauauuuuucauagagauagggucuugcaauauuguccaggcuggucuugaacuccuugggcuagucuuccccaagugcugagauuacaggcaugagccacugcacccggccccuaccucucuuucugauggcugcuuagaagcaggagcauuucgggagugggaaggaacuagaaucuggggacaacugcuuggugcugggggaaucagagugcaggccccagguuugugcucagaccccaccugcuuaauugccuccacuaacgugacagucuugccggugccuggaggcccaaagaugauguagggggcuggacggguggugcccguaacaaugugccucauggccugcagcugcucuggguuugacuccagacuccggucguacagccuggcagagggaccaggaaugugaacuugaagucauccagugacccagaggccucccugacuccacccccugugcccacacuccaaguggcuccagaagcucccugcccacagucucacuugaguuucacaucugagggcagcagcgggacgucccgaggugccacaggaaagagcaugggccacagcagccagcgcccugucagcuccagggcacggugcuggacucgcagcggcuggcgguugaagguaaaguucaccuugaaggucagcccauccacaaagcggcucaggaggcuuugggcagagagaggugguaagaguuuguuggggcaggggaggugggcaauaaagggccagaacuuucuccaccaaccagugucccaaccccucuuuccaagaccucuaugcaaguucucuagaagaggaagcugccguagcaucucaggguaccccugaggaaaagucuccugcucugccccggggucucauuuaucucagggagaaacacuccuccuccccuggggucagaagucuguagacccuuccagcagcucaggguucccccaacacccaccucauggaaaagcucagcuugacacgguccaauuccaccuugugcacaaagcccuuauaugugaugggguccuccuggugugucuccgaggacaaaagggcaaacagguggucgccccguagcacugaggggcggcucucagucacuccaggaaccuauggggugugaacacaagcaagcuucugucccagggauggacgcuggagggcccagcccccagguuccccagaccuuuaagggacaaggacugagacuggccuucuaaccuaagacucagggaguuaugcuaucccugcaccccucuuuccuuucauaccagcaggagucaggggaagaggaagaagacaaauccuccgaagcugcccagagaugccgagcccaggaacccggagccuccagugcagcugcccucuuggccagcucaguuccugcucugccuauaaaaauccuguucaucaguuaaucggguugcuaaaaaaauaauuaaaaaaaaaaaaaaaaaaaaacggaccaggcaugguggcucacgccuguaaucccagcacuuugggagacugaggcaggcggaucacuugaguccagguguugcgagaccagccuggccaauguggcaaaaccccaucucuacaaaaaauacaaaaauuagccaggcguaguggggcaugucuguggucccagcuacuugggaggaucacuugagcccgggcggcggggauuaaagcgagccaagaucaugccauugcacuccagccugagcaccagggugagacccugucucaaaacaaaaacaacaacaacaaaaaacuuguucaaaacucacuuccugcaguaaucuuuccuugaacaaacucacccucuaauucccaccugcaauuguguguagaaauccauucucguguguaauuuugggcuuauaugcacacauugaaaauccaagagccagaaagagcucuaagaauuauccaguccagcucugugcuuuucagauaagggaacuaaggcuuagagaaagccagggacuuacccaaggugguagcaaagccuggacuagaacccagaucuuccccauuucccugcuccaacacaucuuugggcacaggaugcccacccugcuucuugcggagcccugggaaccacuucaacuuuccucuuguucugcccugcugucaggaauaguucugcccacagccucuagcuuggcuggcuugagcccacccuccucacacucaaucugagcccugaccuccagcgugagcagccugggguucugguccacagggucccaggucaugggcaccgacuccaggucauagugccggauaucaugcuccaucugcaguuccuccaggugcagcagcagccgcagcuucaccucauaguuccuccacuucagggcugucuccagcugggcccuggaaaugaugguugggaggggugagugggggcaggaacaggaugggccagacaaccccuaugcccaggaguauccaccuucucccaccugaagcucuggaacuagcgucaaaaagcagagaagacuagagggauacagaaguggaugagagucagaggcccugaagaaggaagccuuggcuccugcuuccuuggaugccccugcccccaccucacccgacuugcauuugcaugguggcucuuauggccagaacauucuccuccaauccucucaugacucccacccucaccucauucaaauguccuucucuguucaaacaucacuaccucaaacaggccaggacuaacuggccuucugcaaagcagcaccaacccauucccuaacccugcuuuaguuucaguauaguucuguucaucuuuuuuagagacaagaucuugcucugucacccaugcuggagugcaguggcaugaucugggcucacucacuguguccucaaccuccugggcucaagaaauucucccaccucugccucacaaguagcugggacuacagacaugugccaccacacuuggcuaauuaaaauuuuuuuuuguagagacagaaucucacuauguugccccaggcuggucuugaacucuugggcuuaaaugauccaccugccucggccucccaaagugcugagauuacaggcaugagccacuuacaccugaccuguuuaguucuucacagcacucaucacuccaugaaauuguaacaaaaaugcucauugucccccauuaaaaugagccaggccuucauuugacugguucaccuugaauggugcuugguguauggugcgugcucaguaagggaaugaaugaauacagccugggaggcugaggacggaggugccagggcaaugcaaagaagccaguagguaaaagacgggagagugcggggugcagagggaugguacuuacuugaucucugcgaucuccuuaggggcagugaagauacuuguucccugaagaagcauggggagcagcugccugaggcggggagguggguaguauguccccagcgccauacuuaacuccaggucauagcccuuagcgcugcagaaucgagggaagaaaacacagaaaaccccucacccuccaacacucugagaacgccccucugggguggaugcacaaagcccuccugcaauccuacugcugaagggaagucagcagccucgcuccaaggguggacuacucucauuuuuggaacaugcgauacuuggaaaccuuuaaaacuauuaucuaaguaauaaaugaucacuagagaaaaaaaucagguaauagguaauaaguaaauaucauucuuaccauccaggaauaaccaauguuaacuaccagacuuuuuucccuguaaguuucuguuauacauauauagucaacaaaaagagcacaauggucugugaagguccuauuauguaguuugcuuuuuuuucuuuuuugagucccacucuguugcccaggcugaagugcaauggcgcaaucucggcucacugcaaccaccgccucccagguucaagcaauucuccugccucagcuccugaguagaguagcugggacuacaggcaugcgccaccacacccggcuaauuuuuuuguauuuuuaguagaaaugggauuucaccauguuggccaggcugaucucaaacucuugaccucaagugaucugcccgccucagccucccaaaaugcugggauuacaggugugagccaccacacccggcuaguuugcuuuuauaacucaguauuuugugaacaucuagcaaaaacaaaaagagaugucuacacauauccuacgcuuccauccauaugaaguauccagcacagagaaaucuacagagacaggaaguagaugagcaguuucuuagggcugaacaaaguggguggaggauaaaagggugauagcuuuuugggauaaugaaauguucuaaaaccgaugguggugauagugucacauauuugugaauauacuaaaaaaauuacugaauuguguaauuuaaaugggugaaucauaugguaugugaauuaucucaauacagcuguuuaaaaaaacagagauguuggcugggcacgguggcucgccccuguaaucccagcauuuugggaggccgaggcuggcggaucacuugaggucaggaguucgagaccagccuggccaacauggugaaaccccaugucuacuaaaaauacaaaaauuagccggguguuguagugggcgccuguaaucccagcuacucaggaggcugaggcaggagaauugcuugagcccaggaggcggagguugcagugagcugagaucacaccaccgcacuccagccugggcgacagagcaagacuccaucucaaaacaaaaacaaaaaacaaaacaaaacagagaugucuacaaugaucugccugauaaugcaucacacagggacaaugccuaaaacuguuuucacucuguccucagaucugcaguucaucugcaacuuucuuccuugacagaaaaauucucugagacccagaagagugaagagccuguaggaaaagggcucuggcucccagcucugugcucuucccaaagcccuggcccaugugguugagauacgagcccagccagggcugaguuggagggaggaguuaccggucaggucucucuccuuccucuauccgauuggucaccacaggguuuccggugauccggguccgcuugaagggagucaugggcuucagcugugcagccagggggcugugggcgacggcagccaagaagcgggcaauguagaaugugccggcuccuucugaacccgacuccccaggucccagcagcucccagagcacuguggcugggaaguagcccacaaagcuggucuuacaauggacauggaguucauagcauucaccuggaggagaauggaugagugaauggggguagggacccucccacccauauccuuaucccggacacucccccaggaagccccaucccaaggcaagagucccauggacagugacaguguguuucccaaagcauaagcacugccugggacaagccccuguccaccagcucuuuccuuuggaaacucacucaccggggcccaguggacagggcaacuccuggucuucauuguagaaagcaaacugggguguccggcagagugggaagaggugagugaggguaacagacuggguuccgccauuccgaagccucagggucagcaccucuuugcgguucaaauccaggcggauaaggagcugcccaucucgggcuucauggggccccuggacuuccacauccacaccauguuucccaugaagauacucagcccuggggagaaggggagucaaggggggguuggggugggagcggucugacuggggaguuacccuggggaaagcuuuaggcuugggaggcaggcaaagugccagcugugcuuaggaaacucacccccucccagcagaccaguucccugcccuucccccauucccugaaggagggggacuuauucccacuuguguaacccacucuuuccucacacagauagcccccuucccucacacccugcagaccuccccguacacacaacauacaacacacacacaccugucauaaaagaucuuggcuagcagugacuugugguguuugcugauaucugaccccagcuucauucuccucuuuucugggaaccgcacgucggcccagcggucgagucugaagaaccugacccgagucuuggugacguaggccagauuugcaaucuucauuccauacagcauggaggagaagccaggggcgggggucccaaagcugccagaagcagaggagacugggaagugagggaaggcagggcucgagggaggcagggcggcgggugggaaagggcaucggagggucacucugugcuggacacaccagcccugcuguggagcaggauggggcccagagacagagagacucaggcuggggaucggaggaauguuuaauguuuucagggaaggcaaugggacuucccaaggcaaaauacaguuguuuuaaacaguggguucuggauuguucguuucugaggggaaaagcccaaucacaggcugcugacuggaaggacugagggaagacagagaaagacauaaaguucuuuuugugggggaaacuguuugggacagaaaagaaaauacaaacaacccagaagaaagagcugaggcuaaggggaagcggaaugauuugauucagagggguggaugugggguccagccuguuggugaggagagaagggaucagagacaguacagauguccaagugugugggcaagguggcugaucagacagcaguuuccacccgaagucauagggugcagguggaacccaagcaggaagggaaaggauccuucuccagagaucaaauagccuggcuuugugccuagagaaggugaagacagggaaaacuggucagaaggacaauaaccucaaggcucagugccuggaguucaguucagucaauucaacaaacacuuacggaggccuguuaugugccagacacuaugcuggaugcuagggguucaaagaugcuagaaacucagcgcuugccucgaggagcacacagacugaacauauacauuccagcguggugcuuggagggcagcucaucggccacagaggggcucagugccacagagggacacugagcccagucugggggcagaggagguguccaugaaggccuucccaggaggcagcauaagaacugaguccugaggaugagugggcauuaccugggcacaagagggagcgcgaaguguaagcagaugugagagguacgcaagaacaugugcagggaggggcagaggggggcggcccacuugacaacucuagccaggucagcucaguugaccucaccucucagagccucgcuuuccuccucuauaaaauuggaggaaagcgagacuuaccucguaggguugcugugagguuuacaugagauuuugacacggcagagaaccacuuagcacagugcuuggcacauaggagaccucaguaagggugagccaugauuaguaucacauacaguuucauugugcuagagugaaaugcacaaggaagggaguggcaggaggagcagaggugggcagggaccagaucauggacaguuuugcacaacaggccaagccuggacuugacucugcaugucugcagucguuuuccccgcucuacugauacccaggagccugaggacauucccacgugccacauacuucagggacauauucaagaucuagaugacugacacccucccuuaaaagcaaaucuuuguuuaugaggacuaugguaauuccuauuuaacucuucaggcuaaaucaucauggucacucacuaggguaugugauaagaucauuuaugguuaugaguauuuuucaggugccugcugccuguaacucugccccucuccuucaccccaagcaaaugagacugguacaauuuggaaaacauugaauuggcuaugauuuguuuuaaaaagguaauaaaucauucaaaagcauaauagaaaaugcucaguaaauguuagcuacuauuguuaguauuuauauuaguagaaauaguaguacuaauaguagcaguaguaguaggaguaguaacaacuuacuuucagcccacgucagaggcuacacugugguuacagaaccacugcgguugguggguuuuaagcaggggaguggcaagaucauauuugcauuucagaucacucuggcaucaggauuggaggauggauuugcuggaggcaagacuguaggcagggagaccaguuagaagaaggcccuugcaauuguccaguuaaaagauaacaaaggccugagcaaggcaguggguagagauacagaagaagagcggcaagauucgcuaauacuuagaauguaaaauuagcagaaauuuggugacugacagaagggggaaugaaggcugggaagagggaugagucuaggauccccaaaucaauggccuggcuucuaggacuaucucugagauaggauguaagacaagaggaggagggguuggagggacugaccaugacauuuggauuuggauaugaugcguuugagauuccugugguccagaggcaaccagcuccacgagucagaagcugagaacucaggccaaagucaagguuacagccuaguauuagggaguccccagguagugguuauaaucaaggaaguguaggaaucuccccagggagugugaguaguugagagcagcuacuagcacaacccggggaggaagggaaaacaagaaacccucaagagagaaaggagaaucagcaaagucucaaaaucagguaucaggaucaaaagcugcugagggguccaguaauacagggacugaaaucaggagaucaucaguaacuuucacaagggcuucuuagaguccaucaaagucccauggaucgaggcacaagcuaaugccuacagcagcuaugcuucacagguaucuugauccuugcagcccuuucagacaccuguucaguccauuuuugagagucacuaguguaagaauacugcaugcauaucccucacaacgcuaagaaaacaaagugcaaccuccaagaaaaguggcuccaggcucccagaucaaugcugggcagaaagagggcuuuguggggacugaacaaacugggaagugcaugcccugucugaagcagguaacugcuuaucuucgaacggggccaguagggaaugcaggccccggauggccagaucugacuuucaagaaaagacaaaaucaaaauuuuaacaugaaaccuccuauuuuugaaaaccugcauggcacaagggcagacagaacucaucucuguaaaauuuccaaauucuacugcagaugcuaucccuaaauauuucucaaauuauucucuaugucucucaucacuacccaaauucaccuaacauuggucuagguaacagucauacaaaaauuauuuuuaaaaaaucacaaacuuauuauauucuugucggaaaaaagccccaauccuuguauuauacauguaauccucuauauuuauuuuauuuuauauuuuauuuuauuuuauuuuauuuuauuuuauugagacggaaucuugcucuaucaccaggcuggagggcaguggcacgaucuuggcucacugcaaccucugccucccggguucaagugagucuccugccucagccuccuaaguagcugggacuacaggugcacgccaccacacccagcuaauuuuucuauuuuuaguagagacagaauuucaccauguuagccaggauggucucaaucucuugaccuccugaucugcccgccucggccucccaaagugcugggauuacaggugugagccaccgugcccggccguaauccccuauauuucuaagaaaaacuuucuaaccaagacuggaaaccagcagcuauaaaauaaaacuaggucaagugugguggcucaugccuguaaucccaacacuuugggaagcugaggugguaggacugcuugagcccaggaguuugagaccagccugggcaauagugaaaaaaaaaaaaaaaaaaagccaggcaugguggugcacaccuguagucccagcuacucaggaggcugaggcagaaggaucacuugagcccaggaggucaaggcugcagugagcugugauuacgccacugcacuccagcuugguuaacagagcuuggguaacccugucucuaaaaaagaaaacaaacauuucugacuacuaaaaaauauuuucucuagcaaaagguaauauaaacacauucaacagauaaauaccagauaaauacucauaaugcagaugacaggcaaagggcuaauuuuuauaauauauaaauuuucuuacaaauugacaagaugaacaauucaacagaaaaaucgaauauucaauuaaaagaacagauccagauggccaaaagaguaugaaaaacugcuccaaauguagagaaaugcaaauuaaaguauaaaugagauauuauuuuauucccauuagacugacaaaaaugaacauaguucuagcauauauuacuauaauggguauguggaaaagugaacucauaaauugcugguagaagagucaaguauugccaucuuuugggaaaacaaucuggcaacaucuacaaauauuuaaaauacagguauccuuuaaaacccagggacuguccgggcacgguggcucacgccuguaaucccagcacuuugggaggcugaggcgggcggaucaccugaggucgggaguuugagaccagccugaccugcauggagaaacccauuucuacuaaaaauagaaaaaauuagcugggcaugguggcaggcaccucuaaucccagcuacucaggaggcugaggcaggagaaucgcuugaacccaggaggcggagguugcagugagcugaguucgcgccauugcacuccagccugggcaacaagaaccaaacucugucacaaaaaaaaaaaaaaaaaaaaaaucccagggacugggcaugguggcucacgccucuaauccuagcacuuugggaggcugaggugggaggaucacuugagcccaggaguuugauaucagccuaagaaacauagcaggucccugucucuacaaagaauuaaaaaaaaaaauuagucaggugugguggcacaccccuguagucccagcuacucaggaggcugaggugugaggauugcuugagcccaggacuuugagguuacagagagcuaugauugcagaucugcacuccagucugggcaacagagcaagacccugacucaaaaaauaaaauaaaauaaaauuuaaauuuaaaagauaaaacaaaaccccacaaaacccaguaacacuguuccuggaaugugucccaugggaagaaaaguaccaauguauaaagacauaugugcaaggauacuuacugcagagucacucacaguggucaagaauugaaaauuaaacaaaugcccaucaacagagugaaaggugaacacauuguaagcacucauaccgugggauauuaugcagccauugaaaagauguaccacacccacucaaauggcuaacauuuaaaaggcucacaauacgaaacacugguaaggauacggaacaaccaggccaggcacagcggaucaugccuguaauccuagcacuuuggaaggcugagguaggaggaucacuucaacugagaaguucaagaccauccugggaaacauagcaagacccuguuucuacaaaaaaauuaagaaauuagcugggcccuugaggcugcagucugccacaauugugccacugcacuccauccugggugacagaaugagauuuugucucaaaaaaauaaaaaauacaacaacccaaacucucaugcauuguuuguuggucuguaaaaugguuuaagcacuuugggaaaaggucuaauaguuccuuguaaaacuaaacauaugccuauccuaugacucaaaaauuccacuccuaguuacaucccaaaagaaauuaaaauguaaguccacaaaaugacuuguauaagauguuccuggcugggcacgguggcucacgccuguaaucccagcacuuugggaggccaaggcggauggaacacuugaggucaggaguucgagaccagcguggcaaacacagugaaaccccgucucuacaaaaaaaaaaaaaauuagccaggcguuguggcaggcaccuguaaucccugcuacucaggaggcugaggcgggagaauugcuugaaccugggaggugcagguugcagugagccaagaucaugccauugcacucuagccugggcaacagagcaagacuccgucucaaaaaaaaaaaaaaaagauguuccuaggagcuucauucagaagagccccaaacuaaaaacacuguccauaaacaggggaauaaauauacaaacugugauuuggauucauacaauggaauacuacuaagugauaaaaaagaaacuacugauacauuguggaugaaucucaaaaacauuacgcuaagugaaaguugccuuacacaacaguacauacuauaugauuccauuaaaugaauuucuagaacagguacugucaugaaaaaaucagagcagugguugcuucugggugaguaagagugaggacugacuaggaaagggcacgagggagcuuucuggagugaugugauguucuguaccucaacaggcguuugcacacagauauaugcauuuguuaaaccucacagaacaguacacuuacaauuugaacauuuugcuguuugcaaauuuugcuuaaaggcccggcacagugguucauaccuguaaucccaaaaguucaagaccacccugcacaauauagacagaccccaucuccacaaaaaaugaaaaauuagcugggcauaguggcacacgccuauggucccagcuacucaggaggcugaggugggaggauagccugagucugggagguugaggcugcagugagcuauguucaugccacuguacuccagucuugacaacggagcaagaccuugacuuaaaaaaacaaaaaaccaaaacccaaacaacaacaacaaaaaacccauggccgggcgcgauggcucacgccuguaaucccagcacuuugggaggccaaggcggguggaucaccugaggucaggaguucaagaccagccuggccaacauggugaaaccccgucucuacuaaauacaaaaaauuagcugggcaugguggcgcaugccuguagucccagcuacuugggaggcugaggcaggagaauugcuugaaucccagaggcggagguugcagugagccaagacugcgccauugcacuccagccuggguaacaagagcaaaacugucuaaaaaaaaaaaaaaacccauaaacaauuuuuuuuuauuucuaggcaaacauaacauaaauuuugaacucuagcugauaauaaucacgcuaaauaauuaauaauaauuuguuggagugaaguguacugaugucuguaacuuauuuugaaaugcaucaggaaaauuaagaugacuugcuaaaugaauagcgggauggaucuaugggcagauauguguaaaacguuaaaagaaaucuagguaaggguauguggauguucacuguagauucauuucaacuuuucuuuauguuuaaaauuuauuauaguaugauauuggggaaaaaaucccaacaaugcauuagaggucuaugccauaugccuacgagugauucccaucacacaguugagagaguaggacguggaugaugugaauaacaugauucuuuugacagagucuuggucugucgcccgggcuggugugcaauggcgccaucuuggcucacugcaacuuccgccucccggguucaagugauucuccugccucagccucccgaguagcugggauuacaggcgcccgccaccacgcccagcuaauuuuuuguauuuuuuaguagagacgggguuucgccauguuggccagacuggucucaaacuccugaccucaggugauccacccgccuuggccucccaaagugcugggauuacagguuugagccacugagcccggccaaacaugauucuuuuuaaauaaaacaaugacuaaaaaaaccacccugauugauaucaagagguaccugaguacagggcggaauguggaaauggagguuggaugcccauaaggggagggguccacaauaaaaaugauaugugauaaugaucccacguguguaaacuuauguaggugugauauaagcaugccugcaaaaagagauaaaugaaccgggugcaguagcucacgccuguaaucccagcacuuugggaggucaaggcaggugaucaccugagguuaggaauucaagaccagccugaccaauauggugaaaccucgucucuacuaaaaauacaaaaauuagccaggcauggugguucacgccuguaaucccaccuacgugggaggcugaggcaggagaauugcuugaacccgagagguggagguugcagugugcugagaucgugccacugcacuccagccuaagugacagagagagauuuaaaaaaaaaaaaaaaaaaagagauaaaugaaaaggugaucaccaaaaguuuuuuuuuuuuuuuuuuuuuuugagacggagucucacucugucgcccaggcuggagugcagugguacaaucucggcucacugcaagcuccgccucccggguucaggccauucuccugccucagccuccugaguagcugggacuacaggcgcccgccaccacgcccagcuaauuuuuuguauuuuuaguagagaugggguuucaccguguuagccaggauggucucgaucuccugaccucgugauccgcccaccucugccucccaaagugcugggauuacaggcgugagccaccgcgcccggcccaaaaguauuuuuaaaacauuuaaacaaguaucuaacauaaaacauuaaagcccuuaauucccuugcuuccaacuacuugcuugauuaggagcaauuaauuaaacccacuauuugauguauguuuuuccugauuuuuuucuaugcauauaaaacacaauaaugagaugauacaugcuacacauacuauucugcagcaggcgucuucccaccauggaucuucucccauaacaaugcuuuacagaaccaccaugaccuuuugaauggcuacaaaagauagcauguaugaaugcaucaugguguguuuuuuucucuagugauagacaagcugccugaaauuucuggcuacuccuaauguuacaauaacuauccuugcacacaaacccuuguacuuguaggcaagucuaaugggauaaauuccuuaaaguacaacaccugggucaaagagaaugaaccuuuacaacuuugauaaguucugccaaauuguccuuuaaacagguuguacaaauuuauguucucacuaacaagaguuagaaaaugcccuuuucccaaagcucuaacaucagaaauuuucaauguuuuaaauuuuugacaauuugauuacaaaaacuccuaucuuuuuaaacugugcauuucucugaucaccaauauagucaaggaucuuuccuucuuuuauuagucauuuauauuucuucugugagcugccugaucauaccccuugcucaauuuucuagguuccaguuaacuguucucccuaccucuggcuucauaccccuacacuaggccacccccuauaucugcagaauugucaucaaacacaaaucugaucuuguucccucaauuuacaacuccauaguccacaaaauuaagucuuuaauauggcaccuuccaagauccuccauaguaacaacgauaaugcaaauacaauaacaucaacagaaaacguuuccugaaugcauuaucucauucaauccucaaaacaacccuuugagguaguaauuauuaucaucccauuuuagagaaaaagaaauugagguacacauccucaaccacacuuggccucuugucaauccauccuuauuucagccauucccaacuacuuguaucacugugccccucugcagacuucugugcuguggacauccuuagccugcacugcccugccuuaggccgccccugcuguuuguugggugaacaauggcuaaucuuuuuagacccaguucaggaaaggccaaaagcuagaggaaugguauuucagcacauaugaucagauuuggaagugaucuuaaagagacaucuaguuucacaaucuauagacuauggauuccaacucccauuagcgggucaaagccaggguuuuuauaaaauugaaauaaaauagaauaaaaaauaucagagagcagggagugaaacuauguauuguuucaagggcaggcauuguuuugugaagguuguguaugccaggucccaaaguaaaauguguuuuuuacuguggguagagguccaaccaccaagccacucuccacgccagaagccagaaugaucuuucuaaaucugauuacgucagacucuuacuuugaaauuuucuguguuuuccuauuuccauuaagauuaaagacaaaacaaaacaccucacaaugccuacccagggcccugcuggucucccguucuucugaggucaucccaagccuuugaaggugcuguuccugccuguacacucuacccuugcccuuuacaccuucuaagucccauuaauccuucaagauucuacucaaauaucacuuuccccaagaaaccucugccuaaguuucuugaucuagucuagguugcuagacuaggacagaucuccaaauuauauacucucaaugcauacuggacuuuucuguacaagcacucaucacaaccguaauuaaauaauuaucuaacugcugccuccuuccuuaguuaguuggguuccuuuuguauauuucuagcaacucacuuuugcuuugccauucauaggaagcacucagccaguacuuguagaagaaugagucuccuguccaaagcaagaaucaucuucucucagaaaccuuuucgugacaucaguccuuaccccauacaauggacuccuaaucaucaucgcacuaaugagggguaccacuuaacaaagccaguguaauaugcuagccacacaaaugcuuugccuaggacaacucauuuuggucucucacaaccccgagagaaagguacuauuuuacauacucuuacaguuggggaaauggaaaauuuagagaguuguucaaaguuaaaugcaaccacuaaauggcagggcuaucuaaacaccauuacuagcaccuauacuacuguauugcauuuguuugucuacacauaucugcugcucuuuacuagauuauauucuuuggaggcaaggaccaaggcacaggcacacaguagagccucauuaacuauauuugcuaaaugaauaaagguaggugggaaaaggcaagaguucagagcagagcacuuuauaacaucauaaaauaaccuagcuggagagaccuauccccucucaguguaggaaucuccuagaauuccuaaagagugugacuugcuauaccccccgcuauauggcccauucucuuguuaguuaacucuaguugcuaguucacuuagauucugcaagcauuuauugagcaucuacuacauacaaagcucuaugcuggggacugcagacagauauaaaccugacuaaagguagaggaucuagcauuugcguggcuagcauaauacacuggcuuuagcauauuacaaugauuugguaccaggaggagaugaccacgugccauaaagcagaguguaacgugaccauaauaccaggcuauacccaagguauaaagaaugagccaugagagcccagagaaaaagcaaguaauuccuacugggaaaugaagguugacuucacagcauuccagccuggcuuuaaaggauguguaggcaaguucuuuaaucugaacauacauuuccccaacaugaugaggguacagagcggggauaguugaugaaacccgcuucugucuucuggagugacacaggagugcaaucuuauccauuauaacacuccaaaauagucaaggauaauuaccuuguacugucugauuuuucuauuuuugaggcaaauauuucugaguuucuuucacugggucucaggauagaauaugaacccacauagaaggccuuuccaccuccucuauguacuaaaauuuuaucucuuucaaggcuaaagucaaugccaucuucuccaucacauccccuaaugauuacagaggagugguaucuuaucugcauaaacacaagugcauacaguaaaaacuacuuuggaaaaugccuacauucacccauaauauacaguauaucuggcuuucuguaugcaauccaacacaaccaguuuuuccccaguacuaaaacauacuauguaccuuugguuuagagcugacaaagacucuccuugaucaaacuuuuguuagacuccccugagcccucuuuuugacuagcccuugaccuugccuccccaaacccuucagucuuaggcccaccuaguucaguuuuagcaagaauacugaagucauuuuagugagacuccucacccuugaugcaugaccacgcuugauaucugaucaaguuccucauucccgccuuugauguacaaguccuuggucugccuuuaacaagaaucuuguuaggucaggugagcaaaaauccucccacucuuuaugacuccucuuaguaauuuucuauauauugauccccuuacucuguucauuggucauaaaucccccgcuguuuuugcuguauucggaauugagcuccaacucucuucuuuccuauugcaauacccuauuaccauagccuugagucaagucagccuuacuguuuuaaccaauuacuuuuuccuuaacagagccaaaagaaguaggugacuuguuuccuagccauguuguacucuguggauauaggugaauucacauaccuuaaguguugauaccaugugaugcaaaugcucgcucuuuccuccagcauuuuucucuuaccaucccuaguauaauccuccauuuuaccauguacuauccuauauuguguacauguauauugcaugcauaucauagccucugaugcuccucugggauuguguguuuuucaucuuaagaguccccauaguguccagcauggugacauaaaacagggccucaucaucuuugccccuucucagauguuguucaagccuguuaauaucccucuccaaaugugauaaccauuagugaaaacgauauuccagacacgauuucaccaauauggagagucucuacccuuuucccccaccccaaaucacacuucuguuagcucaaucuuagacuucagcuguuuuagcagccauaucucacccauacuggcccucuggucugcuaaaacccaaggucuuuuucgggaggucuguuauuaagcccagauucccacuaccuuauguuuauuuguacaagucuuuacguuuacccuuguuaaacugcuucuugguuuuccacgcaaggcagcagccuguugauaaacguguuuuugaagcacaauucuguggugugacagaagacucuuugauuuucacuugggugguagcaggaaaaggagaccaaagagccuucagccacagggugaaagggagccuccagaaggcuggcucugccccugggucuccauggagaagccacaggugcuaauggagguuugguacgcacguaguuugugcccuuuucuucuuuccagagcuuccugagcuucucccuucuacccugggccucuucaguucucccagauagcggacccccgaggcagcagcgccucaacaagguggcagaggucccuguaaagcccgcgcucgggcucgcagcccccaacaggcagccucuaacccgcgcucccgcgaugccugggcccccucuggaggcuccccucccccaccgcgagcgcugucccucagcccccgcgagcggcgcauggacgcgggacgcagcucccggccccggguuccggccuccgggggcgcgggcagcgcgggaggcucuccgcggcgacuuggcgcaggggcccagcucgggcagaacuggcgggcuccgggcggcgcugguggggcgugggcgaggcgcgggaggggaggucugcgccgccccgggacuggccugagccgcugggggagcugcgucccucugcgccccggggcgggaaagguggcccucgcgcgggggucguggcagcaagcugggcccgcgauucggggccgggagugggccggcccguaccugaucuugaagucgcgguuauaaaugguccgcagccgcucgcgaucugucuccauguccaguccccgaacgaccaggaaacucucgaaacacuggcccgccucccggagcugccggcagcugaacuuacugggcaucgcggcggcggcugcggcccaggcaggaggguccguggaaaugaaacugaaagucgccgcugcagcuggaaguuggcggcccugagaugagggugcagcaggagggaagcccccuaacucugaccccugauccugcgggcucccuucuccccaccaggcuucccuccuccguucuuuucuuaccugagcuuucccuucgguuucuucguccuauccccucccccucuucgcauuaacucuuuccuaaagcgucugaccccucccucagggcccuccccuuaccccaagcucccuccccuggcuucuagccaguaucagaacguggcuaccgcuuggggcccucugaacagcccgggaggaccuccgagccucagccagggcuacccucacgcccacccuccagagccucgggacucagugaaaagcaggagagcaaagggcagggcugggaucuaggucggcugcggccggaauggggaagcucauc

SEQ ID NO: 191327 - RNA, 26321 nt, Homo sapiens
gaugagcuuccccauuccggccgcagccgaccuagaucccagcccugcccuuugcucuccugcuuuucacugagucccgaggcucuggagggugggcgugaggguagcccuggcugaggcucggagguccucccgggcuguucagagggccccaagcgguagccacguucugauacuggcuagaagccaggggagggagcuugggguaaggggagggcccugagggaggggucagacgcuuuaggaaagaguuaaugcgaagagggggaggggauaggacgaagaaaccgaagggaaagcucagguaagaaaagaacggaggagggaagccugguggggagaagggagcccgcaggaucaggggucagaguuagggggcuucccuccugcugcacccucaucucagggccgccaacuuccagcugcagcggcgacuuucaguuucauuuccacggacccuccugccugggccgcagccgccgccgcgaugcccaguaaguucagcugccggcagcuccgggaggcgggccaguguuucgagaguuuccuggucguucggggacuggacauggagacagaucgcgagcggcugcggaccauuuauaaccgcgacuucaagaucagguacgggccggcccacucccggccccgaaucgcgggcccagcuugcugccacgacccccgcgcgagggccaccuuucccgccccggggcgcagagggacgcagcucccccagcggcucaggccagucccggggcggcgcagaccuccccucccgcgccucgcccacgccccaccagcgccgcccggagcccgccaguucugcccgagcugggccccugcgccaagucgccgcggagagccucccgcgcugcccgcgcccccggaggccggaacccggggccgggagcugcgucccgcguccaugcgccgcucgcgggggcugagggacagcgcucgcggugggggaggggagccuccagagggggcccaggcaucgcgggagcgcggguuagaggcugccuguugggggcugcgagcccgagcgcgggcuuuacagggaccucugccaccuuguugaggcgcugcugccucggggguccgcuaucugggagaacugaagaggcccaggguagaagggagaagcucaggaagcucuggaaagaagaaaagggcacaaacuacgugcguaccaaaccuccauuagcaccuguggcuucuccauggagacccaggggcagagccagccuucuggaggcucccuuucacccuguggcugaaggcucuuuggucuccuuuuccugcuaccacccaagugaaaaucaaagagucuucugucacaccacagaauugugcuucaaaaacacguuuaucaacaggcugcugccuugcguggaaaaccaagaagcaguuuaacaaggguaaacguaaagacuuguacaaauaaacauaagguagugggaaucugggcuuaauaacagaccucccgaaaaagaccuuggguuuuagcagaccagagggccaguaugggugagauauggcugcuaaaacagcugaagucuaagauugagcuaacagaagugugauuuggggugggggaaaaggguagagacucuccauauuggugaaaucgugucuggaauaucguuuucacuaaugguuaucacauuuggagagggauauuaacaggcuugaacaacaucugagaaggggcaaagaugaugaggcccuguuuuaugucaccaugcuggacacuauggggacucuuaagaugaaaaacacacaaucccagaggagcaucagaggcuaugauaugcaugcaauauacauguacacaauauaggauaguacaugguaaaauggaggauuauacuagggaugguaagagaaaaaugcuggaggaaagagcgagcauuugcaucacaugguaucaacacuuaagguaugugaauucaccuauauccacagaguacaacauggcuaggaaacaagucaccuacuucuuuuggcucuguuaaggaaaaaguaauugguuaaaacaguaaggcugacuugacucaaggcuaugguaauaggguauugcaauaggaaagaagagaguuggagcucaauuccgaauacagcaaaaacagcgggggauuuaugaccaaugaacagaguaaggggaucaauauauagaaaauuacuaagaggagucauaaagagugggaggauuuuugcucaccugaccuaacaagauucuuguuaaaggcagaccaaggacuuguacaucaaaggcgggaaugaggaacuugaucagauaucaagcguggucaugcaucaagggugaggagucucacuaaaaugacuucaguauucuugcuaaaacugaacuaggugggccuaagacugaaggguuuggggaggcaaggucaagggcuagucaaaaagagggcucaggggagucuaacaaaaguuugaucaaggagagucuuugucagcucuaaaccaaagguacauaguauguuuuaguacuggggaaaaacugguuguguuggauugcauacagaaagccagauauacuguauauuaugggugaauguaggcauuuuccaaaguaguuuuuacuguaugcacuuguguuuaugcagauaagauaccacuccucuguaaucauuaggggaugugauggagaagauggcauugacuuuagccuugaaagagauaaaauuuuaguacauagaggagguggaaaggccuucuauguggguucauauucuauccugagacccagugaaagaaacucagaaauauuugccucaaaaauagaaaaaucagacaguacaagguaauuauccuugacuauuuuggaguguuauaauggauaagauugcacuccugugucacuccagaagacagaagcggguuucaucaacuauccccgcucuguacccucaucauguuggggaaauguauguucagauuaaagaacuugccuacacauccuuuaaagccaggcuggaaugcugugaagucaaccuucauuucccaguaggaauuacuugcuuuuucucugggcucucauggcucauucuuuauaccuuggguauagccugguauuauggucacguuacacucugcuuuauggcacguggucaucuccuccugguaccaaaucauuguaauaugcuaaagccaguguauuaugcuagccacgcaaaugcuagauccucuaccuuuagucagguuuauaucugucugcaguccccagcauagagcuuuguauguaguagaugcucaauaaaugcuugcagaaucuaagugaacuagcaacuagaguuaacuaacaagagaaugggccauauagcgggggguauagcaagucacacucuuuaggaauucuaggagauuccuacacugagaggggauaggucucuccagcuagguuauuuuaugauguuauaaagugcucugcucugaacucuugccuuuucccaccuaccuuuauucauuuagcaaauauaguuaaugaggcucuacugugugccugugccuugguccuugccuccaaagaauauaaucuaguaaagagcagcagauauguguagacaaacaaaugcaauacaguaguauaggugcuaguaaugguguuuagauagcccugccauuuagugguugcauuuaacuuugaacaacucucuaaauuuuccauuuccccaacuguaagaguauguaaaauaguaccuuucucucgggguugugagagaccaaaaugaguuguccuaggcaaagcauuuguguggcuagcauauuacacuggcuuuguuaagugguaccccucauuagugcgaugaugauuaggaguccauuguaugggguaaggacugaugucacgaaaagguuucugagagaagaugauucuugcuuuggacaggagacucauucuucuacaaguacuggcugagugcuuccuaugaauggcaaagcaaaagugaguugcuagaaauauacaaaaggaacccaacuaacuaaggaaggaggcagcaguuagauaauuauuuaauuacgguugugaugagugcuuguacagaaaaguccaguaugcauugagaguauauaauuuggagaucuguccuagucuagcaaccuagacuagaucaagaaacuuaggcagagguuucuuggggaaagugauauuugaguagaaucuugaaggauuaaugggacuuagaagguguaaagggcaaggguagaguguacaggcaggaacagcaccuucaaaggcuugggaugaccucagaagaacgggagaccagcagggcccuggguaggcauugugagguguuuuguuuugucuuuaaucuuaauggaaauaggaaaacacagaaaauuucaaaguaagagucugacguaaucagauuuagaaagaucauucuggcuucuggcguggagaguggcuuggugguuggaccucuacccacaguaaaaaacacauuuuacuuugggaccuggcauacacaaccuucacaaaacaaugccugcccuugaaacaauacauaguuucacucccugcucucugauauuuuuuauucuauuuuauuucaauuuuauaaaaacccuggcuuugacccgcuaaugggaguuggaauccauagucuauagauugugaaacuagaugucucuuuaagaucacuuccaaaucugaucauaugugcugaaauaccauuccucuagcuuuuggccuuuccugaacugggucuaaaaagauuagccauuguucacccaacaaacagcaggggcggccuaaggcagggcagugcaggcuaaggauguccacagcacagaagucugcagaggggcacagugauacaaguaguugggaauggcugaaauaaggauggauugacaagaggccaagugugguugaggauguguaccucaauuucuuuuucucuaaaaugggaugauaauaauuacuaccucaaaggguuguuuugaggauugaaugagauaaugcauucaggaaacguuuucuguugauguuauuguauuugcauuaucguuguuacuauggaggaucuuggaaggugccauauuaaagacuuaauuuuguggacuauggaguuguaaauugagggaacaagaucagauuuguguuugaugacaauucugcagauauaggggguggccuaguguagggguaugaagccagagguagggagaacaguuaacuggaaccuagaaaauugagcaagggguaugaucaggcagcucacagaagaaauauaaaugacuaauaaaagaaggaaagauccuugacuauauuggugaucagagaaaugcacaguuuaaaaagauaggaguuuuuguaaucaaauugucaaaaauuuaaaacauugaaaauuucugauguuagagcuuugggaaaagggcauuuucuaacucuuguuagugagaacauaaauuuguacaaccuguuuaaaggacaauuuggcagaacuuaucaaaguuguaaagguucauucucuuugacccagguguuguacuuuaaggaauuuaucccauuagacuugccuacaaguacaaggguuugugugcaaggauaguuauuguaacauuaggaguagccagaaauuucaggcagcuugucuaucacuagagaaaaaaacacaccaugaugcauucauacaugcuaucuuuuguagccauucaaaaggucauggugguucuguaaagcauuguuaugggagaagauccauggugggaagacgccugcugcagaauaguauguguagcauguaucaucucauuauuguguuuuauaugcauagaaaaaaaucaggaaaaacauacaucaaauaguggguuuaauuaauugcuccuaaucaagcaaguaguuggaagcaagggaauuaagggcuuuaauguuuuauguuagauacuuguuuaaauguuuuaaaaauacuuuugggccgggcgcgguggcucacgccuguaaucccagcacuuugggaggcagaggugggcggaucacgaggucaggagaucgagaccauccuggcuaacacggugaaaccccaucucuacuaaaaauacaaaaaauuagcugggcgugguggcgggcgccuguagucccagcuacucaggaggcugaggcaggagaauggccugaacccgggaggcggagcuugcagugagccgagauuguaccacugcacuccagccugggcgacagagugagacuccgucucaaaaaaaaaaaaaaaaaaaaaaacuuuuggugaucaccuuuucauuuaucucuuuuuuuuuuuuuuuuuuuaaaucucucucugucacuuaggcuggagugcaguggcacgaucucagcacacugcaaccuccaccucucggguucaagcaauucuccugccucagccucccacguaggugggauuacaggcgugaaccaccaugccuggcuaauuuuuguauuuuuaguagagacgagguuucaccauauuggucaggcuggucuugaauuccuaaccucaggugaucaccugccuugaccucccaaagugcugggauuacaggcgugagcuacugcacccgguucauuuaucucuuuuugcaggcaugcuuauaucacaccuacauaaguuuacacacgugggaucauuaucacauaucauuuuuauuguggaccccuccccuuaugggcauccaaccuccauuuccacauuccgcccuguacucagguaccucuugauaucaaucagggugguuuuuuuagucauuguuuuauuuaaaaagaaucauguuuggccgggcucaguggcucaaaccuguaaucccagcacuuugggaggccaaggcggguggaucaccugaggucaggaguuugagaccagucuggccaacauggcgaaaccccgucucuacuaaaaaauacaaaaaauuagcugggcgugguggcgggcgccuguaaucccagcuacucgggaggcugaggcaggagaaucacuugaacccgggaggcggaaguugcagugagccaagauggcgccauugcacaccagcccgggcgacagaccaagacucugucaaaagaaucauguuauucacaucauccacguccuacucucucaacugugugaugggaaucacucguaggcauauggcauagaccucuaaugcauuguugggauuuuuuccccaauaucauacuauaauaaauuuuaaacauaaagaaaaguugaaaugaaucuacagugaacauccacauacccuuaccuagauuucuuuuaacguuuuacacauaucugcccauagauccaucccgcuauucauuuagcaagucaucuuaauuuuccugaugcauuucaaaauaaguuacagacaucaguacacuucacuccaacaaauuauuauuaauuauuuagcgugauuauuaucagcuagaguucaaaauuuauguuauguuugccuagaaauaaaaaaaaauuguuuauggguuuuuuuuuuuuuuuagacaguuuugcucuuguuacccaggcuggagugcaauggcgcagucuuggcucacugcaaccuccgccucugggauucaagcaauucuccugccucagccucccaaguagcugggacuacaggcaugcgccaccaugcccagcuaauuuuuuguauuuaguagagacgggguuucaccauguuggccaggcuggucuugaacuccugaccucaggugauccacccgccuuggccucccaaagugcugggauuacaggcgugagccaucgcgcccggccauggguuuuuuguuguuguuguuuggguuuugguuuuuuguuuuuuuaagucaaggucuugcuccguugucaagacuggaguacaguggcaugaacauagcucacugcagccucaaccucccagacucaggcuauccucccaccucagccuccugaguagcugggaccauaggcgugugccacuaugcccagcuaauuuuucauuuuuuguggagauggggucugucuauauugugcaggguggucuugaacuuuugggauuacagguaugaaccacugugccgggccuuuaagcaaaauuugcaaacagcaaaauguucaaauuguaaguguacuguucugugagguuuaacaaaugcauauaucugugugcaaacgccuguugagguacagaacaucacaucacuccagaaagcucccucgugcccuuuccuagucaguccucacucuuacucacccagaagcaaccacugcucugauuuuuucaugacaguaccuguucuagaaauucauuuaauggaaucauauaguauguacuguuguguaaggcaacuuucacuuagcguaauguuuuugagauucauccacaauguaucaguaguuucuuuuuuaucacuuaguaguauuccauuguaugaauccaaaucacaguuuguauauuuauuccccuguuuauggacaguguuuuuaguuuggggcucuucugaaugaagcuccuaggaacaucuuuuuuuuuuuuuuuugagacggagucuugcucuguugcccaggcuagagugcaauggcaugaucuuggcucacugcaaccugcaccucccagguucaagcaauucucccgccucagccuccugaguagcagggauuacaggugccugccacaacgccuggcuaauuuuuuuuuuuuuuguagagacgggguuucacuguguuugccacgcuggucucgaacuccugaccucaaguguuccauccgccuuggccucccaaagugcugggauuacaggcgugagccaccgugcccagccaggaacaucuuauacaagucauuuuguggacuuacauuuuaauuucuuuugggauguaacuaggaguggaauuuuugagucauaggauaggcauauguuuaguuuuacaaggaacuauuagaccuuuucccaaagugcuuaaaccauuuuacagaccaacaaacaaugcaugagaguuuggguuguuguauuuuuuauuuuuuugagacaaaaucucauucugucacccaggauggagugcaguggcacaauuguggcagacugcagccucaagggcccagcuaauuucuuaauuuuuuuguagaaacagggucuugcuauguuucccaggauggucuugaacuucucaguugaagugauccuccuaccucagccuuccaaagugcuaggauuacaggcaugauccgcugugccuggccugguuguuccguauccuuaccaguguuucguauugugagccuuuuaaauguuagccauuugagugggugugguacaucuuuucaauggcugcauaauaucccacgguaugagugcuuacaauguguucaccuuucacucuguugaugggcauuuguuuaauuuucaauucuugaccacugugagugacucugcaguaaguauccuugcacauaugucuuuauacauugguacuuuucuucccaugggacacauuccaggaacaguguuacuggguuuugugggguuuuguuuuaucuuuuaaauuuaaauuuuauuuuauuuuauuuuuugagucagggucuugcucuguugcccagacuggagugcagaucugcaaucauagcucucuguaaccucaaaguccugggcucaagcaauccucacaccucagccuccugaguagcugggacuacaggggugugccaccacaccugacuaauuuuuuuuuuuaauucuuuguagagacagggaccugcuauguuucuuaggcugauaucaaacuccugggcucaagugauccucccaccucagccucccaaagugcuaggauuagaggcgugagccaccaugcccagucccugggauuuuuuuuuuuuuuuuuuuuuugugacagaguuugguucuuguugcccaggcuggagugcaauggcgcgaacucagcucacugcaaccuccgccuccuggguucaagcgauucuccugccucagccuccugaguagcugggauuagaggugccugccaccaugcccagcuaauuuuuucuauuuuuaguagaaauggguuucuccaugcaggucaggcuggucucaaacucccgaccucaggugauccgcccgccucagccucccaaagugcugggauuacaggcgugagccaccgugcccggacagucccuggguuuuaaaggauaccuguauuuuaaauauuuguagauguugccagauuguuuucccaaaagauggcaauacuugacucuucuaccagcaauuuaugaguucacuuuuccacauacccauuauaguaauauaugcuagaacuauguucauuuuugucagucuaaugggaauaaaauaauaucucauuuauacuuuaauuugcauuucucuacauuuggagcaguuuuucauacucuuuuggccaucuggaucuguucuuuuaauugaauauucgauuuuucuguugaauuguucaucuugucaauuuguaagaaaauuuauauauuauaaaaauuagcccuuugccugucaucugcauuaugaguauuuaucugguauuuaucuguugaauguguuuauauuaccuuuugcuagagaaaauauuuuuuaguagucagaaauguuuguuuucuuuuuuagagacaggguuacccaagcucuguuaaccaagcuggagugcaguggcguaaucacagcucacugcagccuugaccuccugggcucaagugauccuucugccucagccuccugaguagcugggacuacaggugugcaccaccaugccuggcuuuuuuuuuuuuuuuuuuucacuauugcccaggcuggucucaaacuccugggcucaagcaguccuaccaccucagcuucccaaaguguugggauuacaggcaugagccaccacacuugaccuaguuuuauuuuauagcugcugguuuccagucuugguuagaaaguuuuucuuagaaauauaggggauuacggccgggcacgguggcucacaccuguaaucccagcacuuugggaggccgaggcgggcagaucaggaggucaagagauugagaccauccuggcuaacauggugaaauucugucucuacuaaaaauagaaaaauuagcugggugugguggcgugcaccuguagucccagcuacuuaggaggcugaggcaggagacucacuugaacccgggaggcagagguugcagugagccaagaucgugccacugcccuccagccuggugauagagcaagauuccgucucaauaaaauaaaauaaaauaaaauaaaauaaaauauaaaauaaaauaaauauagaggauuacauguauaauacaaggauuggggcuuuuuuccgacaagaauauaauaaguuugugauuuuuuaaaaauaauuuuuguaugacuguuaccuagaccaauguuaggugaauuuggguagugaugagagacauagagaauaauuugagaaauauuuagggauagcaucugcaguagaauuuggaaauuuuacagagaugaguucugucugcccuugugccaugcagguuuucaaaaauaggagguuucauguuaaaauuuugauuuugucuuuucuugaaagucagaucuggccauccggggccugcauucccuacuggccccguucgaagauaagcaguuaccugcuucagacagggcaugcacuucccaguuuguucaguccccacaaagcccucuuucugcccagcauugaucugggagccuggagccacuuuucuuggagguugcacuuuguuuucuuagcguugugagggauaugcaugcaguauucuuacacuagugacucucaaaaauggacugaacaggugucugaaagggcugcaaggaucaagauaccugugaagcauagcugcuguaggcauuagcuugugccucgauccaugggacuuugauggacucuaagaagcccuugugaaaguuacugaugaucuccugauuucagucccuguauuacuggaccccucagcagcuuuugauccugauaccugauuuugagacuuugcugauucuccuuucucucuugaggguuucuuguuuucccuuccuccccggguugugcuaguagcugcucucaacuacucacacucccuggggagauuccuacacuuccuugauuauaaccacuaccuggggacucccuaauacuaggcuguaaccuugacuuuggccugaguucucagcuucugacucguggagcugguugccucuggaccacaggaaucucaaacgcaucauauccaaauccaaaugucauggucagucccuccaaccccuccuccucuugucuuacauccuaucucagagauaguccuagaagccaggccauugauuuggggauccuagacucaucccucuucccagccuucauucccccuucugucagucaccaaauuucugcuaauuuuacauucuaaguauuagcgaaucuugccgcucuucuucuguaucucuacccacugccuugcucaggccuuuguuaucuuuuaacuggacaauugcaagggccuucuucuaacuggucucccugccuacagucuugccuccagcaaauccauccuccaauccugaugccagagugaucugaaaugcaaauaugaucuugccacuccccugcuuaaaacccaccaaccgcagugguucuguaaccacaguguagccucugacgugggcugaaaguaaguuguuacuacuccuacuacuacugcuacuauuaguacuacuauuucuacuaauauaaauacuaacaauaguagcuaacauuuacugagcauuuucuauuaugcuuuugaaugauuuauuaccuuuuuaaaacaaaucauagccaauucaauguuuuccaaauuguaccagucucauuugcuuggggugaaggagaggggcagaguuacaggcagcaggcaccugaaaaauacucauaaccauaaaugaucuuaucacauacccuagugagugaccaugaugauuuagccugaagaguuaaauaggaauuaccauaguccucauaaacaaagauuugcuuuuaagggagggugucagucaucuagaucuugaauaugucccugaaguauguggcacgugggaauguccucaggcuccuggguaucaguagagcggggaaaacgacugcagacaugcagagucaaguccaggcuuggccuguugugcaaaacuguccaugaucuggucccugcccaccucugcuccuccugccacucccuuccuugugcauuucacucuagcacaaugaaacuguaugugauacuaaucauggcucacccuuacugaggucuccuaugugccaagcacugugcuaagugguucucugccgugucaaaaucucauguaaaccucacagcaacccuacgagguaagucucgcuuuccuccaauuuuauagaggaggaaagcgaggcucugagaggugaggucaacugagcugaccuggcuagaguugucaagugggccgccccccucugccccucccugcacauguucuugcguaccucucacaucugcuuacacuucgcgcucccucuugugcccagguaaugcccacucauccucaggacucaguucuuaugcugccuccugggaaggccuucauggacaccuccucugcccccagacugggcucagugucccucuguggcacugagccccucuguggccgaugagcugcccuccaagcaccacgcuggaauguauauguucagucugugugcuccucgaggcaagcgcugaguuucuagcaucuuugaaccccuagcauccagcauagugucuggcacauaacaggccuccguaaguguuuguugaauugacugaacugaacuccaggcacugagccuugagguuauuguccuucugaccaguuuucccugucuucaccuucucuaggcacaaagccaggcuauuugaucucuggagaaggauccuuucccuuccugcuuggguuccaccugcacccuaugacuucggguggaaacugcugucugaucagccaccuugcccacacacuuggacaucuguacugucucugaucccuucucuccucaccaacaggcuggaccccacauccaccccucugaaucaaaucauuccgcuuccccuuagccucagcucuuucuucuggguuguuuguauuuucuuuucugucccaaacaguuucccccacaaaaagaacuuuaugucuuucucugucuucccucaguccuuccagucagcagccugugauugggcuuuuccccucagaaacgaacaauccagaacccacuguuuaaaacaacuguauuuugccuugggaagucccauugccuucccugaaaacauuaaacauuccuccgauccccagccugagucucucugucucugggccccauccugcuccacagcagggcugguguguccagcacagagugacccuccgaugcccuuucccacccgccgcccugccucccucgagcccugccuucccucacuucccagucuccucugcuucuggcagcuuugggacccccgccccuggcuucuccuccaugcuguauggaaugaagauugcaaaucuggccuacgucaccaagacucgggucagguucuucagacucgaccgcugggccgacgugcgguucccagaaaagaggagaaugaagcuggggucagauaucagcaaacaccacaagucacugcuagccaagaucuuuuaugacagguguguguguguuguauguuguguguacggggaggucugcagggugugagggaagggggcuaucugugugaggaaagaguggguuacacaagugggaauaagucccccuccuucagggaaugggggaagggcagggaacuggucugcugggagggggugaguuuccuaagcacagcuggcacuuugccugccucccaagccuaaagcuuuccccaggguaacuccccagucagaccgcucccaccccaacccccccuugacuccccuucuccccagggcugaguaucuucaugggaaacaugguguggauguggaaguccaggggccccaugaagcccgagaugggcagcuccuuauccgccuggauuugaaccgcaaagaggugcugacccugaggcuucggaauggcggaacccagucuguuacccucacucaccucuucccacucugccggacaccccaguuugcuuucuacaaugaagaccaggaguugcccuguccacugggccccggugagugaguuuccaaaggaaagagcugguggacaggggcuugucccaggcagugcuuaugcuuugggaaacacacugucacuguccaugggacucuugccuugggauggggcuuccugggggaguguccgggauaaggauaugggugggagggucccuacccccauucacucauccauucuccuccaggugaaugcuaugaacuccauguccauuguaagaccagcuuugugggcuacuucccagccacagugcucugggagcugcugggaccuggggagucggguucagaaggagccggcacauucuacauugcccgcuucuuggcugccgucgcccacagcccccuggcugcacagcugaagcccaugacucccuucaagcggacccggaucaccggaaacccuguggugaccaaucggauagaggaaggagagagaccugaccgguaacuccucccuccaacucagcccuggcugggcucguaucucaaccacaugggccagggcuuugggaagagcacagagcugggagccagagcccuuuuccuacaggcucuucacucuucugggucucagagaauuuuucugucaaggaagaaaguugcagaugaacugcagaucugaggacagagugaaaacaguuuuaggcauugucccugugugaugcauuaucaggcagaucauuguagacaucucuguuuuguuuuguuuuuuguuuuuguuuugagauggagucuugcucugucgcccaggcuggagugcgguggugugaucucagcucacugcaaccuccgccuccugggcucaagcaauucuccugccucagccuccugaguagcugggauuacaggcgcccacuacaacacccggcuaauuuuuguauuuuuaguagacaugggguuucaccauguuggccaggcuggucucgaacuccugaccucaagugauccgccagccucggccucccaaaaugcugggauuacaggggcgagccaccgugcccagccaacaucucuguuuuuuuaaacagcuguauugagauaauucacauaccauaugauucacccauuuaaauuacacaauucaguaauuuuuuuaguauauucacaaauaugugacacuaucaccaccaucgguuuuagaacauuucauuaucccaaaaagcuaucacccuuuuauccuccacccacuuuguucagcccuaagaaacugcucaucuacuuccugucucuguagauuucucugugcuggauacuucauauggauggaagcguaggauauguguagacaucucuuuuuguuuuugcuagauguucacaaaauacugaguuauaaaagcaaacuagccgggugugguggcucacaccuguaaucccagcauuuugggaggcugaggcgggcagaucacuugaggucaagaguuugagaucagccuggccaacauggugaaaucccauuucuacuaaaaauacaaaaaaauuagccgggugugguggcgcaugccuguagucccagcuacucuacucaggagcugaggcaggagaauugcuugaaccugggaggcggugguugcagugagccgagauugcgccauugcacuucagccugggcaacagagugggacucaaaaaagaaaaaaaagcaaacuacauaauaggaccuucacagaccauugugcucuuuuuguugacuauauauguauaacagaaacuuacagggaaaaaagucugguaguuaacauugguuauuccuggaugguaagaaugauauuuacuuauuaccuauuaccugauuuuuuucucuagugaucauuuauuacuuagauaauaguuuuaaagguuuccaaguaucgcauguuccaaaaaugagaguaguccacccuuggagcgaggcugcugacuucccuucagcaguaggauugcaggagggcuuugugcauccaccccagaggggcguucucagaguguuggagggugagggguuuucuguguuuucuucccucgauucugcagcgcuaagggcuaugaccuggaguuaaguauggcgcuggggacauacuacccaccuccccgccucaggcagcugcuccccaugcuucuucagggaacaaguaucuucacugccccuaaggagaucgcagagaucaaguaaguaccaucccucugcaccccgcacucucccgucuuuuaccuacuggcuucuuugcauugcccuggcaccuccguccucagccucccaggcuguauucauucauucccuuacugagcacgcaccauacaccaagcaccauucaaggugaaccagucaaaugaaggccuggcucauuuuaaugggggacaaugagcauuuuuguuacaauuucauggagugaugagugcugugaagaacuaaacaggucagguguaaguggcucaugccuguaaucucagcacuuugggaggccgaggcagguggaucauuuaagcccaagaguucaagaccagccuggggcaacauagugagauucugucucuacaaaaaaaaauuuuaauuagccaagugugguggcacaugucuguagucccagcuacuugugaggcagaggugggagaauuucuugagcccaggagguugaggacacagugagugagcccagaucaugccacugcacuccagcaugggugacagagcaagaucuugucucuaaaaaagaugaacagaacuauacugaaacuaaagcaggguuagggaauggguuggugcugcuuugcagaaggccaguuaguccuggccuguuugagguagugauguuugaacagagaaggacauuugaaugaggugagggugggagucaugagaggauuggaggagaauguucuggccauaagagccaccaugcaaaugcaagucgggugaggugggggcaggggcauccaaggaagcaggagccaaggcuuccuucuucagggccucugacucucauccacuucuguaucccucuagucuucucugcuuuuugacgcuaguuccagagcuucaggugggagaagguggauacuccugggcauagggguugucuggcccauccuguuccugcccccacucaccccucccaaccaucauuuccagggcccagcuggagacagcccugaaguggaggaacuaugaggugaagcugcggcugcugcugcaccuggaggaacugcagauggagcaugauauccggcacuaugaccuggagucggugcccaugaccugggacccuguggaccagaaccccaggcugcucacgcuggaggucagggcucagauugagugugaggagggugggcucaagccagccaagcuagaggcugugggcagaacuauuccugacagcagggcagaacaagaggaaaguugaagugguucccagggcuccgcaagaagcagggugggcauccugugcccaaagauguguuggagcagggaaauggggaagaucuggguucuaguccaggcuuugcuaccaccuuggguaagucccuggcuuucucuaagccuuaguucccuuaucugaaaagcacagagcuggacuggauaauucuuagagcucuuucuggcucuuggauuuucaaugugugcauauaagcccaaaauuacacacgagaauggauuucuacacacaauugcaggugggaauuagagggugaguuuguucaaggaaagauuacugcaggaagugaguuuugaacaaguuuuuuguuguuguuguuuuuguuuugagacagggucucacccuggugcucaggcuggagugcaauggcaugaucuuggcucgcuuuaauccccgccgcccgggcucaagugauccucccaaguagcugggaccacagacaugccccacuacgccuggcuaauuuuuguauuuuuuguagagaugggguuuugccacauuggccaggcuggucucgcaacaccuggacucaagugauccgccugccucagucucccaaagugcugggauuacaggcgugagccaccaugccugguccguuuuuuuuuuuuuuuuuuuuuaauuauuuuuuuagcaacccgauuaacugaugaacaggauuuuuauaggcagagcaggaacugagcuggccaagagggcagcugcacuggaggcuccggguuccugggcucggcaucucugggcagcuucggaggauuugucuucuuccucuuccccugacuccugcugguaugaaaggaaagaggggugcagggauagcauaacucccugagucuuagguuagaaggccagucucaguccuugucccuuaaaggucuggggaaccugggggcugggcccuccagcguccaucccugggacagaagcuugcuuguguucacaccccauagguuccuggagugacugagagccgccccucagugcuacggggcgaccaccuguuugcccuuuuguccucggagacacaccaggaggaccccaucacauauaagggcuuugugcacaagguggaauuggaccgugucaagcugagcuuuuccaugagguggguguugggggaacccugagcugcuggaagggucuacagacuucugaccccaggggaggaggaguguuucucccugagauaaaugagaccccggggcagagcaggagacuuuuccucagggguacccugagaugcuacggcagcuuccucuucuagagaacuugcauagaggucuuggaaagagggguugggacacugguugguggagaaaguucuggcccuuuauugcccaccuccccugccccaacaaacucuuaccaccucucucugcccaaagccuccugagccgcuuuguggaugggcugaccuucaaggugaacuuuaccuucaaccgccagccgcugcgaguccagcaccgugcccuggagcugacagggcgcuggcugcuguggcccaugcucuuuccuguggcaccucgggacgucccgcugcugcccucagaugugaaacucaagugagacugugggcagggagcuucuggagccacuuggagugugggcacaggggguggagucagggaggccucugggucacuggaugacuucaaguucacauuccuggucccucugccaggcuguacgaccggagucuggagucaaacccagagcagcugcaggccaugaggcacauuguuacgggcaccacccguccagcccccuacaucaucuuugggccuccaggcaccggcaagacugucacguuaguggaggcaauuaagcagguggggucugagcacaaaccuggggccugcacucugauucccccagcaccaagcaguuguccccagauucuaguuccuucccacucccgaaaugcuccugcuucuaagcagccaucagaaagagagguaggggccgggugcaguggcucaugccuguaaucucagcacuuggggaagacuagcccaaggaguucaagaccagccuggacaauauugcaagacccuaucucuaugaaaaauaugaaaaauagcugggcacuugaggcugcagugcgauugugccacugcacuccauccugggugacagagugagacucugucucaaaaaaaaggguggggauuggggaagugggaaguuaggguaaauguggcuguggagcacuguuguacggguagggcacugcaugaaucuuggagucaccauucacauuucagucaucauagacuugcccugccccagccuggguacggcugagucucaggaaccugccucccacacugcgcuuaucugcaucucagguggugaagcacuugcccaaagcccacaucuuggccugcgcuccauccaacucaggggcugaccuacucugucaaaggcuccggguccaccuuccuagcuccaucuaccgccuccuggcccccagcagggacauccgcaugguaccugaggacaucaagguacuagggaagugcagagggccaaagaauggcaaaugccggggaggcucucagggcagacacugaggcgaggaagcuaggagaccuggauucugauacuugcuaugugaccuuggguuggacaggaccccucccugggccucaguuugucuguaagugagggggguggauaaaacauuuggggggcugggugcaguggcuuacacuuguaaucccaacacuuugaggggcgaggcagauggauuaccugaggucuggaguuugagaccagccuggccaacauggcaaaaucccgucucuacuaaaaauacaaaaaaaucagcugaguaugguggcgcgugccuguagccccagcuacucgggaggcugaggcacgagaauugcuugaacccaggcggcggagguugcagugggccaagaucacaccauggcacuccagccugggggacagcgagacuccgucucaauuaaaaaaaauaaaaauaauuguuugaggggggguacccacagccagaaucacggugggaaugaguggagccaagcugauuccucuggucccuucacaauccacagcccugcugcaacugggacgcaaagaagggggaguauguauuucccgccaagaagaagcugcaggaauaccgggucuuaauuaccacccucaucacugccggcagguggggagugugugugggugugucucugaaucguaaguguaauuaaagggguaccgggcuggggaaauggggaagaaugguuuccggagugggguggugggugcugagaagccagccugggaaagcauucagguuugguaguugggugccuggauaugaccccugccuggccugacaccucccagguuggucucggcccaguuucccauugaucacuucacacacaucuucaucgaugaggcuggccacugcauggagccugagagucugguagcuauagcaggugagggacucagguggggcugcagguauacacccugugugggucagagagguugcaccacuuaccuuucuucccacaccucuucugcuucccagggcugauggaaguaaaggaaacaggugauccaggagggcagcuggugcuggcaggagacccucggcagcuggggccugugcugcguuccccacugacccagaagcauggacugggauacucacugcuggagcggcugcucaccuacaacucccuguacaagaagggcccugauggcuaugacccccaguucauaaccaagcugcuccgcaacuacagguauucccaugcccuugccuccccugccauauccuaugcuuucacauccugcaugcagaccccacuggagagucuggcuugcugucaguccuguugcucagagguugugugaugcagaaagacuaaacuggaaggcaggagguuuuucuagccccagcacugcugcuuguugucugcgugacuuagccagugguuucacacuacaccagucagcuuaucugcaucuuaggggguggucagugguuccuagaggcuagggugugucugguaccagucccagaugaaguuuucaggcaauccaaggagagauaagaaaaauagggaggaggucgggcacaguggcucauggcuguaaucccagcacuuugggaggccaagguaggucaggcucccacccccgaucacuugaggucaggaguuugagaccagccuguccaacauggugaaaccccaucucuacuaaaaauacaaaaauuagccaggcauagugacaggcaccuguaauuccaguuacuugggaggcugaggcaggauaaucgcuuguacccgggaggcagagguugcagugagcugagaucgcgcuacugcagucuagccugggugacagagcgagacuccaucucaaaaaaagaaagaaaaauagggaagauacaguuuuuucauaaaccuauuguuauucaaauuaaagagcuguauacuuuuagugaaugaguucagccaucuaaaaugcuuagauaaguuuuaugcugucacuaagagcucaauaaauguuaguuauugugucaucacugcuuauauuuuuugauuuaacacauggucucaucaaauaacgugauagucaaggagaauuugguuucguacuguccuugguaaauuugaaaccugaaaaugggccccuaauuauuuaguuuuaaaugucaugggucuguggagucccuggacuagaugcucucuggaacuauauuugguucugcuuucugugguuuacagugccuggcagcagauauuauggaggaguguccugcuauccagggagccagcgggguagcaggcuauugugugugggcccagaguggguagagcggagccccuguagggcagagggaaucugacccuuggucuugcuuuuccuccuccggccucccaggucucaucccaccauccuggacauuccuaaccagcucuauuaugaaggggagcugcaggccugugcugaugucguggaucgagaacgcuucugccgcugggcgggccuaccucgacaggugaggcugagcagggcaggccccaccccuguacccugacuucccucccacugaaggugcagccccucccuuugucaccuuggccuaggaucucuuacucucuggaaggguuugggaagggagggaauagagggaggguggucuggcugacgguuucccccgaccccauguccagggcuuucccaucaucuuucacggcguaaugggcaaagaugagcgugaaggcaacagcccauccuucuucaacccugaagaggcugccacagugacuuccuaccugaagcugcuccuggcccccuccuccaagaagggcaaagcucgccugagcccucgaagugugggcgucaucuccccguaccggaaacaggucagguccucaguuaccagcaaggguggggccccucccccagaugguaccuccuuaauauccagaccacuaggcagaggcuccaggagcuuaggccucugcuggcuccguaucucagaagagcaccaaggucagcugccgccucccuuuguuccccagcucccuggccuccugccaggcucccucuugcauuagguuaauggcacgagagaaaggcaccuguccccuccuuccagguggagaaaauccguuacugcaucaccaaacuugacagggagcuucgaggacuggaugacaucaaggacuugaaggugacaugcuguuccacagucacucccugccuuccgugugcccccacuugcccacuuccagagacuuccucaagcuuccacuccagcccacguccccgucccaccccugcugccuugaauagagcucgagcucucccugagccucucacuccuggagauuccaacuuaagggucugggaugggaucaggaagccugcauguuuaacaaacaccuccugucauucuuagacugaggcagguuugaggccucugcccuaaggauaaaguccaaauuccguggccugucaugugaugcugccacccccacccccaguagccucucucuuaagguucuggucucaacacuggcugcagauaacaaucaccuggagagcuuuuaauaccccgcccccaugccagggccccacccaccagcucauacagcuaucggggcagagccagggcacugguaguuuuuacagcuucucaggugauucuaauaugcagccaggguugaaaacacugcucuaagacuuacaggccucucucuuggaaauucugaucggggguccggguuagggcccaggguuguauauucuuaacagauacuuagugauuguuuucaggaaaguuugaaagucacugcucugaguucccguguucuuugcaaugcuguuuucuuuccuuagaacacuuugcaggccccagcccucagcaggauucaaccuucauguuucagcuuccacagccuaccucccauccccuuucccugggccgugucgcagcacugguucacucacugaucuacaauugcccagugaccucucuguacccuccuuggaaggcaagcucccugggguagggcaccccuuugacaccccuggcuggucucaggcccugccucuuuccccacuagguggguucaguagaagaauuccaaggccaagaacgaagcgucauccucaucuccaccgugcgaagcagccagagcuuugugcagcuggaucuggacuuuaaucuggguuuccuuaagaaccccaagguuugagggcuggucgggguggcaggaauucuuccauucucggggcucuucccucccaugaccacaccacuucuuccuuccagagguucaauguagcugugacccgggccaaggcccugcucaucaucguggggaacccccuucuccugggccaugacccugacuggaaagugugagcauucccaccccauucucccucuuaguggccacagccccugccuagggcagguggaucuuuuuuaagcgcuugcuuaucgcucaguuaauccucagauguguccauuuucacagcaucacuauuguauuuauaaguuaaaugacauccagagguugagcaaguacagcucagaugggacaggaccguggcuuagccuccagucucugcuggcacuccucuguaccccacagauuccuggaguucuguaaagaaaacggaggguauaccgggugucccuucccugccaaacuggaccugcaacagggacagaauuuacugcaaggucugagcaagcucagccccucuaccucagguauggcugggccaggguggggacagugccagaggaggugguaaggaagacacaguguacuuucucucuuuccagggccccacagccaugacuaccucccccaggagcgggagggugaagggggccugucucugcaaguggagccagaguggaggaaugagcucugaagacacagcacccagccuucucgcaccagccaagccuuaacugccugccugacccugaaccagaacccagcugaacugccccuccaagggacaggaaggcugggggagggaguuuacaacccaagccauuccacccccuccccugcuggggagaaugacacaucaagcugcuaacaauugggggaaggggaaggaagaaaacucugaaaacaaaaucuuguucuaugcaaaagccuuga

SEQ ID NO: 191328 - RNA, 53871 nt, Homo sapiens
aaacccugaagagcccaagcaaugugguuguaaaauuugcaaaauaagauuaaaucuuaacugcaaucuguuaacacugcugucuccuuucacucuuucuccuauaucacacuuucccacauguuggauggccuuggagugguagccauaagcauuuuuggaauucaacuaaaaguaaguugaaugaagcacuacuuuauuuaauacuuguaccuaauuuucuccuuuucuucucgauacauaauacuuuacauauuuaugggguauauaugaucauauacguaguauguauaauggucaagcuuguuauacacguaguauguauaauggucaagucaggauauuugggguauccaucaccuugaguauuuaucauuucuauguguugguaucauuucaaguccucucuucuaguuacuuugaaacauacaaaguauuguugccaaguauagucacccuauucugcuaucaaacauuagaacuuauuucuucuaucuaacuguauguuuguaaccauuaaucaacuucucuucauuccccucccaccaaccacccuucccagacucugguaucuaucauucuauucucuauggccaugaggucaaguuuuuuagcucccacauaugaguaagaacaugcagcauuugucuuucugugccuggcuaauuucauuuaacauagugacuuccagcaccauccuuauggcugcaaaugaguugauuucauucuuuuuuaugaccaauaauauuccauuuuguaucuauaccaaguuuucucuauucauucauccguugauggacacuuagguuuauaucuuugcugucaugagucgugcuguaauacacaucugaacgcaggcaucccuuugauauacuauuuauuuuccuuuagcuagauacccaguaauaggauuccuggauuaugguaguucuauuuuuagguuuuaauaaaucuccauauuguuuuccauagugguuguacuaauuuacauucccaccaucaguguauaagaguucccuguucucugcgcccucaucagccucuguuauuuuuuucuucuuuauaauagccauucuaacugggguaagacgauaucucauuuugguuuuguuuugcacuucccuaaugauucaugacauugagcauuuuuucauguauccauuggccauuugucagucuucauuugagaaaugucuauucaugccaguuucccauuuuaaugggauuauuauuauuauuauuauuuauuguuuaguuguuugaguuccuuguauauucuggaauuagucaccuguugcaugaguaguuagcaaauauuuucucccauucaagagguugucucuuuacucuguugauuguuucuucugcuacauagaaguuuuuccauuuaauacaguccuauuugucuauuuuucguuuuguugccugugcuuuugaggucuuggccauaaaaucuuugccuagaccaaugcccugaagaguuuuucuuauguuuucuucuaguaguuuuauaguuuuccaucuuacauuaaaauucuuaauccaucuucaguugucuucuguauauagugaaagauaggaauccaguugcauucuugugcauaugguuauucaguuuucccagcaccauuuauugaagaggguguucuuuccccauuguauguccuuggugauuuguugaagaugaguuagcuguaaauauguggauuuauuucugaguuuucaauucuguuccauuggucuaugugucugcuuuuauaccaauaccauccugauuugguuacuaaagccauguaauccauuuugaagugagucaagaagugacucugaagacacaucugaagauagugugauauauccacuuuauuguuuuugcucaggauuacauuggcuauucuggcucuuuuuugguuccauacaaauuuuaguauuuuuuuucuauucugcggaaaaugacauugguauuuugauggggauugcguugaaucuguagauugcugcaagcaguauggucauuuuaauaauacuaauuauacuaguccaugagcauggaaugccuuuccauuuguuugugucaucuugaauuuuguucaucaguuuuauguaguauaccuuguagagaucuuucaccuacuuaguuaaguuuauuccuagguuuuuuguuguuuguuuguuuguuuuuuagcuauuguaaaucagauuucuuuccuuuuuuuuuuugagacggagcucugucacccaggcuagagugcagugugcgaucucagcucacuacaaccuccgucucccagguucaagcuauucuccugccucagcuucccgaguagcugggauuacaggcacaugccaccaugccuggcuaauuuuuguauuuuuaguagagaugggguuucaccguguuagccaggcuggucucaaacucccaaccucaggugaucuaccuaucuuggccucccaaagugcugggauuacaggugugagucgccguacccggccuauuuauaucuucuuguacuaugucuucaaaaauuguugugauuauuauuucugaguagcucaucuuuuagucauucuacucaagauaugaguaguuuacacaccacaauuacaguguuaugauauucuguguuuuucuguguacuuccuauuaccagugaguuuuguaccuucggauaauuuuugauugcucaaugaccuuuucuuucagauugaagaacucuuuuuagcauuucuuguaggacaggucugguguugaugaaauuccucagcuuuuguuuuucugggaaagucuuuauuucuccuucauguuugaaggauaauuucaccagauauaauuuucuaggguaaaaguuuuuuccuucagcacuuuaaauauaucaugccacucucagcggggugcgauggcucacccuuguaauuccagcacuuugggaggcugaggcggguggaucaccugaggacgggaguuugagaccagccuggccaauauggugaaagcccauuuuugcugaaaauauaaaaauuagccaggugugauggugcacaccuguagucccagcuacuuggcaggcugaggugugagaucacuugagcccaggaggcagacguugcagugagucaagaucacgccacugcacuccagccuggguggcagagugagacucgucucuaaauaaauaaauaaauaauaaaucaugcugcuaugguguacaaaugggggaaaggcguccgcucucuaugcaugagccuaagcacugaggcugcuccaccaguggggguagggucacugcccaggccccagacagucagcucucaggcucacccacuugggcuccugguggcagcaacugcugcauuugugugggugugggggaggaaggggaggcggugggauggguggaaggaauuccacuuuccgauuaugagccccagaauagagucugugccacugcugggggcaaggucgcucucacagggucuggaaagugucugcucuggcuuacugugacugugucccaggggcuuccuccuugguguguggcaccauccuuuuccugaggaguaguaguucaugugggccaggguacuggggacccugugcacauuuggguccagccagugcugugccacuguaacccucugaguggacacuaagggacaucagugggggauucugaaauguggacauaggagggugugguucccagggcaggaugcaguccagugguggcugugcuuucacaauggugcugugcugcagccacguacgucuuggggaagcaugugacccugcaugaguccccugucuggugagaugcccugacagggccuccagaccaccacccacacuagucucagaguuuguauggguagaggagcucucucaugguuaggacugcagcagucugcagcagggauguguauagcagagggauucucaccgccaaccuuggcugaguugaccacucacuuccugcuccaucugugccucagguauuucccauaacuucucuguugaacuccaguguucucuccuagauguucuauuggagguaugauuaucuauucacaauuauugauuccuucuuuaaagagugagugucuaaugucucuagucagccauuuugaaccccuaucucaguuuuuugagagauuucugugguuugccgucacuuccaugaguuuaugcuagccacgccaauaggaauagcuucuaggaauacucccaucaauccaugugcugccugaccugacauaaugacaugaagcagcagugccaaagguuguauucuaggaauauacccuguaguaucuggcacuaaaaguaaagugggaagcaaaggagaaacaaguuuggaauauguggagccagaacacaucuauagaaaauucaucuaguucucagcuguguaaaauuauaagugggcaauuaauuucuuauuaaauccuagccaaaacaaaauuuaucucuugccaaggaaacuggucagugaugcaguguacauaauuauaaaugcagcauacauaugaagauguaaucaaggaguaugaagucaaaagauagauauaugguuuuuuauuuucaagaauucuacuucugacuucaaaauagaguaacaggaacuggauuuauucucacaccuaaaaaaaaacuaagcauuaagccaaauauauuaaagacauugacgaucagacaacaaaggacacagaugggaaacaaagugagucuuauaauugccccccaacaggaaggagaauuccaggcauggccucaugaucuccuuaaguucaggagguaaagcugggagucuugggagggaagaguauuggauguaagacagcuucagugagagagaucaccagaggaugugagaggccuccccuggagucuucaacuaagugcuaaucagcaaauguaugaggaaacuacccaagaccaaugagagaaccacccaaaaggauuagaagaaacuacucagagaucucaugggacugggaguaguuucuguucucauuagcgaaaaaugaaaaaucucauaauuugcagcacauucaaagagucuucagaguuuugucucuauagugggccaaaauaagcccuagaauaaaugaugcucuguucccaccaacccccaaccaaugaaaaaaaaaaaaaaagacucaaaaggauaaaacuguuucuaaauaacuaugucucagaauaaagcucaagaauauguauaggaaaacaaaaauguccagcagucaaaagguaaaaaucacaaugucuggcauccaauaaaaaauuacaaagaaguagaaaaauauggcaaauaauuagaagaaaacucaauccuugaaaauuacuucagggugggcaacauggagaaaccuugucucuacaaaaaauacaaaauuuagcugggugugguggugugugccaggagucccagcuacucaggaggcugaggugggaggaucacuugagcuugggagauugaugcugccgugaguugugaucaugccacugcacucuagccugggcaacaaagcaauacuaaaaaaaaaaaggagagaaagagaaagagagagggagggaggggagggaaggggagagagagagagggaaggagggagaaagggagagggagaggaaagaaaaaggaaaggaagaaaaagaaagaaagaaacacggaaggaggaaggaaggaagggaaaaaagaaagaaaaaagagaaagaaagaagaaggaaggaaggaaaagaaagagaggaagggagggcgggagggacaggagagagggagggaaggagggagggagaggaaaggaaggaaggaaggaaggaaaagagggagggagggagagagggaaggcaggcuggucaaaauaacacaaugacagaaauagcagacaauuacauuaaaauagcuauuauaacuguacuguauauucaaggagauagggaaaagauugaguuugguaacuagagacaugaaagaugcagaaaaacuaaaaucaaacuucuagagaugaaaaucccaguaucugagauuaaaaaaaaauggaugagauuagcaacagauuacacauuguggaagaaaugauuauuaaauaugaagaaauauuaauaaaagcaauccauaauaaaacacagagcauaagaaauuuuuuuuaaugaacaaagcaucagugagcuuugggucacauucaggugaccuaauguaaguuuaaucggcauccccaaagaaaaauauuugaacaaacaauagccaagauuuuccaaauuugaugaaaauaauaaauucacagauacaaaaaaagccaauaaauauaagcauaagaaacaugaaggaaacugcaacaagaaacaucauaaucggcugggcauaguggcucaugccuguaaucccagcacuuugggaggccgaggcggguggaucaugaggucaggagaucgagauuauccuggcuaacacagugaaaccccaucucuacuaaaaauacaaaaaaaaaaaaaaauuagccgggcgugguggcaggcaguuguagucccagcuacucgggaagcugaggcaggagaauggcaugaacccaggaggcagagcuugcagugagccaagauagggccacugcacuccggccugggugacagagagagacucugucucaaaaaaaaaaaaaaaaaagaaagaaaaagaaaaagaaacaucauaaucaaaaagccuaaaaccuaugauaaagagaaugcuuuuuuauuuuuauuuuuugagauggauuuucacucugucgcccaggcuggagugugguggcacaaucucgacucacugcaaccuccgccucccggguucaagcgauucuccugccucagccucccaaguagcugggacuacaggugugagccaccacaucugacugauuuuuuuuuguauuuuuaguggagacgggguuucaccgcguuagccaggauggucucaaucuccugaccucgugaucugccugccuccgccucccaaagggcugggauuacaggcguaagccaccaugccuggccaagagaacacuuuuaaaacaaccagaggaaaaaaagcuauuacauacagaugaacaaacauaaaagaacaugagauuucucauuaguaaugacacaauccugaagacaguggagcaguuagugguagacuacugaggaaaaaaacugucaaccuagaauucuaaacccagugaaaauaccuuucaaaaacaauggcgauagucacuuuuuaaaaugugaaacaccguucagaaaaaugaggaucguguuaugguuucaaucuguauccccacccaaaucucaugucgaauugugaucuccaauguuggagguggagucuggugggaggugauuggaucaugagcauggauccuucaugaauaguuuagcacccuuggugcuguucucaugauaaugaguaaguucuugagagaucugguuguuuaaaaguguguagcaaucccccacacacacacccagcucucucucuugcuccugcuuuggccaugugaugugccugcuaccccuucacuuuccaccauaauuguuaaguuuccugaggccuccccagaaagggagcagaugcuagcaucaugcuuccuguacagccaacagaaccaugagacaguuaaaccucuuuucauuauaaauuacccagucucagguacuucuguacagcaauacaagaaugaacuaauacagauugcuuuccuugaugugugagagucaucaucucuccucuugguucauuauugggugugcuauaaauaaaaucauuagcaauuaaagugagauuugcccacacacacaaaaagcaaaauaaagauauuucucaaacaugcacaugaugaaagaauuccucaucagcagaacugcaguacaagaaauacuaaaggaaguaguucaggcaaaauaaaacuaauaacaaaucugcaucuauacaaaggaaugaugagcaucaaaaaaugguaggcauauggguaaauaugaaagacuuacccauuuuaaagagauuuaaagaacaauaacuuuucuuuaaauauuuaaaucucucuaaagaguuaucacaguguauugugggcuuuuucacauauguagaaauaaaauguaugacaaugauagcacaaacgcugagggaagagaaauggaaauauacuguaguaagauucuuauucuguaaauucaucggcauaauaucacaugaagcuagaccacaauaaguuaaagauguacacaaugagccauaaagcaaccaugaaaaaaagcaaaacaaaacuaauaaggcaacaaagaagauaaaaauagaaucauaaaaauaaucuauaagaaggaaagaagaacaaagaaccuaugguagaaaaauaacauuauugauuuaagcuaacuauaugaauaaucgcuuacaauuuaaauagccuaaacaacucaauuaaaggcagagauuguccaauuguauuuuaaagacaaacacucaaaaauaugcugcccacaagaaauccaauauaaauauaaagacauguauaggguaaauuauuauugacuaccccacccaaaugcaacagaauacauauuauuuuuuaaugcacacauagaacauuuacaaugauagacaauauuuuuggcuacugaaaagucucaauacauuuuaaaagaucuaaaucaugcaaauuauguucucuggccacaauggaauucaauuagaguaaauaaaaugcggguuucugggauaucccuaaauauuuggaaaauaacacacuaccaaauaacccaugggucaaaggaaauuaaaggagaaauuagaaaauaauuugaacugaaugaaaaggaagauguaacauaucaauauuuaugggacacagauugaguacuuaaagagaaauuuauaacacuaaaugccuauauuaaaaaagaagaaagauauaaaaucaguuaagcaaauagaaguucaaaugacaucaccaagaugguggaugagaagguaaugcccaucccccacugagaaaaacaacgaauaaacaacuacauaccaaccaaaauagcucugggagagcugcagaguacaaugaaaaacuugcagcaacccaaaggaccacacaaaccaagauagccauauuaaaaaauacagaaaguauccuaccuacuccaccccaucccccaguccaagcacagcuuugcaccaagaggcaucuccuggacacaacccacaaccuccaccugugggagaaaaguagagcaggaggaccccagcauccuuugccaccaaugcaaacauugaccacuuuuaccacugaggaccccugcaguuuccaccagugaugaucucaacugacagagcuuuccaggguccaugcugcugugucccccuggagaagaagcugcuguguccccaguggccaagauuaccaacucaccgucucacaauugcauguaugcucuagaccccagagccaaggcugcuacauguaugauggacacuucugacacuggcaccaccacugccaugggcacaccuguaccccagaucauagagccauggcuguucugugugcaaccaagcaucaaauaccagcaccacuaccaacaugagcacaccugcacuguggaucuggcacaaaaagggaucccaucagcugugaaguucccccaagcaggaauaagagaacaggaaaaugccagcagccuuugcuguugcauuugggugggguagucaauaauaauuuacccuauacaugucuuuauauuuagaguacccaagcaacuuuuucugcugcuguguacacccacagccuuggcugcugagggccuccagagccauuggccaugcugaucucagcugauggagcuuuauagagaguaugcugcuguacccaccauggaguuggagcugaugcuguggcuucccagagcuagaaccaccacacccaacucagacagcaucuucaugcccacuuauaaauggucuuucccuauugaaaugaguccauacagucuggaagagguggcuauuacuucaaacaugcagacaucacuacaaggcuaaagaaacauaaaaaaaucaaggaaauauuacaccgccaaaggaacacaauaauuuuucaguaauuaaccccaaagaaauagagaucuaugaacuaccuaaagaauaauucaaaauaauuguuuaaggaagcuugguggcuacaagaagacacugggaauucagugaaaccagaaaagcaauacaagaacagauuaaaaguucaagaaagagauagaaaucauuuuaaaauaaccaaacaaauuauggaguugaagaauacaaugaaugaaauugaaaauacaauagagaauuucaacagcagacuugaucaagcaaaauaauuuuaaaaaaaaaucugugaaccugaagacacaucauuugaaauuaucuagucagcagacaaaagagaaaaaagaauggaaaacaguaaagaaagccuaugggauuuauggaauaccaucacugaaaucaauauauguauuugggaguuccaaaaccagaagaguggcugagcacuguagcucaugccuguaacccuagcacauugggaggccaaggcaggaggaucacuugagcccaggaguucaagaccagccugggcaacauagugagaccuggucuguacaaaaaauguaaaaauuagcugggugugauggugcaugccuguggucuccacaacucaggaggcugaguuaggaggaucacuugcacccaggaggucaaggcugcaaugagcugugauugcaccacugcacuccagccugggcaacaaagcaagaugcugucucaaagagagagagagaaaauaaaaaagaaaaaguaggagagagggcagaaagcuuauuaaaaaaaaauaauaaaggcuaaaaacuucccaaaucuugagagagauauagacauccagauucaugauaccaaauagcccccaaauagaaucaacccaaagaagacuacaucaaggcauauuauaaucaaauuaccaaaaguuaaggacaaagagaauuuugaaagcaguaagagaaaaguaacugaucacauauaagggagacucgaugggacuauuggaagauuucucagaagaaaacuugcugaccaggagaaaauagggugauauaacccaaguacugaaagaaaaaaaaaugccauuuaagaauacuauuccuagaaaaauuuuccuuuaaaaaugaaggagaggcugggcaugguggcucacaccuguaaccccagcauuuuggaaggcugagguggaaggaucacuuaaaccuaggaguuugagaccagccugggcaacauggcaaaaccucaucuccacaaaaaaaauuuaaaaauuagccagguguggugacacacuccuguagucccagauaccagggaggcugaggcaggaggcuugcuugagcagagguguuugaaguugcagugaggcaugaucacaccacagcacucuagcuugggcaacagagcaagauucugucuauaaaaauaaaacuaaagggcugggcgcaguggcugauaccuguaucccaguacguugggaggccaaggugggcggauccccucaggucaggaguuugagaccagccagaccaacauggugaaaccuugucucuacuaaaaauacaaaaauuagcugggcguagugguacaugccuguaaucccagcuacucaggaggcugaggcaggagaaucgcuugaaccaaggagguagagguugcagugagcugaaauugcaccauugcacuccagccugggugacaagagugaaacucugucucaaaauaaauaaauaaauaaaaauaaaacuacaaauaagauuaaacaaaacauaagacaaaaauuugcaggggcugggcgugggggcucaugccuauaaucucagcauuuugagaggccgagacgggcugaucaccugaggucaggaguuugagaccagccuggccaacauggugaaaccccgucucuacuaaaaauacaaaaauuagccgguugugguggcaggcaccuguaaucccagcuacuugggaggcugaggcaggagaaucgcuggaaccugggagacagaaguugcagugagccaagaucacaccacugcacuccagccugggagacagagugagacuccauuuuaaaaaaaauuuuuuuucuaauggauauacaguauaaaaacaagccagcagccaacaagaucacaaagugugcaggggugcagggauggagaguaaaagucuaguguuuuuguaagcaauugaaguuaaguuuuuuuguuguuguuguuuuauuuuugagacggggucucgcucugucucccaggcuggagcgcagugucgcaucucugcucacugcaagcucugccuccuggguucacaccauucuccugccucagccucccaaguagcugggacuacaggcaccugcuaccaugcccgacuaauuuucuguauuuuuuuaguagagacgggguuucacgguguuagccaggauggucucaaucuccugaccucgugaucugccugccucagccucccaaagugcugggauuacagacgugagccacugcacccagcugaaguuaaguuguuaucaacuaaaaauaaguuacaacuccaagcuaaccauaaagaaaagaccuaugguugggcacaguggcucaugccuguaaucccagcacuuugggaggccaagaugggcagaucacuugaggucugaggucaggaguucaagaccagccuugccaacauggugaaauccuaucucuacuaaaaauacaaaaauuagccaggcgugguggcaggcacuuauaaugccaguuacuugggaggcugaggcaggagaaucacgugaacuugggagguggaaguugcagccagucaauaucacaccacugcacucagccugggugacagaguaagacuccgucucaaaaaaaaaaaaaaaaaagagaagacaguacaaccgauaccacagaaacaaaaagauguauaaaggacuauuaugaacaauuacaugccaacaaacaggaacaaacaggaucaccuagaagaaauggauaaauuucuagaaacauacaaccuaccaaaacugaagcaaaaaauagaaagccugaacagaccaauaaaaaauaaggcaacugaaucaguacucaaaaaaucucccaaaaaagaaagcccagaaccagauggcuucauaggugaauucuaccaagcauuuuaaaaagaaugaacaccuaaucuuucuuaaacucuugugaaaaauagaagaaaagggaacacuucagaaguuauucugcaaggccaaaauuacccugauaccaaaaccagacaaagauacuccgagaaaagaaaaccucaggccaauauaccugauuaacuuagauguaaaaacccucaaugaaauacuagcaaaacuaauucaacagcacauuauaaaaauuauacaccauaggccgggcaugguggcucacaccuguaaucccagcacuuugggaggccgagguggauggaucaccugaggucgggagaucaagaucagccugaccaacauggagaaaccccgucucuacuaaaaauacaaaaauuagcugggcauguuggcaggugccuguaauccgagcuacucaggaggcugaggcaggagaauugcuugaaccugggaggcaaagguugcagugagccgagaucgcgccacugcacuccagccugggcaacaagagcaaaauuucgucucaaaaaaaaaaaaaaauuauacacccugagcaagugcaauuugcuuauuuauuuguucauuuguuuuauuaucccuggaaugcaaguaugguucaacguaugaaaaucaaucaaugugauacaacauauuagcuaaagaaaaaaugugauuaucucaauagaugcagaaaaaacguuuggcaaaguacaauaucuauucaugacucucaacaaaagagguacagaagaaacuuacccuaaaauaauaaaggccauuaugaaaaguccacagcuaauaucauaaccaauggggaaaaacuacaagcuuuccuucuaagaucugguacaaggcaaggaugcccacuuucaccuucuuuucaacauaguacuagaaguccuagccagagcaaugagacaagaaaaagccauccaaacaaaaaagaaguaaacuuauccuucuuugcagauggugugaucauguacauagaaaacacagaagacucaaugaaaaaacuguuagaacuaauaaaugaauucaguaaauuugcaggguacaaaaaucaacauaaaaaaauuaaucaggccaggcgugguggcucaugcccauaagccuagcacuuugggaggccaggucaagagaauugcuugaguccaggauucaagaccagccugggcaacauaaggagacccccauaucuacaaaaauuuuuuuaaauuagucgggcaugguggcucacgucuguaaucccagcaccuugggaggcagaggcgggcagaucacuugaggucaggaguuugagaccagccuggccaacauggugaaaccccaucucuacuaaauacaaaagauuaaccugguacaguggugcaugccuguaaucccagcuacuugggagucugaggcaggagaauugcuugaaccugggaggcagagguugcagugaguugagauugugcauugcacuccagccugggcaacaagagugaaaacuccaucucaaaaaaaaaaaaaaauuagccaggcuaauuuaaacgguggugcaugccugugguuccaacuauuugggaggcugaugugggagaauaguuugaacccgagaggucaaggcugcagugagucgugauugugcuacuacacuccaaccuggaugacagaacaagacccugugucaaaaaauaauaauaauaaucacauaaaaaaauuuugagacagagccuugcucugucacccaggcugcagugcagugauguuaucauagcucacuguagucuuaaacuucuggacucaagcaaucguccugccucagccuacugauaaucugggacuacaggcacaugccaccagccccacuaauuuuaucuuuuuguaaagacagggucuugcuauguugcccaggcuagucucaaacuccuggccucaagcaauccuccugccucagccuccgaaagcacuggaauuacaggcaugagccaccaugcccagcccuagucacauuucuagacacaaacagcaaaguagucagaaagaaaauuaaggaaacaaucccauucccauuagcaacaaaaagaauaaaauauugaggaauaaacuuagccaaaaagacuuguacacuaaaauuauaaaacauugaaggaaauuaaauaacauuauagauaaaugaaaaagauaucgcauguccauagauugaaaaaauauugguaaaauguucauacuacccaaagugaucuacagauuuaacgccaucccuaucaaaaucccaaugguauucuuuacagaaauagacaauagaauccuaaaauucacaugggaugacaaaagaccuagaauguccaaagcaaucuugagcaagaacaaagcuggauuaaucacacuucccaauuuugaaauguauuauagccagauacaggguagucccagcuaccugggaguggagucugaggcaggaggaugcuucagccuaggaguuugaggcugcagugugcuaugauugcaccugugaauagccacugcacucuagccugggcaacauagauacacacacacacacacacacacacacacacacacacacacauauacacacacacacacauuauaguaaugaaaacaguaugguacuugcauaaaaacaauauauagagcaaagggacagaauagagcucccagaaacaaauccaugcaucuauagucaacugaucuucaacaaggaugccaauaacacacaauuggaaaaggaucaucuccuugauaguguuggaaaaacuggauauacaaaugcagaaggaugaaauuggauccaugucucacacuauauacaaaaaucaacucaaaaaggauuacagaucuaagcuuaaaagcuaaaaccauaaaacuccuagaagaaaacauaggggaacauuuucuugauauuggccugggaaaugauuuuuuuuuugaugugacacaaaaagcacaagcaacagaagcaaaaauagacaaaugagacugcaucaaacuaaaaagcuucugcacagcaaaggaaacaacagagaaaaaaggcagucuaaggaaugggagaaaauauuuucaaacuauguaucugauaagagguuaacauuuaaaauauauaaggaacucauacaacugaauaacaaaaaaaaaaaaagaaagagagaauaaauuuaaaaaauaaauaaauaacccuacuuuaaaaugagcaaaggaccugaauagacauuucccaaaagaaggcauacagauggccaauaaguauaugaaaucaucggagaaaugcaaaucaaaugaaaugucaccucacaccuguuagaauuaguauuaucaaaaagacaaaagccagguaugguggcuugcgcuuauaauuucagcuauucaggagacugaggugggaggaucacuugagcccuggaguucaagacgaaccugagcaacauagugagacuuugucuccaaaaauuauauauauauaauuuuauauaauaauuuuaacaauuuuauauaauaauuuauauaauaaauuauauauaucauuuuuauauauaauuuugucuccaaaaauuuuauauauauauacacauauauauauacacauauauauacacauauauauacacauauauauauacacauauauauauauauauauacacacacauauauauagagagagagagagagaagagggucucacuugucacccaggcuggaguugguggugcagucucagcucacugcaaccucuacuucccaggcucaaaugauccuccugccucagccuccugaguggcuaauuuuuuuuuuguuuuuguuuuuguagagacaagguuucacuacauugccuagacuggucucaaacuccuggacucaagugauucaucuaccugggccucccaaagugcugggauuacaggugugagccacugugccuggcccccaaaauuuuuuaaauuuaaauuuaaauuuuuuaaaucaccaaacuccaugccuggcaugugccuguaguccuagcuacucagaaggcugaggugggaggauugcuugagaccaggaguucaggcugcaacuccagccugggugacagagcaagacucccucuugaaaaaaaaaaaaagguuuauuucuuuauauuagcaauggaaguagaaauuaauaaauaauacuauuuauaauagcaucaaaaauacuaaauguaaagauaucugacaggagaugugcaagacuuauacacaaaaacuacaagucauugcuaagacaaauugaaguucuaaauaaauggagagauauacuguguuuauaaaucagaagacaauauggcuaugaauucagugcucuccaaauaauucauauauagauuuaaugcaaucccagugaaaauuccaacaggcuuuuuuguagaaauugacaaguuaacucuaaaauuuguauggaaaugcaaaggaccuaacauaaccaaaacaacuuugaauaauaaaaacaaauuagaaaaugucacuaucuaacuucaaagcuuuuuauaaaguuauagucgucaggccugggggcaugauggcucaugccuguaaucccagcacuuugggaggccaaugcuggcagaucaccugaggucaggaguuugagaccagccugcccaacaugucaaaaccccgugucuacuaaaaauacaaaaauuaaccaggcauggugacaggugccuguaaucccagguacacaggaggcugaggcacgaggauugcuugaacccaggaggcagagguugcagugagccaagauugugccacugcacuccagccugggcgacaaagugagacucugucucaaaaaaaaaaaaaaaagguuauggucaugaagacuacguuuuauuggaauagaaauaaagaacuauaucaccauaucaaucaaacagaaugaagaguccagaaacagucucucaaauaugugcuuaguuuauuuuuugacaaaggugcaaaugcaauucaauggagaaagcguaaucuuuucaauaaaugguacugaaacaacuggauaucuauaugcaaaaacuaagcuuugauccauacaucacaccauauacaaaaauuaacugaagauauauuuucgaccuaaauguaaaaccuaaaaaaacuguaaaacuucuagaagaaaauguaacagaaaaucuuuguaaccuuggguuagguaaagauuucucuuaauauaccaaaagcagccaggcccaguggcaugugccucuaaucccagcuacuuuuucugaauucauugacaugaucauaugggauuuuuugacuuguuaauauggugaaauacauugauugauuuucaaauauuaaaccauuuaugcauuccuuccauaaacccaauuggucauuuauguauuaucuuuuuauauauuguuggguuugauuugauaaaacaccagcuacuggaaggcugggaggauugcuugagcccaggaguucaagaccagccugggcaagauaaugaguuuuuaacacacacacacacacacacacacaccaggcugggugcuguggcucaugccuguaauccuagcacuuugggaggccaaggcagguggaucccuugagcucagcaguuugaggccagccugggcaacauagcgagaccccaucucuacaaaaaaauuuuuaauuaguugggcaugguguuaagugccuguagucccaguuauucaggagucugaugugggagguuggcuugagcuucagaggcaaugguugcaaugagccaaggucacaccacugcacuccauccugggcaacagagccagacccugucucaaaaacaaaacaaaacaaaagaacauaccaaaagcacuacccauaaagaaccaauugauaaauuggacuuuaucaaaauuuaaaacuucugcuguucaaaaacauuauuaaaagaaugaaaagacaagccauuaacuaggagaauauacuuucaaaucacacauuuaauaaaagacuuauauccagaacauaugaagaacuuucuaaaguuaauaagaaaaaaaaaacccaauaaaaauaggggaaauauuuuacuagaaacuucaaaaaagacauacaguaggcaaaugaaaagaucauuagucauuagggaaaugcaaauuaaaaccacaaugagauagcaauacauaccuacuagaaagccuaaaauuaaaagaacuuuuuauauuauguguugacgagaauguagagcaacuagaacugcaaaugggaguauaaaugauacaacaacuuuggaacauauuucgauaguuucuuuagaaaacauacauuaaccugccacaugauucaguuaucccaugccuagguauuuacucaaaagaaaugaggguauauucuaugcaaagguuguaaaauaauguucauaacaguuuuacaugucaaagccaaaaacuuguaauuacccaaauagccaucaacaagugaauagauaaguaaacugugauauauccauacaauggaauacuauucaacaauaaaaagaaugcagcuacaugaaugaaucucaauuaugcuagugaaagaagacauuuaaaaucaauacacacuauaugauucuguuuauuuaaaauucuauaaaugcaagauaagauacaguaaauaaaagauucgugguugccuggggauugggggagggagcaaagagaauagaaaugugauuacaaaggugugauauaauaagaaauauauacagaugcuucucaauuuaugauagcaggguuaccuccuaauaaaccuaucauaaauuuaaaauaccaugucaaaaauguauuuaagacaccuaaucugcugaacaucucauugcuuaguguagccuaccuuaaaugugcucagaacacauuagccuacaguuggacaaaaucaucuaacacaaucccuauuuuauaauaaaguguugaauaucucauguaauuuauugaauacuaaagugaaaaacaguauaaguauugaaguaguuuguggaaauaaguaauucaaaaucuaagcugggcugggugugguagcucacgccuguaaucccaacacuuugggaggcugaagcggguggauugcuugaggucaggaguucaagaccagccuggccaacauggugaaacccugucucuacuaaaauuacaaaaauuagccaggcaugguggcacaugccuguaaacccagcuaugucaggagguugaggcacaagaauugcuugaaccaaggagacagagguugcaaugagccgagauugcgccacugcacuccagccugggugacacagagaggcucugacucaaaaaaaaaaaaaaaaaaaaaaaaaaucuaagcuguugguagacgacucauauaaaaaauuuuuuaaaaacaaaaucuggccaggcacaguaguucacgcccauaaucccaccacuuugagaggccaaggcgggcaaaucacuggagcucagaaguuugaagagaucagccuggccaacaugguggaacuccgucucuaccaaaaauaaaaaaauuagcugggcaggguggugcacgccuaguaaucccagcuauuugggaggcugaggcuggagaauuauuugaacuagggagguagaguuugcaguuagccgagaucgcuccacugcauugcagccugggugacagagcaagacucugucucaaacaaacaaacaacaacaacaaaacacacacacacacacacacaaacucuaaaauauuuugcgccuuaagggaacacgauuauggcaccugagucacaugacaggcagucaaaaccuuuguuuaucugauuagauuggccuucuuccuuaccugccuuaccugccuuguuuuguaaaugcuguaaauaacuaaagaguguuuagugauguugcacuauggaagggaagacuccuuccuucuuuauuuacuuacuguuuuuuuuuuuuuuuugagauagagucucgcucugucgcccaugcuggagugcagugucacgauccuggcucacugcaagcuccaccacccggguucacaccauucuccugccucagccucccgaguagcugggacuacaggcgcucgccaccaugcccggcuaauuuuuuuuuguauuuuuaauaaagacagguuuucaccauguuaaccaggauggucucgaucuccugaccucgugaucugccugccucggccucccaaggugcugggauuacaagcaugagccacugugccuggcccuuuauuuaccguuuuuuuagagacaggauuuuccuaugucacccaggcuggucuccaacuucugggcuuaagcaauccucccaccuaggccucccaaaugggaauucucauucacuguugugagaguguaaauugcagugaaauuaagcaucugugcauccuaaaaccaagcaaucccagauaaauuugcacucuuaaaggucagguaugaagauguuugcggaggcauuuuuugauauuuuugauagcauggguucaagguacuuagauguucacugggagaacagguagcaaauugugguggcuaucacuacagaauacagugcaacacuuugagggaaugaacuaugcacaucuauauaguaacaaggacagauuuuuuuuuaacaugagaguguaaaaaaaagaaaaagaaaaaaaaaggccaggcacaguggcucacaccuuuaaucccagcacuuugggaggccgaggcgggcagauuacaaaaggucaggaguucaagaccagcauggccaacauggugaaagcccaucucuacuaaaaauacaaaaaaaaaauuagccgggcauggcagcaggcaccuauaaucccagcuacucgggaggcugaggcaggagaaucacuugaacccaggagguggaggcugcagugagccgagaucacgccauugcacuccagccugggugacagagggagacucugucucaaaaacaaacaaacaaaaaacccaaagaggucuaaaguccauugcauuauucccagcaauucacucccuucuaccaguugucauaaaacuugcaaugccaauacucgcaauggauauauuuccucaucccauuguugaguuuaguuaucaugugugggagcagaugugacacaugccaauucaagcugaaguuuuaagaaacaucacaaauucugccuauuuuuuuuuuacuauuccuuuugcaagaaaauauagcaugucccucgccaguauguuccuucagcccagauccuaaagugagaagauggaggaagagaacuucagucuccacccacaauuacugguuuuuaggauuuuaaauuuuaggauuuuuuucuuacugcugcaagucuaauacaagcuucaugucagaauaucauuuauaaaaauuaaaaauuagaaauacacaugcaaacaacauaaaagaauacauauauauccaagugcauauuucaguuacauuagaguggaugccuauuaccaggggaaggaauaagagugggaaaugggauacaggaaauaaagaaacaaacaagagagacaccucgcacaggucgaugaugaucaguguuaagaacuaagcaguagcauuaacucgacucucugcaugugcuguacaaagacaacaaaaaccucuggagugacaaguaacuguuggagaaagguccugggggacuuggaagaggagggaauucacaauccagguagagaaaaucggccuugggaucaccuccucguucugagagagaagcugagagaaaggcuucuuagggauucuguuuucaauguaaccuguaccaaagguguucuuccaagugugagugagaaaggggcucaaagagagagagauaagagaacaauaaauuacuuuucucaaagaacucauauucuuuuuuuuuuuuuuugagacggagucucgcucugucucccagguuggagugcagaggcaggaucucagcucacugcaagcuccgccucccggguucacgccauucuccugccucagccucccuaguagcugggacuaccggcgcccaucaccacacccggcuaauuuuuuguauuuuuaguagagacaggcuuucaccguguuagccaggauggucucgaucuccugaccucgugaucugcccaccucagccucccaaagugcugggauuacaggcgugagcccccgcgcccggccaaagaacucauauucuuaaugaaaagacuaaaaugcccauuuuuguauuucaaauccuacucaucuaucaaggucuaggccaaaauuuaccucuuccggaaagauccccccuggauucccaauagcucuacccuaaauaaaucuacaaaucacuccucuuccugcugaaaauccauagcauuuauuauguuaaauugcgccuguguuuucuuuuccgaccagacugaaggauccuugaggacggcaguaccuggcauaccuacacagucagcguucaacaaguguuugcaaagguacaugauaauuaaaaugucagauaaccaauuauaaaaaauaaauuggccugcacgguggcucgugccuguaaucccagcacuuucagaggcugaggcggguggaucacaagggcaagaguucgagaccagccuggccaacauggugaaacuccgucucuaccaaaaauacaaaaauuagcugggcgugguggugggcgccuguaaucccagcuacugggagacugaggcaggagaauugcuugaacccaggaggcagagguugcagugagcugagauugcaccacugcacuccagccugggcaacagagcaagacuccgucucaauaaauaaauaaauaagucaacagaucagauagcauuucagaagaggcuaagaacauguugaacuguucaggaaagacuacauggaauagggccuugaaagaagggcaggaaucagcuaauuagaagacaggaagagcauuucaggccaagggaaaaugguaaauaaacacaaagaguuagaaggauuggagggagggccaggugcgguggcucauaccuguaaucccagcacuuugggaggccaaggcgggcagauuacuugagcucagggguucaagaccaaccuauucaacauagaccacaucucuacagaaaauuuuuaaaauaaaaaaauuagcuagguauggaggcccacaccugugguccuaacuacucaggaggcuaaagugggaggaucacuugagccugggaauuugaggcugcagugagccaugauugugccaccguacuccugccugggugacagagcaagaucuugucucaaaaaauuuuuuccaauaaaauaauuuuauuuauguucauaaauguauuagggaaaauuuaggauaugaguuucaucaucaugggagugagaacaacuuccuaaguaagauaguaaccuggaagccauaaacauauauguaugacaagucacguaaauaaaauuaagagagaaagaaaagaauaggaaaagacauuuucaaaauauauacaaaggacuuauuuuccacaauauguaaagaaacuauuauaaaucaauauaaaaaagacacucaagauuuagcaauuucccaucuggcauguaaaaagcuugcaagucaucgccccagccuaacaauaaguaaaaaccugaacaaacugaaaaaucaacacccuucuuacauccaccagagucaugaggccacagggcaaaccacugcuuccuaaauugcagagacaggcaggcaaaugcagggaaucacagcuuaccagagcagaaacccaugagcaggaaccaguaccaggguaccaaaaccugagcuguaauugaugaauugcuggagacucaguauggacaacucugagaauuaaaaacuccaggggaagccagucaugggaggaccucacauauugugaguuuuaccuccuagagcucaccagguucucacaguaaauaucagaaaaauauccccugugcuucuggcugggggaaggaaaaguaaccauuucuaaauacaccuaagcauucuguucuucuuaacaaguccuguucucucaagagaaacuauuuugccagaaccuaagcuuuuauuauuacuuuuuuugcagagucuauccaaacuaggggaaggaaaauauccaguuucagcccgcuguagccuuuacauuggggaagggaauauuaaauuccaucccacucuaaccauccuauacuaccuaaggaguggaaggauugagaagcuuuugcgaggugcgcaguccagaggcacaggcucacuaaaugacagagaccuaagcauagaacuauagaaugcuuccucacuucuuaacaccuuaacacauuacuaaaugccuauuuacagcauuucuuuuugucuaauacaucaugccuggcuaucaagaaaaaacuacaaggcacaccaaaaugcaaagaagacaguuugaaaagucaaaacaggcaccagaaccagacucagauauggcagggauauuggaauuaucauacugggaauuuuuaaaaaacugugaucaauauguuaagagcucucucuaauggguaaaguagacagcaugcaaaaacaggcaauguuaacaaagagaaaggagaagcaagaaaugcuagagauccugcuccaucaauagcacuacgacgaaagaaugccuuugaugaguuuguuaguggacuggguccagcugaggaaagaggcucugcacauaaggcuaccucaaaagaaacuuucaaaacugaaaagcagcuagacaugauggcucacaccuguaaucccagcacuucaggaggcugggaggauugcuugagcccaggaguucgagaccagccugggcaacauagugagacccugccuuuacaaaaaaauguauuuugaaucagccaggcaugguggugcacgcuuguggucccagcuacucaagaggcugagaugagaggaucacuugagccugggagacugaggcugcaaugagcugugaucacacccuuacacuccagucugggcaacggagcaagacccuaucucaaaaauaaaacgaaaccaaaacugaaaagcaaagagaaaaaagacuagaaagaagaaaaagaauaaccaagaacggcgggacaacuauaaaagguauaacauguauaaugagaauaccauaaagagaaaaaauagagaaaggaacagaaauauuugaagcaaugacugugaauuucccccaaauuaauguuggccaccaaaccacagguccaagaaguucagugaacaccaagcagauuaaaugacaaaaacgaaaccaacaacgacaaaaacacuacaccuaggcauaucauauuuaaaacugcaaaaaaucuaagacaaaaaaaaaaaaacgauauugaaagaagccagcgaugagaaaaaaacccuuacuuauagagaagcaaagauaaaaaguacaucuaccggccaggcgcgguggcucaugccuguaaucccagcacuuugggaggcugaggcggguggauugccugagaucaggaguucaagaccagccugaccaauauggugaaaccccaucucuacuaaaaauacaaaaauuagccaugcuugguggcgugcgccuguagucccagcuacucgggaggcugaggcgggagaaucguuugaacccgagaagcggagguugcagugaacagagaucgugccacugcacucuagccugggcaacagagagacgauccguuucaaaaaaaaaaauuauaucuaccuucuccucaggaacuaugcaagcaagaagaaagcggagaaaaauauauauauuuuaagacacggucuugcucuaucacccaggcuagaguacaguggcacaaucauggcucacugcaaccaugaccuccugggcuccagcaaucauccugccucagcuucugaguagcuagagccacaggcacacaccaccacaccuggcuaauuauuuuaucuuauuuuuguagagacaaagucucucuuuuguagagaagggcccaggcuggaguaaaauauuuaaaguauugagauauaaaaaccacuaccuuagaaaucugaaccaugugaaauuauccuuuaaaaaugaaggugaaguaaacacugucucagacaaacaaaaaauaggagaauuuguugccauuggacuggccuugccagaaauguuaaaagaaauucuuuagagagaagcaaaauaauaggucagaaacguggaucuacuuaaaggaagaaagaacaucagagaaggaacaagugaagguaaaacaaaaacuuuucauauucuuaauuguucuaacagauaacaguuuguucaaaauaaaaauagcaauaguauauuugauuauguaugcuuauauauauucacaugcuuauguacaagugaaauaaaugacagaaauaauacaagggauuagagggaggaacuaguauuauuuuguuauuacaagguacucacccuacugaugaagcaguauaguauuauuugaaaguggauuuggguuaguuauaaaugucuauucugaccacuaagcaauguaaaaaaauaaguauaacuaauaugcuaagaaaggagggaaaauugaaucauaugaaauguuuauuuaaaaccacaaaaggcagauaaaagagcagaagacaaaaauagguacaaaguauaaaagcaacaacagaaaacaguaacaaauaugguagauauaaauccagcuauaggccaggcgugguggcucacgucuguaaucccagcacuuugggaggcugaggugggcagaucacgaggucaggagaucgagaccauccuggcuaacauggugaaacccccgucucuacuaaaaauacaaaaaaaacaaaaaaaaauuagcugggcaugguggcgagugccuauagucccagcuacuagggaggcugaggcaggagaauggcgugaacccagaaggcggagcuugcagccagccaagaacgcgccacugcgcuccagccugggugacagagcgagacucugucucaaaaaaaaaaaaaaaaauccagcuauaucaauaaucacuuuaaaccacaauggucugaauacaccaauuugaugacagagauugucagacugaucaaacaauaagacccaacaauaucuguugucuauaagaaaucaaauauaaacaaaaacacuauuuucaucuguuuugcugccguaauaaaauagcacagauugggcaguuuauaaaggacagaaauuuaugucucacaguucugcaggcugggaaguccaagaucgaggugcuggcagguuccuugucuggugagggccaggugucuugaaugcugaauccuccagaguggaggacugcuggaucuucacauggcagaagggcaaaaaggauaaacucccucugugaagcccuuauauaagggcaucuaaucccauucaggagggcuccacccucauaacuuaauuacuucccgaagaccccaccuuucaauagugucacauuaauagugccauuaaguuucaacaugaauuccaugggggauggauggguguuuguuuuuguuucuuagagacagggucccccucugucauccagguuagaguacagcgauguaaucauagcucacugcaagccucgaccuccugggcucaaggaaucauccugcuuuagccucccgaguagcuaggacuacaggcauuugccagcacuccuggcuaaguuucaacaugaauuuuagaagguacacauucaaauuuuagaagggaugcauucugccucuggcccccacaaagucauguccuucccaugugcaaaauacucauuccaucccaacagcccccaaagucuuaacucauuccagcaucaacucaaaagucuaagguccacagucucaucuaaaucacauaugagugagacucagugcaugauucauccugaggcaaauuucccuccagcuaugagcccacgaaaccaaacaacuuacaugcuuccaaaauguaauagugggacagguguaggacagacguuucuuuuucuuuuuuguuuuuuuuuuucgagacggaguuucacucuuguugcccaggcuggagcgcaaugguaugaucuuggcucaccacaaccuccuccucccggguucaagugauucuccugccucagccuccugaguagcugggauuacaggcauguaccacuacgcccggcuacuuuuguauuuuuaguagagacaggguuucuccauguuggucaggcuggucucgaacucacgaccuccggugaucugcccgccucagccucccaaagugcuggauuacaggcgugagccacugugcccagcccaggacuuacauuucuaguccaaacuggagcaaucagaaagaaggaguaacaggucccaaguaagucuaaaacccaaggcaaacaacguuaaauccuaugacuggagaauaaucuucuuugacuccauguccugccuuccagacacacuucccacaagcguugggcccccaagccccugagcagccccacucccacaguuuugcuggaaccagccuacacagcagcucuuauggguuggaauaggguaccuguggcuuucccaaggcuggcauugcaaguccaugccucaacgggucugaggucucaggggugguccugcccccacaacuccacuagguauugccuucguguggggaucucuguggcagcccuguuccugcagcaagucuuugcccgggcccugagguugucugaggcauccuuucaaaucuagauggagguagccaugccuccacagcucuugcacugugcgucccugcagaguuagcacuacauggacgcugccaagguuuauggcuugugccuucuggggcagcagccccagcugcaccuagacccacauagcaaagauuuuaaauggcccugggcaggaaauccugaggucucacaggugcccuaggcacucccccaauaacauucugcuucugaggcccuaccacucaaagccugugaugggcacaacagccacaaagaccuccaaaaugucuuugggucauucucccauugucuugaugaauaccaccugacuuccuucuauccuuauuaaucuccuuaccaaacagucacuuggccacaccuuugguuuucucucuaaacaugcuuuuuuauucuuuacaugacgaggcugagaauuuuccaaaucucuacauuuugcuucucuuuuuuauuaagaaauuccaucuuaaaaucguuucucugcuugcauuuuacuauaagcaguuaagagaagccauguaguaccccgagcacuuugcugcuuagcuauuccuuccaccaaauauccuaguucaucacucuuuuuuuuuuuuaaguuccgggauacaugugcagaaugugcagguuuguuauauagguauacauguaccauggugguuugcugcaccugucaacccgucgucaucuagauuuuaagccccgcaugcauuagauauuuguccuaacgaucucuguccccuuucccccccaacccccgauaggccccgguguguguuguuccccuccuuguguccaacucccacuuaugagugagaacaugcaguguuuguuuuucuguuccuguguuaguuugcugagaaugguggcuucuagcugcauccaugucccuguaaaggacaugaucucauuccuuuuuuuuuuuaguuuguuuuguuuugaggcggagucucacucuguugcccaggcuggaaugcaguggugccaucuuggcucacugcaaccucuaccuccuggguucaagugacucuccugccucagccucccaaguagcugggauuacaggcuaauuuuuguauuuuuaguagagacaggguuucaccauguuggccaggcuggucucaaacaccugaccucaggugauccacccaccucggccucccaaagugcugggauuacagacuugagccaccacacccagccaaucucucucuuuuuuuuuuuaauggcugcacuaguucaccacucuuaaauuuugccuuccacuaaauucuaggacauggacauaacacggucaaguucuuugccacuuuguaacaaagauggccuuuccuccaguuuggaaauuguuucccauuuccaucugaggccucaucagaauagucuucacuguccauauuuuuaccagcauucuggucaugaucacuuagguaaucauuaagagagaagcuuucccuauauagcucuucuuuucugauccuuuaguguaguagaaucacccuuaauacuccauucacaccaauguaaguuuuuccaucauucacuucaaaaccguuccagccucuauccauuacccaauuucaaagcugcuuccagcugggcgcgguggcucacgccuguaauuccagcacuuugggaggccgaggcagguggaucacgaggugaagaguuugagacuagccugaccaacauggugaaaccccaucucuacuaaaaauacaaaaauuagccggucgugguggcgugcgccuguaaucccaguuacuaaggaggcugaggcaggagaauggcuugaacccaggagguggagguugcagugagccaagaucacgccacugcacuccagccugggcgacagagcaagacugucucaaaaaaaaaaaaaaaaaagccacuuccacuaagaccaaaacaaugcaauucuccacaaucucuuccagaagacagaagcagaggacauacuuccuaacuuauucuauaaguccagcauuacucuaauaccaaaaccagacaaagacauuauaugaaaacucagacuaauaucucucaugaacacagaugcaaaaauccacaaaauauuagcaaaucaaguccaauaauguauaaaaagaauuaggcaccaucugggauuuaucccagauaugcaaggcugauucaacauuugaaaaucaauuaauauaaccugucacauuaacagucuaaaaaggaaaaaucacaugaucauaucaauaaaugcagaaaaagcauacaacaaaaccccacacccauucauuaaacucucaucaacuaggaauagagguaaacuuccucaauuugauuaaaaaacagguacaaaaacccuauagcuaacauauuuaaugucaaacuuacuaaaucagaguguuaucauugcaugguggaaacucagguugcuaugcaggggugaagguauuucaucagaaagaaaaauaacucagacuccagaauuguuucuaaucauccaacaaucauauauuguucacuauucuaggaguuguaacacuucucaguauguucaggagaaaugacaggaguaacugucucauugcuaaauaauugugcacaguggggaguacagugucuugaucauuaauuccacaaagcugcuaugagcagaggcacgauggucauguugacaugaaccagggagucuuaaaaggguagaugguugggaaaaaagcgaggguaugacgacaggcauaaucagagaacucaaaagugaugucaaaguuaggaacuuugaacugaggaucucaaaucacaguaacggauaagauugcuaagguagugacucuccaagagguucauaguaauacuaagcuguuauuuguucauguuucccucguucugucaugaauguacaauggagcuuuccagaggcuacauuaucacaccagacugaauguagaagcacauaagagaauucugcuauuaagccggacauuaaagauagaguauuugcaaaaauguuaaauaaugccacucuuuucaugcuuuuuguuuuggaaauuauagguauuuucccauaaaaauaugguauuaauauuaacaaguauugggguuauuaucgcuaauaauaaaaaaauuaaaauaaauauuuuuaaauguuuccauuuugaucugauaaaauacauuuuaggccaggugcaguagcucaugccuauaaucccagaacuuugggagguugaggcaggaggauugcuuuagcccaggaguucaagaccagccugggcaacauagugagaccccgucacuaaaaaaaauuuuuuuuaauuauuuaggcaugguggugcauaccuguagucccagcuaaucgggagacugaggagggaagauggcuugagcccaggaguucagggcaagccaugaucgugccacuacacuccagcuugggcaagagagcaaggcccugucucaaaaaauaaaaauaaauuaaaaucuuauauuuuagagcaguuuuuagauuuacagaaaaauugcaaagauaguacaaagugcccauauaucccaguuuucccgauuacaaacaucuuucuuacacuacaaauguaugguacaguugucacaacaguggaccaauacuaauauauuauuauuaauuaaaguccauacuuuguucagaacgccucaguuuuuccccaguguccucuuccuuuuccaggauccuauccaaguuauaauauuacauuuacuugucgugucuccuuaggcgccucuuggcugugacaguugcucagacuuuccuuguuuuucaugaccuugacaguuuuaaggaguacuagucagguauuuuguagaaugucccccugguggaauuuaccagguguuuuuuucuugauuagaccgggguaauggggaggaggaccacagagggaaaguguuguuuuaucgcaucauaucaagaguacauacuaucaaccugacacugguauguugaccuugaucacccagugagguuguauuugucagcuuucuccacugugaaguugcuuuuccccuccacacucccugucuguacaauacucuuggaaaaaggucacgaugcauagcccacacuuaaguaguagggaguuguaugucaccuccuucagggcagaauacccacauacauuauuugggauucuguauaggaaauuugucucuucuccuccauuuauuuauucauucaaucauuuauuuguaucagcauggacucauggguauuuaauuuuaugcuuuggguuacaaucgaaaacuguuuuguuuuguugcccaaauuguccagcuuuggccacugggaacuuuucaguuggcuccugaguuuauguuaauuuuuaauauggauagcuauuacccacauaaacaaaagcucuuugggguccuugauaauuugugaguguaaagagguccugagaccaaaauguuugagaaccaccgcucuagggauccucuggcugacccgaauccccggugugugugcgcgcuucgucugcagguaggaguuguggucuggacagaagcaaaguaggccacacucgccugcccuugggaacacccacuucuccgugccacgcccgcuccuaagguuuucuucgggcagaaacgcggggauccccaagaagacgaagcucaggcugccaugccuuucccgcgaacgccacggcgcggcgcccgguucacagggcgagucgcccacccgcgagucggaaagcgcccggaaucuuggcuaaagcucagcguucuccuccggggcuggggcccuggccaggccuggccugagcggucuccccucacucugcggcucgcucucccgggcuacuccggcgcgcaggugcugcgcccgcgggagagagcgauccugcggccguggcggacgccgggaggagccaccgggcucuccucucaggagcgcguccccgugcccuccagcugcccgucccugcugaaagcauccggacagcuccccgggccgcggcccuggggcccgccagagcccugcccugcaccccgcucuccccucucuggcccggagggcugcgccgggcagauccuuuccucugcaagacagagacaagcagcgauaaacagcuaaagcuggagacccggcuaaaugauacaauaaguucucuaauugccucgaaaauaagguaaugauuuggcagagggaaugcuuugaucuuaucaggcaagagagaccucuccaaaggaaaccucagagaagggcuggaggccucggacuugggggugugaagcccaaggacagccugcuuuccccgcccucccccgacccugcguguccacgguccccagccucacccuccggcuuuucauggaaagacccuucuccugugaugacuggaggagaguacacacacauaacacagggguuaggagaggaggaggggguggguucuggguuuuucaggaacaggaggacggcugaaaugacuggugcaguuuuagagaggcuauagagaaggaaauugggggagaggggauugcggacagggauuauggaaaaccugacuuggcucaagucugaugauguuucuuacacagugagggcugcugauuugagcuuuucaggcaggagggagugacaaagggaggagaacuuugaguguccugccuucuccaagaaucugcacacacacucacacacacaccauugcucugcgcugugggugucccugccuggcagaggccccagcacaaagaggauuagagagaugagcuaaucugguuuguaucccagacauggccccagaaagggaccuuguccacccugauauguaaggaugugaaggagugaggagucuuucuuugggggccugcuggcuaacaguaccagagaccccacuccacuggagucccugggauacugcaguccugacuucagggucagauuuaggaagcagaaagacggucggucccacagaaggaacuagaucucuacccuacuuguuucaccaguggggaaacugaggccugaagugggaaagugauuuacagagucaugccaauagugcauggcugaguugggggaaaaaacccucagguuuucugacuuuuuacugguccagugcucccugcacuguguugcaggagcugcaagggagagguaugagacagagagagggcaagagaaagagagagacgaagacagaagcaaacauacacaccaaggaaaauagaggugcgcacacacccacaugcacagagagacggagaaagccacagagagucagaaacaacauggagagacagauggagagagugaagaaagagcaagacaaacggucauacagauucauacagagagauacacacggagagacagggagugacacaaucugacagggagacaggcaagagacagggauucagaaagagaaggacagagacauucagacagggagggggaggcaggccaacuuagacacauagagagacaaaugaagacagggagauaaacacaagagacagaugcaaauagacagagaaugacagaaacaagagccagagagagacccagggagauggagacucagagaagagacauggggagaguaugagaacaagaggcagcgugaacugaggaaggcagagugggagggaggcaggccaugcccucugcagauauuuguccauuggaaacaacucucacuuccagaucauucuagggcccagaacaggugguagggagagaaagagggcuuagugcuuagccugugugauacaggcagacugggaacccucccuuggggagaggcuggucaguugaccacccaggaucccagcagcacacccacuggccucacacagaaccugggccacccgcccggaauggccgucagcccgcccacugccuggcuccagucugauuacagccaaagugccaaaaggcuccagacacccccauucccugcccccaucgucucaccuccccacgccuccucuccuccuuccccuucuccuuuacaucccucucuuccuuucuuccuaguccucaggggagcaguuugugccccuguuuagccacuagcugggaggaaagggguucuccuccaucaagcccccuuuccugguuuggagcuggaugcuccuucccuccaaagcccuuuuggucuggccucuuugagacacguuccacgccucgccuaagagcucauaaauaccaaggagaggccggccaggcuguguacaaagcguggauccccacucuuuuccccccuuaacagcuccuggguucuucccaagcuuccuuuacuuccccagacaccugcaugggguggcagggcaagaggugaggcauuaguuaccugugugaaccuggcccuauuucaaauaagaccugccucgguuugcaaagaaaucucaggaaaggcgucucagggccccuugugcaagcagcaggcucaggaauuccuugacucccauccaaaccuccccccagccccuucuuggccuuucucucugcucauuaccauccacaccaccucccacccaccgggaaaaagagaaggucaucgccaaaggggcccagggaaggggagccuucuggaggauagagcagggugggguaagagcuguuuacccacaccccagcuccccuuagcucaucuccccucccauccaagggccagcaaaaauucaaaaucauucagccacgcauagcugagaacagagugaaaagaaaucuuaacucugucccaccagagagcagagcauaaggugacaucaagggugacaguggacccuucuucuuugggcacccacuuuugagaggacaggaggaggcucuagugccacuauggggaagaggguggaccugacucugcuggcuggguggaagcuguccugcuggaggccccagguaaucuggcagcuuucaggggaccugggauucuuccucaggucucuacugauacuguucacuaugucugcagcaugcacccuugaacuucagcagagccuagugugccacccacagacgguuuuauuauauuuccaugaaaaugccuugggaguaaugccuuuugcuccuuguuauuuaggauacccuggccaguguugggcacacagcaggugcucaguaagugcugacuugacuccaugcaggguucuacagaccagaacuuaacucugagaucagugacuccucccucuggcucccagaacugagagugagaguguggaauaaaaugaagaugcaggucaggagcuagcuugagccucuggccuugacccucugccuggcagccccacaacaagccuuugcgugaggagcugagcucuccaguagugucuaggaccuugagacuggaaguuuauuuugagauuugaagcuccaaagaggcagaucccagaaaaccucuucucuggcuccauauuuguucucuaguuaagugguugagugcagcucuugcagucagcuggcuccugcagccugggauuccucccggggaacuggggacucagaggagaggggacaaagaagcagaaggagccaagccucauccuagguuguccacucugggggcagaggugacuuguaaaccuuagagagaagucuaguccccucacccacuuccuucccucucagagcugcugauguuucuggcuguaccccccucaccccucccuucagcucagaaacaugcuuuaaaauuuuuuuuauuucuauuuauuuauuuugagacagggucucacucuguugcccaggcugggugcaguggugcauucaugccucacugcagccuugacuuccugggcguaaacaauccuguugccucagccucucaaguagcugggaccacaggugugcaugaccacaccuggcuaauuuaaaaaauuuuuugggucucaccguauugaccaggcuagucucuaacuccugugcucaagccauccucccaacucggccucccaaugugcugggauuacaggcguaagccaccaagccugggccucaaaaacaugcuuuaauacuugagcaucuguguugugccaagacacagucccacuugacuguaaagacagcucaggccaaagaaggggccucagaagugauuugggggcccaugugggcgaguccacucuagguuagggcugaugugaucaucuucagccaacuuucccccucccugcgcuuuccaccaaccccaggcccuguguagaaauaaacacagggccagagucacacccaggucuaaacacacaggggagucugggagaggcugcuggagcuccaagacugcccuguguagggauggggcuggguugggaggagguaaaagagugguccaaggaaagaggcccagccaagaaggagccugggcucauuccucucccaccugccccucucaggaaaacuaagcacagagucugugccuuucuaaggaaauagccaggccaacuggagcccacccgacaaaaagaaagggagagaaggggaagaaaauaaguuagccuguuggccacaaaggauauggucccaguuucugugccaggaagucggcccugagaagugucuguauucaguccucuccaacucccauccaacuccagcccagcccccacuuuccacccaaguggggagcacugccucccauucaugacuuggagcaccucagggacucaucugaauucucuuccuccacgcacuccgcuccagcuggauggccuucucgauaacccucguacaccagcccacuccugccuuugggucccuguacgggcucugcccucggcuuaggaugcucuucaccaggaagcugccuggcuugauuccuugccuccuucaaaucucugcuugcaugucaccuuaaugaggccuacccugaucauccuaguugcaacuguaaccauccccuugacugugcucucuuuaccacugcacuuacuacuuuuuaacauacucuguuuuacuucugauguuuauuguuuauggucuauccuccugcaauagaaggcaaacuccaugagggcauagacuguucaccaaugggucccuagugccuagcacaguccuggcaugugguaggaaauaaguauuuguugaauuaaugaaugcacucaucaccuuaccacagaaaguggggguaaaggagugucacuguagguuggggacaggagggaagugcuugcagccccuucccacucugcccgcccacagaaguuggggcugcggagugaggggcgcuaggacccggaggcgguggggagagagguuaaagguuccucugaaaccuucuccacuaucucugucucugagaugucugcagccagcugcaccccaucugcuuacacucgggaggcaccucuaacgccaccaccgccccccacccccaaccaaagacugacagugaauuuggaguugggggcaucggcaguuacuaguaaguuguuuaccccaggacuuuaaaaucauaugaggaggcaggaaagacaccugcgaggugggagaaacugaggcugaagaagcgacuggagccagaucccaggugaacucugaacucucgaaguuaagcccaggauuuuaaaaagaauuuuacuucugacggagggccacagugcccgcagggcccguaccugcuauccugggagguuugaggguuggggugguggggagaggagagucucuuucggcagacugcaccuccccaccccuucccuauuuaccacgcccccaggcgcugugcgggcggagggagggugaaggagcaguggggaggaggcagggcgagaagacgaaggagggaaaaagcuccagggcuuccacucucucggcaggacccccacccuggccucuggugcgggaaaaccucccagcuguuucugauucuuucauacucucagccccgcccgagaggguggaggaccgaggcacagagggggagcggggagagacugagcuccgcugagcccaggaguaaggggcggggaguccgcaggugcccccuuagcgucggcagucgauucccgguccguaaagaaaagcacccgggccgggcaggccgggcaagcaggagccaggucuaaacgugaugcauuggggguggggggugcaguggcucagaagaagcaggggcgaugagcucuagcugaaagcauccccugcuagaagccgacugcccacggcgcuccuguaggcaguguugaaaagguaguuaagaccuccaacucccgguggcagggacucuacccauuucacagaagcgcaaggauggaggaaaugagugcauccuccgugcucagcgccggugucacuguagguuggggacaggagggaagugcccgcauccccuucccgcuccgccagccuggccgucacccauagaaguggggcugcugagugaagggcgcuaggacccgguggcgcggugucggcagggacugggcgcuuggggcgcaggagggagccgcggcgucccgucgcagcgugcgggagcaggugggggugcagcgcgguggcgcgcgggagccccgaggggcggaggcggcugcuacaccuagggcgucgcggagcgccccgggcuuggcgcgggcggagccgcccuaagggccgcgcguguccccggccucggccccgccccgucccguccaaugagagcccgcggccgaaggggcuguccgcacacuaggcccgcagcucccuucagcgccgcagacccccugacaccgcacccgguccucaggcagcgcgccccagaccccggguucggcacgccgucgucggcuuccggacaucgcaacuugcgccccucucggggauccuccucccgggcucuggaccccaggugauccuagguccccagccgccggcgaacaccauggccccccaggggggugagguaggagcagccugaguacccccagaaggugccccguccacgccccuccgggcugcgcggcgggagucuucggggagcuaugcugagaccggguggugcggaggaagcugcgcagcucccgcuucggcgcgccagcgccccggucccugugccgucgcccgcggcccccgacggcucccgggcuucggcccgccuaggucuugccugccuucugcuccugcugcugcugacgcugccggcccgcguagacacguccuggugguaaguguggcucucaggcugggcgggugaggcgcuugguaggagaggccggaggcgccuggagggacuggcugcucacgggaccaggcuguugcuucgacggguuggagacgauucgggcaggacugucacugaaaucugaagucgcgggguggcgggagggugaggcgccgcgucuuacacgacuggugagaaaggcgcugggcauucggagcaaggaugcccgguggucgcggcuccuuaggccuccacgugcuguacccccucuauuucagcucaagccccuuagggcagaagcuaccuuccgaguuucccucagggugaguucaaggaacgaauaaccuuccagggcccgcaauagcuucgccagggccccaaucgccuaaggucgcccucugagagguggagaaaggggcagcucgcuagucuagcccacccauaccacaggaaggcuuuggugaggcagcagcacccagccgaggcuuagaaauggaaucgaggcaaaauuuaccccauuaacucccacaauuaaaacaaacaaaacgcauggguuugcauuaucuaggcauuugucuucagccaccguuuugaggaugucacuuaggaaacuuugccucccucccuucuuccuauucuuucccaucucccauuucuccccuccaagagccagagggcugcggagucccaagauacuaagagacccccuccccagauuucuugcaggcccuagacuccagacacuucacaagagggcagaugaggcaaaaaggcauuacagauccacuggaugucucgugucuguucuuuuuagaauccucccugcccccuacuccuuggauggcacucaucaccuucccguaggagaaggagcugcuuucccuucuuccccaccauggggagagggcaaagcagggagaguugaaccuagaaaagacucagucuuuccucuucaccccacaaucaaacuggccucuuggacuaggcuauugccccucuccaccaggcagugccucccguccuuuccuuacuccguucuucuucccgugcaagccccccuccccgaaauguggucucuucucuccuugcacccuguggcuuuucuccucuugacuuggaaucuuggcugaagggugagggguagcuggccgaggggcccgccagcuugggcugcagauuccuaucauuucaagaugccgucucuccuuaucccaacccccacccccuguuuuccuguuucagaaaaaucucuuuugaauuuuuuuuuuuuaaaucucugcaguguuggggaaggcaaggaggggggguucugguugggggaacagagaggccuauaucuuacaucuggcuugaaacauucuuuuagaaagggaaaggggagaagggggaugaggagaaaaaccuuucaaaguucugagugagaucaaagcuaccuuuugccuucaugagcuuggucuggcuggggacuuggcaucuucagggucuuuguugagacaacaugaaguaaccgcugcccaucuuuaucuggcucagacagcaguuugcuuuuugggacucuugauugcuucuuaccaguuugggauauagucuuggggaccaauugguguuugggugaggaagugucacucugguaauuucagcauccuggcagugguuccuaaagacccaaaugggggucuuccuaguucccauuuuguacucuugacuacucccucucccuuuuccuuucucccucuacuacccuccccugaugugguucauauuaaagauucuggaaaaauuccugggugaaagagcuagggagggagggagggagggaggugacacagagugacuuagcagccccugugaaaaggaggaaggcugcaacagggccagguugggaaguggguacagagguuguuucagccuccuugcuccacaccugucauagcuacaggcccagaugccugccucagugaucaccacuugugggauaaggugaaaagcuaccuucuaagggcaggcuaagcccccaagccuuucucuuaggaaaaaaccagcaagauugauguucuguacaacccguggaagagaaaugccuguugacucugguguguccauguuccacucuggagcagaaggccaucauuuucaccaguuaauauuuggauuuuucucauagcuugagauucuuccccuuacucucuaaccacugcccucccucuaucuauccuaaacagaccaagaaauagggagcuuccggcaugugcuuuccuguuucauuuugcauucuguaggggguuggauguagggaaucacaagaacaggauuguauucauaggcucacaaagggagagaaacacaaagugguaucauauuguuagcacuacuuuuaccaacagcaguugcuuuuaauaagcccuuacugagcuucaggcacuauggccaaacaccuuaugagcaugaucuuugucaaucugaaauaauccagugagauggguucuauuaucauccuuauuucacaaaugaaagugagggaugcuguggcauuaagagcagauucauggaggcuaauaguguuaucucuguguucaaaguucuauaugugcugggcugaaucauguacacuaggggcuguacacgaaaggaggaaagaaaaaaaaaaagcagaucccuggcccguuugugucuuuaacauacaaacauaaaacaucugcagauaggcuggcaacuguugacaaguaaagcuguaauggaaaugggaguuaauggcuggcuagagggagaagggaguuggggauaaaucagaacaguuagguguuuauucaacaaauagugauugcauaccuacuaugugccaggcacuguucucaguacuggggauauugaauugaacaaaaccgacaaaaaucccugccuuuguggaguggugcauccaaaccaugugaggaucauggugaaaugcagauucuguuacgguaggccuuggguggggccugaaugucugcauuucuaacgaauccccacaugauacagauacugcuguucuggggaccacacuuugaguagcaaggggcuagaguaguguaugccucacuuugucaaaugaagggaugugaauuggccaaaagcaggugaagagaagcauucuggggcaggaagcugggaaggaagugaagaacuuccagaagggaaaaacaaagcuagagucagggcaucuaacacucuaccagaccgugaggugggagaugccuuaaauaucuuugugucccugacaucugagcucagugcuuggcacaugguagacauuuugcaggcauguguugaacugagaggaagaugugguuagccucaggcucagcuuuauuggaggcucccuacacuaacuacaaggggcugacuacuggagagcaagcaagcgccaugcucuguggagucuugaagccauuacuuaguggaguaagggugguaauagagacauuuaauuaucuucccaucuuagauacugaacagauguucccacacucagugaggauguaauaaaaaggaccuaugugggcugcagcagaauggauuuaagucagaccacaagaaggacuuguugcccgaguuuggccugccccacuccagacugucucacgagggcuggguuauuggucucucauucccauccaacccuccucacccaagccccauuaaaaaaaaacaaaaaaacacacccauugccuagagcaguacuugggcugaacuagggaagcugaacgguggugagacagggacaagcuccaacuccaacggucuugauucuccaaacaaagcaccacagcaguggguguaacucugggcugugcgucaggcagccuuuccggccuggcccugucugggguguuuauuuuguuuguuccuggaagcuguugcccugauggacagugcuggggaugcugauuccaugggauuuguuaggggagggccagcccucucaccccuuccccgggacagaugggccccaucagcccugcugaguucccgaagaggcaagcaucagcccuccuuguguuuguuugaguuggugucaccaguggugauccagucugugggugagggccggcugugggaaugcaggggggugguggggggggacacagagcccagggcagucuagcuuuuccccuccccacaccagcugcccucccuucuccucacccacuucuaggcccauuuuggggccguucccaaaccacaggcucauucauagcucaaaccaagucuuuucugucugcaguaacaauugcucuccauggccccaccuguucaaaacaggggagggagggcagcccuuugaugcguucuggacaggagaauaaaaaguucccagcaaaucaaggaaggugcuaugggguuaaagggagagaaagagaaugacaaguggagcugggcuguugagcuggaggaagugggugaaugggucagaucucauuugguggccucuuggggaagaagggugauauacuccuguuuucucucugaaauauucuuccugaggcuuguggugggauccaggguuaaaacugagugaagagaaaauauugccuugagaaacaauaaugacucuggcaacccaccuauucuuuaguagcccaucucaauugaccuucuuuuaauuguucauauuggacagacuggagacugcaguguggggagagucauccucuuacuuaucuuggccuuuggcuucccacugcagacagcccuugcagguccauccagguuggggaagaugguuuuaaaagguucauuaguuaagaaaggcccuggggccuggaaauaaaggguuugaggaggagaguagaggguggggucuuccuccccggaccucacgauugggaaugaggauuuuuuuuagcuacacgggucugacuagagcuguaaacguuacucagauugcucacuaugucucuucccacgagccccucccugucaccaccccccugcugucaaaccauaucuucguggaccagccaugcgggacaucccucuuaaugggagcauaagaguguugucucagacccuuauuuuguuaguuuauguuuccaugaagcucuuaauguuuauuaaauaaacagacaaugaguuugugugacaugcccacagcuucuguguaugugacacaugccuagccuguguucugggaguguaugucacuuuggccuuuggcuggggaacuggugauggugggaggccacucaauuacucucucugcaacuguauaacuauuaauacuucuucagaacugugggaaaugguucuacucaucagcuuuauggaauguggguuagggagaggggacagaaucucuucaaggucuggaugcuaaacguaccccuuccuuauucccucccaaugcagaaaaaggucugggauguucugacagggccaucucugccuugcagguacauuggggcacugggggcacgagugaucugugacaauaucccugguuuggugagccggcagcggcagcugugccagcguuacccagacaucaugcguucagugggcgagggugcccgagaauggauccgagagugucagcaccaauuccgccaccaccgcuggaacuguaccacccuggaccgggaccacaccgucuuuggccgugucaugcucagaaguaagagccucuuccauccugugucagcuccuucccuuucugugcuggggguggugagugggaagaguaggcaagaucuccccucuccucucccacacacuguuucaucaucagagaaagaacugugggcagagcccaggauauaauugggaacagacucuuagcaucuuagauuuguagacaggggcuccucuaaaucuuagugcucugggacaagaccaagguaaagcauucccuagaaccuccaucuuucucccucauuuuccuuguccuccccaauccccagcuugggaggcuaccauguacuguaaggcugaggucuaugauaggcccucuguucuuaacaccaccaucacuaucgucaccccaacacucccaacacuacaguaaugggaacaaaagauaaacagaaaggugauauguaaauauuuggagagucaguggcuuggccucagcucagcaaaaaagcuaaauagagcuagacaguaaacuaggagaaagggaacaagaugggaaucuggaggugucaggcauacaggggcgauaauucaucagucuccaagagcagggagggagagcaagcaggcaagggaggguagcauggaucucuaaacaggcugaccccugggcuggggucuccauugugggggaacuguccagcagagugggccugaaaaggccuggaauguggacuaaggcaggcuuagcugagccagugcuggcacucagugggaggggaugauucaccaggagacuuuucaauggauggacacagggaauuuggcaggaaacaagaguauaggucagcucaaaaggucagauauacaaagaaguggauagagaguagugagggcugaggggaagaggucagauacucuggggaaugcucuuggaaaugaaaggcaccuugaauaaaggggguguaggggugacucugggaaagaaaauuagggaagagguuucagagucagagguuguaugggcugaagaaggggacagacaugggccucuuuccugaagcacaccucuacaauucucucucuagguagccgagaggcagcuuuuguauaugccaucucaucagcagggguaguccacgcuauuacucgcgccuguagccagggugaacugagugugugcagcugugaccccuacacccguggccgacaccaugaccagcguggggacuuugacugggguggcugcagugacaacauccacuacgguguccguuuugccaaggccuucguggaugccaaggagaagaggcuuaaggaugcccgggcccucaugaacuuacauaauaaccgcuguggucgcacggucaguacucaugucuguguaaguacacucauauuugcugggggugaccagugugugugaccauggacuaaauaaaugugaagauggaagagcugaaggcuucugggucacuuccaaaagccccaacauccugggacaggagaacuaaaugcaagggagcuuaggaaugccuagggucaaucaggugcgugaagagucuucacauagguggaaaguaggaaaagguggagaaaagaaguaacuuuuuaagaaggaaaagaacugccuucauaaagacugagaggauaagagguuguucuagucaguucccugguauuugaacaucuucuaugugccuaguacuaugcuggaaaauggcacaccacuaaaguagaaggcaugguaccuggcacucuaaaacgugaaaaguagaggaugugcaagcacacugucaucgugaacagaauccuguggcucuacaguucagugggcugucaugaaaaggaaagcacuguugguucaggcagauuuccuggaaaaagaguuucuugaacuugaucaggaagaaugggugggaucugaugugggagagaaccgagagcucaaucggccagccagggccagguccagccuaucucagagcacucauccuuuuggaccuagggaugacuaaaauguguccugaccagcuacuucucccuuaacugccuucccccucccccaggcugugcggcgguuucugaagcuggaguguaagugccauggcgugagugguuccuguacucugcgcaccugcuggcgugcacucucagauuuccgccgcacaggugauuaccugcggcgacgcuaugauggggcugugcaggugauggccacccaagauggugccaacuucaccgcagcccgccaaggcuaucgccgugccacccggacugaucuugucuacuuugacaacucuccagauuacugugucuuggacaaggcugcaggugaguaaggaaggcaggcagggacaugcagucccaguucuuagugcaggcaccccugguuaaucauggucuguucagucucaggaguuagggaagggggugcugugggaggaggcaguuuccucuccacaugaacaccuggucaugagauuguugcaguccaccaggcccagugcugcccaaguagagaggaggucacucagcuccuugaggccugaggucaugcaucgcuccuuuguaucccagcaucugggauacaguaggcauuauucaggguauguuuaacuuaguuaccuguuuucaguuuuaagcaaugugugggcugcacagaaacauaagaugcagcccuaagccuuuggcucuucgcaaucuacuuaaagaaaugagacauaauggguagacaaaugcaaagagagauggagaaaucaauaaaguuuauuugaaaauguagggaaaaaaaagaaacuagaauuuaagcugcuccuugaaguguagggaguaucuggauagcuugagagacgagugggcaauuucuuaucagagaguaguaggugggaaagcacaugaucugucccagggacagagaacagaccaaucugcuggguaaagguucucucuaagggagauuaaagcuagaaagauguccuugaaaggcuuuauccagugugcugccauugaagauucugaaacagcugaaaaagaaacgaagaagagaucccuaccaaaggcagguaaagcagcaaaugguuguuuuucagucuguucgagguauuuguggugggauucuuggaggugcuggaaguugauaugguuuuuccccaagggaaugaaaguuaccauccuggcucacauuucugguucagauagguuaaacuaggaacaugcaaugcagcagaacucuucuccucugguuauugcuguggggcucccaggcucuuuucuacaggcucagcgucaggacuugggugaaguggagccaaaaaaccucagcuaucuucgguacuguuuguuuucacccaucacugucauuccuggaagagucaaguggcuuggaguaaaacugggcacagaaaaaggguggggcucuacccaauuaaugaagaaaguagucuguauacuuuguagggugcuagaagaaaaaaacuuggagcccuucugauuuuccuagugauuuccugccacuaaguauacuuuccucccacuuggucuaauucagagggucacucucuggauaccuagaaauaauuccauaacaucugagguguaaaccuauacuaccauacugaaaauacaccuuuagggaaggaacuuuggaguuaggagggaggauaagucaaauguguguucguuuuucucagaggcauaaaauuaggccuccuaaaacccaaagugggcccuggaauucaaagaauauaagucaucccagaaagaauauggagccaggaauucccuccaaagcaauagaguccaauugaacuuucugugaugauagaaauguuuuccuaucucuguuguccaauacaguagcaacuagccacaugugauuacugaguacuuggaauauaacuagugugacugaggagcuaaauuuuuuaguuuaauuuucauuaauuuagauguaaaagaccauaugugacuaguggcugcuacccuggacagcacagcuccacaguguagaagggguuuuuggugcccaagaggacuuaagacccagcccuuggaguuaggagacuaacauauacaguagaccuagucaguccacauuccagaccaguggucuccuaacauucuggauccuuuacuccuaucauuaaaacaauuugagcauauaucuccauuauauguauauuuauuuauaccuguguuccacuauaugaauauguauauuauaaaacguaaauauuuuaaauugaugagauaaaaaacauagaaguucuagcauuuuccucccguaucccagugacauuuggagacuaauucuguagaaaucaguuaaucuauucuccguuuugaaccuaggcuagucaguuucccaucucuggauucuuauuaaccauggaaaagcuuggaguagaugcucucaugggcccaacucauccaaaagucuauugauuuuaugaucuguuggcaggaucucuuuugcuaaaaucagucagaaugagguucuaagcauucccuaugcauggggaaaacaugaucccuauccuagaguuuccacuguaaggggaagggauaaugcuuagggauaauagcaauaauaauaaugcaagggauauuacuuaggaauuccuuaggaauaugccuccagccagucaugguaaucaguucaccucuucagaugaacagagauuauaucuaacaaucuauuauugugcuuauuuucauaugagaaacuaaguuaauguuucauuuugacuaaaucacacaacuaagagugguagaacugggauuugaauccagacaagaugaugucagagcccaugcuucuuuuuuuuuuuuuuuuuuuuggagacagaguuucacugucacccaggcuagagugcaguggugcaaucuuggcucacugcagccucgaccucccagccucguguuacuuucaccucagccuccugaguaucuaggacuacaggcucaugcccauggcaccuggcuaauuuuuuaaguuuuuguagagacagggcuugcuauguuucccaggcuggucuugaauuccuggacucaaggauuccuucugccuuggccuuccaaaaugcugggaugauaggcaugagugagccacugugcccagcccaaaaaagcgauucuuuuuaucuuccuucugagaaugugguuaaggguauccagggcagcugaagagauaacuuuguucucacucccucucuuccccaacccagguucccuaggcacugcaggccgugucugcagcaagacaucaaaaggaacagacgguugugaaaucaugugcuguggccgaggguacgacacaacucgagucacccguguuacccagugugagugcaaauuccacuggugcugugcuguacggugcaaggaaugcagaaauacuguggacguccauacuugcaaagcccccaagaaggcagaguggcuggaccaaaccugaacacacagauaccucacucaucccuccaauucaagccucucaacucaaaagcacaagauccuugcaugcacaccuuccuccacccuccacccugggcugcuaccgcuucuauuuaaggauguagagaguaauccauagggaccaugguguccuggcugguuccuuagcccugggaaggaguugucaggggauauaagaaacugagcaagcucccugauuucccgcucuggagauuugaagggagaguagaagagauagggggucuuuagagugaaaugaguugcacuaaaguacguaguugaggcuccuuuuuucuuuccuuugcaccagcuucccgauacuucuuggugugcaagaggaaggguaccuguagagagcuucuuuuuguuucuaccuggccaaaguuagaugggacaaagaugaauggcaugucccuucucugaaguccguuugagcagaacuaccugguaccccgaaagaaaaucuuaggcuaccacauucuauuauugagagccugagauguuagccauaguggacaagguuccauucacaugcucauauguuuauaaacuguguuuuguagaagaaaaagaaucauaacaauacaaacacacauucauucucucuuuuucucucuaccauucucaaccuguauuggacagcacugccucuuuugcuuacuugcugccuguucaaacugagguggaaugcagugguucccaugcuuaacaaaucauuaaaacacccuagaacacuccuaggauagauuaauguaguaa

SEQ ID NO: 191329 - RNA, 64987 nt, Homo sapiens
ucuccuuuccccuccuuuauuuuuacuaaugaauuggccacugauacacaaaugguggguggacaggcucucauuucucaacuaguuuuauagaaauuaaauuaaaaauuauuccuguggaacaaugcucauugcccacuucugauucauuaggaaaacacauccuauuuugaagccaguguuuugaaagacaguugaaguuccauuucaaggacuaagcaucagaagcacuccuuaugaauucacacacacacacacauacacacacacacacacaaauugacaaggcagcacugcugacaggcuauuaagggaaaccggauaugcuaguauuuguugaaaugaucauuaauuugcuuaaaugcugaaaacuucagauauguaaacauccacacuauuugaacauuuuuuagacaucaaaggauuuucaagugcuucucucuggcuugcauuugcuaacauugcagcagcaacagcgcuggaguaguugaaaagggaugcauuaaucauuuguaaaaugagagagcagaacaagauuaugcuuucuuaagcagaaauacaugagccauggauggcuucagggucuuuggauccuaugaagccaucaaacaaauuuugcauauaggcauauucauuuuucuagggauaaacuccauggcuuuucuaagauucucaaaaagguccagaaccaccaaaagguuuaaaaaaucacagacuggauuauuguaaaggcuuuuuccagcucuaagacucuaaagaaaaucaaugucuuaguuccuuauggagucuaaccuggaugggucauugacuucauuuguuuugucaaagccacagucaagugcucccucuacaccacccccucuucccaacaaaauaugcccaaauugugccauuuuucacuuuguacaaacaagacuauuuccccccaaacagcaagauuuaacuuguuuuaaugcagucugcuauaaaaaugaagacuucugcaugguauauuuggcuuuacaaacguuaaugccuaguuaaugcuuguguuauaugguacacaucauuacaaucuguuggccaguaacagcuuuugcaacauggguuaauacuaaaauugugaaucauggaacuuuuacuuagcacacacacacacaaucuacagcaaacuuaaauacuaaucuauaauaccuaacuggguuauuggauccauugcaagauugugcuuauuuaucucagaagguaggcaacuagcaaaaauacacauuucuuucgcauauccccacccccauauuacacuguaaaagaaauacauuauucagugcacuuccuaagaaauaaacuuccuuauaguaucucucucuauauauaucuaucccaaaacaaaggaagagcacaaugcaacuuuuaagauuaccauuuaaagcaaaagagacaauaacucucuggcacuguagccuccucuccaguuuagaaaguuuagcuauuuuaucaacacuauucguuuuggcucugcauaggaauaaaguucaaugcaugauugccuuggacaguuuaagauacccccuacaucauuuugauagacaccuuggggcauuaguagcauuuuuauuuuucauguauuugccuuuaucaaacuauaagcuguggaguugccaauauacuccauugugauuuauacacugauuuccaucaccugccuuuuuacuaucaacucuuauuagauuaaaaggaaauagacuuaaauuauagcaggaggucagggcugcuggauagauguuggcucagagaauguaugugaagacaccaaggccucuccuguauggacacaaaaucauauaaccacugugucugagcuggguuguggauagucuuauuuggcagagggggauagccauuauauucuaugaaccuugccagcuguacuggccuacacaguuggaaaguuuggaggcuuuuguccgcauagacuugcuaugaugaaaaugacagaaguuucuagaaugaaagagguugcaacuuggcagcuugcaagcuaaauccagcugcagacguguuuguuuaaccagcaccauuuaaacauuuuaaaaucacuucuugauauuuaaaaaugagaauguuucucaugaaaauuuggauuucaaaaaaugugaagaacugguaauccugguuuagcauucuugcaccgcagcaagcagauggagcugaacagaugcccuuuuuaaaugcggcuugggcacuuuaguuugccacagcucccacugcucccagcuguuuuacaucgcuugugugagaggccuguuucacucauuuauaugaccaguugaguuuugugacacugggguuaguuuagcucugccuauuuauuuuuuuaauagagauggggucucacuauguugaugaggcuggucuugaacaccuggucucaagagauccucccaucucagccucccaaagugauaagauuacaggcaugagccacugugccuggccagcucugccuuuuuaugauacugaagaucuaggcuucauuuggaauuuccucaccuuccuguggacaaaauuccuccuuugauugugucccagccacaucuaguugcuucgguagguaaucuuaaugugcaguucuacuuguccuuuaugcuauauugcaaacuccaaagauauaaucacacuaguauuuauguguuuaaguguguguauguuaaacauguaaagggguaauguaucuauacagauauauguauacuucccauuuaagcaaaaguuaauuugguuuuacagauacagauaccagguucuggcagcuuggagaauaaguguaacaauuugguaaaacuuguauaauucugacugaccuauaauauuacagagugaauuucaaguuauugcuuuuugauuacagaauaaaaaauucauucucuugcaaaacuuuuauacagaaugaguaaccauuuccuauucaaguaacagcaaucagaaucagaaguuccuuacacaacaguagaugcuugagacauuuuuugaauggagaugugauuucauucuguucaagaacuuaugcaggaaacugggagugacuuaauuuuucaaaaguacaagaaaaucagcaccccaacugcuuagugcucaggaggguuucucaagggcucuauaaagcucagcuuguggugaguucacacccaccuuuagaaggauucccauucuacuuaugcagccuuguuucagaacacaaagcuuguauuaaaacauuaaaagaggauuaaaagcaguguugguuuuuaacauucagaauucacagaggaucucauuuucuguaauuaaaugaucuauuuuguguuuuuugcugcagaaucacauucauauggcagucauauuucaggcacuuuuaaaacauguucaucuggaauaaaaaucugcaugaaccacuucugcauaauucaaaaugaguguugagugauucuaguucucaaauagauagcaaaucaccaccuggugauucgcuuucuucaucacaacaugacggugacugcugagcuugagacaucuuugaggugccuuucuggcuucaguaaaaagaugugagccauaaaaauccaaacuacucaguuucuacuuaaaaaaauacaaaauggugaaauauacuaaauguauuauacagaugguuucagcuacuaucaaaauaaauaacauaaucugacucagaagucugacugagcuuuuggacgaaaucugauggaaugucaaacguggagacucccuccuagggacuagcugcugguaggcaaaaguaacucaacauccuuaccauuugcuacaacaguauuggaagagcagcugcuggcaaggucuucugcaguggucaaagaggcugccugggaaugaguuuuggucaauggagugguagcagauggagaaggggugaggccagguuucuugggugggauggguggaggguuuccucucucagcucuggggaugguuggggacuugauuccuggagacagggggcucaggggacuggacacuuucccuggaguaggugaauggcuugugucaccucuuggauuggcaguguuggcuagauuucgauagucugugccaaagggagagcuguugggagagacuggcuugauuggcccuuguuggcuagugaaucuggagagcaccugagugacuguguuucgggccagcugcuuggcggcagaguugucuaugagggugggggauaaaucccuggauggagggcucuguaggccacuggcuuguugguccugaucugcuugggacugaaauuuguggcgagcugcauggaaccguugguugaucccuacuugguacgaugacugguagccagggcugcuagcugaugaccccaauaaacgcuuagugaguaccggcgaagagcaaggagaggauguuagagaggaggaggcagugcugcugggagacagugagcucccacuggaagagaggggacugggcauugggacuggagucucaauccccacaggacacccaccauucuccacugguuucucuugggccaaugccacagauuuuucccguggaggcaccugguuuucuacauuguugccugcagucagcucccugguaguuuguaucucugggucacaauggccauugguuuuugcauaugaguaagcaggaguggcaggaccaggcagcccaguguuugucaucuuggcuauguugcucccauggguucuuucugcuggaaaacucucuguuuggcaaaacacagacauuagcaugagaggcucaguugcugugccuuuggacacgguuacugguuucuucaauugcucauuagggcuacugugcuggugggaagccucuagguccuucacuaucuucuuuaaacuuuccauuucuucuuucaggguuuugguccgguucucuucucgguucaguuuugcucucaguuguucccuuucgaugucaaacucugauaacugcuucucuaccugggccucagucugcaagccucucuuucucucagcugccaacucuucuuccaguuuacucacccggcucuucuccuucuccaauuucaggcucagcucuccugccuucuguccuuccucggcugccuuguugguggcuuucuugcacucaagcacuagcauggaugagagcugcuuguggcgggagcgcuccucuuccagcugacuagagagcuucuucuguucuuuuucaaacuuuuucacuugggauuuuucaaauuccaacuagaaaaaaaaagaaaagagagacauacugacaaacugugaucaaguagacugucuucguuagcuguucucugguauacaggauuaacaugcacaucacagugcuuagaucaaguauuucugaaauuuuagaacaccuaacacaaaaaaugcacacacuaugauuuaaucuuucuuugaugauuugggaggcacuucuaguucccauacugucuugcagugauuagugggaauaugacguaucuuuguguuucacguauguggagagcaucagaaccaaucaaaacaagauaacagaaagcuguaucaaccacauuuugugaugaauguugcugaaaacaaacauuuuaaaguuucagcaauaauuuucuugggucucagaaacaaacacacacaaauaguugcauuugaaucauacuuuuuuuuggagacugaguuucacucuugucucccaggcuggagugcaauggugcaauauuggcucacugcaaccuccgccuucuggguucaagcgauucuccugccucagccucccggguagcugggaucagucaugcgccaccacacccgccuaauuuuguauuuuuaguagagacaggguuuuuccauguuggucaggcuggucucaaacuccugaccuuaggugauccacccaccucggccuccaaaagugcugggauuacaggcgugaaccacugugcccagccugaaucauauuuuuuacacaaauauagccuguuuuaauugucuucccaacccuauuugaggcagagacucugcgugagagggaaaggguugaagaaacucaguguuuuucaaacucugagauccauuaauggauggggaaacuaacugagccacgacuagaauuuuaaaaaaauauauaaacagaaaacaucaauguguacuguagcaguagggguuauauaugauuucaugagauuuuuguuucaggcguaacuguguaugucuacauauacuggguugugacauaaaaugucacuucuuacuggggguucuaagucaaaaguuugagagcuacaagcgcuaaguuaccauuccccaaagaguguucuacggaacaauaauaaucccacagugagggaucuaugccaauaaaagauuuuauaaaaccauggauuugcuaaacacagaauacccuaucuuguucuugaagacucacaaugugcuucugcauacuaaagauccuaacaaaguuagaaaccuguuuaacuuugcuuaauccaguaguuccuaaacuuauuugaccacaaagccccuuuucugaacaauaccaguuggcauccugcagaauaaucuuugggaaaugcuguuccaggcaaaugcuacugugaaucccucuaccuuaauuaccuguugagucagccucucucuuuccuucucuagcauguaggugacaucaucuccuucagccguauccugugcaugccgcugccuuucuuccucaaggucuaggaucaccuuuaaagaauuuuuuaaauuucauuuucaaauaucaaggagucacauuuauuaauacaaccaauaauaagugccaaaucaggcaccuuagauaguuccagagaucaaacaaacaaacgaauaaaugaaacccagcaagggcuaucaaggagcacacugccuuacagugaaagacaugaaagcucuguguuaaacaguaagauacuuacuuuacuugaaguauguagagaaugauaugcaaacagagagaagagagcaacuaauuagcuagagggguugaggaggugucgagaauuaacagaaauuccaagaaacugcaggcaguuugguguuacuaggggccagguguaggugauggagcaagacaggaccacagaaaccugaaagcugagauuuucuucucaauucucaaaucaccagaggcaccaaagaaggagccugaaauucaacauuucaaauaggugacauucuaagugugccuuguuuaacuaauaauauacauuuuuauauaguuagauaagagguggauagacucucuugacuuccuacugcauguaaaaaggcucaaauauagagaccuuaaauggagauuuuucauacgcccuuuuauuuaacuugccuaccccuauuucacuuacccuggugccaaaggauuaagcccaauuuuaaggagaagacaaauauauuuauuuuucgagacagggucuugcuuugucacccaggcuggacuguaguagugcaaucauggcucacugcugccuuggccucccgagcucaagagauucucccaccucucagccucccaaguagcugggacuacaggugugcgccaccacgcccagcugauuuuaguauuuuuuguagagaugggguuuugccaucuugcccaggcuggucuggaacuccugggcucaagugauccacccgccucagccucccaaaaugcugggauuacaggugugagccaucacacauggccaagaauacaaauuuaaagagacauuuuucacauaaucccaucuacaacugcaaauauucugauugcuuaguagcuucugcucaugcuucagaagugccuuggcccagaccuccaggguagagcacucuugucccaaaggccauuucuuagucuucucacuaaaaauuuuuaugagugaagagaguaaauuuucugggacaugaaaccugucuauaaaaauaaaaaugagcucaugccuguaaucccagcacuuuugggaggcagaggcaggaggauugcuugagcacaggaguuugagaccagccauuuauuucucccucucccucucccucccccacccccuuccuuccuuuugaggagacagggucuuacucucacccaagcugaaaugcaguggcaucaucucggcucacugcaaucuuugccuccuaggcucaagugauccucccaccucagccuccugagcagcugagacuacaggcauacaccacuauggccugcugauuuuuuguagaaauggggugucgccauguugcccaggcuggucucaaacaccuggacucaagugguccuucugccucagcuucccaaagugaugggauuacaggugugacccacugugcccaacccaaaaccccauuucuacaaaaaaguacaaaaauuagccaggcauggugaggugugcauguagucccagcuacucaggaggcugagguggaaggaucaccucagcccagggaggucgagguugcagugagccaugauuaugccguugcacuccagcccaggcaacggagugagacuuugucucaaaaaaaaaaaaagaggccaggagugguggcucaugccuguaaucucagcacuuugggaggccaaagcagguggaucaccugagguugggaguucgagaccagccugaccaacauggagaaacccugucucuacuaaaaauacaaaauuagccaggcaugguggcacaugccuguaaucccagcuacucgggaggcugaggcaggagaaucgcuugaacccaguaggcagagguuguggugagccaagauugugccauugcacuccagccugagcaacaagagugaaacucugucuaaaaaaaaaaaaaaaaaaaaaaaaaaagaagagacuggugcugugguguaugcuuguagucccagauacuagggaggcugagguggaucacuggagcccaagaguuccaggcuauagggugcuaugaucgcaccuguuaauagccacuguacucccgcccaggcaacacagcgagacccugucucucaaaauaaaugaaagaaaaaaaauuuggcacauuuccuuuuuuuaaucuaauuuuucaauuuaauagaaagacaugcuuuuggccaaaagugguaagucuuaucuucucccuuuugggaguccucaaaaauuacagaaauggaauaaaaagacuaaaaccccacaaaggagagagccucuagcagagaaaaaauuuuaauaauauuuugaagaagaaaagaggcuggaguugugguaacuacuuuacuuugaaggagggaagcuguuuugccuugcagagccccaaagagauggaaccuggagguggcagguacugcagaggagaggugaaauguagaauagaaaacaggagaacuggcucaaagccuguuuuuuuguuuguuuguuuuguguuuuuuuuuuuuuuuuugagacagucuugcucugucacccaagcuggauuacaguggugugaucucagcucacugcaaccuccaccuccugggcucaagcuauucuucugccucagccucccgaguagcugggauuacaggaacgccaccaugccuggcuaauuuuuguauuuuuagcagagaugggguuucaccauguuggcuggccuggccucgaacuccugaccucaagugaucugccugucuuggccucccaaagugcugggauuacaggcaugagucacugugucuggccuucaaagccuguauuuucagaauuauuugucccuucacccugauuccugcacacagaccaucagcaucuggccucugucacaucuacuauucccaaauccugagccugucacauucaagaaauagugugacaggcucaggauuugggaauaguagaugugacagagaaugguggugggaaaagaggauuaaauuuguucuggguaaggguuaaggagaggaaagggaggcgggguguaagauaacuaaaucugcaccuauauaaaagaaaguaauauaaaugucuaaaauugauaaagcaagagagaacagugcaguauuuagaaauauggagguuagcuaccaaagugaauggcuaaaagaaaaaacugguugccugugaauacuggggaggauggggaaugagaagagguggaauagaaaacuguuuuucauuguaagcacaaugaccauguaauuuauuauucaaaccagaacauuucugacagucaaagggaauaugguuaauaacuaagccaaggugacaggcauaagcugagacuaugagcacccuaauuauaagccucuagguacuguuugauuucuaacaaagucagucuucuacuuugauaaaccacuuaaacuugaaccugggagguggugguugcagugagccaagauuguaccacugcacuccagccugggugacagagugagacuucaccucaaaaaaaaaaaaaaaaagaauagauagguacuuuguuucaaaaauuuaauauucacuuaaaacauuuagcacugcaauauaguauuaagaaauuuugaauuauuuuuaacuucuuccucucuccaaucaccuagaaacacaaacugucccuaguacaccuuccaugggcaugaaagcuagcccaacuagcuucaacacaacucagucaccucauggaugaaguggaaauaaagccugccuauuaaacaagaauguugugaagauuuuuagagaauuauguaaaagcucccccuccacccaauuuaggcaacuaacucccacccacugauaccuuuuaaauuggaguguaaauguuuucagauuacuucauucuaaccagagguuaaacauuuuugggucuuggguaacuuggagaaucugauuaaagcuauggaaaaaauacauuuccuacaaaaaugcauaaacucugaacauucugucuauuuucugggggacuguggaacaucugaggccuauccaugguuaagaaguuccacucuggccuuucauuuggcuucugugaagggaaagaaaagaucacgggcaagauccagagccuagaaaauguaucagaugcaauuuaagaagauggcucuaaugcugauaaccauaaaaguaagguccaccaaauuuugcagcugcuaacccuauuuuucagaugaaaauguuuccuaccaaaugcacugauaacugccuuguuggcauaaaucuaaacugacaguguuuuaaaaaugaagauuguagccaagcaucuuuuacaggccaaauuugaggaguaaaugacaagaugacaaguuggugaauaaauucacaagcacuagaauuccaguaagaugaagcagaggaaagcacagguuugccuucuuagggcuuguuagaaauggaaacacacacacacacucuuuacuaauaggguagaacagcuuuaaaguaaauacuguaaauaaccauaagguuugccuuccuauuuuagggcuuguuaaauauggaaaacacacacacacacacacacacacaccccucacuaauagaguagaacaccuuuaagguaaauaaaccaagggacuguuuaugguuucaugagcaacaaaaugcaaugaaacucaaaacuaggaauaauaggaauaaaugaaaauaaucuauuggcuucuguguuuauccucagguaaauucuuucucucccuuggauauagcaugccucaaauaccuguuaaucuuuuuauuuaucucuuaaguaagcaaauagagaacacucccgucagcuacaagcuuggccaaaccccaaaguuugaaugaucaagaacugaaaaaacauacaaaguguuuuggagugacauaucaagaagaaaugcugucuuaaauaacgugucuggcacguucucuaaacuuaacauuugcaauaagcuguguuuucuuuuuuaucuccuggcucuuacauaaacuaaggggcuuuuugauacccgugagaugucccaauugaauuacugugaaaaacuggcagcugacaagaaaguaucaggcauaauuuauaaagacuucacaaagauuuacacaucaacugaggugaaccuaccuuucggugccugcucucagcagcagccagcugggacagcaugcgcuccugcauguucuugcacugcuucaucacaaccuuaagaauagagaguggauuugugcagacuggcugcuuuucgccaucauuuuucuccuucaguguuucaaaaucucucuguagagccauuaaaggaucacugauguuauauuuuccauagcguucuucaaugaaaguaucucuguguugggccugggaaagaggaaaaaaaauaagcaucuugcuuuuuaaaacuacugaggaagggggauuugcuauccagugguuauacauuaaagguugugguauuaguauaaauguaaccuacuaauuacaagucagauugagccaucuaaagaaacagcauuagaaagguggcaugguauauuaacaagaacaaauacuuauaaagcacuauguauuagacauuguuuuaaauauuuauagucagauuaacuuguuuaaaauuuacaacccuguaagguagugcuaucaucucgauuuugcugaugagaaaacuauuccugguuacucaucuagcaagcugucugaauugggauuuaaacccaggcaaccuggccccgaagucuguguccuuaaccucugugcuuacugacucugcuuauaucugcuuaugaaugcuuauauuaccagcagguacaucuuauuuuuuuccguguuaugguacuagcauuucuaaaacauguuaaguaugauaauuuuaugaguuuauauauuuagagaccuaacaaaaugccagcagauauauaaagugugcaaaauauaagcaggaucacauuacaaucuaggacuacuugugaccuguacauaugaaccauuacucaguuguugaugggucaaggaggauggaggcaccucauaaccagacaugcagacaaaaccucuuccaccugcugccaaauuccacccccucuucuugucucugguuguuacuuuccauucucuuuucugucucuuucaaggcuugaugagccuuggggaugagcauguaagaaagggaugcaagcuggugccuggagucuggucaaggacguuagcccuggguacccaguugggaguauaaggaucaggaaguggguggaaagauauuccuaggcuucccucuuuccuuaucucuguaggaagagcuugaagaacuccacaugagcaucauacauuacauguacauuacuuuuuacuuauuacacagauauuuaaaaguuucuugagauauuuuacaaugaaaaaugaaguguuaacacaggguugaagaaacuaaaaagucacagcaaaguacuauauaauuuaagcuuucaaauuaaaucugguuaugaaaacuacuauuauuuauccauuuuaaaaaacuaaucaguagucauguuuucuuagcacugccauccacaaauaggagccuguuuaaaaaaaagggaaauuugcaauucauuggcuaugcuuuaauuuaaaggaaacuuuaagaaaauaaagcaaacauggguuuuuuuuuuaacacagaaguauuucagugcugaaaaucugaagacuucuucuucauugacuguccaauuuaggccccaggaaucacuuagccuuaugguaaaauuuuacguucuuaucagcuggcaaauguucaaagcaguuagaaauucuggguuuuacuucuggcuugacugcagccaucuuacuuuaugacauuacuggaguauuuggauguuauuuguauacuggaaauaugaagagagaaauccauuucuuuaaguuacuaauaacuaucuuucuagccuuaugguguguugugugugugugugugaauuaaaagugggggagguauaaaacacagagucuaagaugaaacucuacuuuuuuuuuuuuuuuuuuuuuuuuuagauggagucucgcucugucgcccaggcuggagagcaguggcacaaucuuggcucacugcaagcuccaccucuuggguucacgccauucuccugccucagccucccaaguagcugggacuacaggugcccaccaccacgcccggcuaauuuuuguauuuuuuaauagagacgggguuucaccauguuagccaggauggucucgaucucccgaccucgugauccacccgccuuggccucccaaagugcugggauuacaggcgugagccacugcgccuggcugaaacccuacuuuuuucagcuccaaguuaaaaaggaaauucacaguaaaauuucaaaauaaccuccaguccauuuaggauggagaaagaaaagaucagcuccagaaccagccauucuucuucuuauuuuaaaacauggugaauagccggccgcagcaucucaugucuguaaucccagcacuuugggaggcagaggcaggagaaucacuugagcccaggaguuuaagaccaaacugggcaaaauagggagaccuugucucuacaaaaaacaaaaaauuagcugggcaugacggcaugugccuguagccccagcuacuugggaggcugaagcaggaggauugguugagccuaggaucuaggcugcuaugagcucugauuauaccacuacauuccagccugguuaacagaagaagaaccuguuucuaaaaauacauaaauaaauaaaacauacugaaaguaaaaccaaaaagcuaguuguauuuuaaaagcaacagugccaaacaacaugggacucaucaauguuucccuuuuaccauguuucuuuaaauucagcuauaaaaaccugaaauugauuaccuguaacucacugaaaguaucaaauuuuuuuuuucuuuuuucuuuuuuguuugagacagggucuggcucugucaaccaggcugcaguguaauggugugaucacagcucacugcagccuugaccuccugggcucaagugauccuuccaccucagccucuugaguagcugggacuaaaggcacauaccaccucacccagcuauguuguuuuuuuuuuuuuuuccacuuuuuuaggccauguuuagaaaaauagaaaaguuuagaaaaagaagcaaaagaaaaaauaaucucuuuaugcagcugaaauacuacuuuucuaacugucacauuucuuauucaugauagccauuucaguaugguuagugaugguaaaggaauaacuauuggcacuguugguuuaguuagggcaaaaaggaaauagaaaaaguaaacccaaauacuuuuaauaaccuuuuccuuuucagagcaccauggagaaagugggauggaggaguaggagcugggacuacaauucaugaccuugacaucagaucugcugagaagcugucucucugguuugaguaguauauaguuaacuaauccccaaaauaugacuuuuaaaacccacacugugauuacccuguauaauuaauaagcaccacagaguuaugaguaauagacaaagagcuucuuuggugaggucucagccugagaacaguuguuuggcugucugcuuucuccuguaguacuucauaguaauuccauaaucacuugcauaguaauuacaaguuguauaauacagacggcuuugccuguaaaggaaaaggaucuguggaauaaccucaagaagacuccuugucagagagcgauucucuuaaguacauucuaauauggggucaaauauaggaaaggugaauucaaagucuauauuuauuauaucaaacacuggacuggaacaugggagacagaacaugguauuuuucaaucaacuuaaugauucagucaggugaacuauauggauuacagguuuaacaguauaaauaauaaaaaaaccccaaaacagauauuaagauuugaagaaugaagagauuuaauggggguguguaaugaugaucuauuccugcauaccaaucacccccaaaguaggcagccuaaauaauaaacauuaaaaaaaaaucucacaguuuuggagggucaggaaucugggaggggcuuagcugggugguucuggcucagggucucaugagguugcaaucaaacuguuggucagggcuguagucaucugaagccaugacugggacugauggacccacuuccaugcuuacuuacucacaugacuguuggcguaggccuuggcuccuuacaagugccagcuucccacacagcaagugacccucagccccauaaaagagacagagaccaagauggaagucccaaugucuuuuauaaccuaaucuuggaagugacacaccaucauuucugauguauucuaucagucacacagaccaacucugguaaauuugggggcagacuacccaagggugugaauaucaugggguagagaucacugggagccaucuuggaggcuggcuacaaggucaaugacuagaugugcuaccacuaucauuuauaucucgggucaaaauuuaaagaccaaacaccuauauucaaaacuaucaaagcugaguuguaauauauuaaugauauuucaguuauuuuauaagaaauuuuaaaugauauuagaguuuggaggggguuuaguaauaaaaauaaaguaaauucaauuuuauuauuuuuaauucaauaacaacacacacauuaacugaacagaaauuccuacauugucagaaaacaugauggucuuuaauuucagacagcagaaaaauaacuggcugguuagacagauucaauaacagaggguauuaucacagcagccagagcacacuagucaucuauuacucauuuauuuuuacuaucacaggcugaaugaaacacaccacuacugaaagcuuaaaaucaaaucacauaaucuucuuagagucggccauacuugcucuccaaaaguuucagcuguguuauuccuaacuucaaaaggaaauaugaaguagucaccuccucuccacuucccaguacaguguguguguauauuccaaucuuaaaguaggaaaucaauuucuuuuuauucuuuggcaccaacaugaaaaaucguucaaaauccaauggugaagaauuaaggcucauuuaauuggaaguuuauauucaacuauaagguuuuauuuucaagacucaggcugguaccauaacuggauuaggauguauuuuugccacuaaagagacaauucugaagugauauuuuaaaaaguaaucagcaaugugaacaucauaggucuucaaagaaaucugaauacuucaugccagggaccagaacaacaauaugauuccaaguauuugguuaaugcuaccaaaagcauguuaaaaggaaucauuaucacaugcacacugaaucuauuuacugucaaguaauucacacuauagauaaacuauaaguaguuuauagcaaccugagcaacuggaaauaaagcaaacauucuggauaaagaugacaacaauaagaaaacccuuguucuggaaguuccuuuauaauugcugaacaagaacuagauuuuaauguuugauacuaauaaaagagcugauuuagccucauuuaaauuaaacuuuauuuuuuggaaaauaguacaaaaauuaaacaugacaguaaagagagaaaauugucaugauuuaaaaauauuucaggccaggugcaguggcucacagcuauaauaccagcacuuugggaggccaaggcaggcagaucacuugaggucaggaguucaagaacagccuggccaauguggugcaaccccaucucuacugaaaauacaaaaauuagccagguguggugacucacaccuguaaucccagcacuuugggaggccaaggugggcagaugacuucaggugaggaguucaagaccagccuggccaacauggugaaaccccauuucuacuaaaaauacaaaaauuagcugggcaugguggcacacgccuguaaucccagauacucaggaggcugaggcacgagaaucacuugaaccugggagggaaagguugcagugagccaagaucgcaccacugcacuccagccucggugauagagugagacucugucucaaaaauauuuuaacuaacugugaaauagaaugaacuucaaauauucccucuggagucaaccugcaaccauaaauauuuauaaaagcaauuauuuacauaaggacagaugaccauuuauuauuauuugacuacaguguacuaaauucuauucaagacuaaaaauaguuuaguauaaauagguauaaguguggcacuucuagcccccaggcugcuugcugauagcauaagaauaugaguaaacaggcugggcgcaguggcucaugucuguaauaccagcacuuugagaggccgaggcaggugaucaccugaggucagaaguucgagagcagccuggccaacauggcgaaaccccgucucuacuaaaaauacaaaaauuagcugggugugguggugggcgccuguaaucccagcuacuugggaggcugaggcaggagaauugcuugaacaugggaggcggagguuauagugagcugagauugcuccacugcacuccagccugggcgacagagcgagacucucuuaaaagaaaaaaaaaaagaauaugaguaacagaauaauguagcuguuucaacauucaaauuccagaguccugugaaauguucuaaugaaacugaaaucaaauguguugagauuuuuuuuucuuuuuguucuuacuuguucaguguagguaggugguugaaacaaauuauauguacauucuggacugaguccacaagaauaacuuuuugagguggggaagaaaauguguuuaggaauucaacaaguacugaacagauuaaugaacugauaaagggagaaugcucugaauauaaauuaagaauuuuaaaguauaauuuaaaaauaauuuauuuuuggccgaggcgggaagaucaccugaagucaggaguuugagaccagucuggccaacauggugaaacucuguuucuacuaaaaauauaaaaauuagccaggcauggcggcacaugccuguaguccccacuugggaggcugaggcaggagaauugcuugaaccugggaggcagaggcugcagugagccgagaucgcgccacugcacuccagccugggugacagagugagacacugucucaaaacaaaacaaaacaaaaaacaaaaaacauuauuuuuuagagcacuuuuggguucacugcaaaaugcagcagcagguacagagaucucucauauauccccugccccacacaggcacagccgcccccauuaucaguaucaucaccaaagugguacauuuguuccaguugaagaaaguauuauuuuaaaugauacauuagauccuaaucucuuuuuucgggagaccguacauuucugaaaauacaaugggaagaugcauaccuuauaccauauacaaaaauaaaaaugcaucacagaccuaaagagaaaacugcaauagggaaaagcauaugaagaagugccuaagucauuagggaucagggagguguaaguuaaaaaaauaaaaagauaccacuauacagccacuagaauggcuaauaugacagacugacaacaucaaauguuggaaggaauguagaguaaguagaacacucacacauugcuagugagaguauaaaacaguacaguuacuuuggaaacugaucuggaaauuucucauaaaguuagacaaauccuaccuguaauucuacuuguaaguauuaaauauuaauccaaaagauaugaaaacacauuucuacaagaguuuuauacaauaaagcugcuauagcagcuuuauucguaauagccccaaacuagaaauaaucagauaucaaucaacaggagaauaaacagaauguggugcauuuauaaaauggaauacuagacagcaauaaaaaggaacaaagugcugauacauacagugacacugaugaaccugaacaucauacugaacaaaaaaaagaggccaggcauaaaagaguauguucugugugacuuuguuuagaugaaguuguggaauaaacaaaaccgaacuauggugaacaaaaaaucagaagagugguuuccucuggggacagggggaugauugacugggaaggggcacaagauccuggugugauaagaauguucugugucuugauaggaguguggguuauguggaugugugcaucuguaaaaacacauugaauugaaauguuuaagaucugugcauuucacuauauccaaauuauaccuccaguuaaacaauguaaaauguaaauauauauaauaaaaguuauaaggaaacaaguuauauguaguauauguuuuacauacaguauuuccaaaacagauaggaaggucaaaucaaaguauuuuuaacaaugacagcaaaaacaacagagacguuaacacucgagcguuuauugccugcgaaacagugugcuuuuuacauaucuaaucuauuccuaacagcauuccucaugaaguaaacaucacuauuaucuucauuuuauagaaaaacugaauaucaaacacgugacuuucccaaggucacaaagcuaauuaaguagugaagaacaauaaguguuauauauaguuaagugcugacuauguuagcugauugaguaauacagaaauacauccccaggacuuuguaggaaugaauuucaauuuaguaggucuugaucaguaacuuaaaaaugaaacaaaacagaauaaaaaacacugcagagcacugaauguuagaagaugcauuuugaggaacuuuacuucuagcauaagaauauagguguguacccugggucacaaugcaaagucuacuuuuuaauauguguuacuguccaaaaaguuugagaaacacuagaauggaaugaagaaugcaagaaaucugaauccugaaucuaucauuuuaaacaauuuaagcuaugauaaacaugcaaauucuaacagaaaugauaaguaaucgguauuauuguuuauuuuaaacuaacuaauguuauaaagucgauaaaccaggagagguuuggucuaacaucaaauauacaaaauguaacaaaaaauaaacaacacaacacaucucuguguuaucaggguuaaacaaccaaaauacuauuggagaaaucugggaaaguuuucuggacuugugcaugauuugcagggcccaggcucugaaugguuugaauacuuaauguuugcuggguacuguguauuauaagcaacgugaguaaugacaugggaacagagaugugacuauguaagauguaguccacugcccucaaggagcuuaaaauuugcuagacaaguauaaggccuaacaucagcaaugaacaaauagccucucuguuuaaauguuuucuaaacaauaucauuaauguuuagaggaacaccaaguacaauuuauuugagauuggaauuuucuaagacuuagacuuuacauucacaaggaauaggaaggaaaaggccaacccuggaaguggguggguucuggcagauaaauggagcaaucggcaaucuaaugaauuacaggaaacaccaugagguuggcaggguucggguagggggcccacacaacccaaaacugucucugaaguauuacacagugaaacccagccuacagacuauagcugugugugauacuuaaaguuaacccuaugaacuugaaaaaccuuuauuggagaugugcugggcucuuucacucaccauuaacagacagugccgaaaacuucaagguuaauauauuuuaaaagagcucaguaaacaagaugugaaaggauaucuucauuuccucuaguuaagguauucuaugggagagagaucugaagcugcguaacugugagaugggucuuaacucuaaaaauuuauuugaagcaaguuucuuaaauuauaaacagacugauauuacacagaaacaugccaagaaacaagcugcucaaaagugagguccugggaagagggccuuaucuugguuaagaaguagaaacuauucauauuuagaaguuaucaaguaacaggaauaagaaauuugugggggaaguggagguggggugugaaaagagacagggcagaaugaaaaaggggacaguaauacuuuaagaccccuaccauggugagagcaggaugccagggcaggcaaacagaagcaaggacaguguaaucauacauccuaaugacagaagguggaauagaauaucuaaguaacauauuaagauaaagaacaagcccuaugucacaagucggcagauggaaaggcagcaauuucggcugucacuguagccuuacguagaaagaaguagcuagcuaguuauucgguuucaaccagcagucaaauagauagauugggacucaaauuaaggaaggaucauucuucucuagagaacaaaauggggagagaguaaaaacgucaagacuaaaaaguaaaaggugggcuaucauugcauugcaggguguuuagugauaauuuugaauacaaccuggcaauggucaucacugcaguaaggcacaaauauauggugaaauugugcaugcuaaaggugaccacugcaacuguuagguccaaguaaucccaaccuaagacugccuuuaucuucuguucauaacagaaguauacaacaaacccacagccaacaucauacugaauaugcaaaagcuggaagcauuccccuugaaagcuggcaaaagguaaggaugcccucucucaccacuccuauuggaaguccuggccagggcaaucaggcaagagaaauaaauaaagggcauccaaauaagaaaagaggaagucaaacuauuccuguuugcagaugacaugauucuauaucuagaauagauauagaaauauagaauacagaaaaaccccauggucucagcccaaaaauuccuucagcugauaaacaacuuuagcaaagucuaggauacaaaaucaacauacaaaaaucacuagcauuccuacacaccuacaacagccaggcugagagccaaaucaggaacgcaaucccauucacagucgccacacauagaauaaaauagcuaggaauacaacuaaccagggaggugaaagaucucuacaaugagaauuacaaaacacugcucaaaaaaaucagagaugacacaaacaaauggaaaaacacuccaugcucaugaacuaguagaaucaauaucauuaaaauguccuuacaccacauacaaaaauuaacucaagauggauuacagacuuaaauguaaaacccaaaaacuauaaaaacccuggaagacaaccuagacaauaccauucuggacacgggaacuggcaaagauuucaugacaaagacaccaaaugcaauugcaacagaagcaaaaauugauaaaugggaucuaauuacuuaagggcuucugcacagcaaaagaaacuaucaacagaguaaacagacaacguacagaaugagagaaaauauuugcaaacuaugcaucugacaaacgucuaauauccagcaucuauaaggaaggaacucggccggguaugguggcucacaccugcaaucccaggacuuugggaggcugaggcaggcggaucacaagcucaggagaucgagaccauccuggcuaacaugguaaaacccugucucuacuaaaaauacaaaaaauuagcugggugugcuggugggcaccuguagucccagcuacuugggaggcugaggcaggagaaucacuugaacccaggaggcagagguugcagugagccaagauggcaccacugcacuccagccugggugacagagugagacuccgucucaaaacaaaaacaaacaaaaaaaaacaaaggaacucaaacaacuuuacaagaaaaaaaaccaagcaauucuauuaaaaagugggcaaaggacaugaauagacacuuuucaacagaaaacauacauguggccaacaagcauauuuuaaaaugcucaauaucacugaucauuagagaaaugcaaaucaaaaccacaaugagauaccaucucauaccagucagaauggcuauuauuaaaaagucaaaaaauaacaaauguuggugagguugcugagaaaagggaacacuuauacacuauuagugggaguguaaacugguucaaccauuguggaaaguagucuggcaauuccucaaagaccuaaaaacagaacuaccaguaaucccauuacucaauauauacccaaaggaauauaagucauucuaccauaaagacaugcacgugaauauccacugcagcacuauucucaauagcaaagacacaaucaaccuaagugccuacagugguagacugaauaaagaaaaugugguacauauacaccauggaauacuacacagccauaaaaaagaaugagaucauguccuuugcagaaacaugguuggagcuagaagccaucauccuuaccaaaugcaggaaccaaauaccacacguucucacuuauaagcuggagcuaaaugauaagaacacauggacaucaagagaggaacgacagacacuggggacuauuugacaguggagggugggaugagggagaagaccagaaaaaauaacuacaggguacuaggggugaugaaauaaucuguacaacaaccccccaugacauuaguuuaccuacauaauaaaccugcauauguaccccugaacuuaaaauaaaaguuaaaaaaaaaaaaguguacuaaagggagccaggcacaguggcucgugccuauaauuccagcuacuuggcaggcugaaggagaucacuugaggccagacgugugagaccagccugggcaacacagugagaccugucucuaagaaaaaaaagaagugugcuaaagaggauugggauauggauggauaagaagaacaggagugaucuuuggugacaugagcucuucuuuucauucugaaggauggcaacaccauauggaaacuuuaaaugucaccagauuagaauaaccaagacccucuuuuccauuuuaaucccauaaggaauaggaaaacuggcucuauucuaggccucuaagacucuguuuuggcaccuuccuccuuuaaugauuucuaggucuggggugaagaugucagucauuuguccuaugacagauauucacagaaaaggauggacaagagccugaaaaagacauuuuaaagguuaaagaacucaaaguuaccacuuuggaaaguaaacagacaaagggggaugauaaagauuuugugaaagccaaacaaacaaacaaacaaacaagcaacaauaaaacaggacaaaaaaaaaagcaaaucucaaaaaaaaaaaaaaaaucacaggagaaauggaggaucagucgauacauucuaaaagauagagaaucuguguaauuuagacagaugaccauaaagguucuuagcuaaaaagucugggaaauaauauuuuuguauguauccagaugaagaaagacaagcuaauuuuuuucauacugaacuauuuuaucugauacugaaaguuccccuuacugaccagucagggaaugcagauaaucacaccccaauuugauaggaaaggauaccaagauuaaaugucaguugaaaauuaagaaguaauaggaaauaauuuccaaacgauuuuuucuuuagaugaauacaaaauagugagcaaaaguacauauuccaauuaugugguauccuucacuaccaauaaagaacgaacacaaugcaaugauuuccugccugaagaacaaauuguuccuucuuaguacgggguaagauguaaauaaugucacugaauggaaauuaucaacaacaguaaaaguuaugaaauuauauuacuaaaguuaaguuucuuuucugagaaauaugaauuaauaauuagcaaucuauuuugagccuugaauacauucaagguagacuuacagggccugaaaucauucuccuguaugacaaauacuuaugaaguacuuacuuggguccagauaccugggauauagugguaaauaagauuaaggaccugcccccugaggagcuuacauuuagugaaaaaaauaauaauaauaaacauaaagaaaguaaacaaaucccuauaaucugugaugcuuaucagcacaaauauauaaauucuccuauuaucacuaaucuagcguagacaacagaaaaagagaaaccauguuacguaugauucaauucuaugaacauuuauuggguacacuucuuuuuuuuuuuuuuuuuuuuugagacagagucuugcucugcugcccaggcuggagugcaauggugugaucucggcuugcuacaaucucugccuccuggguucaagugauucuccugccucagccuccagaguagcugggauuacaggugcgugccaccauguguggcuaauuuuuauauuuuuaguagagaugggguuuugccauguuggccaagcuagucucgaacuccugaccucagaugauccacccgccucggccucccaaagugcugggauuaccagcaugagccacugcacccagccuggacauacuuuuuaugugaaggguucuaugugugaagaagaaggaaaggaaaacaguauuccaaacaagggaacaguucaagcaagguuauggaagaauggaaaugcguaauuuggcuacagaggucagauuuauagcuaguagacuggcaggaaaugagacuggguuccagccagucuguaaaugucuugaauguaaugucuuuaagcuuaauuuuuuaggcagcaaggagucacaagaaguuuuuaaagagaaaaacaagaucaacuugauacuaaugaugguuagguuacaaaucuaggauauaagaugaguagcagagugucagguaggaggcuagauccagagaccauuuggaucuaaagucaaaauauaagagggagagaaaaaccacauuuaagggguacucuggagaagagccaacagguuuuagcaccugauuagacacaaagagggaagacacacagauacuuugaaguauuuagguugggugaguggaugguuggugaugccauuaaccaaaacagagaacaaaggcagaacacacaggcuuuuagggaaggaugcugagacugugauacgggauauuuaggugcacaagucaaaaaggcacuuggauauaugggucuagguauaagagaauaacaaaucuggguguuaacaacccauagaaaccaauaaaacugaugaaaucacccacugaggaagagaguaaauagguuacgaugugacagggcuaagaacaaaguaucaggaaauaucuuuuuauguauuauucauucagcuaacauauucuauguaccacugugcaaugcuagguguagacacgaagucacacaggaggccaggcaugguggccuuugggaggccaaggcggaaagacugccugagcccaggaguucgggacuagccugggcaacauggcaagaccccgucucuuuaaaaaaaaaaaaagccacaaaggagacucaguaaaauaaguguauauuauggaguaugacacagcagauagaagcaacagaucaugugcagucauggcaacaugauggacugcaaaggcauaguaauuauaaaaaguaagaaacagaacaagcuagauagcacaaugccauuuaugcaaauugauacacacaaggcaauacauuuuacaagaauauauacaaauaaaaaauguauuaagaauaguugcuuauggagaccaagaagggaaugggaggagaaacugaggauacagggaauuuuauuauuauuauguugguuuguuuuuugagauggagucuugcucugucgcccgagcugcagugcaguggcacaaucuuggcucacugcaaccugugccucccggguuuaagccauucuccugccucagccuccugaguagugggauuacaggcaugcaccauugugccugguuaauuguuguauuuuaguagagacaggguuuugccauuuuggccaggcuggucucaaacuccugaccucaaguaauccacccaccuuggccucccaaagugcugggauuacaggcgucagccaccgcgcccagccacggggaauuuuaaaacaaaacgcacgcaugcacgcacauacacacacacacacacccccacacaaaaaugaauaauaacauuuuggcuucuacccuuuaggauccuaaaaggcuauagggcaagagacaaugcuauuucaauacaguuaugaaaagugcuauaguagauuuugaacaguaugugaugggagcuacaggaagggacauuuuaucuagucacagaagauaucagauuuaagaggaauauggaagaaaaaaacacaaaggagucugagaaggaccaggacaagaauaucacagaagccaaggaaagaaguuuaacaaggaggauggucaacacgguugaaugcugaguuaggucaucuaauuaaagaggccauuagcgguuacuuuuaacuucaaaacguaaaauuucauuagaguaguagaaacaaaaggcaaaugaguaaugaggaaugagaaauauuuaauuaaauauuucaguguaaagagagaaagagaacuagggugguaacuuagaaggauggcaagauugagaagguuuuuuuuuuuuuuuuaaauauagaauggaaaguuucaaacaggcuuuagccaaaaauaaguaguaguauuaaaagaagaaacuggggcacuaagcgagaaggcaagguguaacugauggaguauggucaugaagaaacaggguaaagauaagaucaagaguacaaguggcauuacucuuagaauagggugguauaagaaaagaagaaugucuuauuaaauggaugaaaaaaaucucuagacauuuccaaucaguaagaagagagacuuaauaauaauacaauaauaugcucauuucuaccaaugaauccaguuuccuugacaucccauugugcauauuauauuucuuacaaaauuuuuauuuuaauuccaucaucaguaaguauuuucucauaaaaauucaaacuauaggcccggcgcgguggcucacgccuguaaucccagcacuuugggaggccaaggcaggcggaucaugaagucaggagaucgagaccacggugaaacccugucucuacuaaaaauacaaaaaauuagcugggugugguggcgggcgccuguagucccagcuacucgggaggcugaggcaggaaaauggugugaacccgggaggcagaacuugcagugagcugagaucaugccacugcacuccagccugggugaaagagugagacucugucucaaaaaaaaaaaaaaaaaaaaaaaaaucaaaauauauagauaaagcugaaacucuuccugaccguaacccccuuucacuuuccucccuaaaaguucuuaguauguuagguauccuuccagaccauuucuuuuucuaauuuaaguuuuuuauuuuuuguagagacagggucuugcuuuguuucccaggcuggucucaaacuucuggccucaagugauccugugugcccagccuccauuuccaagaauauauauacauuugcauguguguggugucuguguguauaaaaccuaauuacauagauauuauuauuguguaaaacuguuuugcaauuuguuuucacugucugagagaucugucaguacauagcuuucuuucucauuaaaaaaaguauauaauauuccauacuaaggaugcaccaguuuaugcagccauugauggaacuuagugaugaacauuuauguuguuuacaguuuccaauacuguauuaaacaaugcuucaauaagcuaacuugugcauaugugagagaacuguuuuguagaauaguuauauuacuaugcuuuucuaacaaaacaauuucacauaauaaaacucccaguucauucuauaaaugccuccuuuccauaaauauuuucagcaaacauacaagaugguuuucuccuaucuuccaaauuauucuuacaacuggcuaaacuggaauacuaaaugauauguuuuaguuuuagaagcaaccucuuugucuuccuuugcuucucuucucuuuauggggacaacuagaaauaaccccugauuaaucucaaaucacaaggcuaacacaugcaaggaagacacaauaagaggaagucaaaauaggaauaagcuauuucccuuuuuuauuuguuuuaguuacaggcugaauaaaugcaaugaaauuccucacugcuguaaucuuuucugaagccccuccguaacugcuggaaaacuguauguucucuaaauagguacuguuuuauaaacugaauuuccccuuucuugaaaaauauuaaaacuacaacaacaaaacaaaacacagaacccacaggaagacaucagucaaacgagaaauuugcuuauucuucuggcaucuucauucuuaaaccccuaaaugccacaauuuguaauaugaaugaugacaugauaaaaaguuauacagcaaacagcugaugccagacaauaauuuuuaagagcuagcuggccgggaacaguggcucaugccuguaaucccagcacuuugggaggcagaggcaggcagaucacgaggucaagagauggagauaauccuggccaacauggugaaacauguauuuuagucucuacuaacauguauuuuagucucuacuaaaaauacaaaaaaauuagcuggacaagguggcacgcaccuguagucccagcuauucgggaggcugaggcgggagaaucacuugaacccaggaggaagggguugcagugagccgagaucacgucacugcacuccaagccugggcaacagagucagacucugucucaaaaaaaaaaaaaaaaaaaaaaaagcuagcuauggccuggugcgguggcucacgccuguaaucccagcacucuggaaggccgaggcggguggaucacuugaggucaggaguucgagaccagccugggcaaaauggcgaaaccccaucucuacaaaaaaguacaaccacaacaaauuagauaggugggugucguggugcaagccuauagucccagcuacuuaagaggcugaggugggaagaucacuugagcccaggaggcggagguugcagugagcugagaucaugccacugcacuccagcaugggcgacagagugagacccugucucaaaaaugaaagagaaaagacaagaaaagaaaagaaaagaaaagaaaagaaaagaaaagaaaagaaaagaaaagaaagaaaagagcuagcuuuuauauaugggguuugauguuuuucugaauggagcaaagacauuuaaucgcuuaagaaugcaguccuuuuuuaaauaaauagccaauuuaugaacaacuaacacauaugaauagccuguccuguaccuuuuggcccuuuucugcuagaguacucuaccacugaaucuggcacuucccucuuacuaauuucaugcucuuccuagaacagauuauuagaagaguuccuacuauucucaagagaaccaagcuaaaaggaaggaagaggcuuugugagauguauuucuggcuucaccaguggcaacuuaauacugccuuuuuuuaagaauuuaguacagugcucugugacuuucuuucuuuauuauauauaaagaucuuucauuuuauuaguuucacaguauuuuauucuacaaucauaccauaauuuacuugaccagaacccuaauaagagacacuaaauuguuucuagcauuuuguuucuaugaauuaugcugcaauggguaucuuuacacauauacuucauuguguaaagauuagcucuaagaacauuuguauuguaaaggccuaaggacaucuguagcagaaauuucuagaagugaaauuucuucuagauacaugcauuuuuuuaagaaagagguaaggucuugcuauauugcccaggcuggaguacaauagcuauucacaggcaaaaucauuuugcauuagagcuuggaacuucugaccucaagugauccuccugcuucagccucccaaguagcugggacuauaggcaagugccaccaugccuggcucugcauuuuuaaauuugauagauauugccaaacucuccuuaaccaguugaggacaacaauauaggagagugccaguuucuccucaccuuuacagguacaguuuuuaaugaaacacauuuuaucucuuauggucagaucccauaguucauuuagcugagcacaguuaaucugaaaauaauauguuaaauuacaagagaugagcuccaggaucugcauguaaaauaucaacuucacaaggguacagagaauucaacaacauaucacacauagaaacacucugaaaaccauagagggcuauauacaaugcuaguucuuguuaaaggaauaaacuuugggaauagcuucugauuccauagcuuagcaaaauucuuuuagaauuuuauaagaaacauaccuaaauaaaucuuauuuccagucucaggaucuggcaagaugaaacaaagugaaaucuugccacuauaaaacaaauuaagaaauuaaaggaagugcuuuagacuaauguuuuucaaacuuuggaucacagcucauuaguggaucauaaaacuagucuaguggggucauaaucagcauuuaaagaaaaaugaaguauaacagaaaauauuacaguacaguaugguauaguauaaauauuauaguauaguaaaacacaaaguaaauucuagugaaauuuugguuuuaguuaauauacguauauggguguguauauguauccuggauuguggugaaaugugaaauuuauuucaaaaauguuuaaaagacaacucuuuagacugugguaugauaaaaaggucuuuauucaagucuucuuuuuucuucccccaaacucugcaaucuuuuuacuggauagucuggaaauuuagguugguuuuuuaggcagauucaguugaguuauuucagguggguuggaaagaaauaauauuaacuuaauaucaggaacaaccaaaaaagaagaauuuaacuguaggucugauuagcucuaauuuauuuuccuacaaagugaauaauagaaggcuaaaguaucuucuuugggcaagaauguuaauaaacugagaguugagaaaaaaauguguuguacaagauuauuguuacuuaaaaaaaucaacauuucugaaauaaaaguaacuaagauauaaagcagaaguucugaagaaaaaauuaaaauaugcauaugauucuacuaccuagggccaaccacuauuaacacucaaacuacaaauuucaauguauuugcuugagucuuuuauguguguguaugugugugaguguguguguguggauacauauauauauaaaugcuuauaauugagauuaaaggauauauuuaauuuuguccuaggaacacuacuaugucauuaaacguucuucauaugcaucuuauuuuaaaauggcuucauaauguuccaucauguggauauaccacccaauucauguagcuauuaauaaaggauuuacuguuuuuuuuuuuuuuugagacagagucuugcucugucccccaggcuggggugcaguggcgcgaucucggcucacugcaaccucugccuccuggguucaagggauucuccugccucagccucccaaguagcugggacuacaggugcaugccaccaugucuggcuaauuuuuuuguauuuuuaauagagacgggguuucaccgugucagccaggauggucucgaucuccugaccucgugauccacuugccucggccucccaaagugcugggauuauaggcaugagccaccacacccagcaggauuuacuuuuucugaagacuuaauugcuagaucaaaauaacuauguuaucauggguugucugagggguaauuggaaguuaacuuauacaaaauguuucguaaauggauuuuuauguaaaaucaugucaacuacagccacucuccucaguagguguccugagauuaguaaauucaguaaaagaaacaaacccugaauuuuuuuacccaaaaguaaaacggagaagcaauacuauguuuacuuauucuucaacaacugacucuggagcagcauucagaauauaggggaugucaccuauaaacacaauccccuuuaaaaucaaucuucuugugcucccagauuaacgagaaaaaaugccuucggaaaaauacuaaaggaaugguacauuuugaugucuauuuccuaagugagccacuaaaaaucaauuuaaaugguuuaccauaaaaggagccuuuaagauuguuucaaauaaauuauuucuguuauuccugggaaagggguaauaauauucuaucagguauaaaaauucacacuuuguauuuuugucuuuggaaaaaugaucauaagaagccaauaaaauauuaaaaccaauaaaagacaaaggaaaguugcuuuaaaggagaggaguucauaaaagcaguagagguauuguuuauucuguugaaauguuuaugauuuuuaaauuacuauuaaguuuugccauggggaggccaggugcgguggcucaacccuguaaucccagaacuuugggaggcugaagugggcagaucacuugaggucaggaguuugagacuagucuggccaauauggugaaaccuugucuauaguaaaaauacaaaauuagcugggugugguggugggcaacuguaaucccaguuacucaggaggcugaggcaggagaaucauuugaauccaggaggcagagguagcagugagccgagaucaugccacugcacuccaaccucaguaaagggcaagacuccgucucaaaaaaaaaaaaaaaaaaaaguuuugccguagggaaaaugauuuaauuacuggacucuacucagcaaaauuuuacuuucuuuucuuuuuucuuuuuuuuagagauggggucuugcuauauugcccaagcuggucuucaacuccuggcuucaagugauccuccugccuugaccuccuaaaguucugggauuacaggugugagccacugugcccagcacagcaaaauuuuaaaaauuaaauuacagaauuuaguuucuaaaaagcagcagaauaaaucugaaaaagcuacuccacaucacucuacuugaucucagagaaggucaauaaaaaaggggaugaagcucucuuucacacaauacuucagacacacaacaaggacauaaaaauuuuuaugcuuuuaauggguacagaaaaagcaugacaaaauccagcauccauuccuaauaaaaauucccugcaaauuaaaaauacaaauuuccuuaaucugauaaacagcauuugcaaaaaaccuacggccaacaacuugacagacugaaggcuuucugggaagaagacacagauauccccaucauuucuacuugacauuguacugaaguucuagccaauguaguaagacagacagacacacacacacacacacacacacacacacacacacacacacacacacggcauccagauuagaaagaaguaaguaaaacuguccuuauuugcagacauaauugucuguagaaaauccaauggaaacgacugacugauugauugagccagggucucauucugucucccaaguuggagugcaguggugcaauuauagcucauugcagccucaaucucauuaauucgaucaagucuccuaccucagccucccuaguagccgggguuacagaugcacgcuaccauacccagcuaauuuuuuuuuuuuuuuagacaagggguuucaccauguugcccaugcuggucuugaacuccuggacuugaaugauccacccacgaaggccucccaaaauacugggauuauaggcaugagccaccgucgugggcccccaugaaauuuauuuuaaaagcuacuggaauuaauaagugaguuuauuagcaugguugcaggauauaaaaucaauguauacaaaaaucaauuuuauuucuuuuuuugauggggauggagucuugcucugcugcccagguuggagugcgguggcgcgaucucagcucacugcaaccuuugccucccagguucaagugauucuccuaucucagccuccugaguggcugggacuacaggcgugugccaccucgcccggcuaauuuuuguacuuuuaguagagacgggguuucaccauguuaaccaggcuggucuugaacuccugaccucaggugaucugccugccucagccucccaaagugcugggauuacagguguaagccaccgcaccuggccaauuuuauuucuguaaaacagcaauaaacaaucagaaauuaacauuuaacaaacaauacuggcugggugcaguggcucacgcuuguaaucccagcacuuugggagggugaggugggaggaucacuuggguccaggccaggaguucgagaccaaccugggcaacacagugagcuccuaucucucuaccaaaaaaaaaaaaaaaaaauuuagcugggcguuguggugugugccuguaguccuagcuacuugggaggcuaaggcaggaggaucacuugagccuggggcuugaggcugcagugagccaugaucaugccacuacacucagccugggugacagagucagacccugucucaaaaaaacaaaccaaaccaaaacaacaauaacaacaaaacccaauaccacuuacaguaucaucaaaagugugaaacacuuaggguaaaucugacaaaaaaaaugugaaaaagcuauacacuaaaagcuacaaagcacugcugagagaaauuaaagacaaccuaaauaaaugaugagauauagcauauucauggaucgaaaaacacaauguuguuaagauaugaauucuccccaaauugaucucuagauucaauacaaucccaaucaaaaucccaacaggauuuuuagggaaauuggcaagcugauucuauucauauggaaaugcgaaggaccauaaauaaguaaagcaaguuucaaaaagaauacaaguuggaggacuaacacuaauugauuuuaaguuaccacaaggccacaauaaccaaaacagugugguacuggcaucaagguagacaaauagaucaaaagaacagaacagagggucuagaaauaaacacaugaauauaugaauaaccgacugacaaaggugcaaagaccauucuaaagaggaaggauaaucucaacaauuggugcuagaacaacuggacaucuauaugcaaaaaaacaaaaaauggauccaugcauuguacuauauaacaacauuaacugaagauauaucauagacuuaaguguaaaacuuaaaacuaugagacuuauaagaaaaacaaaaaacaaaaacaaaaacaaaaaaacaggagaaaaccuuucugaccuugguuuaggcaaagauuuccuagauauaacauuaaaaacaaaauccauaaaagaaaaauugauaggcugggcacggcggcucaugccuguaaucccagcacuuugggaggcugaggcgagugggucaccugaggucaggaguccaagaccagcccgaccaacauggugaaauccugucucuacuagacacaaaaaauuagccggguaugauggcaugugccuguaaucccagcuacuugggaggcagaggcaggagaaucacuugaauccgggagccaaagguugcagugagccgagaucgcaucacugcacuccagccuuggcgacacagcgagacuccgucucaaaaaacaaaacaaaaaaaauugauaaauuggacuucauggaaaugaaaaacuuuugcucuucaaaagauacaguuaagagaaugaaaugagacaagguuaaguaucuuuucuuaagauacaguuaagagaaugaaaugagacacacuuaaguaucuuuucuuuuuuccugucuacaaaagaugcauuuuuuuuuccuggucuagauuauggcuggguuuuuauuuauuuaaaauuuauuuuuuaacugauaaaaaauuggaaauauuuauagugugccacaugauguuuugaaauauguauacacuguggaauggcaaaaucgagcuaauuaacauauguaugaucuuacauacuuaucauuuuuguguagugagaacauuuaaaaucuacucucagugauuuuugaaguauacaauacauuauuauuaacuauaacaguuaaguaucuuaacuguaaaaaaaauagaguuaagauaaugaaauaagucacagacugggagaaaauauuugcaaggcauauauuugauaaaggacuugcauccagauauauaagaaacucucaaaacuaaauaaugagaaaacaaauaacuuaaaaaaaaugggcaaaagauuuuaacagauacugcaugcaccaaagaaaacaacacaggccagguuggugacuaugccuacaaucccaacacuuugggaagccaaggcgggaagaucguuuagggugaggaguuugagaccagccugagcaacauggugagaccucauuucuacuaaaaauuuuaaaaauuagccaggcaugguggugugugccuguaguuccagcuacuggggaggcugaggcuggaggauugcuggagcccaagagguugaggcugcagugagccaugauuacaccacuguacuccagcuugggcaacaaagugagaucccaucucuaaaauaaaaaaauacaaaaacaaacaaaaaaacauaauacagagagcaaauuagcaaauaagcacaugaaaugauacuuaacaucagccaacaauaauaugcaaauuuuaacuauaaugagauauuacacaccuauaaggauggcuaaaaugaaaaagauuggcuauaccaaguuuggugaggaugugcagcaacuggauauaucuguggaauguaaaaugguacaaucgcuuugcaaaacacuugggcagauucuuaaaaauuaaauacacaucuaucauaugauauagccauucaauuucuagcuuuuauucaaaagaaauaaaagcauauauccacacaaagccuuguacaugaauguucacagcaacuuuaauuauaaagucccaaauuagaaacaauacaaauguuuaucaacagauaaguggauaaaacaaaaccgugguauauacauauaaugccaacacuauuaaguaacaaagaagaaaugagcuaucaauauacacaacgacaugaauaaaucucaaaguaauuaugcugagugaaagaagccaggaaaaaauagaguauauuccauaugauuccacuuauauaaaauuucagaaaauguaaauaauuucugaugacagaaagcagaucagugguuugggguaaggggcagagaguaguggggaaaguugagcaggagaggucacuaaggggcauaaaaauuuuggggagcaauggauauguuuguuaucuugauugugauaaugguuucuuggggaaacacauaucaaaacaucaguaugcacauaucaaauaauacaguuuaucaugccaauuauacuucaauaaagcuguuuuaaaaaaacaaaauaagcugcaucaaacaauggaauaauaaacaaaucaaugaaaaaaaaucugcuacgaaggcuucugcauuaucccuguauuuccuguuuucauuauaaagagaaggaauuaaaacaucuguuccaugcaccagaguacacccuuaaccuuugcugucucaaaauacaugcuuuuggguguguggaugggaaugggucaccucaaaacugucaauucccauaagaaaaacaagauaauguccaagugccacuaauaacaacaaagauuuaauugagaagaacugucauuuuccuauuaucaguauuucuuucuucuucuccuuuuuuuuuuuuuuuguagaaaugggggucuugccgggcacaguggcucaugccuguaaucccagcacuuugggaggccgaggcagguggauuacgaggucaggaguucaagaccagccuggccaacauggugaaaccccaucucuacuaaaaauacaaaaaaacuagccgggcgugguggcgcacaccugcagucccagcuacuugggaggcugaggcaggagaaucgcuugaacccaggaggcagagguugcagugagcugagauugugccacugcacuccagccugggcaacuccgucucaaaaaaaaaaaaaaaaaagaaaagaaaugggggucucauuauguugcaaaggcuagacucaaacucuuagcacuucaggcuaggaguccgagucuagccuuggcaacauaaugccuccugccucggccucccaaagugcugggauuaauaggcauaagccacagugccuggccuuauuaguauuucuugcuuuauggaauguaucuuuguuccuaaauggauggauggacuuugaaccucuguucuaauaauaauaaccaacaguaaaugagcacugagcacuucaauuagcauuugcuaucucauuugguccucguaauaaccauaacauuuuaccaauaaaacuuacaagguaaaauaauuggucuaagaucacacuacaauugaguggcagagcucaaacccuaaagucugucucacuugaaagcucacauuccuaacagcuacacuuaauugaauguucugguugaugguuuugaagagugccuaguaauuaucuuuauguuucuuuuuugaaaaaucaggaauccauguauaaacuuuacucagagagagcaggaauaggcuggcacgguggcucaugccuguaaucccagcacuuugggaggcugggacagcagaacugcuugagcaggaguucgaaaccagccuggguaacauggcaaaacccugucucuacaaaaaauacaaaacuuagccagguauaguggcaugccccuguagucccaguuacucaggaggcugaggugggagaauuacugaaguccagcagguugaggcugcagugagcugcucacuccagccacugcacucuagccuaggcgacagaguaagacucugucuccagaaaaagaaacagagcauaggaauaaaaauagccacuccaggcugggugugguggcucacgcauguaaucccagcacuuugggaggcugagguggguagaucaggagucaggaguucaagaccagccuggccaauacgguaaaaccccaucucuauaaaaguauuaaaaaauuagcugggugugguggcgcacgccuguaaucccagcuacucggaggcugagacaggagaaucacuugaacucaggaggcggaggcugcagugagcugaaaccaugcuauugcacuccagccugggcaacagagcgagacuucaucucaaaaaaaaaaaaaaagccacuccaacucuaaaaaacauauuaaaauguggccacaaauggucacugauuaauucauuaacguuuuauaauaaagguuaugaauacuguaaauauaaaaaccuuauaacucaguaaccuaaauaaaguucugcucccacccuaauaucccaguugggaacuagacagaaauuggacuucugucaguuauagcuuauguucauguguucaugugaucuuuaucaaugaucgaaaccacccaucccaaucuuaaaagcucuuccuaaaaaccaucuauuaaaaugggaucauuuuuggccaaagaacuguuagguccaggcuuaugggugccagagaauguuucaacuugaguccguuuaagacuuucaaagaucuguuaucaagcaagcuaauaucugauuuuuuuaaaaaaugcaaacucucuucacaggcuuauuaguauguauggugauugcuaaguucaauuuuacguuuuucauuucagaccagucuuuauaauaaucugcuuccauaauaaguacaaggccgugaccaaaggcagauguuaggcuauggacuuauagugaacuugcauuguuauuuuuuuuuuaauuuuuggugccacaacuuggauacaacugagguugcugcaggcacaacacagaguacuaaccacuauaugaucauagcugugauguucuuaagccacagcaccuuccaugguaacuuuuguuuucuauauuuuggcacugucauuagauccuuaugauuauuuuuucaauaauauuuucagugaaaguaaauuauuuguuucaacaaagacauaacauuucgauuuuuucauuuuaacccuuuguggcugaaaaaacucacaacaguuaaaccuauagaaugauguauuacauaaucucauacucuaaauauacuucuaacuuugucaugucuacaacauuuuugccuguaaaucuucuugcuugggggauuuugcaacagcauuuggccaaacacaacaaaguucuauccucgguuuuaaaagaggauaucccuauuuuaugauugaggcaucaauggaaacgaauucaagacuccuuaaguuaaucgcacaugaaagcuguaauauuucaccauuuaucauuguauagaugauuuaaagaaugcuuuaaaauaaagcaauaccaauaaaugcaagguggauucuauuuagucacagaagccauuuaguguggcuuugcaucagaucuaagaugugcagauguaauauacccgauguggaauauucagaaauaaacuauuuaaucuaaauuuuauuagcagucaaaucuauuuuucagauuuuuuaaaauggccauugauuaaccuuccuuuauucuccucugaagcaaucacagccuaugguaggaagccauuuacuagauuugcuuggaauuaaugaacugaggcuuuccugcugaacuaugugguuccacucucugcuucccccagacaguucaugagcaauguaauuugcuuucauuguagaggguauuccuuugguguucuuauucaugaaauuaaaguaauaaaagggaaagacguucauaaagaaguuuuuuuuuuucugacaugauuccuucuaaaacagaaaaccacuuuaaauaaaauuuaauuaggaccaaauauaguauagguccccuccauaacaauuagauuugaaauauacaagacacugaauaauguguuacauuauuuucuauuggcuuucccugguucuaugccaaacaugucuuggcugcaauagagagugagugaggaggauucugggaagaaaaagaacguaauuauggggggcucuagaagaguauagcugcaaucuggcacuuugcagaaauuuuggaauaggaauguagcucuuuuacaauucuaacucuauaggugaggucaacuuacagccuaugggaacuuuacaacauauccugaaagaaacucaagccuugccaaagaagugacaguaagccauaugguuuuguuuagagauauaagauuaaagaacagauuuuauguccagacaaaaaucuauuuugaagcuagggagaaaauaaaaagauaagcuuuuuuuuacuggagacaaaacagaaaagaaaaacaaaucauaacuauuuagaacaaagaccaaaaccuuuucaaccgacuaagcaucaauuaagaaccaauauuaaaaggaagaaaauugguaaguugccauaguaguucauaaaguccaacagguguuuauuguuaagcaaaaacgauacaaauaaugcaguaaaauccugauacauuggagaaccaaaacaaauaacaacaaaaaaccccccaaaacuccauaaauaaaaugauacuucaguuuaaagaaugcuauggcaguuacuuuucucaaacgauugaaacaauuuuaaucccggcugcccccuauuuuaucuaacaauagauuguuuaaagauaugucacuucuggugaaguuauucauuucaccuaaacugcacagaguuaagccucagaauaauuuuaucaccuacagaccauaugcagacuaaauacaacacuugugccugauucugaaugguaucuuauaucaaaaugcucccuuaauuuuagcucuugcuucucaagcuucucucucaacuuaucagaacugccuauaguaaccaaaauuggauucaugaagaaaaaaauauauuuuaggaaaacaugugcaaaaagcaucuaagcaucuguuaacauuaaaaccagaaggcaguaugugcugcagaguacauaagaagaggcuuuaaaauuuaguaauucacaacauccacuuagaaguauuauaguaaucuuuuaaaguaacacaccacaaugguacaaucauuucauuuguucaacaaacauuuacugagcaucuacaugccuggcacuaugcugggugcugaggauacagugauuaguaaauagacacauaaagcacuacagguuuguacaguuucuaaggcugaaaagcagacagguuaucucgguaaaacuauaaaagagaaaacgaggucauccucugauuuuuccauuagaggcagcuguuaccuccacuccuauccuaauuaugaagggauugagacagaugauaaauggggcaaagaagugagacuaacaauaggcaauuagcagugacaauuagaaaugggcuaaaacuaccaaaagaauucuuaaucugggguccagggaauccguggauguuuucaugggauccuugaucucccagauauuauauuucaaauuuugauauauggauguauguacauuuauuaggaaguugcucuuaucaagucucaaaggggucagcguucaaaaacagcuaagggccacuaaacuaaaagaaugaaauucugccgggcgugguggcucacaccuguaauuucagcacuuugggaggcuaagcgggggcggaucaccaggucaagagaucaagaccauccuggccaacauggugaaacccugucucuacuaaaaauacaaaaauuagcugggcaugguggugugcgccuguagucccagcuacucaggaggcuggggcaggaacuugaaugcaggaggcagaaguugcagugagccgagauagcgccacugcacuccagccuggcgacagagugacacuccgucucaaaaaaaaaaaaagaaugaaguucaaggucuagacaucagaucgagaaacuaagggaacuauuuugaaaacagaaagguuucaccagugucccuaauaacacacaauguagguggcuaccuauggcaaguaucaguauguccuccauuuaauuucaauggaaacugcagaaauaccuuaguuaaauaaauuaaaacuaaugaaugacuuucacaauguaugaugaccucuuuuuuuuuuucuuuuaacauaccuuuaaggcuucuauaacaaggucccuugcuucaagcucuccuucaagaauacuaaauagugucaggaguucaggcuugcugaguuuuuccagauucaucuugaaagccugaaacaaagguaacaaucagacaaucuccaaagacauaguuaauuugauacaauuaaagaaaaaauaaagugagagauaagagcaauuauaguaucaaaugccuuaauaaaggaaauaguugaaauuaaauagaaauauguuuucugguguuaaucacaaacuaagcaacaacagaaaguaaaauucacuuuaauuauugauuucacuaccacucacaaagaucaauuuuucaucauauuuccuccagacacguuuacaaacaaauauccuaggaaaucucagaaagaauuagccgcuagggcugggugcaguggcucaugccuguaaucccagcacuuugggaggcuaaggugggcggaccacgaagucaggagaucgagaccaucccggccaacaugguaaaacccugucucuacugaaauacaaaacauuagccgggcaugguggggcacgccuguagucccagcuacucgggaggcugaggcaggggaaucacuugaacgcgggaggcaaagauugcagugagccgagaccacgccacuguacuccagccugggcgacagagugagacucugucucaaaaaaaaaaaaccaaaaaaaaagcaaacaagaauuagccacugauuuuucagguaaaauuguguuauaaugaauaccauuucucugaaaaauugauagaccaucaaaagauuucccaguuuuagauaaccaauuuccaaaacuguauauaaaacauucugauaucccucuucaauugguuaaaauaaaauucgggaaaagagauaauguuuggugggaguaugggagaaauuuuucuuuuaaauugucugcuuucacagacaauagcuaacacaauauuuauaucuuguauaguaaaauagacuuaauucaacuauaugcaaacuuacuuuuaaaugaauucucaaaguauaggguuuaaacaucuuuauuuuuuuuuguuuuaagacagggucuugcucugucacccaggcuggaguguaguggugcaaacacggcucacugcagccucaaccuccugggcucaaguaauucucccgccucagccucccaaguagcuaggaucaccgauacaugccaccacgccugguuaauuuauuuuuuauuguuuguagaaauggggucucccuguguugcccagacuggacucaaacuccugggcucaagugauccucccaccuuagccuucaaagugcugggauuacaggcaugagccacugugccaggccuguuuaaacaucuuaauuggcuaggcuaccaaaaacugaauuuaucugacuugguaaguucacauuucucugagaaucugcauguuccaaaguauguuaaauggcaaauugcaugacacaaacucaauccuuucuacaacacuaauucucacaaaccacauaaagauacaaguuagacugcuguacaaucuuggaagagccuucugaccaguguguaugguaagauauauuuuauaauuuccaaaguagaacaaauauuucucucuccacuuuuuauuuucaaauugccacucuuauggaaagugaaucaaaacaugaccaguucacacauccuccaguaauuuaucacucuuuuuaauuuuggggggcacacaaaaaaagaauugauuccuuccagagcuacugcuuuuaagugaacauguauaaaaugcauacuucacuuuguuguuagauuguguuccaggacaugcuguccaagucuuuuaaagcauaguaaaacaucuucgauguaaccucagcucuaacugcuaauuuucuuuuuuugagauggagucucacucaguugcccaggcuggaaugcaguggggugauuucggcucacugcaaccaccgucucccagguucaaguacuucuccagucucagccucugaguagcugggauuacaggcaaccaccaucacgccuggcuaauuuuuguauuuuaguagagacgggguuucaccauguuggcaaggcuggucuugaacuccugaccucaggugauccgcccaccucagucucccaaagugcuaggauuacaggugugagccaccacaccuggccuuuuuuucuuuuucuuuuuauuuauuuauuuuuuugagacagaguuuugcucuuguugcccaggcuggagagcaauggugcagucuuggcucacugcaaccuccgccucccggguuccagcgauucuccugccucagccucccaaguagcugggauuacaggcacaugccaucaugcccagcuaauuuuuguauuuuuaguagagaugggguuuuaccauguuggccaagcuggucuccaacuccugaccucaggugauccgcccgccuuggccucucaaagugcugagauuaaaggugugagccaccacgcccagccucuauuuucuaacaagugaauuucagcaacuaguaaaugacguucacuuuaguaucagggauauaucugauaacauuuauuuuaaaaauaaaaauaaaaacuaaaacaaaacuaaacaaaaaaauucuaacaaaccuaauaaagcuacacuuuauuagagguuauauuggaaagaacauguagcuugguagucagaugccacaucugcaucuuccuaguugugugacugggcaaguuaucugacuccguuuucuaaucugugaaagggggaugaugauauuuaacucauagggcugcuaugaagauuaaguuaauaaauguagaacaucuuaccacauugcugauaccugguuucauuauuaguaacuauuauccugucucauuuuucaaaagaauuuaagaaaggcacuaucaaaaacugcagacagccaagaucgaugaccucggaaauaacuucaguugcccuuuugcaauugggaaguccuucuugguucuaguuuaagcuucuaaguaaaaaccaaguauuauuuguuagauucuaauaaaauaaaaauaagagguacauauacaaagaacuaaauuauauuguacuuaaaguguucgauauguaaaaugaaacaaaaagucuuugaucuguuaugauaaauauacauccuuauaaaagaguaaaauuaaaacaaucuucagagucacuuuaauuacaaaacaguccagccuaggcaagaaaaaguucuauuccuugucaaugacaaagaagaauucuuuuauuaucucuguguuuauaaaucacuucugcacacaaauguuaauaacuggaacauuucacuaauaugucccaacucggcuaggcaugguuacccacaccuguaaucccaucccagcacuuugggagguggaggugggaggaucacuugaggucaggaguuuaagaccagccuggccaacauggugaaacccugucucuacuuaaaauacaaaaaaauuagccagacgugguggugcacaccuguagucccagcuacucaggaggcugaggcaggagaaucgcuugaaccugggagguggagauggcagugagccgaaaucacgccacuguacucuagccugguugacacagugagacucugugucaaaaaaaaaaaaaaaaaaaaaaaaaagguaccaacucagcuuagugucuacaugaacacaauauaaauauuacacaggaggaaagaaaggccacugcuguguaauguaagaaccaacagaucuguuuuugcauauuccaauaaccaccauuuauaaguauuaacauuuaacaguuccuucuguucuaugcauuugaauguaaucucaauauauagacacugcaauaaauuuuugccugaaauauaaaagaaugacaguaaaauugcauuagauuuuaggauagcagugauauccuuggagguaggggugauacugaccugauaaucggcagagucacacuucaguccucaaguauaaacuuacaguuuucuucaguaaaaaauugggaaaauugccaaauauauuuaaaaugccauuagcaugguggaaauguguccaaugcugcaaaauaaggagaaauuuauuguucaugugauuauacuauaaacaacuugguaaaucccauuaacgucaacugucaucgcugaugaggucugacagcugcagguugauaaugacaagaaagaagaaaacagccaguucuucaaguugaaguugaauaauauaugaaaaauaccaggaaucugacuucccuuuugcaacuaaaauaagggaagguagaggcuuuugagaucuuuuccacuuuaagauguccacugccauuuuaacuucugacuuuucucuuccugaaaugacaaaaaccuauuugcuugaaucaccaugacuuaagcacaacgcacuuagauuuagccgggcgugguggcgggugccuguggucccagcuacucacgaggcuaaggcaggagaauggcgugaacccaggagguggagcuuguagugagccgagauugugccacugcacuccagccugggcgacagagcaagacuccaucucaaaaaaaaaaaaaaaucauaauuacaacggaaauuuuuaaacugccaaauucauauaaggaaaauucucaucuccucaccucccaacaauccauaaacaaacaaaucagccucuuagcaucucgacuuugucuauaaaggcugauuacacauccccacagucuauaaaucugaaauaaaaaccacuuguagacaaauuguguggauacauuaucauacacugugguauagacagcuauagcuguauauauuuuucacauuuaugaucagauguuaaauguuaaauuauauguaauuuuuuguuuaugauuuccuaacaguguauuagacccagcaaauuuuauuaaaaaugauaggcuuuaaauuuuauuugauaaaauguaaucuuugccuuuuauuuuaaggcacuaagucugaaagcccauuugaguugcugaaaccuaacagucaaauggggacagugucaaaggaagaaauaaugcugcaguaaguccuugguugcuucauuaaaacaagaaucaguaauuaaacuaauuacagaucucucaaguuaggacaggaaguaugaauuuguuauacagucaagaauauagacccaacaacauauacacaaaccacugcauaagcuauuccagcaauuucugcccaauauaugggcagaauuauguggccaaggauauucagaaaaaggguauuucuagccccauauucauuaucagaaaaacugacagauuuuugguaugccacauggugucuauagacucauucccuacuuauuuucuaaguaagcugucacuugucaucuucaucaucagugacucugaaggacaagaucaguucaacuagaugcucagcucauuccuuccaagacccgaauuaccuuagaguuuagacacagauauuucuaagucuauggacucauucccuacuuaucuucuaaguaagcugucacuugucauuuucaucaucaguaacuccgaagagcaagaucauuucaacuaaaugcucagcuaauuccuuccaagacccaacuuuccuuagaguuuagacauagauauuucuaaggaaugcuacagucuauaaaucugaaauaaaaaccacuuguagacaaauuaucuggauacauuaucauacacuguggcauagccagcuauagcuauauuaagcuuuauaguuuucucaauaaaaaauacacauauaaauauauacaauaaaaaagauaaagauauuuauuuuuaaaaaagauauuuuaauagccuggaaaaauaaacccauuuaagggcuaaguauaacacuuuuuuuuuuuuuuugagauggaguuucgcucucauugcccaggcuggagugcaauggcacgaucuugaucaccgcagccuucgccucccggguucaagcuauucucccaccucagccuucugaguagcugagauuauaggcaugcgccaccaugccuagcugauuuuauauuuuuaguagagaugggguuucuccauguuggucaagcuggucucaaacuccugaccucaggugauccccccgccuuggccucccaaagugcugggauuacaggugugagccuccgugcccggccuacacuuauuuuuauguuaucaauaagugauuucaaaugagccugcccagcauaccauuugguguauucacagguuucaucccaccaugaaaucuuagcccaauagccaggacagcaugagucuuuucuagaugaacuuucuugugccaacagucagaaguuauggguaucaaaaacugcauccccccaacuaccccacugugccuccuuaacuguaguacugauuuugccuagaaguauguugguguggcucugcucauuuuauucugauauuuuccccucucuggauacuauccgagcuccacuuauucugguuucgguuaugcuucuucuuucuugaagaagucccaguuucugcucuggaauucugacuuaauucuauaagauaacaagcauugcugcugccauuuuaccauauagagacugaauggcggaaaaagaaacacccuaaacagcuucuauagccauguaagcaguaggacagggcaggacagggcagggcaggguggaguacaagcaagauguuugucugucuauuaucugggugugagcauaucuacauagaacugaggcuuuauuucuuuccaggugguagguuuuuccacauaagguaggaaaacaacauuuuuagaugaggcuuagauagcuccugacauagaaaugccucaaaaaaaucuauauagaucuauuuaaauaaaucaacuggacuaauuuuuuuuaaucaguaauuuuaccuaggagagcauucuugcaacgcuggauaaaaaucacuuuuuaauuauauacucagauaucgaacuuaagaaauuuauacucagcuaucaaauuuaagaaauuuauauuuggacuacaaaugacucagauuaaggucauucagugaguuuuuaguauuggugagcaaagugauuagugauuagcgagcaaaguuauaaaggaaauugacuccaauuauguaaagacuccuuuuuuuuuuuuuuuuuuuugagacagagucucacuugguugcccaggcuggagugcacuggcacaaccuuggcucacugcaaccucugccuccgcaguuuaagcaauucuccugccucagccuccuaaguagcugggacuacaggugcgugcuaccacgccuggcuaguuuuuauauuuuuaguagagacgggggucucaccauguuggccaggcuggucuugaacuccugaccucaagugauucgcccaccucagccucccaaagugcugggauuauaggugugagccaccaugcccggcccguaaauacucuuucaauacauauaagccaagccaaaauauaggaggccaguaaauucuuaaaacucaaagagccaagauggacaugugaaauggguguuuuugauaguuugccacuagaucauguacuuuucuuaaaaacccaguauacaugaaauaauaauaaaaaagaaacuugccacauuuacaaauacuaaaucugaauaugaacagaaaugcacugcuauuuuaaaaaaugcauucaaagcuucaguuaauaggguugcuccuuaaaaaaaaauuaaaauguauacaaaacaaccucauauuggagguagaagguguugacacacuaccuugacuaucucaaaagauuuaagauucuaauuuuucagaaggauuauuuauucauuugggauaaaagagugacaacauucuaaauggucccuuucauuccucuuuggcauuuaaggguuaggcuaggaaguaaaacaugucaaugugccacuagaaaauaauuuucuggcugggugcaguggcauaugccuguaaucucagcacuuugggaggccaaacaggaggaucaauugaggccaggcgcucaaggccagccugggcaacagcaaaaaaaaaaaaaaaaaaaaaauuaaaaaaaaaagaaagaaaguaauuuuuugauuaagaaagcagaucuuuuguacauuuguuaaagaaagcuguuuuugaagggcguggcucacaccuguaaucccaacacuuugggaggcugaggccggcaaaucaccugagcucagaaguuugagaccagccuggacaacauggcaaaauccugucccuacaaaaaaugcaaaaauuagccaggcaugguggcaugugugccuguagucccagcuacuugguaggcugaggcaggagaauugcgugagcccgggugguggagguugcagugaggcaagauuacgucacugcacuccagcccgggcaauacagcgagacccugccucaaaaaaaaaaaaaaaaaaaaaagaaagaaaaaagaaagccguuuuuguuacuauuuacaaaaguucuaaaaucaagguauaauaacugaucucauuuuauucaauuccaauauuaaacaguauauaucucaaaucaagcuucucucagaugaaggugaaagauauuacuggaauauuuggauuacuauaauacauguguuaaauacacauaacacaggcugacuuguaccucccaaaauucauauguugaaguccuaagccccaguaccucaaaaugugacugauuuuggaaacaggaucucuaaagagauaauuaaguuaaaaugaggucauuagggugggcucuaauccaauaugacugguguuuuauaagaagaggaaauagagauauagacgggucagaguuaagacaaugugaagacagccaucuuuauaagccaaggagagacgccucagaagaaaccaaucuugcccacacauugaucucagacuucuaggcuccagaauugugaaaaaauaaauuucuauuuuuuaagccaccccaucugugguacuuuguuauagcagcccuagcaaacucacacaacauguuaaccacuuacuacuuugacagaugauuagaacaacuggaucuaauugaauuguagguaagggggaucuaagccuuccucuuaccaugacagcacuacaacacaguauuucucagaaugccuuauuuugccuuaucagucuguuuuuucccagccauauuauagacagcauuauauaaaacagaaugguuugggaacauuuuuagagaaaaucaauuucaggaucccacgaggaaagauguuuugaguuauccugaaauauaauaugaauagugcacuuacaaagaaauuacaauggugccaagggaucaagaugcuuguuuauucaauacugccaacauagacuuugaagcaggccucaagagaucagcucuauaauuaagcuaguauuuuuuagggucaacauuuauaacacuguaguacucuauucaaauacauagugcucuauuuacauuaaagcagauuccagguuaccagauuaucuggaucuaugcuuaauagagaaauuaauuaugauauacuaucagcaauaaucaccaccacuucagaguucuauagcaguuuucuaagaagaauuuaaacaauaauaguaauaaugaaaaaaagauaaacauuuauugagcuaaacauuaauguaugccagacaguguucuaaguacuugacauguacagguauuaacuaauucagucuucacaacaaccuuaggugauaugcuauaaccauccccaacaaauucaucauuaucaucauccuccucauuuaacagaugagaaaccugaggcauagaggcuaaaaaacuugcucaaagccucacagcuaguaugugguagaaaugggaugugaacccagguaaauugacuccagagacucccuugguaaccacugcuuacaucugauccucucauuuuaucagccuuaggaauuguaugguggaaaaaccucagcuaaacaacgauucacaaagcuggaaggagccucagcaauaaucuaauucagcacucucauucuacagaugaguacugaggccagaguuguuaaugugaauacaguuaaauagaacuaggucuagcacacguuuuuuuuuuuuugagacggagucucacuuugucacccaggcuggagugcaauggcgcgaucucggcucacugcaaccuccgccucccagguucaagcaauucuccugccucagccuccuaaguagcugggauuacaggugcccaccaccacgcccagcuaauuuuucuauuuuuaguagagacaggguuucaccauguuggucaggcuggucucgaaccccugaccucgugauccaccugccucggccucccaaagugcugggauuacaggcgugagccacugcgcccggccgcauacaugucuuuuuaagauccaguuuaauucgcuuucugggacaacauaauagguaucagguuuuuguuuuguuuaguucuaagacucaugcaacucugcuauaucucucugugagugugaaugugugaauguguaaguguguguguguacacaucucuuucucugucucucauauaugaugucagcaagauuuauauguauauugaagaaaagaaggaaguagccuuaugcccauaaacaaacauucagauaucucuucccucaaaugagaacauuagugcaaagcuauuaaaaacaggucugggcugggugcagcggcucacgcauguaaucccagcacuuuggaaugccgaggcaggcagaucaccugagauaaagaguucaagaccagccuggccaacauggugaaaccccaucucuacuaaaaauacaaaaauuagccgggcaugguggcgcacaccugugaucccagcuucucagguggcugaggaaagagaaucgcuugaacccaggagguggagguugcagugagcugagauugcaccacugcacuacagccugggagacagagcaagacucuaucucaaaacaagaacaaaaggucugucuaccuggauaucuguuuacaccaucucagguauucucaucugagacaaggccaaacuagaacuacauuaguuaagcuacuggaauggauguuaaugaaaaugaauaacaacuuuuauauuaauaaauuuuuuaucauugaacauuuuaaaaaagauaugucuuuuaacaucagaauauuauuaccaggaaacugaaacauuacauuuuuuuuguuuguuuuuuuugagauggaguuuugcucuuguugcccagccuggagugcaauggcgcaaccucggcucaccgcaaccucggccucaccgcaaccuccgccuccugguucaagagauuccccugccucagacucccaaguagcugggauuacaggcuugugccaccaugccuggcuaauuuuguauuuuuaguagagacgggguuccuccauuuuggucaagcuggucuggcacuccugaccucaagugacccgcccaccucggccucccaaagugcuggaauuacaggcgugagccacugcacccggcugaaucauuucuauauaauuuguuagauggcuuuauuucauuuaaaugaaauuguaacaugauuucaaucaaauauguaucugaccgucucuauugucuaucuguccaucaguccccuaaauuuuugcuuuucugaaauaaugccaccauaacuuguaaaauaccacaagggaacaauaacauguagauugauuauuuucaguaagaugauucaugggccacaauucuagaggcagccuggaaugcaaacccuucaaaugcuaauguaggaugaugacgucauugauuccacuaagauuccacacuggggagaaacuccagaguaugguaugaaggauuaaccaucaaacaguuaaggaaucuguguuuuagcgaugcccauaaccugacuuuaucugaacugcaaaaaaaacuucaaauaauccucuagcagaaauaaaacucgugauguuguuuugucuucuaagacagauaacugacuuaaaaaaaauuuaacaauugaguaucaguugaauauuuccaacaacaagccuggcaauuguuguucuaugguucuucagggacaguaauucugcugggagacaguauguuauaguggaaagcacauggauuuuggaaucugacagagcugaguuugcauccuggcucugccacuugcucuuucauccauuuaaccuuugaacuucaguuuuuuagcuauaaaauggacauaacaauacauacuguaacaggaggcugcaugguuuaaaugaguuagugacuggucagcuucucauuucucauccuuaaagagcauacuuuuugguuucaucugcaaggauaaugaaguuuuccuuuuccaaugggucaucauugucuaucauucacgugucuaauuuacaaaccaaaacaaguuuacuucugacuucuggcagguugaucugcaccaaaaagaaagagauggccuggccaguuccugggaaagucaguuuagagacauguucaagccaauuguaucugcacaauacuugggaaaagaaaaggccagccuucugcuuagauuaguuuuuugugccuuuagcauacagguaaacgcauaccuuugcuuccacugaauuuuaacagguuuuaaucaagucacaacuuuaacuugugaugacugagaaauggguuuccugaaaauaucacagcuauuuuuuuacauuaaauuaaaugcauaauggauauguaucuacauucguaauucaagagcaguuaucacauucuauuacaucaauucaucuguuuacauaucugucuucugucucacaagacucugaacucaucugaacaacuacucugucuauucaacuugaucacacuuagcacuagcagugucugguucagauacugaaaaaaugcugguuggaaagaaauguacagcacuuucaaucucagccaacacaacuggacuuuaccuuuuagaaaaugggaagccacucaacauuuuuaaccuggugaaaaucauaacaaaagcauaguuuuaggaaaguuaaugcuuacaguacagggcugacuugacugaagagaaaauggaaacagaaagaguagucgggaaaaaaauuuaacagcauagguaugaggcaaaaauguaugaacuaggaugguagcaauaagaauggaagagacugacaaaagagacauuaaaaagaauuuacuuaguuauuuaagaauuuacuuacaguaaaugacggauuuucauuuagggagguaagaggggaaauaaucccagaucagcugagguuuugagacugggugacuagaaugaugauaccauuagcaaaaacagggauguuagaaauggaacuggguuuacuggggaaaugaugacugugauacgagacaggcugaaugagaaguuauuugacccccaagaggaacguguuaagagucuguuaguguggugauggcuaaggguuuagaagugaagaagucuuuggggauagagccuuuuaaggaaauuuauucugugcccucaauuuaaggacaagaggcaacaagaugaaacugauauauagggcuagaccagaucauuguuauacccucaaacauuaagucaguuaagaacuagauugguucuguuguuacuucuguagcaccugcuguaacagaaaggacuauuuagcagaaaccaaguaaugagggccucccuggagcccccauucuccaacaaaaaacccaguuugugcuucuuucuuuuuccuauaacuuaccugucaguuaucuuucauccuucucuccauuauaacuuacaauucuuaucucguguuaaaacaauuuaucccugcuucuacuuucuguucuccuucccuggcucucacuuuucuuuuuuuugagauggaguuucacuguuguugcccagccuggagugcaauggcgcgaucuuggcucaccacaaucuccgccuucuggguucaaacgauucuccugucuuggccucccgaguagcugggauuacaggcaugugcuaacaugccuggcuaauuuuguauuuuuaguagagacgggguuucuccauguuggucaggcuggucuugaacucccagccucaggugauccaccugccucagccucccaaagugcugggauuacaggcgugagucaccaugccuggccuggcucucaccuuucuauggugaguagacccagagcacacuucagcuucagccuagccuuucccagcaguuuugcacaaagaaucuacgcagaugcucccgaagcucacggucaggagucuuugucuguagacccaccccaucauccugugcuuuccuauuuuccuuucuuguuucuauuaaacucaguaacaauuaaggguugcauucuuuaaauucaguaacaauugagaacuauauucuuuguggcuccagaagucagaaaggauucauuaaacagcaaaugacacauuuagauuggaaguucuggcucuguaccugaaaugcagaguuuggaaauaacuggcaaagaugagccauauuacagcgcauugcauuaucuaguucaaugccucuuuguagucuuguuuucuucaacccacaaacucccgccuuucauguucccccaccucuacucaacuccccuauccauguuuucuucucacuccaguuuugguuguuccuaucaucgcuccuuacuuugaggacagugggggaggcugucuucaaaaguaagguaaaaaccacuuuuaaucaaaauuaccauuaaaagucccuuaaauuucacagaagguauaacucugcacgguaaucacaguaucuacaaaaccauuuauaugacauucaggaugaugcuacuuaaagauaguagagcuuagaguggagcaacugacaauucagaaagaagacaucggcuagcugaaucccuugccuuucuuuuuuccuuggaccaaaaaacucaagaaagauaaucugcaugacaaaauuauuaaauacacacacuccaagacagauacacacucuccuaaaaaucuuuggcucagaugcuugagaucaugacauaugcaaacaagcuuuguuucccucuauucaggacuuagucauauguugaaaaauuuaaaacaaaaccaaucaauaacuaaaauccaacacuaagucuucaccuuugcuaaaaugcugaagggguaaaauaauguugaauauuaaauucuuuaacucacaugccaagugcuaauaauaauaccugucaauuacuaagugcuucuuauauccuggguaccuugcuuugugauaugugcacguguauguguguauauucauguaauccuuuuuuuuuuuuuuuuuuuuuuuuggugacagagucuugcugugucacccaggcuggagugcagugacacaaucuuagcucacuacaaccuccaccuccuggguucaagcaaauucucaugccucagcuuccugaguagcugggacuacaggcacgugccaccaugccugguuaauuuuuguauuuuuuuuuuucuuugagacagaguuucgcucuuguugcccaggcuggagugcaauggcacgaucuuggcucacugcaaccuccgucucccggguuaaagccauucuccugccucagccuccggaguagcugggauuacaggcaugugccaccacacccuguuaauuuuguauuuuuaguagagaugggguuucuccauguuggucaggcuggucucaaacuccugaccuuaggugauccgccugccuuggccucccaaagugcugggauuacaggugagccacugcaccuggcaauuuuuguauuuuuaguagagacagaguuuugccauguuggccaggcuggucucgagcuccuggccucaagcgauccacccgcuucggccuccaaaagugcugugauuacaggugugagccuccgcaccuggccuauucguguaauccuuaaagaaaccucuccaaguuauuucuaucucacagcugaggaaacagacugagcuacggugaagacagaaaauuuuucucuugcccuggaucacacagugaacaguagcacaguugggauuugaaccuagguuugccuuuaaagucuguguuguaaauaauuacauucuccaggcucaugauaaguaagccauuuucucacuaaaaggcuuuaaauugaacuuuggaagauuuaaauuuuaguuauuagcagcaaauauucagaaacuuuaauuuuguuaauuuuuuauuuuuugagaugaaguuucucucuucuugcccaggcuggagugcaauggcgugaucucggcucacugcaaccuccgccuccuggguuuaagccauucuccugccucaggcucccgaguagcugggauuacaggugaccaucaccaugccuggcuaguuuuuguauuuuuaguagagaagggguuucaccauguuggccaggcuggucucaaacuccugaucucaggugaucugccugccucaaugucccaacgugcugggauuacaggugugagccaccaugcucggccaaauauucagaaauuuuaaaauggccuuuagaaaacaugcuaauaagccacuccuggggccaaccagcauagacugaacaaauuuccucuagaagcauaucucugcuuccugcuucaugacgucaaacaccaguuagauggaaacccccaagaaacaccauucugcuccacucagaaaaaccaagaauucaaauccuacgcugcaaaucaacugguagcacugcaaaugugauucugccaagauacaaauccagagaagacugauuguauuaugcccaccacaaucaauaaucagccuguauaauuacacuuagggacccaaggcuguucugugcuccguuccuauuuuuaguguuacuuuaaaaacacaaaaucaacuaaaaauccauuuuaaaagucccaaaguagaucaauaacuugucaaaaccaaacacucagaaacuauucuuuuuuuuuuuuuuuuuuuuugagacagagucucgcuuuguuucccaggccggggcgcaguggugcaaucucagcucacugcaaacucugccuccuggguucaagcaauucugcugccucagccuccugaguagcuaggauuacaggugcaugccaccacauccagcuaauuuuuuacauuuuugauaaagacgggguuuuaucauguuggccaggcuggucucgaacuccugaccucgugauccacccgccucagcuucccaaagugcuggguuuacagaugugagccaccaagccuggccucagaaacuauucuugaacaaaaaucagcaaucagucccuagugaucucuccuaaauucacuucauuccuaucaggucagauauuuagaacaauaaaauccuaaaaugauuagcacucauuacguucuuaagucugguucaaauuucaugacaguaaaauaguauuuucuaacuagcagauuacauauauauuuuuuuaacuuuuuuuuuuuuuuuuuuuguuaagagacagggucucuuucugcugcccaggcuggagagugcaguggcaugaucauagcucacuguaaccucaaacaccugggcucaagcaagccuccugccucagccucccaaguagcaaggauuacagggaugagccaccacacccugccucacagauauuucuuuauaagaaauucaaaauuuuagucacuuaagacacuggaauuucauaagacagaagauggggaaaaucaaguuaaaugaagacaacaaguaggccguuuauacuaacaaauugugccaaaucuaaucaguacauugccuuucagucuacccuaaggugacagccucaaacuaaguuaaacaaacacucaugaagucauacuauauacuaggaacugugaaagauauaaagaugaaaaacaaaaaauacuacuaucugcccucaaagaauuuauaauucaaggagagagaucagacaucuauccucugcauacuaugcuuuucuucaccuagcaugaccaaacagguguugaaaagguuaaaggaaagauuuucaagacccaaaaguguaacaaacagaucuugcuuacugugcuaaauaauaaaagaauauuauuugcuuuuuccuauuaaaccucggcaaucacaacuuugguuugcuuagucucuuaccuuaguuuauuuucuguucucuguugauauaauacaacuuaucuuuuugggauuuucuguucugcuuuuaguuuuuucugcuguuauugcugggagcucacgucuuacccuucuauugcagcacacauugcguuugcuagagacacccuccaguuucuucuuuguacuuucuuacuggagauuuggaaacaaucacugagaagaccugugagcaccgaguggcucugaaaacuucaaaccuaacuauucaaaaguaauuaucuuuaggaagucuaccuucagaaagucuaaucaagaagguaaaagacaacagucauuacaaucacccuccgugauuccaacuccuugcauuuuauugccaucagcuuuggcuauagcugacagaggggagguagacuugagauuggaagcaaaagaaacuaugcuaaaaacaugguaaauuuuaauauauaaaagcgcuagcaauagaugauuacuggggauucaacgacauuaacaugaggucaaaaucaacacuuugcaccugcugaaaugaagaccacuugacaaaaccuuuaggagcacacuagaagaggcacuuuuugguaaacaugaauagcuagaauaccuugccuuuauuuacucuuaucucugagauuuaaaaauuguucuuacuuuucauccucuaaauuuugauagaugaucguaaaaccaaucaaaauauacaugaauguuuccugggggcggggaggacacuauaaaaaagggguuagagaguuaccaaaggacauaggacuagauuaaucauaaaccuagaugacugacccugaauuuucuucaaacacuuccugucuuuuguuucaaccugcaguauaccuucaagguuaacugcagucucccugagcaauggaccagcccacccuagacugggauauacucauuccuaauccacugcuacuuauuuacuuauguauacuguuucauuugaaaacaugguguuauucauugacugucaagcaacauauacugcauuccugcccacacaaagccagcucugcagauauccaacacacccaccucacugugaaauauaagauggcuuuucaucaaguucucagggaggaaauaggguggaaaaggaaaaaugaaacgcaauucaaaccuaagaaacccuuagaggcugggugcucccagaaggaacagaaaguagaaggaagguacaaagggugaaggagaggagguccuaguucucccucuuucacaguccaaaacagucccaaaacaggagagcucucgacuccucacaagaggccagaggaugcgaggggcugcgggaggaagacugagcaucagagaaugggggaugggaagaacuuaagugggagaagccgcuuccuccguaaagcuggcugucuaggucggucuuugauuuuugcuucgccccaucccuccuuuuugggaaacaccaauuuuaucuuacggaggaaagcagcuccagucccacccuggcgagcagggacagguguagggagggauguuuggccuuccggggguacgaaaugggguugggggcggcagccuagagaaucgguaccugugaguccucuccgccaaggcugaggugcggggugggaggugccuuugaaugaggggugucagagggaagccccuucugaggagcugggaaucgacgagggacaaaaaguagcugugaggacccucggaggaugaggagccgccuccucggggaauaccgggagguggaggagacggccccgcccccucaggggaugggcccagaggccguugagacggcggcgggaggcuaccggugccccuauccuugcuuugcucuugagaacccggccucccagccaucaccaagccccagggauaguugcuccuaccuuuccacgacgcuccgggcuccgcuccccuccgccuccacuccccauccacagcggcugaggcuccgcccccucagccgcccggcgggggcauu

SEQ ID NO: 191330 - RNA, 64987 nt, Homo sapiens
aaugcccccgccgggcggcugagggggcggagccucagccgcuguggauggggaguggaggcggaggggagcggagcccggagcgucguggaaagguaggagcaacuaucccuggggcuuggugauggcugggaggccggguucucaagagcaaagcaaggauaggggcaccgguagccucccgccgccgucucaacggccucugggcccauccccugagggggcggggccgucuccuccaccucccgguauuccccgaggaggcggcuccucauccuccgaggguccucacagcuacuuuuugucccucgucgauucccagcuccucagaaggggcuucccucugacaccccucauucaaaggcaccucccaccccgcaccucagccuuggcggagaggacucacagguaccgauucucuaggcugccgcccccaaccccauuucguacccccggaaggccaaacaucccucccuacaccugucccugcucgccagggugggacuggagcugcuuuccuccguaagauaaaauugguguuucccaaaaaggagggauggggcgaagcaaaaaucaaagaccgaccuagacagccagcuuuacggaggaagcggcuucucccacuuaaguucuucccaucccccauucucugaugcucagucuuccucccgcagccccucgcauccucuggccucuugugaggagucgagagcucuccuguuuugggacuguuuuggacugugaaagagggagaacuaggaccuccucuccuucacccuuuguaccuuccuucuacuuucuguuccuucugggagcacccagccucuaaggguuucuuagguuugaauugcguuucauuuuuccuuuuccacccuauuuccucccugagaacuugaugaaaagccaucuuauauuucacagugagguggguguguuggauaucugcagagcuggcuuugugugggcaggaaugcaguauauguugcuugacagucaaugaauaacaccauguuuucaaaugaaacaguauacauaaguaaauaaguagcaguggauuaggaaugaguauaucccagucuagggugggcugguccauugcucagggagacugcaguuaaccuugaagguauacugcagguugaaacaaaagacaggaaguguuugaagaaaauucagggucagucaucuagguuuaugauuaaucuaguccuauguccuuugguaacucucuaaccccuuuuuuauaguguccuccccgcccccaggaaacauucauguauauuuugauugguuuuacgaucaucuaucaaaauuuagaggaugaaaaguaagaacaauuuuuaaaucucagagauaagaguaaauaaaggcaagguauucuagcuauucauguuuaccaaaaagugccucuucuagugugcuccuaaagguuuugucaaguggucuucauuucagcaggugcaaaguguugauuuugaccucauguuaaugucguugaauccccaguaaucaucuauugcuagcgcuuuuauauauuaaaauuuaccauguuuuuagcauaguuucuuuugcuuccaaucucaagucuaccuccccucugucagcuauagccaaagcugauggcaauaaaaugcaaggaguuggaaucacggagggugauuguaaugacuguugucuuuuaccuucuugauuagacuuucugaagguagacuuccuaaagauaauuacuuuugaauaguuagguuugaaguuuucagagccacucggugcucacaggucuucucagugauuguuuccaaaucuccaguaagaaaguacaaagaagaaacuggagggugucucuagcaaacgcaaugugugcugcaauagaaggguaagacgugagcucccagcaauaacagcagaaaaaacuaaaagcagaacagaaaaucccaaaaagauaaguuguauuauaucaacagagaacagaaaauaaacuaagguaagagacuaagcaaaccaaaguugugauugccgagguuuaauaggaaaaagcaaauaauauucuuuuauuauuuagcacaguaagcaagaucuguuuguuacacuuuugggucuugaaaaucuuuccuuuaaccuuuucaacaccuguuuggucaugcuaggugaagaaaagcauaguaugcagaggauagaugucugaucucucuccuugaauuauaaauucuuugagggcagauaguaguauuuuuuguuuuucaucuuuauaucuuucacaguuccuaguauauaguaugacuucaugaguguuuguuuaacuuaguuugaggcugucaccuuaggguagacugaaaggcaauguacugauuagauuuggcacaauuuguuaguauaaacggccuacuuguugucuucauuuaacuugauuuuccccaucuucugucuuaugaaauuccagugucuuaagugacuaaaauuuugaauuucuuauaaagaaauaucugugaggcagggugugguggcucaucccuguaauccuugcuacuugggaggcugaggcaggaggcuugcuugagcccagguguuugagguuacagugagcuaugaucaugccacugcacucuccagccugggcagcagaaagagacccugucucuuaacaaaaaaaaaaaaaaaaaaaguuaaaaaaauauauauguaaucugcuaguuagaaaauacuauuuuacugucaugaaauuugaaccagacuuaagaacguaaugagugcuaaucauuuuaggauuuuauuguucuaaauaucugaccugauaggaaugaagugaauuuaggagagaucacuagggacugauugcugauuuuuguucaagaauaguuucugaggccaggcuugguggcucacaucuguaaacccagcacuuugggaagcugaggcggguggaucacgaggucaggaguucgagaccagccuggccaacaugauaaaaccccgucuuuaucaaaaauguaaaaaauuagcuggaugugguggcaugcaccuguaauccuagcuacucaggaggcugaggcagcagaauugcuugaacccaggaggcagaguuugcagugagcugagauugcaccacugcgccccggccugggaaacaaagcgagacucugucucaaaaaaaaaaaaaaaaaaaaagaauaguuucugaguguuugguuuugacaaguuauugaucuacuuugggacuuuuaaaauggauuuuuaguugauuuuguguuuuuaaaguaacacuaaaaauaggaacggagcacagaacagccuugggucccuaaguguaauuauacaggcugauuauugauuguggugggcauaauacaaucagucuucucuggauuuguaucuuggcagaaucacauuugcagugcuaccaguugauuugcagcguaggauuugaauucuugguuuuucugaguggagcagaaugguguuucuuggggguuuccaucuaacugguguuugacgucaugaagcaggaagcagagauaugcuucuagaggaaauuuguucagucuaugcugguuggccccaggaguggcuuauuagcauguuuucuaaaggccauuuuaaaauuucugaauauuuggccgagcaugguggcucacaccuguaaucccagcacguugggacauugaggcaggcagaucaccugagaucaggaguuugagaccagccuggccaacauggugaaaccccuucucuacuaaaaauacaaaaacuagccaggcauggugauggucaccuguaaucccagcuacucgggagccugaggcaggagaauggcuuaaacccaggaggcggagguugcagugagccgagaucacgccauugcacuccagccugggcaagaagagagaaacuucaucucaaaaaauaaaaaauuaacaaaauuaaaguuucugaauauuugcugcuaauaacuaaaauuuaaaucuuccaaaguucaauuuaaagccuuuuagugagaaaauggcuuacuuaucaugagccuggagaauguaauuauuuacaacacagacuuuaaaggcaaaccuagguucaaaucccaacugugcuacuguucacugugugauccagggcaagagaaaaauuuucugucuucaccguagcucagucuguuuccucagcugugagauagaaauaacuuggagagguuucuuuaaggauuacacgaauaggccaggugcggaggcucacaccuguaaucacagcacuuuuggaggccgaagcggguggaucgcuugaggccaggagcucgagaccagccuggccaacauggcaaaacucugucucuacuaaaaauacaaaaauugccaggugcaguggcucaccuguaaucccagcacuuugggaggccaaggcaggcggaucaccuaaggucaggaguuugagaccagccugaccaacauggagaaaccccaucucuacuaaaaauacaaaauuaacagggugugguggcacaugccuguaaucccagcuacuccggaggcugaggcaggagaauggcuuuaacccgggagacggagguugcagugagccaagaucgugccauugcacuccagccugggcaacaagagcgaaacucugucucaaagaaaaaaaaaaauacaaaaauuaaccaggcaugguggcacgugccuguagucccagcuacucaggaagcugaggcaugagaauuugcuugaacccaggagguggagguuguagugagcuaagauugugucacugcacuccagccugggugacacagcaagacucugucaccaaaaaaaaaaaaaaaaaaaaaaaaggauuacaugaauauacacacauacacgugcacauaucacaaagcaagguacccaggauauaagaagcacuuaguaauugacagguauuauuauuagcacuuggcaugugaguuaaagaauuuaauauucaacauuauuuuaccccuucagcauuuuagcaaaggugaagacuuaguguuggauuuuaguuauugauugguuuuguuuuaaauuuuucaacauaugacuaaguccugaauagagggaaacaaagcuuguuugcauaugucaugaucucaagcaucugagccaaagauuuuuaggagaguguguaucugucuuggaguguguguauuuaauaauuuugucaugcagauuaucuuucuugaguuuuuugguccaaggaaaaaagaaaggcaagggauucagcuagccgaugucuucuuucugaauugucaguugcuccacucuaagcucuacuaucuuuaaguagcaucauccugaaugucauauaaaugguuuuguagauacugugauuaccgugcagaguuauaccuucugugaaauuuaagggacuuuuaaugguaauuuugauuaaaagugguuuuuaccuuacuuuugaagacagccucccccacuguccucaaaguaaggagcgaugauaggaacaaccaaaacuggagugagaagaaaacauggauaggggaguugaguagaggugggggaacaugaaaggcgggaguuuguggguugaagaaaacaagacuacaaagaggcauugaacuagauaaugcaaugcgcuguaauauggcucaucuuugccaguuauuuccaaacucugcauuucagguacagagccagaacuuccaaucuaaaugugucauuugcuguuuaaugaauccuuucugacuucuggagccacaaagaauauaguucucaauuguuacugaauuuaaagaaugcaacccuuaauuguuacugaguuuaauagaaacaagaaaggaaaauaggaaagcacaggaugauggggugggucuacagacaaagacuccugaccgugagcuucgggagcaucugcguagauucuuugugcaaaacugcugggaaaggcuaggcugaagcugaagugugcucugggucuacucaccauagaaaggugagagccaggccaggcauggugacucacgccuguaaucccagcacuuugggaggcugaggcagguggaucaccugaggcugggaguucaagaccagccugaccaacauggagaaaccccgucucuacuaaaaauacaaaauuagccaggcauguuagcacaugccuguaaucccagcuacucgggaggccaagacaggagaaucguuugaacccagaaggcggagauuguggugagccaagaucgcgccauugcacuccaggcugggcaacaacagugaaacuccaucucaaaaaaaagaaaagugagagccagggaaggagaacagaaaguagaagcagggauaaauuguuuuaacacgagauaagaauuguaaguuauaauggagagaaggaugaaagauaacugacagguaaguuauaggaaaaagaaagaagcacaaacuggguuuuuuguuggagaaugggggcuccagggaggcccucauuacuugguuucugcuaaauaguccuuucuguuacagcaggugcuacagaaguaacaacagaaccaaucuaguucuuaacugacuuaauguuugaggguauaacaaugaucuggucuagcccuauauaucaguuucaucuuguugccucuuguccuuaaauugagggcacagaauaaauuuccuuaaaaggcucuauccccaaagacuucuucacuucuaaacccuuagccaucaccacacuaacagacucuuaacacguuccucuugggggucaaauaacuucucauucagccugucucguaucacagucaucauuuccccaguaaacccaguuccauuucuaacaucccuguuuuugcuaaugguaucaucauucuagucacccagucucaaaaccucagcugaucugggauuauuuccccucuuaccucccuaaaugaaaauccgucauuuacuguaaguaaauucuuaaauaacuaaguaaauucuuuuuaaugucucuuuugucagucucuuccauucuuauugcuaccauccuaguucauacauuuuugccucauaccuaugcuguuaaauuuuuuucccgacuacucuuucuguuuccauuuucucuucagucaagucagcccuguacuguaagcauuaacuuuccuaaaacuaugcuuuuguuaugauuuucaccagguuaaaaauguugaguggcuucccauuuucuaaaagguaaaguccaguuguguuggcugagauugaaagugcuguacauuucuuuccaaccagcauuuuuucaguaucugaaccagacacugcuagugcuaagugugaucaaguugaauagacagaguaguuguucagaugaguucagagucuugugagacagaagacagauauguaaacagaugaauugauguaauagaaugugauaacugcucuugaauuacgaauguagauacauauccauuaugcauuuaauuuaauguaaaaaaauagcugugauauuuucaggaaacccauuucucagucaucacaaguuaaaguugugacuugauuaaaaccuguuaaaauucaguggaagcaaagguaugcguuuaccuguaugcuaaaggcacaaaaaacuaaucuaagcagaaggcuggccuuuucuuuucccaaguauugugcagauacaauuggcuugaacaugucucuaaacugacuuucccaggaacuggccaggccaucucuuucuuuuuggugcagaucaaccugccagaagucagaaguaaacuuguuuugguuuguaaauuagacacgugaaugauagacaaugaugacccauuggaaaaggaaaacuucauuauccuugcagaugaaaccaaaaaguaugcucuuuaaggaugagaaaugagaagcugaccagucacuaacucauuuaaaccaugcagccuccuguuacaguauguauuguuauguccauuuuauagcuaaaaaacugaaguucaaagguuaaauggaugaaagagcaaguggcagagccaggaugcaaacucagcucugucagauuccaaaauccaugugcuuuccacuauaacauacugucucccagcagaauuacugucccugaagaaccauagaacaacaauugccaggcuuguuguuggaaauauucaacugauacucaauuguuaaauuuuuuuuaagucaguuaucugucuuagaagacaaaacaacaucacgaguuuuauuucugcuagaggauuauuugaaguuuuuuuugcaguucagauaaagucagguuaugggcaucgcuaaaacacagauuccuuaacuguuugaugguuaauccuucauaccauacucuggaguuucuccccaguguggaaucuuaguggaaucaaugacgucaucauccuacauuagcauuugaaggguuugcauuccaggcugccucuagaauuguggcccaugaaucaucuuacugaaaauaaucaaucuacauguuauuguucccuugugguauuuuacaaguuaugguggcauuauuucagaaaagcaaaaauuuaggggacugauggacagauagacaauagagacggucagauacauauuugauugaaaucauguuacaauuucauuuaaaugaaauaaagccaucuaacaaauuauauagaaaugauucagccgggugcaguggcucacgccuguaauuccagcacuuugggaggccgaggugggcgggucacuugaggucaggagugccagaccagcuugaccaaaauggaggaaccccgucucuacuaaaaauacaaaauuagccaggcaugguggcacaagccuguaaucccagcuacuugggagucugaggcaggggaaucucuugaaccaggaggcggagguugcggugaggccgagguugcggugagccgagguugcgccauugcacuccaggcugggcaacaagagcaaaacuccaucucaaaaaaaacaaacaaaaaaaauguaauguuucaguuuccugguaauaauauucugauguuaaaagacauaucuuuuuuaaaauguucaaugauaaaaaauuuauuaauauaaaaguuguuauucauuuucauuaacauccauuccaguagcuuaacuaauguaguucuaguuuggccuugucucagaugagaauaccugagaugguguaaacagauauccagguagacagaccuuuuguucuuguuuugagauagagucuugcucugucucccaggcuguagugcaguggugcaaucucagcucacugcaaccuccaccuccuggguucaagcgauucucuuuccucagccaccugagaagcugggaucacaggugugcgccaccaugcccggcuaauuuuuguauuuuuaguagagaugggguuucaccauguuggccaggcuggucuugaacucuuuaucucaggugaucugccugccucggcauuccaaagugcugggauuacaugcgugagccgcugcacccagcccagaccuguuuuuaauagcuuugcacuaauguucucauuugagggaagagauaucugaauguuuguuuaugggcauaaggcuacuuccuucuuuucuucaauauacauauaaaucuugcugacaucauauaugagagacagagaaagagauguguacacacacacacuuacacauucacacauucacacucacagagagauauagcagaguugcaugagucuuagaacuaaacaaaacaaaaaccugauaccuauuauguugucccagaaagcgaauuaaacuggaucuuaaaaagacauguaugcggccgggcgcaguggcucacgccuguaaucccagcacuuugggaggccgaggcagguggaucacgaggucagggguucgagaccagccugaccaacauggugaaacccugucucuacuaaaaauagaaaaauuagcugggcgugguggugggcaccuguaaucccagcuacuuaggaggcugaggcaggagaauugcuugaaccugggaggcggagguugcagugagccgagaucgcgccauugcacuccagccugggugacaaagugagacuccgucucaaaaaaaaaaaaacgugugcuagaccuaguucuauuuaacuguauucacauuaacaacucuggccucaguacucaucuguagaaugagagugcugaauuagauuauugcugaggcuccuuccagcuuugugaaucguuguuuagcugagguuuuuccaccauacaauuccuaaggcugauaaaaugagaggaucagauguaagcagugguuaccaagggagucucuggagucaauuuaccuggguucacaucccauuucuaccacauacuagcugugaggcuuugagcaaguuuuuuagccucuaugccucagguuucucaucuguuaaaugaggaggaugaugauaaugaugaauuuguuggggaugguuauagcauaucaccuaagguuguugugaagacugaauuaguuaauaccuguacaugucaaguacuuagaacacugucuggcauacauuaauguuuagcucaauaaauguuuaucuuuuuuucauuauuacuauuauuguuuaaauucuucuuagaaaacugcuauagaacucugaagugguggugauuauugcugauaguauaucauaauuaauuucucuauuaagcauagauccagauaaucugguaaccuggaaucugcuuuaauguaaauagagcacuauguauuugaauagaguacuacaguguuauaaauguugacccuaaaaaauacuagcuuaauuauagagcugaucucuugaggccugcuucaaagucuauguuggcaguauugaauaaacaagcaucuugaucccuuggcaccauuguaauuucuuuguaagugcacuauucauauuauauuucaggauaacucaaaacaucuuuccucgugggauccugaaauugauuuucucuaaaaauguucccaaaccauucuguuuuauauaaugcugucuauaauauggcugggaaaaaacagacugauaaggcaaaauaaggcauucugagaaauacuguguuguagugcugucaugguaagaggaaggcuuagaucccccuuaccuacaauucaauuagauccaguuguucuaaucaucugucaaaguaguaagugguuaacauguugugugaguuugcuagggcugcuauaacaaaguaccacagaugggguggcuuaaaaaauagaaauuuauuuuuucacaauucuggagccuagaagucugagaucaaugugugggcaagauugguuucuucugaggcgucucuccuuggcuuauaaagauggcugucuucacauugucuuaacucugacccgucuauaucucuauuuccucuucuuauaaaacaccagucauauuggauuagagcccacccuaaugaccucauuuuaacuuaauuaucucuuuagagauccuguuuccaaaaucagucacauuuugagguacuggggcuuaggacuucaacauaugaauuuugggagguacaagucagccuguguuauguguauuuaacacauguauuauaguaauccaaauauuccaguaauaucuuucaccuucaucugagagaagcuugauuugagauauauacuguuuaauauuggaauugaauaaaaugagaucaguuauuauaccuugauuuuagaacuuuuguaaauaguaacaaaaacggcuuucuuuuuucuuucuuuuuuuuuuuuuuuuuuuuuugaggcagggucucgcuguauugcccgggcuggagugcagugacguaaucuugccucacugcaaccuccaccacccgggcucacgcaauucuccugccucagccuaccaaguagcugggacuacaggcacacaugccaccaugccuggcuaauuuuugcauuuuuuguagggacaggauuuugccauguuguccaggcuggucucaaacuucugagcucaggugauuugccggccucagccucccaaaguguugggauuacaggugugagccacgcccuucaaaaacagcuuucuuuaacaaauguacaaaagaucugcuuucuuaaucaaaaaauuacuuucuuucuuuuuuuuuuaauuuuuuuuuuuuuuuuuuuuuugcuguugcccaggcuggccuugagcgccuggccucaauugauccuccuguuuggccucccaaagugcugagauuacaggcauaugccacugcacccagccagaaaauuauuuucuaguggcacauugacauguuuuacuuccuagccuaacccuuaaaugccaaagaggaaugaaagggaccauuuagaauguugucacucuuuuaucccaaaugaauaaauaauccuucugaaaaauuagaaucuuaaaucuuuugagauagucaagguagugugucaacaccuucuaccuccaauaugagguuguuuuguauacauuuuaauuuuuuuuuaaggagcaacccuauuaacugaagcuuugaaugcauuuuuuaaaauagcagugcauuucuguucauauucagauuuaguauuuguaaauguggcaaguuucuuuuuuauuauuauuucauguauacuggguuuuuaagaaaaguacaugaucuaguggcaaacuaucaaaaacacccauuucacauguccaucuuggcucuuugaguuuuaagaauuuacuggccuccuauauuuuggcuuggcuuauauguauugaaagaguauuuacgggccgggcaugguggcucacaccuauaaucccagcacuuugggaggcugaggugggcgaaucacuugaggucaggaguucaagaccagccuggccaacauggugagacccccgucucuacuaaaaauauaaaaacuagccaggcgugguagcacgcaccuguagucccagcuacuuaggaggcugaggcaggagaauugcuuaaacugcggaggcagagguugcagugagccaagguugugccagugcacuccagccugggcaaccaagugagacucugucucaaaaaaaaaaaaaaaaaaaaggagucuuuacauaauuggagucaauuuccuuuauaacuuugcucgcuaaucacuaaucacuuugcucaccaauacuaaaaacucacugaaugaccuuaaucugagucauuuguaguccaaauauaaauuucuuaaauuugauagcugaguauaaauuucuuaaguucgauaucugaguauauaauuaaaaagugauuuuuauccagcguugcaagaaugcucuccuagguaaaauuacugauuaaaaaaaauuaguccaguugauuuauuuaaauagaucuauauagauuuuuuugaggcauuucuaugucaggagcuaucuaagccucaucuaaaaauguuguuuuccuaccuuauguggaaaaaccuaccaccuggaaagaaauaaagccucaguucuauguagauaugcucacacccagauaauagacagacaaacaucuugcuuguacuccacccugcccugcccuguccugcccuguccuacugcuuacauggcuauagaagcuguuuaggguguuucuuuuuccgccauucagucucuauaugguaaaauggcagcagcaaugcuuguuaucuuauagaauuaagucagaauuccagagcagaaacugggacuucuucaagaaagaagaagcauaaccgaaaccagaauaaguggagcucggauaguauccagagaggggaaaauaucagaauaaaaugagcagagccacaccaacauacuucuaggcaaaaucaguacuacaguuaaggaggcacagugggguaguuggggggaugcaguuuuugauacccauaacuucugacuguuggcacaagaaaguucaucuagaaaagacucaugcuguccuggcuauugggcuaagauuucauggugggaugaaaccugugaauacaccaaaugguaugcugggcaggcucauuugaaaucacuuauugauaacauaaaaauaaguguaggccgggcacggaggcucacaccuguaaucccagcacuuugggaggccaaggcggggggaucaccugaggucaggaguuugagaccagcuugaccaacauggagaaaccccaucucuacuaaaaauauaaaaucagcuaggcaugguggcgcaugccuauaaucucagcuacucagaaggcugaggugggagaauagcuugaacccgggaggcgaaggcugcggugaucaagaucgugccauugcacuccagccugggcaaugagagcgaaacuccaucucaaaaaaaaaaaaaaaguguuauacuuagcccuuaaauggguuuauuuuuccaggcuauuaaaauaucuuuuuuaaaaauaaauaucuuuaucuuuuuuauuguauauauuuauauguguauuuuuuauugagaaaacuauaaagcuuaauauagcuauagcuggcuaugccacaguguaugauaauguauccagauaauuugucuacaagugguuuuuauuucagauuuauagacuguagcauuccuuagaaauaucuaugucuaaacucuaaggaaaguugggucuuggaaggaauuagcugagcauuuaguugaaaugaucuugcucuucggaguuacugaugaugaaaaugacaagugacagcuuacuuagaagauaaguagggaaugaguccauagacuuagaaauaucugugucuaaacucuaagguaauucgggucuuggaaggaaugagcugagcaucuaguugaacugaucuuguccuucagagucacugaugaugaagaugacaagugacagcuuacuuagaaaauaaguagggaaugagucuauagacaccauguggcauaccaaaaaucugucaguuuuucugauaaugaauauggggcuagaaauacccuuuuucugaauauccuuggccacauaauucugcccauauauugggcagaaauugcuggaauagcuuaugcagugguuuguguauauguuguugggucuauauucuugacuguauaacaaauucauacuuccuguccuaacuugagagaucuguaauuaguuuaauuacugauucuuguuuuaaugaagcaaccaaggacuuacugcagcauuauuucuuccuuugacacuguccccauuugacuguuagguuucagcaacucaaaugggcuuucagacuuagugccuuaaaauaaaaggcaaagauuacauuuuaucaaauaaaauuuaaagccuaucauuuuuaauaaaauuugcugggucuaauacacuguuaggaaaucauaaacaaaaaauuacauauaauuuaacauuuaacaucugaucauaaaugugaaaaauauauacagcuauagcugucuauaccacaguguaugauaauguauccacacaauuugucuacaagugguuuuuauuucagauuuauagacuguggggauguguaaucagccuuuauagacaaagucgagaugcuaagaggcugauuuguuuguuuauggauuguugggaggugaggagaugagaauuuuccuuauaugaauuuggcaguuuaaaaauuuccguuguaauuaugauuuuuuuuuuuuuuugagauggagucuugcucugucgcccaggcuggagugcaguggcacaaucucggcucacuacaagcuccaccuccuggguucacgccauucuccugccuuagccucgugaguagcugggaccacaggcacccgccaccacgcccggcuaaaucuaagugcguugugcuuaagucauggugauucaagcaaauagguuuuugucauuucaggaagagaaaagucagaaguuaaaauggcaguggacaucuuaaaguggaaaagaucucaaaagccucuaccuucccuuauuuuaguugcaaaagggaagucagauuccugguauuuuucauauauuauucaacuucaacuugaagaacuggcuguuuucuucuuucuugucauuaucaaccugcagcugucagaccucaucagcgaugacaguugacguuaaugggauuuaccaaguuguuuauaguauaaucacaugaacaauaaauuucuccuuauuuugcagcauuggacacauuuccaccaugcuaauggcauuuuaaauauauuuggcaauuuucccaauuuuuuacugaagaaaacuguaaguuuauacuugaggacugaagugugacucugccgauuaucaggucaguaucaccccuaccuccaaggauaucacugcuauccuaaaaucuaaugcaauuuuacugucauucuuuuauauuucaggcaaaaauuuauugcagugucuauauauugagauuacauucaaaugcauagaacagaaggaacuguuaaauguuaauacuuauaaauggugguuauuggaauaugcaaaaacagaucuguugguucuuacauuacacagcaguggccuuucuuuccuccuguguaauauuuauauuguguucauguagacacuaagcugaguugguaccuuuuuuuuuuuuuuuuuuuuuuuuuugacacagagucucacugugucaaccaggcuagaguacaguggcgugauuucggcucacugccaucuccaccucccagguucaagcgauucuccugccucagccuccugaguagcugggacuacaggugugcaccaccacgucuggcuaauuuuuuuguauuuuaaguagagacaggguuucaccauguuggccaggcuggucuuaaacuccugaccucaagugauccucccaccuccaccucccaaagugcugggaugggauuacagguguggguaaccaugccuagccgaguugggacauauuagugaaauguuccaguuauuaacauuugugugcagaagugauuuauaaacacagagauaauaaaagaauucuucuuugucauugacaaggaauagaacuuuuucuugccuaggcuggacuguuuuguaauuaaagugacucugaagauuguuuuaauuuuacucuuuuauaaggauguauauuuaucauaacagaucaaagacuuuuuguuucauuuuacauaucgaacacuuuaaguacaauauaauuuaguucuuuguauauguaccucuuauuuuuauuuuauuagaaucuaacaaauaauacuugguuuuuacuuagaagcuuaaacuagaaccaagaaggacuucccaauugcaaaagggcaacugaaguuauuuccgaggucaucgaucuuggcugucugcaguuuuugauagugccuuucuuaaauucuuuugaaaaaugagacaggauaauaguuacuaauaaugaaaccagguaucagcaaugugguaagauguucuacauuuauuaacuuaaucuucauagcagcccuaugaguuaaauaucaucaucccccuuucacagauuagaaaacggagucagauaacuugcccagucacacaacuaggaagaugcagauguggcaucugacuaccaagcuacauguucuuuccaauauaaccucuaauaaaguguagcuuuauuagguuuguuagaauuuuuuuguuuaguuuuguuuuaguuuuuauuuuuauuuuuaaaauaaauguuaucagauauaucccugauacuaaagugaacgucauuuacuaguugcugaaauucacuuguuagaaaauagaggcugggcgugguggcucacaccuuuaaucucagcacuuugagaggccaaggcgggcggaucaccugaggucaggaguuggagaccagcuuggccaacaugguaaaaccccaucucuacuaaaaauacaaaaauuagcugggcaugauggcaugugccuguaaucccagcuacuugggaggcugaggcaggagaaucgcuggaacccgggaggcggagguugcagugagccaagacugcaccauugcucuccagccugggcaacaagagcaaaacucugucucaaaaaaauaaauaaauaaaaagaaaaagaaaaaaaggccaggugugguggcucacaccuguaauccuagcacuuugggagacugaggugggcggaucaccugaggucaggaguucaagaccagccuugccaacauggugaaaccccgucucuacuaaaauacaaaaauuagccaggcgugauggugguugccuguaaucccagcuacucagaggcugagacuggagaaguacuugaaccugggagacggugguugcagugagccgaaaucaccccacugcauuccagccugggcaacugagugagacuccaucucaaaaaaagaaaauuagcaguuagagcugagguuacaucgaagauguuuuacuaugcuuuaaaagacuuggacagcauguccuggaacacaaucuaacaacaaagugaaguaugcauuuuauacauguucacuuaaaagcaguagcucuggaaggaaucaauucuuuuuuugugugccccccaaaauuaaaaagagugauaaauuacuggaggaugugugaacuggucauguuuugauucacuuuccauaagaguggcaauuugaaaauaaaaaguggagagagaaauauuuguucuacuuuggaaauuauaaaauauaucuuaccauacacacuggucagaaggcucuuccaagauuguacagcagucuaacuuguaucuuuaugugguuugugagaauuaguguuguagaaaggauugaguuugugucaugcaauuugccauuuaacauacuuuggaacaugcagauucucagagaaaugugaacuuaccaagucagauaaauucaguuuuugguagccuagccaauuaagauguuuaaacaggccuggcacaguggcucaugccuguaaucccagcacuuugaaggcuaaggugggaggaucacuugagcccaggaguuugaguccagucugggcaacacagggagaccccauuucuacaaacaauaaaaaauaaauuaaccaggcgugguggcauguaucggugauccuagcuacuugggaggcugaggcgggagaauuacuugagcccaggagguugaggcugcagugagccguguuugcaccacuacacuccagccugggugacagagcaagacccugucuuaaaacaaaaaaaaauaaagauguuuaaacccuauacuuugagaauucauuuaaaaguaaguuugcauauaguugaauuaagucuauuuuacuauacaagauauaaauauuguguuagcuauugucugugaaagcagacaauuuaaaagaaaaauuucucccauacucccaccaaacauuaucucuuuucccgaauuuuauuuuaaccaauugaagagggauaucagaauguuuuauauacaguuuuggaaauugguuaucuaaaacugggaaaucuuuugauggucuaucaauuuuucagagaaaugguauucauuauaacacaauuuuaccugaaaaaucaguggcuaauucuuguuugcuuuuuuuuugguuuuuuuuuuuugagacagagucucacucugucgcccaggcuggaguacaguggcguggucucggcucacugcaaucuuugccucccgcguucaagugauuccccugccucagccucccgaguagcugggacuacaggcgugccccaccaugcccggcuaauguuuuguauuucaguagagacaggguuuuaccauguuggccgggauggucucgaucuccugacuucgugguccgcccaccuuagccucccaaagugcugggauuacaggcaugagccacugcacccagcccuagcggcuaauucuuucugagauuuccuaggauauuuguuuguaaacgugucuggaggaaauaugaugaaaaauugaucuuugugagugguagugaaaucaauaauuaaagugaauuuuacuuucuguuguugcuuaguuugugauuaacaccagaaaacauauuucuauuuaauuucaacuauuuccuuuauuaaggcauuugauacuauaauugcucuuaucucucacuuuauuuuuucuuuaauuguaucaaauuaacuaugucuuuggagauugucugauuguuaccuuuguuucaggcuuucaagaugaaucuggaaaaacucagcaagccugaacuccugacacuauuuaguauucuugaaggagagcuugaagcaagggaccuuguuauagaagccuuaaagguauguuaaaagaaaaaaaaaaagaggucaucauacauugugaaagucauucauuaguuuuaauuuauuuaacuaagguauuucugcaguuuccauugaaauuaaauggaggacauacugauacuugccauagguagccaccuacauuguguguuauuagggacacuggugaaaccuuucuguuuucaaaauaguucccuuaguuucucgaucugaugucuagaccuugaacuucauucuuuuuuuuuuuuugagacggagugucacucugucgccaggcuggagugcaguggcgcuaucucggcucacugcaacuucugccuccugcauucaaguuccugccccagccuccugaguagcugggacuacaggcgcacaccaccaugcccagcuaauuuuuguauuuuuaguagagacaggguuucaccauguuggccaggauggucuugaucucuugaccuggugauccgcccccgcuuagccucccaaagugcugaaauuacaggugugagccaccacgcccggcagaauuucauucuuuuaguuuaguggcccuuagcuguuuuugaacgcugaccccuuugagacuugauaagagcaacuuccuaauaaauguacauacauccauauaucaaaauuugaaauauaauaucugggagaucaaggaucccaugaaaacauccacggauucccuggaccccagauuaagaauucuuuugguaguuuuagcccauuucuaauugucacugcuaauugccuauuguuagucucacuucuuugccccauuuaucaucugucucaaucccuucauaauuaggauaggaguggagguaacagcugccucuaauggaaaaaucagaggaugaccucguuuucucuuuuauaguuuuaccgagauaaccugucugcuuuucagccuuagaaacuguacaaaccuguagugcuuuaugugucuauuuacuaaucacuguauccucagcacccagcauagugccaggcauguagaugcucaguaaauguuuguugaacaaaugaaaugauuguaccauugugguguguuacuuuaaaagauuacuauaauacuucuaaguggauguugugaauuacuaaauuuuaaagccucuucuuauguacucugcagcacauacugccuucugguuuuaauguuaacagaugcuuagaugcuuuuugcacauguuuuccuaaaauauauuuuuuucuucaugaauccaauuuugguuacuauaggcaguucugauaaguugagagagaagcuugagaagcaagagcuaaaauuaagggagcauuuugauauaagauaccauucagaaucaggcacaaguguuguauuuagucugcauauggucuguaggugauaaaauuauucugaggcuuaacucugugcaguuuaggugaaaugaauaacuucaccagaagugacauaucuuuaaacaaucuauuguuagauaaaauagggggcagccgggauuaaaauuguuucaaucguuugagaaaaguaacugccauagcauucuuuaaacugaaguaucauuuuauuuauggaguuuugggggguuuuuuguuguuauuuguuuugguucuccaauguaucaggauuuuacugcauuauuuguaucguuuuugcuuaacaauaaacaccuguuggacuuuaugaacuacuauggcaacuuaccaauuuucuuccuuuuaauauugguucuuaauugaugcuuagucgguugaaaagguuuuggucuuuguucuaaauaguuaugauuuguuuuucuuuucuguuuugucuccaguaaaaaaaagcuuaucuuuuuauuuucucccuagcuucaaaauagauuuuugucuggacauaaaaucuguucuuuaaucuuauaucucuaaacaaaaccauauggcuuacugucacuucuuuggcaaggcuugaguuucuuucaggauauguuguaaaguucccauaggcuguaaguugaccucaccuauagaguuagaauuguaaaagagcuacauuccuauuccaaaauuucugcaaagugccagauugcagcuauacucuucuagagccccccauaauuacguucuuuuucuucccagaauccuccucacucacucucuauugcagccaagacauguuuggcauagaaccagggaaagccaauagaaaauaauguaacacauuauucagugucuuguauauuucaaaucuaauuguuauggaggggaccuauacuauauuugguccuaauuaaauuuuauuuaaagugguuuucuguuuuagaaggaaucaugucagaaaaaaaaaaacuucuuuaugaacgucuuucccuuuuauuacuuuaauuucaugaauaagaacaccaaaggaauacccucuacaaugaaagcaaauuacauugcucaugaacugucugggggaagcagagaguggaaccacauaguucagcaggaaagccucaguucauuaauuccaagcaaaucuaguaaauggcuuccuaccauaggcugugauugcuucagaggagaauaaaggaagguuaaucaauggccauuuuaaaaaaucugaaaaauagauuugacugcuaauaaaauuuagauuaaauaguuuauuucugaauauuccacaucggguauauuacaucugcacaucuuagaucugaugcaaagccacacuaaauggcuucugugacuaaauagaauccaccuugcauuuauugguauugcuuuauuuuaaagcauucuuuaaaucaucuauacaaugauaaauggugaaauauuacagcuuucaugugcgauuaacuuaaggagucuugaauucguuuccauugaugccucaaucauaaaauagggauauccucuuuuaaaaccgaggauagaacuuuguuguguuuggccaaaugcuguugcaaaaucccccaagcaagaagauuuacaggcaaaaauguuguagacaugacaaaguuagaaguauauuuagaguaugagauuauguaauacaucauucuauagguuuaacuguugugaguuuuuucagccacaaaggguuaaaaugaaaaaaucgaaauguuaugucuuuguugaaacaaauaauuuacuuucacugaaaauauuauugaaaaaauaaucauaaggaucuaaugacagugccaaaauauagaaaacaaaaguuaccauggaaggugcuguggcuuaagaacaucacagcuaugaucauauagugguuaguacucuguguugugccugcagcaaccucaguuguauccaaguuguggcaccaaaaauuaaaaaaaaaauaacaaugcaaguucacuauaaguccauagccuaacaucugccuuuggucacggccuuguacuuauuauggaagcagauuauuauaaagacuggucugaaaugaaaaacguaaaauugaacuuagcaaucaccauacauacuaauaagccugugaagagaguuugcauuuuuuaaaaaaaucagauauuagcuugcuugauaacagaucuuugaaagucuuaaacggacucaaguugaaacauucucuggcacccauaagccuggaccuaacaguucuuuggccaaaaaugaucccauuuuaauagaugguuuuuaggaagagcuuuuaagauugggaugggugguuucgaucauugauaaagaucacaugaacacaugaacauaagcuauaacugacagaaguccaauuucugucuaguucccaacugggauauuagggugggagcagaacuuuauuuagguuacugaguuauaagguuuuuauauuuacaguauucauaaccuuuauuauaaaacguuaaugaauuaaucagugaccauuuguggccacauuuuaauauguuuuuuagaguuggaguggcuuuuuuuuuuuuuuugagaugaagucucgcucuguugcccaggcuggagugcaauagcaugguuucagcucacugcagccuccgccuccugaguucaagugauucuccugucucagccuccgaguagcugggauuacaggcgugcgccaccacacccagcuaauuuuuuaauacuuuuauagagaugggguuuuaccguauuggccaggcuggucuugaacuccugacuccugaucuacccaccucagccucccaaagugcugggauuacaugcgugagccaccacacccagccuggaguggcuauuuuuauuccuaugcucuguuucuuuuucuggagacagagucuuacucugucgccuaggcuagagugcaguggcuggagugagcagcucacugcagccucaaccugcuggacuucaguaauucucccaccucagccuccugaguaacugggacuacaggggcaugccacuauaccuggcuaaguuuuguauuuuuuguagagacaggguuuugccauguuacccaggcugguuucgaacuccugcucaagcaguucugcugucccagccucccaaagugcugggauuacaggcaugagccaccgugccagccuauuccugcucucucugaguaaaguuuauacauggauuccugauuuuucaaaaaagaaacauaaagauaauuacuaggcacucuucaaaaccaucaaccagaacauucaauuaaguguagcuguuaggaaugugagcuuucaagugagacagacuuuaggguuugagcucugccacucaauuguagugugaucuuagaccaauuauuuuaccuuguaaguuuuauugguaaaauguuaugguuauuacgaggaccaaaugagauagcaaaugcuaauugaagugcucagugcucauuuacuguugguuauuauuauuagaacagagguucaaaguccauccauccauuuaggaacaaagauacauuccauaaagcaagaaauacuaauaaggccaggcacuguggcuuaugccuauuaaucccagcacuuugggaggccgaggcaggaggcauuauguugccaaggcuagacucggacuccuagccugaagugcuaagaguuugagucuagccuuugcaacauaaugagacccccauuucuuuucuuuuuuuuuuuuuuuuuugagacggaguugcccaggcuggagugcaguggcacaaucucagcucacugcaaccucugccuccuggguucaagcgauucuccugccucagccucccaaguagcugggacugcaggugugcgccaccacgcccggcuaguuuuuuuguauuuuuaguagagaugggguuucaccauguuggccaggcuggucuugaacuccugaccucguaauccaccugccucggccucccaaagugcugggauuacaggcaugagccacugugcccggcaagacccccauuucuacaaaaaaaaaaaaaaaggagaagaagaaagaaauacugauaauaggaaaaugacaguucuucucaauuaaaucuuuguuguuauuaguggcacuuggacauuaucuuguuuuucuuaugggaauugacaguuuugaggugacccauucccauccacacacccaaaagcauguauuuugagacagcaaagguuaaggguguacucuggugcauggaacagauguuuuaauuccuucucuuuauaaugaaaacaggaaauacagggauaaugcagaagccuucguagcagauuuuuuuucauugauuuguuuauuauuccauuguuugaugcagcuuauuuuguuuuuuuaaaacagcuuuauugaaguauaauuggcaugauaaacuguauuauuugauaugugcauacugauguuuugauauguguuuccccaagaaaccauuaucacaaucaagauaacaaacauauccauugcuccccaaaauuuuuaugccccuuagugaccucuccugcucaacuuuccccacuacucucugccccuuaccccaaaccacugaucugcuuucugucaucagaaauuauuuacauuuucugaaauuuuauauaaguggaaucauauggaauauacucuauuuuuuccuggcuucuuucacucagcauaauuacuuugagauuuauucaugucguuguguauauugauagcucauuucuucuuuguuacuuaauaguguuggcauuauauguauauaccacgguuuuguuuuauccacuuaucuguugauaaacauuuguauuguuucuaauuugggacuuuauaauuaaaguugcugugaacauucauguacaaggcuuuguguggauauaugcuuuuauuucuuuugaauaaaagcuagaaauugaauggcuauaucauaugauagauguguauuuaauuuuuaagaaucugcccaaguguuuugcaaagcgauuguaccauuuuacauuccacagauauauccaguugcugcacauccucaccaaacuugguauagccaaucuuuuucauuuuagccauccuuauagguguguaauaucucauuauaguuaaaauuugcauauuauuguuggcugauguuaaguaucauuucaugugcuuauuugcuaauuugcucucuguauuauguuuuuuuguuuguuuuuguauuuuuuuauuuuagagaugggaucucacuuuguugcccaagcuggaguacagugguguaaucauggcucacugcagccucaaccucuugggcuccagcaauccuccagccucagccuccccaguagcuggaacuacaggcacacaccaccaugccuggcuaauuuuuaaaauuuuuaguagaaaugaggucucaccauguugcucaggcuggucucaaacuccucacccuaaacgaucuucccgccuuggcuucccaaaguguugggauuguaggcauagucaccaaccuggccuguguuguuuucuuuggugcaugcaguaucuguuaaaaucuuuugcccauuuuuuuuaaguuauuuguuuucucauuauuuaguuuugagaguuucuuauauaucuggaugcaaguccuuuaucaaauauaugccuugcaaauauuuucucccagucugugacuuauuucauuaucuuaacucuauuuuuuuuacaguuaagauacuuaacuguuauaguuaauaauaauguauuguauacuucaaaaaucacugagaguagauuuuaaauguucucacuacacaaaaaugauaaguauguaagaucauacauauguuaauuagcucgauuuugccauuccacaguguauacauauuucaaaacaucauguggcacacuauaaauauuuccaauuuuuuaucaguuaaaaaauaaauuuuaaauaaauaaaaacccagccauaaucuagaccaggaaaaaaaaaugcaucuuuuguagacaggaaaaaagaaaagauacuuaagugugucucauuucauucucuuaacuguaucuuaagaaaagauacuuaaccuugucucauuucauucucuuaacuguaucuuuugaagagcaaaaguuuuucauuuccaugaaguccaauuuaucaauuuuuuuuguuuuguuuuuugagacggagucucgcugugucgccaaggcuggagugcagugaugcgaucucggcucacugcaaccuuuggcucccggauucaagugauucuccugccucugccucccaaguagcugggauuacaggcacaugccaucauacccggcuaauuuuuugugucuaguagagacaggauuucaccauguuggucgggcuggucuuggacuccugaccucaggugacccacucgccucagccucccaaagugcugggauuacaggcaugagccgccgugcccagccuaucaauuuuucuuuuauggauuuuguuuuuaauguuauaucuaggaaaucuuugccuaaaccaaggucagaaagguuuucuccuguuuuuuuguuuuuguuuuuguuuuuuguuuuucuuauaagucucauaguuuuaaguuuuacacuuaagucuaugauauaucuucaguuaauguuguuauauaguacaaugcauggauccauuuuuuguuuuuuugcauauagauguccaguuguucuagcaccaauuguugagauuauccuuccucuuuagaauggucuuugcaccuuugucagucgguuauucauauauucauguguuuauuucuagacccucuguucuguucuuuugaucuauuugucuaccuugaugccaguaccacacuguuuugguuauuguggccuugugguaacuuaaaaucaauuaguguuaguccuccaacuuguauucuuuuugaaacuugcuuuacuuauuuaugguccuucgcauuuccauaugaauagaaucagcuugccaauuucccuaaaaauccuguugggauuuugauugggauuguauugaaucuagagaucaauuuggggagaauucauaucuuaacaacauuguguuuuucgauccaugaauaugcuauaucucaucauuuauuuagguugucuuuaauuucucucagcagugcuuuguagcuuuuaguguauagcuuuuucacauuuuuuuugucagauuuacccuaaguguuucacacuuuugaugauacuguaagugguauuggguuuuguuguuauuguuguuuugguuugguuuguuuuuuugagacagggucugacucugucacccaggcugaguguaguggcaugaucauggcucacugcagccucaagccccaggcucaagugauccuccugccuuagccucccaaguagcuaggacuacaggcacacaccacaacgcccagcuaaauuuuuuuuuuuuuuuuuugguagagagauaggagcucacuguguugcccagguuggucucgaacuccuggccuggacccaagugauccucccaccucacccucccaaagugcugggauuacaagcgugagccacugcacccagccaguauuguuuguuaaauguuaauuucugauuguuuauugcuguuuuacagaaauaaaauuggccaggugcgguggcuuacaccuguaaucccagcacuuugggaggcugaggcaggcagaucaccugaggucaggaguucaagaccagccugguuaacauggugaaaccccgucucuacuaaaaguacaaaaauuagccgggcgagguggcacacgccuguagucccagccacucaggaggcugagauaggagaaucacuugaaccugggaggcaaagguugcagugagcugagaucgcgccaccgcacuccaaccugggcagcagagcaagacuccauccccaucaaaaaaagaaauaaaauugauuuuuguauacauugauuuuauauccugcaaccaugcuaauaaacucacuuauuaauuccaguagcuuuuaaaauaaauuucaugggggcccacgacgguggcucaugccuauaaucccaguauuuugggaggccuucguggguggaucauucaaguccaggaguucaagaccagcaugggcaacauggugaaaccccuugucuaaaaaaaaaaaaaaauuagcuggguaugguagcgugcaucuguaaccccggcuacuagggaggcugagguaggagacuugaucgaauuaaugagauugaggcugcaaugagcuauaauugcaccacugcacuccaacuugggagacagaaugagacccuggcucaaucaaucagucagucguuuccauuggauuuucuacagacaauuaugucugcaaauaaggacaguuuuacuuacuucuuucuaaucuggaugccgugugugugugugugugugugugugugugugugugugugugugugugucugucugucuuacuacauuggcuagaacuucaguacaaugucaaguagaaaugauggggauaucugugucuucuucccagaaagccuucagucugucaaguuguuggccguagguuuuuugcaaaugcuguuuaucagauuaaggaaauuuguauuuuuaauuugcagggaauuuuuauuaggaauggaugcuggauuuugucaugcuuuuucuguacccauuaaaagcauaaaaauuuuuauguccuuguugugugucugaaguauugugugaaagagagcuucauccccuuuuuuauugaccuucucugagaucaaguagagugauguggaguagcuuuuucagauuuauucugcugcuuuuuagaaacuaaauucuguaauuuaauuuuuaaaauuuugcugugcugggcacaguggcucacaccuguaaucccagaacuuuaggaggucaaggcaggaggaucacuugaagccaggaguugaagaccagcuugggcaauauagcaagaccccaucucuaaaaaaaagaaaaaagaaaagaaaguaaaauuuugcugaguagaguccaguaauuaaaucauuuucccuacggcaaaacuuuuuuuuuuuuuuuuuuuugagacggagucuugcccuuuacugagguuggagugcaguggcaugaucucggcucacugcuaccucugccuccuggauucaaaugauucuccugccucagccuccugaguaacugggauuacaguugcccaccaccacacccagcuaauuuuguauuuuuacuauagacaagguuucaccauauuggccagacuagucucaaacuccugaccucaagugaucugcccacuucagccucccaaaguucugggauuacaggguugagccaccgcaccuggccuccccauggcaaaacuuaauaguaauuuaaaaaucauaaacauuucaacagaauaaacaauaccucuacugcuuuuaugaacuccucuccuuuaaagcaacuuuccuuugucuuuuauugguuuuaauauuuuauuggcuucuuaugaucauuuuuccaaagacaaaaauacaaagugugaauuuuuauaccugauagaauauuauuaccccuuucccaggaauaacagaaauaauuuauuugaaacaaucuuaaaggcuccuuuuaugguaaaccauuuaaauugauuuuuaguggcucacuuaggaaauagacaucaaaauguaccauuccuuuaguauuuuuccgaaggcauuuuuucucguuaaucugggagcacaagaagauugauuuuaaaggggauuguguuuauaggugacauccccuauauucugaaugcugcuccagagucaguuguugaagaauaaguaaacauaguauugcuucuccguuuuacuuuuggguaaaaaaauucaggguuuguuucuuuuacugaauuuacuaaucucaggacaccuacugaggagaguggcuguaguugacaugauuuuacauaaaaauccauuuacgaaacauuuuguauaaguuaacuuccaauuaccccucagacaacccaugauaacauaguuauuuugaucuagcaauuaagucuucagaaaaaguaaauccugcugggugugguggcucaugccuauaaucccagcacuuugggaggccgaggcaaguggaucacgaggucaggagaucgagaccauccuggcugacacggugaaaccccgucucuauuaaaaauacaaaaaaauuagccagacaugguggcaugcaccuguagucccagcuacuugggaggcugaggcaggagaaucccuugaacccaggaggcagagguugcagugagccgagaucgcgccacugcaccccagccugggggacagagcaagacucugucucaaaaaaaaaaaaaaacaguaaauccuuuauuaauagcuacaugaauugggugguauauccacaugauggaacauuaugaagccauuuuaaaauaagaugcauaugaagaacguuuaaugacauaguaguguuccuaggacaaaauuaaauauauccuuuaaucucaauuauaagcauuuauauauauauguauccacacacacacacucacacacauacacacacauaaaagacucaagcaaauacauugaaauuuguaguuugaguguuaauagugguuggcccuagguaguagaaucauaugcauauuuuaauuuuuucuucagaacuucugcuuuauaucuuaguuacuuuuauuucagaaauguugauuuuuuuaaguaacaauaaucuuguacaacacauuuuuuucucaacucucaguuuauuaacauucuugcccaaagaagauacuuuagccuucuauuauucacuuuguaggaaaauaaauuagagcuaaucagaccuacaguuaaauucuucuuuuuugguuguuccugauauuaaguuaauauuauuucuuuccaacccaccugaaauaacucaacugaaucugccuaaaaaaccaaccuaaauuuccagacuauccaguaaaaagauugcagaguuugggggaagaaaaaagaagacuugaauaaagaccuuuuuaucauaccacagucuaaagaguugucuuuuaaacauuuuugaaauaaauuucacauuucaccacaauccaggauacauauacacacccauauacguauauuaacuaaaaccaaaauuucacuagaauuuacuuuguguuuuacuauacuauaauauuuauacuauaccauacuguacuguaauauuuucuguuauacuucauuuuucuuuaaaugcugauuaugaccccacuagacuaguuuuaugauccacuaaugagcugugauccaaaguuugaaaaacauuagucuaaagcacuuccuuuaauuucuuaauuuguuuuauaguggcaagauuucacuuuguuucaucuugccagauccugagacuggaaauaagauuuauuuagguauguuucuuauaaaauucuaaaagaauuuugcuaagcuauggaaucagaagcuauucccaaaguuuauuccuuuaacaagaacuagcauuguauauagcccucuaugguuuucagaguguuucuaugugugauauguuguugaauucucuguacccuugugaaguugauauuuuacaugcagauccuggagcucaucucuuguaauuuaacauauuauuuucagauuaacugugcucagcuaaaugaacuaugggaucugaccauaagagauaaaauguguuucauuaaaaacuguaccuguaaaggugaggagaaacuggcacucuccuauauuguuguccucaacugguuaaggagaguuuggcaauaucuaucaaauuuaaaaaugcagagccaggcaugguggcacuugccuauagucccagcuacuugggaggcugaagcaggaggaucacuugaggucagaaguuccaagcucuaaugcaaaaugauuuugccugugaauagcuauuguacuccagccugggcaauauagcaagaccuuaccucuuucuuaaaaaaaugcauguaucuagaagaaauuucacuucuagaaauuucugcuacagauguccuuaggccuuuacaauacaaauguucuuagagcuaaucuuuacacaaugaaguauauguguaaagauacccauugcagcauaauucauagaaacaaaaugcuagaaacaauuuagugucucuuauuaggguucuggucaaguaaauuaugguaugauuguagaauaaaauacugugaaacuaauaaaaugaaagaucuuuauauauaauaaagaaagaaagucacagagcacuguacuaaauucuuaaaaaaaggcaguauuaaguugccacuggugaagccagaaauacaucucacaaagccucuuccuuccuuuuagcuugguucucuugagaauaguaggaacucuucuaauaaucuguucuaggaagagcaugaaauuaguaagagggaagugccagauucagugguagaguacucuagcagaaaagggccaaaagguacaggacaggcuauucauauguguuaguuguucauaaauuggcuauuuauuuaaaaaaggacugcauucuuaagcgauuaaaugucuuugcuccauucagaaaaacaucaaaccccauauauaaaagcuagcucuuuucuuucuuuucuuuucuuuucuuuucuuuucuuuucuuuucuuuucuuuucuuuucuugucuuuucucuuucauuuuugagacagggucucacucugucgcccaugcuggagugcaguggcaugaucucagcucacugcaaccuccgccuccugggcucaagugaucuucccaccucagccucuuaaguagcugggacuauaggcuugcaccacgacacccaccuaucuaauuuguugugguuguacuuuuuuguagagaugggguuucgccauuuugcccaggcuggucucgaacuccugaccucaagugauccacccgccucggccuuccagagugcugggauuacaggcgugagccaccgcaccaggccauagcuagcuuuuuuuuuuuuuuuuuuuuuuuugagacagagucugacucuguugcccaggcuuggagugcagugacgugaucucggcucacugcaaccccuuccuccuggguucaagugauucucccgccucagccucccgaauagcugggacuacaggugcgugccaccuuguccagcuaauuuuuuuguauuuuuaguagagacuaaaauacauguuaguagagacuaaaauacauguuucaccauguuggccaggauuaucuccaucucuugaccucgugaucugccugccucugccucccaaagugcugggauuacaggcaugagccacuguucccggccagcuagcucuuaaaaauuauugucuggcaucagcuguuugcuguauaacuuuuuaucaugucaucauucauauuacaaauuguggcauuuagggguuuaagaaugaagaugccagaagaauaagcaaauuucucguuugacugaugucuuccuguggguucuguguuuuguuuuguuguuguaguuuuaauauuuuucaagaaaggggaaauucaguuuauaaaacaguaccuauuuagagaacauacaguuuuccagcaguuacggaggggcuucagaaaagauuacagcagugaggaauuucauugcauuuauucagccuguaacuaaaacaaauaaaaaagggaaauagcuuauuccuauuuugacuuccucuuauugugucuuccuugcauguguuagccuugugauuugagauuaaucagggguuauuucuaguuguccccauaaagagaagagaagcaaaggaagacaaagagguugcuucuaaaacuaaaacauaucauuuaguauuccaguuuagccaguuguaagaauaauuuggaagauaggagaaaaccaucuuguauguuugcugaaaauauuuauggaaaggaggcauuuauagaaugaacugggaguuuuauuaugugaaauuguuuuguuagaaaagcauaguaauauaacuauucuacaaaacaguucucucacauaugcacaaguuagcuuauugaagcauuguuuaauacaguauuggaaacuguaaacaacauaaauguucaucacuaaguuccaucaauggcugcauaaacuggugcauccuuaguauggaauauuauauacuuuuuuuaaugagaaagaaagcuauguacugacagaucucucagacagugaaaacaaauugcaaaacaguuuuacacaauaauaauaucuauguaauuagguuuuauacacacagacaccacacacaugcaaauguauauauauucuuggaaauggaggcugggcacacaggaucacuugaggccagaaguuugagaccagccugggaaacaaagcaagacccugucucuacaaaaaauaaaaaacuuaaauuagaaaaagaaauggucuggaaggauaccuaacauacuaagaacuuuuagggaggaaagugaaaggggguuacggucaggaagaguuucagcuuuaucuauauauuuugauuuuuuuuuuuuuuuuuuuuuuuuugagacagagucucacucuuucacccaggcuggagugcaguggcaugaucucagcucacugcaaguucugccucccggguucacaccauuuuccugccucagccucccgaguagcugggacuacaggcgcccgccaccacacccagcuaauuuuuuguauuuuuaguagagacaggguuucaccguggucucgaucuccugacuucaugauccgccugccuuggccucccaaagugcugggauuacaggcgugagccaccgcgccgggccuauaguuugaauuuuuaugagaaaauacuuacugaugauggaauuaaaauaaaaauuuuguaagaaauauaauaugcacaaugggaugucaaggaaacuggauucauugguagaaaugagcauauuauuguauuauuauuaagucucucuucuuacugauuggaaaugucuagagauuuuuuucauccauuuaauaagacauucuucuuuucuuauaccacccuauucuaagaguaaugccacuuguacucuugaucuuaucuuuacccuguuucuucaugaccauacuccaucaguuacaccuugccuucucgcuuagugccccaguuucuucuuuuaauacuacuacuuauuuuuggcuaaagccuguuugaaacuuuccauucuauauuuaaaaaaaaaaaaaaaaccuucucaaucuugccauccuucuaaguuaccacccuaguucucuuucucucuuuacacugaaauauuuaauuaaauauuucucauuccucauuacucauuugccuuuuguuucuacuacucuaaugaaauuuuacguuuugaaguuaaaaguaaccgcuaauggccucuuuaauuagaugaccuaacucagcauucaaccguguugaccauccuccuuguuaaacuucuuuccuuggcuucugugauauucuuguccugguccuucucagacuccuuuguguuuuuuucuuccauauuccucuuaaaucugauaucuucugugacuagauaaaaugucccuuccuguagcucccaucacauacuguucaaaaucuacuauagcacuuuucauaacuguauugaaauagcauugucucuugcccuauagccuuuuaggauccuaaaggguagaagccaaaauguuauuauucauuuuuguguggggguguguguguguguguaugugcgugcaugcgugcguuuuguuuuaaaauuccccguggcugggcgcgguggcugacgccuguaaucccagcacuuugggaggccaagguggguggauuacuugaggucaggaguuugagaccagccuggccaaaauggcaaaacccugucucuacuaaaauacaacaauuaaccaggcacaauggugcaugccuguaaucccacuacucaggaggcugaggcaggagaauggcuuaaacccgggaggcacagguugcagugagccaagauugugccacugcacugcagcucgggcgacagagcaagacuccaucucaaaaaacaaaccaacauaauaauaauaaaauucccuguauccucaguuucuccucccauucccuucuuggucuccauaagcaacuauucuuaauacauuuuuuauuuguauauauucuuguaaaauguauugccuuguguguaucaauuugcauaaauggcauugugcuaucuagcuuguucuguuucuuacuuuuuauaauuacuaugccuuugcaguccaucauguugccaugacugcacaugaucuguugcuucuaucugcugugucauacuccauaauauacacuuauuuuacugagucuccuuuguggcuuuuuuuuuuuuuaaagagacggggucuugccauguugcccaggcuagucccgaacuccugggcucaggcagucuuuccgccuuggccucccaaaggccaccaugccuggccuccugugugacuucgugucuacaccuagcauugcacagugguacauagaauauguuagcugaaugaauaauacauaaaaagauauuuccugauacuuuguucuuagcccugucacaucguaaccuauuuacucucuuccucagugggugauuucaucaguuuuauugguuucuauggguuguuaacacccagauuuguuauucucuuauaccuagacccauauauccaagugccuuuuugacuugugcaccuaaauaucccguaucacagucucagcauccuucccuaaaagccuguguguucugccuuuguucucuguuuugguuaauggcaucaccaaccauccacucacccaaccuaaauacuucaaaguaucugugugucuucccucuuugugucuaaucaggugcuaaaaccuguuggcucuucuccagaguaccccuuaaaugugguuuuucucucccucuuauauuuugacuuuagauccaaauggucucuggaucuagccuccuaccugacacucugcuacucaucuuauauccuagauuuguaaccuaaccaucauuaguaucaaguugaucuuguuuuucucuuuaaaaacuucuugugacuccuugcugccuaaaaaauuaagcuuaaagacauuacauucaagacauuuacagacuggcuggaacccagucucauuuccugccagucuacuagcuauaaaucugaccucuguagccaaauuacgcauuuccauucuuccauaaccuugcuugaacuguucccuuguuuggaauacuguuuuccuuuccuucuucuucacacauagaacccuucacauaaaaaguauguccaggcugggugcaguggcucaugcugguaaucccagcacuuugggaggccgaggcggguggaucaucugaggucaggaguucgagacuagcuuggccaacauggcaaaaccccaucucuacuaaaaauauaaaaauuagccacacaugguggcacgcaccuguaaucccagcuacucuggaggcugaggcaggagaaucacuugaacccaggaggcagagauuguagcaagccgagaucacaccauugcacuccagccugggcagcagagcaagacucugucucaaaaaaaaaaaaaaaaaaaaagaaguguacccaauaaauguucauagaauugaaucauacguaacaugguuucucuuuuucuguugucuacgcuagauuagugauaauaggagaauuuauauauuugugcugauaagcaucacagauuauagggauuuguuuacuuucuuuauguuuauuauuauuauuuuuuucacuaaauguaagcuccucagggggcagguccuuaaucuuauuuaccacuauaucccagguaucuggacccaaguaaguacuucauaaguauuugucauacaggagaaugauuucaggcccuguaagucuaccuugaauguauucaaggcucaaaauagauugcuaauuauuaauucauauuucucagaaaagaaacuuaacuuuaguaauauaauuucauaacuuuuacuguuguugauaauuuccauucagugacauuauuuacaucuuaccccguacuaagaaggaacaauuuguucuucaggcaggaaaucauugcauuguguucguucuuuauugguagugaaggauaccacauaauuggaauauguacuuuugcucacuauuuuguauucaucuaaagaaaaaaucguuuggaaauuauuuccuauuacuucuuaauuuucaacugacauuuaaucuugguauccuuuccuaucaaauuggggugugauuaucugcauucccugacuggucaguaaggggaacuuucaguaucagauaaaauaguucaguaugaaaaaaauuagcuugucuuucuucaucuggauacauacaaaaauauuauuucccagacuuuuuagcuaagaaccuuuauggucaucugucuaaauuacacagauucucuaucuuuuagaauguaucgacugauccuccauuucuccugugauuuuuuuuuuuuuuuugagauuugcuuuuuuuuuuguccuguuuuauuguugcuuguuuguuuguuuguuuguuuggcuuucacaaaaucuuuaucaucccccuuugucuguuuacuuuccaaagugguaacuuugaguucuuuaaccuuuaaaaugucuuuuucaggcucuuguccauccuuuucugugaauaucugucauaggacaaaugacugacaucuucaccccagaccuagaaaucauuaaaggaggaaggugccaaaacagagucuuagaggccuagaauagagccaguuuuccuauuccuuaugggauuaaaauggaaaagagggucuugguuauucuaaucuggugacauuuaaaguuuccauaugguguugccauccuucagaaugaaaagaagagcucaugucaccaaagaucacuccuguucuucuuauccauccauaucccaauccucuuuagcacacuucuuuuuuuucuuagagacaggucucacuguguugcccaggcuggucucacacgucuggccucaagugaucuccuucagccugccaaguagcuggaauuauaggcacgagccacugugccuggcucccuuuaguacacuuuuuuuuuuuuaacuuuuauuuuaaguucagggguacauaugcagguuuauuauguagguaaacuaaugucaugggggguuguuguacagauuauuucaucaccccuaguacccuguaguuauuuuuucuggucuucucccucaucccacccuccacugucaaauaguccccagugucugucguuccucucuugauguccauguguucuuaucauuuagcuccagcuuauaagugagaacgugugguauuugguuccugcauuugguaaggaugauggcuucuagcuccaaccauguuucugcaaaggacaugaucucauucuuuuuuauggcuguguaguauuccaugguguauauguaccacauuuucuuuauucagucuaccacuguaggcacuuagguugauugugucuuugcuauugagaauagugcugcaguggauauucacgugcaugucuuuaugguagaaugacuuauauuccuuuggguauauauugaguaaugggauuacugguaguucuguuuuuaggucuuugaggaauugccagacuacuuuccacaaugguugaaccaguuuacacucccacuaauaguguauaaguguucccuuuucucagcaaccucaccaacauuuguuauuuuuugacuuuuuaauaauagccauucugacugguaugagaugguaucucauugugguuuugauuugcauuucucuaaugaucagugauauugagcauuuuaaaauaugcuuguuggccacauguauguuuucuguugaaaagugucuauucauguccuuugcccacuuuuuaauagaauugcuugguuuuuuuucuuguaaaguuguuugaguuccuuuguuuuuuuuuguuuguuuuuguuuugagacggagucucacucugucacccaggcuggagugcaguggugccaucuuggcucacugcaaccucugccuccuggguucaagugauucuccugccucagccucccaaguagcugggacuacaggugcccaccagcacacccagcuaauuuuuuguauuuuuaguagagacaggguuuuaccauguuagccaggauggucucgaucuccugagcuugugauccgccugccucagccucccaaaguccugggauugcaggugugagccaccauacccggccgaguuccuuccuuauagaugcuggauauuagacguuugucagaugcauaguuugcaaauauuuucucucauucuguacguugucuguuuacucuguugauaguuucuuuugcugugcagaagcccuuaaguaauuagaucccauuuaucaauuuuugcuucuguugcaauugcauuuggugucuuugucaugaaaucuuugccaguucccguguccagaaugguauugucuagguugucuuccaggguuuuuauaguuuuuggguuuuacauuuaagucuguaauccaucuugaguuaauuuuuguaugugguguaaggacauuuuaaugauauugauucuacuaguucaugagcauggaguguuuuuccauuuguuugugucaucucugauuuuuuugagcaguguuuuguaauucucauuguagagaucuuucaccucccugguuaguuguauuccuagcuauuuuauucuauguguggcgacugugaaugggauugcguuccugauuuggcucucagccuggcuguuguagguguguaggaaugcuagugauuuuuguauguugauuuuguauccuagacuuugcuaaaguuguuuaucagcugaaggaauuuuugggcugagaccaugggguuuuucuguauucuauauuucuauaucuauucuagauauagaaucaugucaucugcaaacaggaauaguuugacuuccucuuuucuuauuuggaugcccuuuauuuauuucucuugccugauugcccuggccaggacuuccaauaggaguggugagagagggcauccuuaccuuuugccagcuuucaaggggaaugcuuccagcuuuugcauauucaguaugauguuggcuguggguuuguuguauacuucuguuaugaacagaagauaaaggcagucuuagguugggauuacuuggaccuaacaguugcaguggucaccuuuagcaugcacaauuucaccauauauuugugccuuacugcagugaugaccauugccagguuguauucaaaauuaucacuaaacacccugcaaugcaaugauagcccaccuuuuacuuuuuagucuugacguuuuuacucucuccccauuuuguucucuagagaagaaugauccuuccuuaauuugagucccaaucuaucuauuugacugcugguugaaaccgaauaacuagcuagcuacuucuuucuacguaaggcuacagugacagccgaaauugcugccuuuccaucugccgacuugugacauagggcuuguucuuuaucuuaauauguuacuuagauauucuauuccaccuucugucauuaggauguaugauuacacuguccuugcuucuguuugccugcccuggcauccugcucucaccaugguaggggucuuaaaguauuacuguccccuuuuucauucugcccugucucuuuucacaccccaccuccacuucccccacaaauuucuuauuccuguuacuugauaacuucuaaauaugaauaguuucuacuucuuaaccaagauaaggcccucuucccaggaccucacuuuugagcagcuuguuucuuggcauguuucuguguaauaucagucuguuuauaauuuaagaaacuugcuucaaauaaauuuuuagaguuaagacccaucucacaguuacgcagcuucagaucucucucccauagaauaccuuaacuagaggaaaugaagauauccuuucacaucuuguuuacugagcucuuuuaaaauauauuaaccuugaaguuuucggcacugucuguuaauggugagugaaagagcccagcacaucuccaauaaagguuuuucaaguucauaggguuaacuuuaaguaucacacacagcuauagucuguaggcuggguuucacuguguaauacuucagagacaguuuuggguugugugggcccccuacccgaacccugccaaccucaugguguuuccuguaauucauuagauugccgauugcuccauuuaucugccagaacccacccacuuccaggguuggccuuuuccuuccuauuccuugugaauguaaagucuaagucuuagaaaauuccaaucucaaauaaauuguacuugguguuccucuaaacauuaaugauauuguuuagaaaacauuuaaacagagaggcuauuuguucauugcugauguuaggccuuauacuugucuagcaaauuuuaagcuccuugagggcaguggacuacaucuuacauagucacaucucuguucccaugucauuacucacguugcuuauaauacacaguacccagcaaacauuaaguauucaaaccauucagagccugggcccugcaaaucaugcacaaguccagaaaacuuucccagauuucuccaauaguauuuugguuguuuaacccugauaacacagagauguguuguguuguuuauuuuuuguuacauuuuguauauuugauguuagaccaaaccucuccugguuuaucgacuuuauaacauuaguuaguuuaaaauaaacaauaauaccgauuacuuaucauuucuguuagaauuugcauguuuaucauagcuuaaauuguuuaaaaugauagauucaggauucagauuucuugcauucuucauuccauucuaguguuucucaaacuuuuuggacaguaacacauauuaaaaaguagacuuugcauugugacccaggguacacaccuauauucuuaugcuagaaguaaaguuccucaaaaugcaucuucuaacauucagugcucugcaguguuuuuuauucuguuuuguuucauuuuuaaguuacugaucaagaccuacuaaauugaaauucauuccuacaaaguccuggggauguauuucuguauuacucaaucagcuaacauagucagcacuuaacuauauauaacacuuauuguucuucacuacuuaauuagcuuugugaccuugggaaagucacguguuugauauucaguuuuucuauaaaaugaagauaauagugauguuuacuucaugaggaaugcuguuaggaauagauuagauauguaaaaagcacacuguuucgcaggcaauaaacgcucgaguguuaacgucucuguuguuuuugcugucauuguuaaaaauacuuugauuugaccuuccuaucuguuuuggaaauacuguauguaaaacauauacuacauauaacuuguuuccuuauaacuuuuauuauauauauuuacauuuuacauuguuuaacuggagguauaauuuggauauagugaaaugcacagaucuuaaacauuucaauucaauguguuuuuacagaugcacacauccacauaacccacacuccuaucaagacacagaacauucuuaucacaccaggaucuugugccccuucccagucaaucaucccccuguccccagaggaaaccacucuucugauuuuuuguucaccauaguucgguuuuguuuauuccacaacuucaucuaaacaaagucacacagaacauacucuuuuaugccuggccucuuuuuuuuguucaguaugauguucagguucaucagugucacuguauguaucagcacuuuguuccuuuuuauugcugucuaguauuccauuuuauaaaugcaccacauucuguuuauucuccuguugauugauaucugauuauuucuaguuuggggcuauuacgaauaaagcugcuauagcagcuuuauuguauaaaacucuuguagaaauguguuuucauaucuuuuggauuaauauuuaauacuuacaaguagaauuacagguaggauuugucuaacuuuaugagaaauuuccagaucaguuuccaaaguaacuguacuguuuuauacucucacuagcaaugugugaguguucuacuuacucuacauuccuuccaacauuugauguugucagucugucauauuagccauucuaguggcuguauagugguaucuuuuuauuuuuuuaacuuacaccucccugaucccuaaugacuuaggcacuucuucauaugcuuuucccuauugcaguuuucucuuuaggucugugaugcauuuuuauuuuuguauaugguauaagguaugcaucuucccauuguauuuucagaaauguacggucucccgaaaaaagagauuaggaucuaauguaucauuuaaaauaauacuuucuucaacuggaacaaauguaccacuuuggugaugauacugauaaugggggcggcugugccuguguggggcaggggauauaugagagaucucuguaccugcugcugcauuuugcagugaacccaaaagugcucuaaaaaauaauguuuuuuguuuuuuguuuuguuuuguuuugagacagugucucacucugucacccaggcuggagugcaguggcgcgaucucggcucacugcagccucugccucccagguucaagcaauucuccugccucagccucccaaguggggacuacaggcaugugccgccaugccuggcuaauuuuuauauuuuuaguagaaacagaguuucaccauguuggccagacuggucucaaacuccugacuucaggugaucuucccgccucggccaaaaauaaauuauuuuuaaauuauacuuuaaaauucuuaauuuauauucagagcauucucccuuuaucaguucauuaaucuguucaguacuuguugaauuccuaaacacauuuucuuccccaccucaaaaaguuauucuuguggacucaguccagaauguacauauaauuuguuucaaccaccuaccuacacugaacaaguaagaacaaaaagaaaaaaaaaucucaacacauuugauuucaguuucauuagaacauuucacaggacucuggaauuugaauguugaaacagcuacauuauucuguuacucauauucuuuuuuuuuuucuuuuaagagagucucgcucugucgcccaggcuggagugcaguggagcaaucucagcucacuauaaccuccgccucccauguucaagcaauucuccugccucagccucccaaguagcugggauuacaggcgcccaccaccacacccagcuaauuuuuguauuuuuaguagagacgggguuucgccauguuggccaggcugcucucgaacuucugaccucaggugaucaccugccucggccucucaaagugcugguauuacagacaugagccacugcgcccagccuguuuacucauauucuuaugcuaucagcaagcagccugggggcuagaagugccacacuuauaccuauuuauacuaaacuauuuuuagucuugaauagaauuuaguacacuguagucaaauaauaauaaauggucaucuguccuuauguaaauaauugcuuuuauaaauauuuaugguugcagguugacuccagagggaauauuugaaguucauucuauuucacaguuaguuaaaauauuuuugagacagagucucacucuaucaccgaggcuggagugcaguggugcgaucuuggcucacugcaaccuuucccucccagguucaagugauucucgugccucagccuccugaguaucugggauuacaggcgugugccaccaugcccagcuaauuuuuguauuuuuaguagaaaugggguuucaccauguuggccaggcuggucuugaacuccucaccugaagucaucugcccaccuuggccucccaaagugcugggauuacaggugugagucaccacaccuggcuaauuuuuguauuuucaguagagaugggguugcaccacauuggccaggcuguucuugaacuccugaccucaagugaucugccugccuuggccucccaaagugcugguauuauagcugugagccacugcaccuggccugaaauauuuuuaaaucaugacaauuuucucucuuuacugucauguuuaauuuuuguacuauuuuccaaaaaauaaaguuuaauuuaaaugaggcuaaaucagcucuuuuauuaguaucaaacauuaaaaucuaguucuuguucagcaauuauaaaggaacuuccagaacaaggguuuucuuauuguugucaucuuuauccagaauguuugcuuuauuuccaguugcucagguugcuauaaacuacuuauaguuuaucuauagugugaauuacuugacaguaaauagauucagugugcaugugauaaugauuccuuuuaacaugcuuuugguagcauuaaccaaauacuuggaaucauauuguuguucuggucccuggcaugaaguauucagauuucuuugaagaccuaugauguucacauugcugauuacuuuuuaaaauaucacuucagaauugucucuuuaguggcaaaaauacauccuaauccaguuaugguaccagccugagucuugaaaauaaaaccuuauaguugaauauaaacuuccaauuaaaugagccuuaauucuucaccauuggauuuugaacgauuuuucauguuggugccaaagaauaaaaagaaauugauuuccuacuuuaagauuggaauauacacacacacuguacugggaaguggagaggaggugacuacuucauauuuccuuuugaaguuaggaauaacacagcugaaacuuuuggagagcaaguauggccgacucuaagaagauuaugugauuugauuuuaagcuuucaguagugguguguuucauucagccugugauaguaaaaauaaaugaguaauagaugacuagugugcucuggcugcugugauaauacccucuguuauugaaucugucuaaccagccaguuauuuuucugcugucugaaauuaaagaccaucauguuuucugacaauguaggaauuucuguucaguuaauguguguguuguuauugaauuaaaaauaauaaaauugaauuuacuuuauuuuuauuacuaaacccccuccaaacucuaauaucauuuaaaauuucuuauaaaauaacugaaauaucauuaauauauuacaacucagcuuugauaguuuugaauauagguguuuggucuuuaaauuuugacccgagauauaaaugauagugguagcacaucuagucauugaccuuguagccagccuccaagauggcucccagugaucucuaccccaugauauucacacccuuggguagucugcccccaaauuuaccagaguuggucugugugacugauagaauacaucagaaaugauggugugucacuuccaagauuagguuauaaaagacauugggacuuccaucuuggucucugucucuuuuauggggcugagggucacuugcugugugggaagcuggcacuuguaaggagccaaggccuacgccaacagucaugugaguaaguaagcauggaaguggguccaucagucccagucauggcuucagaugacuacagcccugaccaacaguuugauugcaaccucaugagacccugagccagaaccacccagcuaagccccucccagauuccugacccuccaaaacugugagauuuuuuuuuaauguuuauuauuuaggcugccuacuuugggggugauugguaugcaggaauagaucaucauuacacacccccauuaaaucucuucauucuucaaaucuuaauaucuguuuugggguuuuuuuauuauuuauacuguuaaaccuguaauccauauaguucaccugacugaaucauuaaguugauugaaaaauaccauguucugucucccauguuccaguccaguguuugauauaauaaauauagacuuugaauucaccuuuccuauauuugaccccauauuagaauguacuuaagagaaucgcucucugacaaggagucuucuugagguuauuccacagauccuuuuccuuuacaggcaaagccgucuguauuauacaacuuguaauuacuaugcaagugauuauggaauuacuaugaaguacuacaggagaaagcagacagccaaacaacuguucucaggcugagaccucaccaaagaagcucuuugucuauuacucauaacucuguggugcuuauuaauuauacaggguaaucacaguguggguuuuaaaagucauauuuuggggauuaguuaacuauauacuacucaaaccagagagacagcuucucagcagaucugaugucaaggucaugaauuguagucccagcuccuacuccuccaucccacuuucuccauggugcucugaaaaggaaaagguuauuaaaaguauuuggguuuacuuuuucuauuuccuuuuugcccuaacuaaaccaacagugccaauaguuauuccuuuaccaucacuaaccauacugaaauggcuaucaugaauaagaaaugugacaguuagaaaaguaguauuucagcugcauaaagagauuauuuuuucuuuugcuucuuuuucuaaacuuuucuauuuuucuaaacauggccuaaaaaaguggaaaaaaaaaaaaaaacaacauagcugggugaggugguaugugccuuuagucccagcuacucaagaggcugagguggaaggaucacuugagcccaggaggucaaggcugcagugagcugugaucacaccauuacacugcagccugguugacagagccagacccugucucaaacaaaaaagaaaaaagaaaaaaaaaauuugauacuuucagugaguuacagguaaucaauuucagguuuuuauagcugaauuuaaagaaacaugguaaaagggaaacauugaugagucccauguuguuuggcacuguugcuuuuaaaauacaacuagcuuuuugguuuuacuuucaguauguuuuauuuauuuauguauuuuuagaaacagguucuucuucuguuaaccaggcuggaauguagugguauaaucagagcucauagcagccuagauccuaggcucaaccaauccuccugcuucagccucccaaguagcuggggcuacaggcacaugccgucaugcccagcuaauuuuuuguuuuuuguagagacaaggucucccuauuuugcccaguuuggucuuaaacuccugggcucaagugauucuccugccucugccucccaaagugcugggauuacagacaugagaugcugcggccggcuauucaccauguuuuaaaauaagaagaagaauggcugguucuggagcugaucuuuucuuucuccauccuaaauggacuggagguuauuuugaaauuuuacugugaauuuccuuuuuaacuuggagcugaaaaaaguaggguuucagccaggcgcaguggcucacgccuguaaucccagcacuuugggaggccaaggcggguggaucacgaggucgggagaucgagaccauccuggcuaacauggugaaaccccgucucuauuaaaaaauacaaaaauuagccgggcgugguggugggcaccuguagucccagcuacuugggaggcugaggcaggagaauggcgugaacccaagagguggagcuugcagugagccaagauugugccacugcucuccagccugggcgacagagcgagacuccaucuaaaaaaaaaaaaaaaaaaaaaaaaaguagaguuucaucuuagacucuguguuuuauaccucccccacuuuuaauucacacacacacacacaacacaccauaaggcuagaaagauaguuauuaguaacuuaaagaaauggauuucucucuucauauuuccaguauacaaauaacauccaaauacuccaguaaugucauaaaguaagauggcugcagucaagccagaaguaaaacccagaauuucuaacugcuuugaacauuugccagcugauaagaacguaaaauuuuaccauaaggcuaagugauuccuggggccuaaauuggacagucaaugaagaagaagucuucagauuuucagcacugaaauacuucuguguuaaaaaaaaaacccauguuugcuuuauuuucuuaaaguuuccuuuaaauuaaagcauagccaaugaauugcaaauuucccuuuuuuuuaaacaggcuccuauuuguggauggcagugcuaagaaaacaugacuacugauuaguuuuuuaaaauggauaaauaauaguaguuuucauaaccagauuuaauuugaaagcuuaaauuauauaguacuuugcugugacuuuuuaguuucuucaacccuguguuaacacuucauuuuucauuguaaaauaucucaagaaacuuuuaaauaucuguguaauaaguaaaaaguaauguacauguaauguaugaugcucauguggaguucuucaagcucuuccuacagagauaaggaaagagggaagccuaggaauaucuuuccacccacuuccugauccuuauacucccaacuggguacccagggcuaacguccuugaccagacuccaggcaccagcuugcaucccuuucuuacaugcucauccccaaggcucaucaagccuugaaagagacagaaaagagaauggaaaguaacaaccagagacaagaagaggggguggaauuuggcagcagguggaagagguuuugucugcaugucugguuaugaggugccuccauccuccuugacccaucaacaacugaguaaugguucauauguacaggucacaaguaguccuagauuguaaugugauccugcuuauauuuugcacacuuuauauaucugcuggcauuuuguuaggucucuaaauauauaaacucauaaaauuaucauacuuaacauguuuuagaaaugcuaguaccauaacacggaaaaaaauaagauguaccugcugguaauauaagcauucauaagcagauauaagcagagucaguaagcacagagguuaaggacacagacuucggggccagguugccuggguuuaaaucccaauucagacagcuugcuagaugaguaaccaggaauaguuuucucaucagcaaaaucgagaugauagcacuaccuuacaggguuguaaauuuuaaacaaguuaaucugacuauaaauauuuaaaacaaugucuaauacauagugcuuuauaaguauuuguucuuguuaauauaccaugccaccuuucuaaugcuguuucuuuagauggcucaaucugacuuguaauuaguagguuacauuuauacuaauaccacaaccuuuaauguauaaccacuggauagcaaaucccccuuccucaguaguuuuaaaaagcaagaugcuuauuuuuuuuccucuuucccaggcccaacacagagauacuuucauugaagaacgcuauggaaaauauaacaucagugauccuuuaauggcucuacagagagauuuugaaacacugaaggagaaaaaugauggcgaaaagcagccagucugcacaaauccacucucuauucuuaagguugugaugaagcagugcaagaacaugcaggagcgcaugcugucccagcuggcugcugcugagagcaggcaccgaaagguagguucaccucaguugauguguaaaucuuugugaagucuuuauaaauuaugccugauacuuucuugucagcugccaguuuuucacaguaauucaauugggacaucucacggguaucaaaaagccccuuaguuuauguaagagccaggagauaaaaaagaaaacacagcuuauugcaaauguuaaguuuagagaacgugccagacacguuauuuaagacagcauuucuucuugauaugucacuccaaaacacuuuguauguuuuuucaguucuugaucauucaaacuuugggguuuggccaagcuuguagcugacgggaguguucucuauuugcuuacuuaagagauaaauaaaaagauuaacagguauuugaggcaugcuauauccaagggagagaaagaauuuaccugaggauaaacacagaagccaauagauuauuuucauuuauuccuauuauuccuaguuuugaguuucauugcauuuuguugcucaugaaaccauaaacagucccuugguuuauuuaccuuaaagguguucuacucuauuagugagggguguguguguguguguguguguguguuuuccauauuuaacaagcccuaaaauaggaaggcaaaccuuaugguuauuuacaguauuuacuuuaaagcuguucuacccuauuaguaaagaguguguguguguguuuccauuucuaacaagcccuaagaaggcaaaccugugcuuuccucugcuucaucuuacuggaauucuagugcuugugaauuuauucaccaacuugucaucuugucauuuacuccucaaauuuggccuguaaaagaugcuuggcuacaaucuucauuuuuaaaacacugucaguuuagauuuaugccaacaaggcaguuaucagugcauuugguaggaaacauuuucaucugaaaaauaggguuagcagcugcaaaauuugguggaccuuacuuuuaugguuaucagcauuagagccaucuucuuaaauugcaucugauacauuuucuaggcucuggaucuugcccgugaucuuuucuuucccuucacagaagccaaaugaaaggccagaguggaacuucuuaaccauggauaggccucagauguuccacagucccccagaaaauagacagaauguucagaguuuaugcauuuuuguaggaaauguauuuuuuccauagcuuuaaucagauucuccaaguuacccaagacccaaaaauguuuaaccucugguuagaaugaaguaaucugaaaacauuuacacuccaauuuaaaagguaucagugggugggaguuaguugccuaaauuggguggagggggagcuuuuacauaauucucuaaaaaucuucacaacauucuuguuuaauaggcaggcuuuauuuccacuucauccaugaggugacugaguuguguugaagcuaguugggcuagcuuucaugcccauggaagguguacuagggacaguuuguguuucuaggugauuggagagaggaagaaguuaaaaauaauucaaaauuucuuaauacuauauugcagugcuaaauguuuuaagugaauauuaaauuuuugaaacaaaguaccuaucuauucuuuuuuuuuuuuuuuuugaggugaagucucacucugucacccaggcuggagugcagugguacaaucuuggcucacugcaaccaccaccucccagguucaaguuuaagugguuuaucaaaguagaagacugacuuuguuagaaaucaaacaguaccuagaggcuuauaauuagggugcucauagucucagcuuaugccugucaccuuggcuuaguuauuaaccauauucccuuugacugucagaaauguucugguuugaauaauaaauuacauggucauugugcuuacaaugaaaaacaguuuucuauuccaccucuucucauuccccauccuccccaguauucacaggcaaccaguuuuuucuuuuagccauucacuuugguagcuaaccuccauauuucuaaauacugcacuguucucucuugcuuuaucaauuuuagacauuuauauuacuuucuuuuauauaggugcagauuuaguuaucuuacaccccgccucccuuuccucuccuuaacccuuacccagaacaaauuuaauccucuuuucccaccaccauucucugucacaucuacuauucccaaauccugagccugucacacuauuucuugaaugugacaggcucaggauuugggaauaguagaugugacagaggccagaugcugauggucugugugcaggaaucagggugaagggacaaauaauucugaaaauacaggcuuugaaggccagacacagugacucaugccuguaaucccagcacuuugggaggccaagacaggcagaucacuugaggucaggaguucgaggccaggccagccaacauggugaaaccccaucucugcuaaaaauacaaaaauuagccaggcaugguggcguuccuguaaucccagcuacucgggaggcugaggcagaagaauagcuugagcccaggagguggagguugcagugagcugagaucacaccacuguaauccagcuugggugacagagcaagacugucucaaaaaaaaaaaaaaaaacacaaaacaaacaaacaaaaaaacaggcuuugagccaguucuccuguuuucuauucuacauuucaccucuccucugcaguaccugccaccuccagguuccaucucuuuggggcucugcaaggcaaaacagcuucccuccuucaaaguaaaguaguuaccacaacuccagccucuuuucuucuucaaaauauuauuaaaauuuuuucucugcuagaggcucucuccuuugugggguuuuagucuuuuuauuccauuucuguaauuuuugaggacucccaaaagggagaagauaagacuuaccacuuuuggccaaaagcaugucuuucuauuaaauugaaaaauuagauuaaaaaaaggaaaugugccaaauuuuuuuucuuucauuuauuuugagagacagggucucgcuguguugccugggcgggaguacaguggcuauuaacaggugcgaucauagcacccuauagccuggaacucuugggcuccagugauccaccucagccucccuaguaucugggacuacaagcauacaccacagcaccagucucuucuuuuuuuuuuuuuuuuuuuuuuuuuuuagacagaguuucacucuuguugcucaggcuggagugcaauggcacaaucuuggcucaccacaaccucugccuacuggguucaagcgauucuccugccucagccucccgaguagcugggauuacaggcaugugccaccaugccuggcuaauuuuguauuuuuaguagagacaggguuucuccauguuggucaggcuggucucgaacucccaaccucaggugauccaccugcuuuggccucccaaagugcugagauuacaggcaugagccaccacuccuggccucuuuuuuuuuuuuugagacaaagucucacuccguugccugggcuggagugcaacggcauaaucauggcucacugcaaccucgaccucccugggcugaggugauccuuccaccucagccuccugaguagcugggacuacaugcacaccucaccaugccuggcuaauuuuuguacuuuuuuguagaaaugggguuuuggguugggcacagugggucacaccuguaaucccaucacuuugggaagcugaggcagaaggaccacuugaguccagguguuugagaccagccugggcaacauggcgacaccccauuucuacaaaaaaucagcaggccauagugguguaugccuguagucucagcugcucaggaggcugaggugggaggaucacuugagccuaggaggcaaagauugcagugagccgagaugaugccacugcauuucagcuugggugagaguaagacccugucuccucaaaaggaaggaagggggugggggagggagagggagagggagaaauaaauggcuggucucaaacuccugugcucaagcaauccuccugccucugccucccaaaagugcugggauuacaggcaugagcucauuuuuauuuuuauagacagguuucaugucccagaaaauuuacucucuucacucauaaaaauuuuuagugagaagacuaagaaauggccuuugggacaagagugcucuacccuggaggucugggccaaggcacuucugaagcaugagcagaagcuacuaagcaaucagaauauuugcaguuguagaugggauuaugugaaaaaugucucuuuaaauuuguauucuuggccaugugugauggcucacaccuguaaucccagcauuuugggaggcugaggcggguggaucacuugagcccaggaguuccagaccagccugggcaagauggcaaaaccccaucucuacaaaaaauacuaaaaucagcugggcgugguggcgcacaccuguagucccagcuacuugggaggcugagaggugggagaaucucuugagcucgggaggccaaggcagcagugagccaugauugcacuacuacaguccagccugggugacaaagcaagacccugucucgaaaaauaaauauauuugucuucuccuuaaaauugggcuuaauccuuuggcaccaggguaagugaaauagggguaggcaaguuaaauaaaagggcguaugaaaaaucuccauuuaaggucucuauauuugagccuuuuuacaugcaguaggaagucaagagagucuauccaccucuuaucuaacuauauaaaaauguauauuauuaguuaaacaaggcacacuuagaaugucaccuauuugaaauguugaauuucaggcuccuucuuuggugccucuggugauuugagaauugagaagaaaaucucagcuuucagguuucugugguccugucuugcuccaucaccuacaccuggccccuaguaacaccaaacugccugcaguuucuuggaauuucuguuaauucucgacaccuccucaaccccucuagcuaauuaguugcucucuucucucuguuugcauaucauucucuacauacuucaaguaaaguaaguaucuuacuguuuaacacagagcuuucaugucuuucacuguaaggcagugugcuccuugauagcccuugcuggguuucauuuauucguuuguuuguuugaucucuggaacuaucuaaggugccugauuuggcacuuauuauugguuguauuaauaaaugugacuccuugauauuugaaaaugaaauuuaaaaaauucuuuaaaggugauccuagaccuugaggaagaaaggcagcggcaugcacaggauacggcugaaggagaugaugucaccuacaugcuagagaaggaaagagagaggcugacucaacagguaauuaagguagagggauucacaguagcauuugccuggaacagcauuucccaaagauuauucugcaggaugccaacugguauuguucagaaaaggggcuuuguggucaaauaaguuuaggaacuacuggauuaagcaaaguuaaacagguuucuaacuuuguuaggaucuuuaguaugcagaagcacauugugagucuucaagaacaagauaggguauucuguguuuagcaaauccaugguuuuauaaaaucuuuuauuggcauagaucccucacugugggauuauuauuguuccguagaacacucuuuggggaaugguaacuuagcgcuuguagcucucaaacuuuugacuuagaacccccaguaagaagugacauuuuaugucacaacccaguauauguagacauacacaguuacgccugaaacaaaaaucucaugaaaucauauauaaccccuacugcuacaguacacauugauguuuucuguuuauauauuuuuuuaaaauucuagucguggcucaguuaguuuccccauccauuaauggaucucagaguuugaaaaacacugaguuucuucaacccuuucccucucacgcagagucucugccucaaauaggguugggaagacaauuaaaacaggcuauauuuguguaaaaaauaugauucaggcugggcacagugguucacgccuguaaucccagcacuuuuggaggccgagguggguggaucaccuaaggucaggaguuugagaccagccugaccaacauggaaaaacccugucucuacuaaaaauacaaaauuaggcgggugugguggcgcaugacugaucccagcuacccgggaggcugaggcaggagaaucgcuugaacccagaaggcggagguugcagugagccaauauugcaccauugcacuccagccugggagacaagagugaaacucagucuccaaaaaaaaguaugauucaaaugcaacuauuuguguguguuuguuucugagacccaagaaaauuauugcugaaacuuuaaaauguuuguuuucagcaacauucaucacaaaaugugguugauacagcuuucuguuaucuuguuuugauugguucugaugcucuccacauacgugaaacacaaagauacgucauauucccacuaaucacugcaagacaguaugggaacuagaagugccucccaaaucaucaaagaaagauuaaaucauagugugugcauuuuuuguguuagguguucuaaaauuucagaaauacuugaucuaagcacugugaugugcauguuaauccuguauaccagagaacagcuaacgaagacagucuacuugaucacaguuugucaguaugucucucuuuucuuuuuuuuucuaguuggaauuugaaaaaucccaagugaaaaaguuugaaaaagaacagaagaagcucucuagucagcuggaagaggagcgcucccgccacaagcagcucucauccaugcuagugcuugagugcaagaaagccaccaacaaggcagccgaggaaggacagaaggcaggagagcugagccugaaauuggagaaggagaagagccgggugaguaaacuggaagaagaguuggcagcugagagaaagagaggcuugcagacugaggcccagguagagaagcaguuaucagaguuugacaucgaaagggaacaacugagagcaaaacugaaccgagaagagaaccggaccaaaacccugaaagaagaaauggaaaguuuaaagaagauagugaaggaccuagaggcuucccaccagcacaguagcccuaaugagcaauugaagaaaccaguaaccguguccaaaggcacagcaacugagccucucaugcuaaugucuguguuuugccaaacagagaguuuuccagcagaaagaacccaugggagcaacauagccaagaugacaaacacugggcugccugguccugccacuccugcuuacucauaugcaaaaaccaauggccauugugacccagagauacaaacuaccagggagcugacugcaggcaacaauguagaaaaccaggugccuccacgggaaaaaucuguggcauuggcccaagagaaaccaguggagaaugguggguguccuguggggauugagacuccagucccaaugcccaguccccucucuuccagugggagcucacugucucccagcagcacugccuccuccucucuaacauccucuccuugcucuucgccgguacucacuaagcguuuauuggggucaucagcuagcagcccuggcuaccagucaucguaccaaguagggaucaaccaacgguuccaugcagcucgccacaaauuucagucccaagcagaucaggaccaacaagccaguggccuacagagcccuccauccagggauuuaucccccacccucauagacaacucugccgccaagcagcuggcccgaaacacagucacucaggugcucuccagauucacuagccaacaagggccaaucaagccagucucucccaacagcucucccuuuggcacagacuaucgaaaucuagccaacacugccaauccaagaggugacacaagccauucaccuacuccagggaaaguguccaguccccugagcccccugucuccaggaaucaaguccccaaccauccccagagcugagagaggaaacccuccacccaucccacccaagaaaccuggccucaccccuucuccaucugcuaccacuccauugaccaaaacucauucccaggcagccucuuugaccacugcagaagaccuugccagcagcugcucuuccaauacuguuguagcaaaugguaaggauguugaguuacuuuugccuaccagcagcuagucccuaggagggagucuccacguuugacauuccaucagauuucguccaaaagcucagucagacuucugagucagauuauguuauuuauuuugauaguagcugaaaccaucuguauaauacauuuaguauauuucaccauuuuguauuuuuuuaaguagaaacugaguaguuuggauuuuuauggcucacaucuuuuuacugaagccagaaaggcaccucaaagaugucucaagcucagcagucaccgucauguugugaugaagaaagcgaaucaccagguggugauuugcuaucuauuugagaacuagaaucacucaacacucauuuugaauuaugcagaagugguucaugcagauuuuuauuccagaugaacauguuuuaaaagugccugaaauaugacugccauaugaaugugauucugcagcaaaaaacacaaaauagaucauuuaauuacagaaaaugagauccucugugaauucugaauguuaaaaaccaacacugcuuuuaauccucuuuuaauguuuuaauacaagcuuuguguucugaaacaaggcugcauaaguagaaugggaauccuucuaaaggugggugugaacucaccacaagcugagcuuuauagagcccuugagaaacccuccugagcacuaagcaguuggggugcugauuuucuuguacuuuugaaaaauuaagucacucccaguuuccugcauaaguucuugaacagaaugaaaucacaucuccauucaaaaaaugucucaagcaucuacuguuguguaaggaacuucugauucugauugcuguuacuugaauaggaaaugguuacucauucuguauaaaaguuuugcaagagaaugaauuuuuuauucuguaaucaaaaagcaauaacuugaaauucacucuguaauauuauaggucagucagaauuauacaaguuuuaccaaauuguuacacuuauucuccaagcugccagaaccugguaucuguaucuguaaaaccaaauuaacuuuugcuuaaaugggaaguauacauauaucuguauagauacauuaccccuuuacauguuuaacauacacacacuuaaacacauaaauacuagugugauuauaucuuuggaguuugcaauauagcauaaaggacaaguagaacugcacauuaagauuaccuaccgaagcaacuagauguggcugggacacaaucaaaggaggaauuuuguccacaggaaggugaggaaauuccaaaugaagccuagaucuucaguaucauaaaaaggcagagcuggccaggcacaguggcucaugccuguaaucuuaucacuuugggaggcugagaugggaggaucucuugagaccagguguucaagaccagccucaucaacauagugagaccccaucucuauuaaaaaaauaaauaggcagagcuaaacuaaccccagugucacaaaacucaacuggucauauaaaugagugaaacaggccucucacacaagcgauguaaaacagcugggagcagugggagcuguggcaaacuaaagugcccaagccgcauuuaaaaagggcaucuguucagcuccaucugcuugcugcggugcaagaaugcuaaaccaggauuaccaguucuucacauuuuuugaaauccaaauuuucaugagaaacauucucauuuuuaaauaucaagaagugauuuuaaaauguuuaaauggugcugguuaaacaaacacgucugcagcuggauuuagcuugcaagcugccaaguugcaaccucuuucauucuagaaacuucugucauuuucaucauagcaagucuaugcggacaaaagccuccaaacuuuccaacuguguaggccaguacagcuggcaagguucauagaauauaauggcuaucccccucugccaaauaagacuauccacaacccagcucagacacagugguuauaugauuuuguguccauacaggagaggccuuggugucuucacauacauucucugagccaacaucuauccagcagcccugaccuccugcuauaauuuaagucuauuuccuuuuaaucuaauaagaguugauaguaaaaaggcaggugauggaaaucaguguauaaaucacaauggaguauauuggcaacuccacagcuuauaguuugauaaaggcaaauacaugaaaaauaaaaaugcuacuaaugccccaaggugucuaucaaaaugauguaggggguaucuuaaacuguccaaggcaaucaugcauugaacuuuauuccuaugcagagccaaaacgaauaguguugauaaaauagcuaaacuuucuaaacuggagaggaggcuacagugccagagaguuauugucucuuuugcuuuaaaugguaaucuuaaaaguugcauugugcucuuccuuuguuuugggauagauauauauagagagagauacuauaaggaaguuuauuucuuaggaagugcacugaauaauguauuucuuuuacaguguaauauggggguggggauaugcgaaagaaauguguauuuuugcuaguugccuaccuucugagauaaauaagcacaaucuugcaauggauccaauaacccaguuagguauuauagauuaguauuuaaguuugcuguagauugugugugugugugcuaaguaaaaguuccaugauucacaauuuuaguauuaacccauguugcaaaagcuguuacuggccaacagauuguaaugauguguaccauauaacacaagcauuaacuaggcauuaacguuuguaaagccaaauauaccaugcagaagucuucauuuuuauagcagacugcauuaaaacaaguuaaaucuugcuguuuggggggaaauagucuuguuuguacaaagugaaaaauggcacaauuugggcauauuuuguugggaagagggggugguguagagggagcacuugacuguggcuuugacaaaacaaaugaagucaaugacccauccagguuagacuccauaaggaacuaagacauugauuuucuuuagagucuuagagcuggaaaaagccuuuacaauaauccagucugugauuuuuuaaaccuuuuggugguucuggaccuuuuugagaaucuuagaaaagccauggaguuuaucccuagaaaaaugaauaugccuauaugcaaaauuuguuugauggcuucauaggauccaaagacccugaagccauccauggcucauguauuucugcuuaagaaagcauaaucuuguucugcucucucauuuuacaaaugauuaaugcaucccuuuucaacuacuccagcgcuguugcugcugcaauguuagcaaaugcaagccagagagaagcacuugaaaauccuuugaugucuaaaaaauguucaaauaguguggauguuuacauaucugaaguuuucagcauuuaagcaaauuaaugaucauuucaacaaauacuagcauauccgguuucccuuaauagccugucagcagugcugccuugucaauuuguguguguguguguguaugugugugugugugugaauucauaaggagugcuucugaugcuuaguccuugaaauggaacuucaacugucuuucaaaacacuggcuucaaaauaggauguguuuuccuaaugaaucagaagugggcaaugagcauuguuccacaggaauaauuuuuaauuuaauuucuauaaaacuaguugagaaaugagagccuguccacccaccauuuguguaucaguggccaauucauuaguaaaaauaaaggaggggaaaggaga

SEQ ID NO: 191331 - RNA, 62864 nt, Homo sapiens
accccaacgccgcuucugcggccaaaguagguugggaguggaaggugguggcugcugcuccgcagugucgggaagauggcgccgccgguggcagagagggggcuaaagagcgucguguggcagagugagugcggugggguagggguugagagagggaaggccgggaggcugccgugccgggccucguuuugcagccccaacccagcggucuguugaggagccgccgcgagcacuuguugcuuugggaccugugugaggacuucuuccugcuuuccugcccugccuuauuccuugccagcaccagggaugggcggggugcgacgggacgcggccuucucguuggcgucgggcacccccucgccucggccgcgcucuggccgcgaagcuccgccccgggugagccgcccggcccggcuuucccucccgcggagcccgugcgugcccucggccgcgcuccccacucuucuccgcucccguccgcgcuccaccaguuggggaugucucuccauccgagacaauucgggcgcuguuuauuccgcccccaucuccaccccacacuggaguuugcaaggacuguuuauucugcuuauucguguuaguaucaacccgugcuuuucaaaaaaccucacuguuuaacagacucaucuuccccuauuccgagaggagccuacuuucugaaaaguucuugagaagagaccauuggaaugaccgguguccagccgugacaucuuccugcauagccugggcaagagccgcuccuuccguuuucccuacucucgggggccccucccugcuguuaggaccggacuccuuauugguuacugauguucugcgguaucauccacaacuuucauaaacaucgcuccaaaccuaggucuggcagguuagagaaagaaugaaaccacccaacaggaauaaccaucauuguuugguaucucugaguucaagauaauuauggccuaguaguggaaagggaguagcaucuaauuaguauuucuuaguccaacuuguugaacaaaaaacaaaugauuuagucagcagaauucugggaguuagaguuccuugucuaaaauuaaaaauccaaaucaguaacugggauagugcuuaacauauagcaggcacuaagcaaauguauaaauaggugaaaaauaugaaauuaucuuuuaaaagauuagauaauuuuaagguuggcauuugcuuuuucaagauuuacauggcugacuuaagauuugagauguuuuaaaacaaugguauuuaaauacauuuaugugaaaauggguaacaaauuguguuguauaauuuccaagauauauaugugauuaacauccgcauguauguauuuaagccaguucuuuacauauugaaucauaagcuuuucccuuuuucacauuuuccuucugauccucauacagauaaagacauuguuuuuauuaucugucauucugugacuuccuuuuuuuuaaacaacugacauugacucaacauuuuucauguugcuucacaaucucguaauuaacauuuuaaauugcuuuuuaaauaccuugagguggcaaaaaauuuugauagcagaaaagaaaagaaaaaauuauggccaggugcagugguucacgccuguaaucccaacacuuugggaggccggggcaagaugaucaccugagccuaggagugggcaacaaagugagaccccaucucuacaaaaaaauuuuaaaauuaaccauguuuggugacaugcaccuguguucccaccuacaugggaggcugaggcaggaggaucccuucagcccaggaggcugaggcugcaguggacauugauugugccaccgcacuccagccugggugacagagcaagacccugagucuaaauaaauaaauaaauagcuagcguaagcccgggcacaguggcucacgccuguaauuacagcacuuugggaggccaaagcagguggauugcuugagcucaggaguucgagaccagccugagcaacauggugaaacucucucucuaucaaaaauacaaaaauuagccaggugugguaacgcacaccuguggucccagcuacucgggaggcugaagugggaggaucgcuggagccugggaaguugaggcugcagugagcagugaucaugccacucaauucagccugggugacagagcauaacucagucucaaaaaacaaaaacaaaaauuauuuggguaacuuuuggacuaguggaagauuaauuuagagauuagguagaagccagucaguggaggauguuaaauaguagaguuuagauuuuauucuauaagcaagagugagcauuugagggaauuucgagguguguauuaauauaaacaaaggguuguauuucaggaaggugacucugacagcugugugaaaaauggauugaaauagcaaagguguuggagguggaaagcaggaaauccagauaggauucuauugcaguacuucagugagagagaagaaucaagucgaugcugggugacaguagcaaugaaaaauaauagcuaccagggagaacaaucaauaugccuaauaggugggcguggggaaaggaggaaauagacaaagacaaugacuaagaaaaugacaauaauacuuagagaaauaagucuagaguaguuuucagggugcuguaaucucaacuugagacauguagcugcuuguaucuguauugcguaguugaaugaaguucaaagagagaaaggcuguaagauuguggaaaaucgaaagauuaauaugauagaugaaacuuugaugaugaauauggucucugagaagaccagccacaggagcaaauucucuuaccuuugcucugagaacaagcagagcaaaaguaagagaauugagucuugagauauauccauauuuaggaugcuagagaaauggauauaaggucaaaugauuuucauuaguauuuagaggaaauaccuccuuaguucuauaguauuuguugauaugauuuccuuugacuccucucuaaacauaccuaccugugacugugucacuuuuuaugggugcccuuacuaucuccauaaaacuaguucguucuuuuagacaauaacacugacucuguagguaucuucagauucuuuuuauuuuuucgucuggcagacacagguagauccaaguaucuucagauuccaagacaguucuaucauuagaaauuuaaagcacauauguaauuuuaaauuuucuaguagucacauaaaaagguaaaaagaaaaagguaaaauuaauauauuauauuugaccuaauaaguuuuuuacauuccuuuuuuugugcuaagguuuuuugaagucucauauguauucuguacuuacaggauaucucaguucagacuagccacauuucaggugcucaauagccagauauggcugguuuccaccaucuaggacaaugcaguucuaagguuucaaagacuguaaugagaugacuucugcuuggggagcuuuucuccaaucugcuccaucauaaauuccaugagcauucauuucuuaagagaaagacacaaauaaaucugauaaaaacaagcaaaugucuucaauuuucagcuguuugagguauaaggaaugaagcuagcuuugaaaggaaaagcagcauaauauuucuguaucugagcucuaccggagaaaauccuuuauuuuugccuguaggguucuagaagccagcgcuuuuggcuuaaauuaugguuaaauauuucggacuuucaccauaauucucauauaacacuauaauccuccuagcaaacaauauauaauuaucucaauugauauuucauaacacuuccaaaucuucucaaucacaauacaaccuuccagaucacaauucuaaaaaugacuauaaauaacugaauugcuuuuacuaacaacauuucugacaccaaauauguguuuuauuccccccucacaccaaccaguucuccaacucuggacaccagcuguauuagugucagaauugaaaugaauuguaggauauccaguuaguuaggaacuaguuagcuaggaacacuaguuagugucagacuccacagguuuaagggcucagucucacaauacugccuucacuucaaaugccaguaccaagucccuagguuacccacacuucugucugucuuggcuacaaagucaggaauuccuacaaccucccuucccuuucagguucauuaauuugcuggaauggcucacagaacuucagaaaacgcuuaacuuacuauuaccaguuuauuacaaaagauacaaaugaacagccagguuggagagguacauaggguaaggucaaaaaagguccuaagcauaggugcuucuauccacauggaguugggugucucacccuccuggcacaugguuuguucaccaccuugggagcucuccaaacucucuuaagggguuuuuauggaggcuucauuauauaagcaugaaugauuacaucacuggugauugaacucaaucuccagucccucuucuuucccagagguccugggguggggcugaaaguuccaacccucuaaacauggcuuggucuggugaccagcccucaaucuaaagcuguauaggggccccucacccaagagucauuucauuugcagacggaagagaugcuaucacucaggagauuccaaggucuuuaggggcucugugcuaggaacaggggguaaaaaccaaauauuuuuuauuguaccacaguaacuguuauuauuuauacccucugauagaagagccgucaguuuuuaacaugacuuguuaccaaaaacuuguugauaaauuucccaaaagcauuaacuuaaauauaaauuaggaaauagaaaagcuuaaguuaaugaaauaaccaucucauuaauaagauuuaaugaaaaauagguuacuauaauuuauauuuuaauuauauuuuauguauuacuauguauuacuaccgauuuuaaaaucaauugaacauuaauaaaacauagugugggaaauuguuuuauuaaguagaacagauauuuguauaaauuguccacaugaauuauuuaauacauaauggaaaauguuuuuaaaucagugaacuaauuuuuaaaacauauuuagauaauuuugaaagucauuguaaggaacauauuuauugauuauaaaucaagacugaauauugguauccaaaugcugugauauguauuguugaaaagcauaauguaguaaaucaguaugaaaaauguuuaugcagauuugaucaucagauauaauuuagcaaugggcaacuuaaggauguucccguggguuuuuuguuuucaucuuguuuuacuugggauuuaaguagaauaggaaaaaccaaaucagguaauaauuuuagaaauauuuucucgguacguucauguacuuaaauauauuaacccuuuuuauaauaccuuuuaaaguuaaaaaauugauuacaguuuaaauguacuguauaggcuagguauuagaauuggauuuuuccguaagguuuaacaaauauguaugcuuuuuauguaguuuaacaaauuucaaauuggauuuuuccuuagccauuuuggacccuuuggauuacuauguuucuguuuauuuaauuccuaaguaauuccuuucuuuuuuaaacagagauaaaagcaacaguguuugaugacugcaagaaagaaggcgaauggaagguagaguuugcauaccuugcucuuauaaaaaauaauacaaacuuuaaaaacaauacaguauaaaaacuacauaguauuuacaugguauuagguauucuaguauaaguaaucuaaagauaauuugacguaugugggaggauguguguagguuacaugcaaacacuacacuauuuuauauaagagauuugagcauccauggauuuuugguauacacagggguccucgaacccccauggauaccgagggaugacuauauagggucuggaaucacacugcuuggcuccaaauacuaacuucaccacuuaauagcuguggcuccuugcacaaguuacuugaccucucucugccccauuuccuuguuuauaaaaauggugaugguaauaccucauaugguaauuguaaauaugaggugaauuaauccauggaaauuacuuaaaacagugcuuugugcaauaauuguucuacaaguggcaauuguaauuuuaagaaaauuugauguuaaacagugucauucaaaaugaauaagcucuauguuucaaauuagaaauauuucuguuuguuuacuuauguacgauacuauaugcauguauauugagaaaaucucuagcucaugcaagauaaaagaugagaucauuuugccuacuguucugauauuuuguguuauaaaaggcuuauaaaguuuaauggauaaaauucuuuuuuucauucuugguaauaggaugcuuacaguauuuuuaaauuuguguuuguuuuaagauaaugcuuuuagaugaauuuaccacuaagcuuuuggcaucguguugcaaaaugacagaucuucuagaagaagguauuacugguaaguguuauucuuggcaugaacacuuuuuaauuguaauugggggagaucugagguauuaaauuuuaguuaguaguuguguuucuaaggagcuuauuuuuuuaaauuacuguagccauaacuauuagauuuaacauucuuuucucugaaucuucugucaguuuuuuucccucagccgagacauauaauuaagaccucuaaccaagccuaacuuaauugcuuuguugagguuguucuuuaaauguuuuacucauauauacauauauauauauaaaacaauuuuguauauugauacacaagcuuuacuucaguauuuugauuuaguuuaugguuucauauaucgcuuuaaaauggauaucaagauuuaugucauaaaaucagcuguuguacauguuuacaaaugcauaaugcugacuucguaaauuuaucuuuauuaccagaaaugagacaaauaauuauaaguuuaaaucaguuuuaguaugaaaauuugaaauacuuacagauucugaaaaaaaaucauaaugucauaagaaguuaucuuccucuaggcgggauuauguuauugagauauuaaucuguauuaccuauugaggaaaauaccaauaucuuguaacaugcauaaucauguuauucuuaauucaucauccuuuaacucacuuauuaaaauuugaucuucauaauaacccuaugaagacagauaaauacucucauuuguaaugaggaaucugaggcuccaagugaaauauaauucauuuauauuuuggauccuaauguaguuuauguaccgucuguuacuccuaacuuaaugaaguucaaaaguauacccaguauucucaagaaagucugaccauauaauauuuauguuuugauguuuacacauaaaauaaucuuuuuuuuuuuuuuuuugagacaggaucucacucugucacccaggcuggagugcaguagugcgauuuuggcucacugcagccuccuccuccuggguucaaacaauccucccaucucagucuccgaaguagcugggacuacaggcacacacuagcacacccagcuaauuuguauauuuucuuggauagaaacaggguuucaccauguugcccaggauggucucaaacuccuggguucaaguaauccacuugccuuggccucccaaagugcugggauuacagguguaagccaccaugcccagccauaaaguaaccuuuauuguuuauuacauauucaauuguggucuuucugacccucaauguaaaaagcucuaaacuagaaauuagaaaauugaagccuugauuuuucuacuccuggauaagugaaauauugauuaagccacuuaaguuuuuuaaguucugaaaggucauucugaugugaaacuagggugagaaccauuugauaauacauaaaaguucuguggaacugcagagccauuaugcacuguagggagguuuuauugcauuuuguagaccauuguuucuuacuguaugcucacuauuaauagauauucuucaaggaagggauuccauggccaguacauuuaggaaacaguauuaaacagagcuccacagcuuucuuuaggacuuaagagucuuuauaugccaagguauaaguggauccccuggguaaaaugauaguauucaguuuucuaaacuuauuuggccacagaaagcuauuuuugagaagcauuucauaggacuguauaucauagagcucgcugcugugggauaccuuugauauccuccagaaccaccuaaguuugcuaugguuuaauuguagucauaucuucuaacuuaaacucaaaacaguccuuuugaguuccacauuagcucuccugaaaaucccucuaugaaacugggcacuggcagguucagcagucaaacuuucuguugucauucaggucauucaugaaaauauuuaguagugucuugggauuaaaacaaaaucgggaaaaaaaaugcucugucaggauuugcuacuugaguggagaauaaagucaaguauaaaaccuuaaaaaaaauaaacugaagcuggguacaaugacucaugccuguaaucccagcacuucgggaggcugaggcaggaagaucacuugaacucaggaguucaagaccagccugggcaauauagugagacuuugucucuacuaaaauccaaaaaaauuaaccaagcaugguggcacauaccuguaaucccagcuacuuggagaacugaggcaggaggauugcuugagccagggaagucaaggcugcaguaaacccugauugugccacuacacuccagccugggugacaaaaugagaccuuauuucaaaaaaauaaauaaaaaguaaaaaacagacugggaauuagauuuuuuuuuucacuauuaaagaccuuucucuuuguuuuuuuaguuguuugauagauguguauuuuucagugaauggagaaguggcacuuucuguuauuaauaaagagauuucagaauauuuucagagccugagcccuaaaucauauuuaucacaguauuuucaguguuuuaacaaauacauuauucaccaaacaaaauaauauguauagcaugacuguaagacacuccauuuugaacauuaaacaauugaaauaaaugaaaacagauuaaaccuuaauuuuuucaaguaaaacuauaauaguugagaaugaagauaaaaagauuaaauuuuuccuuggaaauauuauuugauugucuaguaguaguuaugauaaaccuauacauuacuaauauacauuuaggaaugagaaaaggaaaucaccauauuuaaaagagaaguccagcaguaaccucucuugcccgucacauuaauguuaauucuuucuaggcccuuugucaacaugaaucuugaaagaugguucccuggauuuguugaaggauacuuuaaauuaguuuuaagaaauauauauguagcuuuaaauaguuaauuugacaaaguuuauuaacuuuauauucacuuugcuuuagcuaaucuuauaaacugcuuaauuuccauaauaaaaaauauaauugacuaaauucuagugauguucuguuguugaaaaaauacuuuauaaauaugugugguuuugaaagaauaggcguuaauuggcaauuuauuuaaacagcauuguggcagguaaaaacuugggcucuggagucacaucuggguuagaagccugccuguuccacuuccuaacugugugauuggauaaguuacuucuuuaagcuucaguuuccucauuuguaaaauacuugcaagguuauuaugaauuuuaaugaguaauucauguaagaaaaugaauuauuaauuuaagaaaugaauaauuucuuacauuauucauguaagaaaaugaagaauuuuuauuuuucauuuuucaggauuuuaaaauguauccagugaagacaaagaaaauguuaaacccaguaaauguuuuuguuuucauauuauuuguaaauguauuuucauauuauuauaaauggaaaguacaguaaaguuuauuuaaaaauuauuuuaaguauauaaauauuugguuauauaaaaugaccuuuuuucuuguuaguuguagagaauauuuauaagaaccgugaaccugucagacaaaugaaagcucuuuauuucaucacuccgacaucaaaggugaguauuuugagaccuuaaaaagcagguucaucaauauuucaccauuguuaugguuuacuaacagaaaauucaaaguaauaaaguacacuuuaguagaaaaauauugccauaaacuaguuugcuuaggaaaguuuuuuucuguguuagaagauuauuugcauucuuccgaaugagaauguauaaguaaaaggauuccuuuuuuccccauauaugaaagcagaauuaaauuguauaaaauaacauuucuuugcauguuuuguuuuucaugcaguuccuauugaacuauaccuuuuggggggaugguaauguagguaaaagaaauaaucuauagucuuggauuacuucuuuaucucagugacuuuccuguagcauauuuguauguauauaugaagauggguauauauguguguauguauauauuuuaugugaaaggaaauucuuuaguuuauaaucugacucuaugaccuaacucauacuugaugccaaccuuucagagccaaauuaucagauuucuuuauucuguacaauaucugagaaugcauuuuugaaaaccugaucucucacuuauucccauguagaacguuaauuuggcaaucucuguuucauuucacuucuaaaaaacuuuagcagacauuuuuaaaaaaacaaaaagauacacacuuuuuagucucuacauguuggcugcuaguggguuuuaaugacauuuuauaucuuaucuguaauauaauuccauaagagaaaaauucaugauuggaaaaaaaaaugcaacuuaaaaguaccauuuuucaccuagcaaauuggcagagggauuuaaaauauauauauauggguauguaugugugugugcauucuggcuauucugguuaucaguggauaauggagcagaaacugccauauacugcuagugggaguauagauugauacagccuuuuuggaaaauaguuuguaauuuguuaucaagaaccuuaaaaaauguuuuauauuuuagaguuuauuguuaggaaauaaauaaaugguuuagcuaaguuucuaguaguaaauaaaucuaauuaaauuuuagcauuaauaaauaauagaccauaugaugauaucugaaugaaauauaugaauaaaaugauaaauaaaugaaaacccauguggccauuaaaaauaauuuuucuagggguuguuagugaccuagauaaauguucauuuugaauguuaagugacaaaagcaagauacaaaauuguauauuccucauucuugcagucaccuaccaagcuuuggaucuuucuaaucacuugauaguuuaagcuucucacucacugugucucacuucaacacuucuccagucauaagucuuggugguucguuauccauguagaugauacuuauaguauguugguuucuaguuccuuaaucuguuauauuccaauagucuugucuucuauguuguuucaguuuuccuagaccucuucauugccaauaagagcauccuguucauacauauuaccuuacucuuuuuuuuuuuuuccaaaaccaaaaaugguuaauauuaccuuacucuuuuuaccuuacuaccuuauuagcuaucacuggcuggagaacauagcaucuuaaaaaaucaguuuauaaauuaaacuuuuagccaguaaaguuuuauuuugucacugaaauaaaauaaucuuagucauuucaaaagguaacauauuuaaauuaauauuuaauaaaauguguauuaacaucuaaccuuuuuuaagucuguagauuguuucuuacaugauuuugcaaguaaaucggagaacaaguauaaagcagcauauauuuacuucacugacuguaagucuuuuaaaaaguuauugcuucauuguucaaaaugccauugguuuuaaacugucgacuuuuuaaaaaucagcccaaaaugucauuaaaguaucuacuuuuuauaauauuauuucaguccuggugauuuucuauuuaucauuuguucuaauuaggcuagaaagaaucuaaaaauguaagauuauaucuauccuaauucauauuaaggugauagaaaauuaaaagaaacuauucccaacugcuuucaaaagacagucauuuugcugggaugcugggaugugagggauggguggagagggcuagcccucaaauccugugcuggugacaggaagaaauauuuuuaaucagcauuucaguuagggauuugauucucuugugaaaaacaaagaccuuuugagagggcacugaagaaaacagccaucuguuuggcaaauauaaagggagaaaaucugucacauuuaucuuacucugccauaugaucacauagaaaacugguaacuaaagaaucacagagaaguccaaagacacauacaauucugucuuauguuacauguuauauaauauacuucaaaauaaaaauaucauaucuaaguuaagucuuggucucugcuguuagagauuccucacuuuaaguaaguaguauaucauuuuuccuauaaauuuuuaucucaugccuaauaguuugcauuuuuaaaaaugucacaccauaaguauuuguaauguaaccuuauuauacagagcaucauguuuauggaauugaugaaauuuaaugaaugugaacccucuuuuaacuuaaggaaucuuaaggcuaaagaauaucauguuaaaagauacuaggagccagugguugauauuccaaccuagaucuaguggaaugauaaacucuuugaugaaaggggaaaaacacuggcucugaguuccagaacuuaguauuauagagucuuagaauuuucuaauguuagaaagcugccuuuaauugaaggaaaaauuaaccauuuguguuguaugauuguaguauggaucacuuaguggcaauuuggaaaaguaguauaaauuucuaagauguccugaaagugcugcuguuuguuaagucauaaguuuggacuugauuuuucuuccuaacaauuucaguuugcucuguuagcagaucuuuaaggaaauacaucugagguugugguggaugugaaugggaaagauggaauuucuguuauaguccuuuucaguagaauauaucuuuuguaaagcaaauaacaauauuuauauauuauuuauguccucauaauaacugugaaagccaguaauuauguauaacuauucuuggauguuggaaugauuuauuuaaaaggaauaaaaucuagauguaacuauaugcuuuguuuuuuuuuccccucaguuugcccugauaaucucuuuaacaaaauuaaggcuucuugcuccaagucaauaagaagauguaaagaaauaaauauuuccuucauuccacaugaaucucagguacuuucuauuuuuauuuuuuaguucaugagagguuucaaauuugguuuuauggcuuauuguuaauaaaguauauucugaagauauuuuuuauauguauuuggugaauuuugaaccuaauccacaaauagacauuucccaugaugaagucagacgcgugagcaauaaauuggaauuaaaaaugaauagcagggcuuaaauuucauaucugccaccaaguccuuugucaaauuacagaacuaccagguuaugaaaucaagagaguuuugagcacagucuuuguuagaugacuccaaaaaaaguguuucauuuagcuuguguaaccuuuugugauauuaaaacaaaugcucuuuaauaaacuuuuuauauaauauuauguaaauuauuuuaauuuauaaagugaggggauuuuugacuuguuuugccuuuggaacauugagccuucaauuaauaauagcaaugauuauaaugauauaagcaaacacucauauaauacucccuaugugucauauacuuuccugaguguuuuacauaaauuuauucauuuaauccucacaauagccauaguaauagauuguacuucuccauuuugaagaucaagaaaucaaagagguuaaguaccuugccucaaaucacacagcuaaugaauuguuaagguuuguuuugcucuguucucuguguuuggauucuagcauuuuauagaauugaaauaguugacuguuguuuggaacuaugaucaauauuuuaagggauagacaaguccuagacaagggauuucuacuauauuacuuuuaagauacugcuggguuuuuuguuuuuguuuuuuucuuuuuuugagacugaguuucgcuuuugucacccaggcuggagugcaauggcgcaaucuuggcucacugcaaccuccaucucccaaguucaagcgauucuccugccucagccucccaaguaguugagauuacaggcaugcgucaccacaccuggcuaauuuuuuuguauuuuuagaagagaugggguuucuccauguuggucaggcuggucucgaacugcugaccucaggugauccaguauccucggccuucccaagugcugggauuacgggugugagccaccacgcccagcugauacugcuguuuuugacaaagaaaaauaauaauccaaauuauaagauuuuaacauaucugcuuaacauuaaacuguuuuccaaaaguuuccuuuaaacuuauuauuuuaauauguaaguuuaguauagggugaaaaugagcuucugaaaaugauguaggauuuaagugguagugugagaaauauuacaaacauuucuagaacaucucgcuucacagaagauaaauauaauuuuagccccagaauuuauuaaaauucugcaguugcugcauuugaaggaaugauuuguguagauaucugaauaauuugauggugaauagaaauaaccugucuuugcaugucuagagaaugcucuugagaaguuucuacuuaucagucuuuacaaaauauugugauuauguaaggucccaucugugaaugguuuuccuauaagaauuuuuuucuuuuaauuuacuuacuugaaaagagucuuaggaggguauacuugacugggcacaguggcuuaccccuguaaucccaacacuuugggaggccgagguggguggauuaugaggucaggaguucaagaccagccuggccaacauaguaaaaccccgucucuacuaaaaauacaaaaaaauuagcugggcauggugauuagcaccuguagucccagcuacuugggagccugaggcaggagaaucauuugaacuggggaagcaaagguugcagugagccgagauggcaccacugcacuccagccugggcaacagagcgagacuccaucuccaaaaaaaaaagagguucuacuuaauaaaucuaacuguuuuggagaaauuacauugaaaauauuuuggauuuuugauuguuugcaagugaaaauguaaaugaaauacuacuaggugcuuugagcugugagcaaaggccuacugagcauuuaucaagauuauguucaguggacguuguuuguuaaaugcaaagcagucuacugugaaaagaugagcaagauauauguccuacccucauuugaauacuauaaagagauuaaaaaguauuagacauuuucaaaaacuguuucaaucaugguuaaaucaaguaggacuaggcucaacuaauuaaaagaaaacucuggacuuucaguggauuacacaacacggaaauuuauuucuuccuaauacacaagaaaucaggaauaggcuauauaagggugauaaugcuggcucuaugaaauugucaggggucuagucuccuaggcauggcccuuaugaucuaagaugauuguaaauuuuuuuuuuuuacuguuauaucuuuuuuuuaauuuuaaggaauguuauuuuaaaacauuauaaaaaucauaggcuuauuucaauauuuuaaaauaucuucuguaacauuccacucagaagguagauaacaaaauucuucccauaggaagggugccaauggaaugugauauuauauuauucaguuauuccauuuuuucuuccuaccucauuuuugcugaagaacugcucacuuaauauccugggagugaucuuguugaaauuugccaccaucauguugaagcaaugaaccuucacccguaguauaaugaaugugacacugcuuauaucuauccuguaggacagcuaaaaggacaagaccucagcaucacaugccaaccagucuguuagagcaaucacacacauaacuacuuuugccaaaauccuccaacuuaauuuuuaaauagcugaaauauagucaaggccauauggguacuguaccuggaacuagaaacauacccuuuucacacacauucaguguuacagcaacagcauccugggacagguuaggacacaaucacauuuuuuaaaaucaagaguaagaaguaaacauaaaagaauauuugcacaaggcacagaauccuguuucuuggcaauagacagaaaacaacuggcuaaagaaauagguuuacagauagauacaaucuagaauuugauucuuugaguauuaaacuuggagacauagcuauauacauuccaacauacaaucuaauauuuuacauuaguaguuucuuauucaauauuuaaaagaaaaaccuaccaaaaaccaacccaaauuauauuuauuaaccauuggauaaccccuuuuauccuuuaucagccacuuuacuccagguuugauuaguguaaucaugagauugucuagccuaaugcucuagggaaaauucuguggguguaagaugaugccuugcuguggaaccauuaauuauuaagcuccaagugaacugaagcagauauuuaugaaaugaugauauauuuccaaaaauacgaaaaacagauaaggcagaugguaacucuaauaagagucacugaaguauuauaauggcacucuggaaauggcucauagcaaaacccaacuuuuuuuuuugagacagaguuucacucuuguuacccaggcuggggugcaguggcgcgaucucagcucacugcaaccuccacuucccgaguucaagcgauucuccugccucagccucccgaguagcugggauuacaggcaugugcuaccaugcccagcuaauuuuguauuuuuuuuuuuuaguagagaugggguuucuccauguuguucaggguggucuugaacucccgaccucaagugaucugcccaccucagccucccaaagugcugggaucacaggcaugagccacugcgucuggcccuaacuuuuuuuguuaacuuuuagguuuggaguacauuugccaguuuguuauagguaaacucaugucaaggggguuuguuacacagauuauuucaucacccagguacuaagccuaguacccaauaguuauuuuuucuauuccuuucccuccucccacccucuacccucaaguaggccuagugccuauuguuccucucuuugugaccguguauucucaucauuuagcuccuacuuguaagugaaaacauguaguauuugguuuucuguuccugcauuaguuugcuaaggauaaugaccucuagcuccauccauguuccugcuaaagacauaaucucauucuuuuuuauggcugcuuaguauucuaugguacauauauauauagagagagauaccacauuuuuuuuaauccagucucccacugaugggcauuuagguugauuccaugucuuugcuauugugaauagugcugcagugaacauauacgugcauguguccuuaugauagacuuauauucuuuuggguauauaccuaguaaugcgauugcuggggcaaaugguaguucuguuuuuuaggucuuugaggaaucaccacacugucuuccacaaugguucaacuaauauacauucccaccaacggaaugugagcguugccuuuucccugcggccucaccagcauauguuauuuuuugacuuuuuaaaaauagccauucugacuggugugagauaguaucucauugugguuuugauuugcauuucuuuaaugaucagugauuugagccauuuuucauaugcuugugggucaccuguaugucuuuugaaaaguguugauauccuuugcccacuuuuuaaugguuuuuuuucuuguaaauuuaaguuccuuauagaugcugaauauuagaccuuugucagaugcauaguuugcaaauacuuucucccauuguauagguugucuguuuacucuguugauaguuccuuuuguugcacagaagcucuucaguuuaauuagauuucauuugucgguuguugcuuuuguugcaauugcuuuuggcgucuuugucuugaaaucuuugccaguuccuacguccagaaugguacugccuaggcugucuuccaggguuuuuauaguuuuggguuuuaccuuuaagucuuuaauccaucucgaguugauuuuuguauaugguguauggaagggguccaguuucagucuucugcauguagcuggccaguuaucccagcaccauuuauugauuagggaguccuuuccacauuguucuugucagcuuugucgaauaucagaugguuguagguaugcggccuuauauaugggcucucuauucuguuucauugaucugagugucuguuuuuguaccagugucauguugcaaaaccuucuuuucuguuagguucaucacaugggugcaaccauugucaguagaaaacaaacaggagccuccauggguaggcccacgccaagggaauuuuccucuuauggauccacagaagaaaaauaauuuuuggugccauguggcuuguccuuaucuccagcaaaacaaucuaguucccucaaccccauugugugucugggaaaagauagugaaaauauuuccauaagaggcaaagacuauaacaaagcuacaagcucacugugcaaaggugugaaaaugucaugguaaaaagcaccacaugcuaauuuuuuuuuuuuuuuuuuuuuugagacggagucucauuccaucauccaggcuggagugcaguggugcaaucucguuucacugcaaccuccaccagguucaagcauuuuucuugccucagccuccagaguagcugggauuacagacacguacccccacgcggggcuaauguuuguacuuuuaguagaaaugagauuucaccauguugaccaggcuggucucaaacuccugaccucccaaagugcugggauuacaggugugagccacugcucccggcauuuuuuuuuuuuuuuuuuuuuuuuggagacagauucucacucugucaccaggcuggagugcaguggugcgaucuuggcucacuucagccucugucuacugggcucaagcgauuuuccugauucagccucccgaguagcugggauuacaggcaugugccaccaagcccagcugauuuuuuguauuuuuaguagagacuggguuucacuauguuggccagguuagucucaaacuccugaccucaaaugaucuguccgccuuggccuaccaaagugcugggguuacaguuacaagccaccgugccuagcugauuuuaauagcuuuuuuuuaacuggagaaaucuauuuguuauguacacaccacagaaaaauugcccccgccccugaaaaaaaaaaggucaugcaagaaaaucagauuccuaauauaaaaauguauauaucuaaaguaggcaaaaauaugguuuauguuuuaaaaagaaaauauguaaaauuucacuaugaaaugcuuugauuugcaugugacuuaguacuuauuucauauuaaccauauccaguugcuaugauaagucucuauguuuuagaauagcuauucuuuaaaaauaucuauuuuuaagccagaacauauacguuacauuugugcauccguguguaagcuauccugcuugguauggaaucaagauacuaaaagauuaauaaaagaaguuuuaaaaucuucagucacagacuagcaaagaauauauuucuucaaguuuucugggccacacugcugacuuaauauuaaugcaaucugaauuuucagauguaaauaccagugagagguugguugucaaaacuuaaaagcaguugaguugggaggaccuucacaauaucggcucuuaaaucauaaguaaaauuauucuuagaacuggaccauaguaagcagaaagccuuaaguuuucuuagcucaaacccuccaaauugacucuuaacauucauaaucaugcccuuuuaguugcuuuaagagggcauacugacuuuguggucuauacuuuguaagagagcagguaacucuagcacaaaagaaacuguaauauggaacuggggaggacuucaguggcacuauuccaauuuuauugauccauacuguugcuuucaacccugcuuugagacccccuugugugucacuuucuaacaugucaccaaccaucacacaguccacagguuguacuccaaggagauugcagcauuaauaaaauauggaaggugcuggcuucuccucccucugcuguucaccuacaacaacuuggacauaggacugacagacacaagccucaucuucucccucugggucugucugaccccauucauuacuaaaaguaggcagaccuccuuucugauuucaaugagcauagcuuugacaucucacugaccuuagugucaugugcuguaaaugugugguuuuccaaaggagguaacguucuucagccaguuuccuauuggcuacaccauguuuuguuuccuggauugcuuccucccauugugaaguccuuagaucaguaaugcauguauuguaauggugaaaacauuccuucuugaguuuaacuugagcuuuaucacaggugaauucagccuccuguuuauacugguauuuugauuguaagagcuuuauugccuccaacaugccucuccugcuugucacaccuguguugaugaguguguuguccaggucaaagaaaauggccugcacguggcucagccccauagcaccugugccuugcugcaaccugccacgucgcugccugcacaugcgcaaggugggcggcccaauuuuguuuuuuucuuugagagagggucucgcucaaacaguccucccgccucagccucccaaguagcugggaccacagaugcaugccagcacgcccagcuaauuuuuucuucauuuauagcagagaugaggucuugcuauguugcccaggaugaucuagaacuccugagcucaagcaauccuccuaccucagccucccaaagugcugggacaggcaugagccaccacucccagccauacuguagaauuauuacaucaucauuugaggauauacaaaagaaugagagaauaauuuucguuuuuaucucauuagcuaaaauugagucacauggcuacacauaagugcaugggaaacugagaaaauuuuuuagcugggcauauauggcuguucuucacaaagaacugaagugcaguuacugaaaaggggaggauguuuguuggagaagcaucuuguagucggccacaaaaggagggagauucucuuuuuaaauauuuauuuauuugacacauuguaauuguaccuauuuaugggauacaauuugauguuuugauacauaucuguguuguauaaugauacaaggaauguauccaucauuucaugcauuuaggagccagguuuuguuagguuuuguuuguauuuuuaguagagaugggguugcccaggcuggucucgaacucccggguucaagcaaucugccugccucggcuucccaaagugcugggauuacaggaaugagccacugcaccagcauugagagaggcuaauucuuacugggagauugggaaaauauuugaagaauggauguauuuuuauaagguaguaaugaagagggaaagaaccuaggagguaaaaauaaucuagauguaaagauacagaaucagaagagugcaggagaacagcaggaauguggcuuauaagaggugaaggaaugaaagauaggcucucuguagguagguuggggcuauuguacguaggaggcuccugguucuaccaaaaauaaugacagaaaauuagcuggugcagaaaacuguggaacuggucguaaaguccuuaaugaaaaguagaauccuagaagucaggagaucauugcagagagauugguaaagucagauaugauagugcuucaaagaaauaaaguuggacaucagcacauuuagaaauuacauggagaggaagaagauuaacucacucauggugauuccaugagucaaagggauuaaagaaagaucuuucuuucccuuucagaggauuuaagguaagugaugcugucacauauauaauaaggcaaguagaguugauccuugaauaacauagggguuaggggcaccaacccccugugcaguugaaaaauuuguguauaauuuuaaacucgccaaaaacuuaacuaccaauagccugcuguugaguggaagccuuccugauaacauaaacaauagaauaacacauauuuuaauauuguuuuuacuauauucuaacaaaguaagcuagagaaaagaaaauguuauuaagaaaaccaaaaggaagagaaaauauacuuacuauuaaauagaaguggauuauuaugaaggucuucauucuugucauugucaaguugaguaggcagagguggaggaagcggagggauugaucuugcugucucaugggguggcagaggcagaggagguggcaggggaggcaggcacacucuuuguaacuuuuauugaaaaaaaucugcauauaaguggaccuguguacuucaagcccuuguuguucaagggucagacaaacauagaaagcauucaagaauaugagggaguuuguuuacagugaaccuuagugaguacagagagucugguacaguuaguagagaggauacuagaagggaucugguagagauagaaacaagcuagcuauagauuagcaugaagaguagauggaagacaggaucuguauuuaaggagcugauuauagguuuauaaagaugaaaaaagcauguggcaguagucuuaaaaaacuuuuaaugauggugauggaaaguggggaggagauagaggaagagggaaauggaggaaaugugaguauagaaugagaaccagcacccagauuaucuuugguacauugggguauuagauagcuuagauuaauuugugguaggaaccccccagaucucagugcauuacuacaacaaagguuuauuucucauuuguguuguccauuguuguuuggcuggggcuuugcucuacauccucuaccuucuaguacugaggccgaagggcuagucugggacauagccgagggaaaagagaaaauaguggagccacacaauagcuuuuaaagcuucugcugggaaguggcacguguaucuucuacauacauuccaggcugagcacgguggcucacaucuguaaucccaggacuuuaggaggccaaggcggaaggauugcuugagcccaggaguacuagaccagccugggcaacaaagugagaccuugucucuacaaagaaacuuaaaaaaggaauuagccaggugugguggcacauaccugugguccuagcuacgugggaggcugaaauugaggaucgcuugagcccaggaccucaaggcuucagucagccauaaccaugccacugcacuccagccugggugacagagugaguccccaucuuaaaaaacaaagacaaaaacaaaccuacacaugaccauggcuaaaccugguaucagugagugggagggagaagccuugggcggccgugcgauaaauguuuuuaaucgaauaauguuaucuccugcugugggauauuauacuaugaggaagccacaguucaaguguagggugcuuguugacaauuaauacagcauccuagccuuuugagcaggaaagagauaaguggaugagccacagcuaaauuuucaucuauguucaggcugcugcuguuggugcuggguuauguccagagaaaugaauaacuguguguaaaaggaaaugcgagaaguuuguucauaauucauuacuuaaccuauaauguuuauuacuugccuacuuucacuuacaauaaauuuucauaguuuaagagaaauuaucauuguuuagaaaacaacaaaauuuaguuuaacggggaacucucaauaccauuuagggagcuccuggcuuuuguauccuccaaauccucuaacccaguucuuuguacauaaguaaauuauuuuguuaauugaaugaaugaauguaucugugagguuuugcuguacauacguacaguaagauuuauauuaugucuagcacaaugccaugucuuuuggggaaauaugucucuuauuuuaaggacaugaagaguauaagcuaaagaacggaagacauguaucaacuaugggagauuuuuggguuacucucuaauggguuaagguuuauaauuuaugucugagauauaggccgauuuugguaauguuguguuucucugugcuaggaguuagauuuuuauuuuagucuaucucagauuccuucaucuguugcacugguaguaaaaagcagauaguacaaucuguguaugaaacaagaauugaaggagagagguagacuaaagcaggagaggagagcgagaaaagaaauaaaggaugaaaucaggaugacagagaaaaugagauuugauuaagguaaagacacaguuguuucaggaaacagcaugguuagugcaaguauuuuuuuaacugccccaaauaguugcugcauuuucuugauauauaucuauauauauauaauauauaaauauauaugauauauaucuauauauauaauauauaaauauauaugauauauaucuauauauaucauauauaaauauauaugauauauaucuauauauaucauauauaaauauauaugauauauaaauauauaugauauauaucuauauauaucauauauaaauauauaugauauauaaauauauaugauauauaucuauauauaucauauauaaauauauaugauauauaucuauauaucauauauaaauauauaugauauauaucuauauauaucauauauaaauauauaugauaucuaucuauauauaucauauauaaauauauaugauaucuaucuauauauaucauauauaaauauauaugauaucuaucuauauaucauauauaaauauaugauaucuaucuauauauaucauauauaaauauaugauaucuaucuauauaucauauauaaauacauaugauaucuaucuauauaucauauauaaauacauaugauaucuaucuauauaucauauauaaauacauaugauaucuaucuguaucauauauaaauacauaugauaucuguaucauauauaaauacauaugauaucuguaucauauauaaauacauaugauaucuguaucauauauaaauacauaugauaucuauauaucauauauaaauacauaugauaucuaucuauauaucauauauaaauacauaugauaucuaucuauauaucauauauaaauacauaugauaucuaucuauauaucauauauaaauacauaugauaucuaucuauauaucauauauaaauacaugauaucuaucuguaucauauauaaauacaugauaucuaucuguaucauauauaaauacauaugauaucuaucuguaucauauauaaauacauaugauaucuguaucauauauaaauacauaugauaucuguaucauauauaaauacauaugauaucuguaucauauauaaauacauaugauaucuguauauauaaauacauaugauaucuaucuguauauauaaauacauaugauaucuaucuguauaauauauaaauacauauaucuaucuguauaauauauaaauacaugauaucuaucuauauauaauauauaaauacauaugauauauaucuauauaauauauaaauacauaugauauauaucuauauaauauauacauuauauauaacauaaauauaaauauauauuuuuuuuaaaucaggucuccagauuaacagugaguuuuuuugucuuaacuuagguguauacucuugauguaccagaugcauucuauuacuguuauaguccagacccugguaaugcaaagggaaaagaugccauuauggaaacaauggcugaccagauaguuacagugugugccaccuuggaugaaaaucccggaguaagauauaaaagguaagacacugagcaucugcacauguuaugcuuccuauuuaccauucauuauagagguaaguaaugugucuguaccuuggcauguugguuugcaaaauuuauuuucuuuguaugauuaccaugcucuacauauaggagauuuaaagcuugugguuuaaauuucagacuagcaaauagcuucuguuacugaauuucggagccuaaauuugguacaauuuacggacgguuuuucaucaguuuaaagaacgcuuagaggaaaugucuuuauagucacauagggaauacaguguuacaguuaauguuuuucauuaaaucaccaacaaauuuaaaugaccauauucucuggauaccuguuacaaugucaaaguaucuauaguaucuaaucugccuauucuaaauaaauuuugggguuuucuuaagggguaaaauuuaacuuuaguacaauauaccuugacuuauauacuucuuuuuaaaaaugaaguuuacuauaaagugccuaaauugucuauacaguaaguccucacuuaaaauguuguugauagguucuuguuaacugacaaaaccaauuuuaccauaggcuaauugauauaaacaagaauuaaguuccuugguuauguaaugucaccaaacuucuacauaaagaccugaaacacuucgaauauuaaacauugaaagaaaugugacuauauguacauuuaagaaagauuaauaaaaacaggaucauuuuuuugcccaguuauucuaguucaggcucauuagaaggauggccagagcucaucccagcagcucauggcacaaggcaggaacccacccagauuauaggauaccaucccauugcagggcacacuacacacacauccacacucacucgacugggacaauuuagacaugccaguuaaccaaacaugcugcacaucuuugggaugugggaggaaaccagaguaccaggagaaaacccaugcagacguggagggaucaugcaaacgccacacagacaguggccucagccaggaaucuuuuuuuuuuccucugcauuauaucgagaugacgaacaaaaugacauuauuugaggacgugcuagauauggcauguuaauucauuccaaaaugaacauauccaucuaacccuaccaaggucaaaaaaauagaacauuaacagcaucucagaggccucucuugugaucccucccagcucucccgucccuuuucuucccuagagaugacuaccaucugacuuuuaacacauaguuaaauuuugcuugauuuugagcugguauaaauggaaccacaugauauuuuuuguuuuugacuucuuugcacaacauuauuuucugagagucauccauguuuguugugugugccaggcaguuuuaguuuuaauuuuggucugcuaguucaugugugacccucucgccucaguuuccuuaucuaugaaauaagaaugauaauaauaccuaccauauacaguuguuuuuagaauuaaaugaauuaauaucuguaaagcauucagcacuaauaaauaugguaguaaauauauugcacuacucguaauaaguauuacucauuugucuuuuaaaaaguccuuuaauuugaacauuggcauuugucaaguuagcuggcugaacuguuuaauuuuaaauucauguaguacuuuaagucacauuacucuucacuuaccauuuaaaaauuccacuauuaguacuuagaaaaaguauagugaucuccuuggagauuaaguuaucuccuuaauucagguauuaccagacaagcucuuuauucauaccuuggguauuagaaacauucuuuuucucucuuucuuuccuuuuuuuuuuuuuuuuuuuuugagaugggggucucuauguguugcccaggcuggucucaaacuccugggcucaagcaauccaccugccucugccucccaaagugcugggauuaucuuuuucuugucagagaugugcuaauuacauucuggacucaguggagcuaagugguuuggcuccuguuaaggguuuaguaacuguugaagcuucuacuguuggugauugguuacguucagggaaaugaguaaauauagccaauuuauaauuuuaucacucacauaagggcuaguuuugaguuaugcuaauaaauaaucuguaauccugucuuuuaaaauucuaccuguuuccacaaaauauuccuuuacgcuuuauaaaguauaauuuaaaaaugaaguuucuuucuuuugaaaauauaguacaaagaguuuaauuuauuguacaauuaauuuauuguacaauuuauuguacagaguuuaauuauuguacaaagaguugaauuacccuuuauagauguuacauuauuuauuuuuaagguauacaaccuaaagauucuguaaaacuuugaagcccucacaaugagaccucccauuuuugagguuguuaugcuggugaagagccuuuuucuuucucucucucuuuuuucuuaaauaauuuuuguggauacauaguagguguauauauuuaugggguacgugacacauuuugauacagacauacaaugcauaauagucacaucaggguaaacgggauaucuaucaccucaagcauuuauccuuucuuugugauaaaaacaauccaauuauacucuuaguuauuuuuaaauauacuguagucacccuguugugcuaucaaauacuagaucuuacucauucuaccuauauuuuuguacccauuacccauccccacuaaacagucacccaccacuccugccccuuuccagccucugguaaccaucuuucuacuuucugcaugagaauuguuuucauuuuuagcucccggaagcaagugagaacaugcgaaauguucuuucagugccuggcuuauuucgcuuaacauggugaccgccaguuccauccauguuguuguaaaugucaagauccauucuuuuuuauggcugaaacauuuguuucaguauuuguaauaguguaauaagaaugacucauauguccaucuuuagaggaaucgauacauagaauccaauauaaucaugauggaauacuguauaggagauaaaaugaauaaauccgauaugugugucaaugucaauguagauaaaucucaaacacacacacacacacacacacacacacacacauacauaugaaacagaaaugacuggagggagaauacacaugaaauuaauuauaaugguugccuugguuugaggcagggguaugggagaggaccaggacuuaggaguggaauaaaaggaacugcaacuuuacauguaauauuuuauuuccuuuauauuaaaaaaucugaagcagauaugauaagguuuuuccuuguaaauuccaaauauaucgauauaagauuauuugauacauuaucugaacuuuuacauguuuauaaaauaauuuuucauuuuguaaacauuuuuuaaauuucaguuuaauuuuagaauuaaacuucaugauauuauaaaguauacacugaaagaaagauaauuguuugauccuuuuuuccauuucuaguaaaccucuagauaaugccaguaagcuugcacagcuuguugaaaaaaagcuugaagacuacuacaagauugaugaaaagagccuaauaaagguaauguaugcaaggcaaguaaugacuaugcauaaagucugucuuauuucuuuauaagccaaagaaacuugcucauucauuuucuaguauugauuugggagucauuaacauagaucuccaauacugauuugagaaucauuaacauacacaaucgugcaaaccuuaauagaugguaugguuuagagggggaucuauuaacuaacagauuuugaagucagcacuguguccaaaucuaguucugccguuuaauucauaguuaaugucuauuugggcaaauuauguaacuucuauguaacuacauuuucuuuucuauaaaauggggauaauaaaagaauaccuauuuuaaaaguuaugauuaaaugaguuaauacauggaaaguccuuagaauaaugcuugccaauguguaaacauuuaauaaauguaggaauuccuauuaucacuaguucugugaccuugaguuuuccaucugugaaauagaugaaauaauauauaccuugcuaggcgguaugaggauuaaguuagcauguaaguauuuggcaccaaugugaauuuaauaaauggcagccauuguuauccuauggaaauaauauaaucaaagacuaagguugaaaucugggaaauaccagcauuuacaugugggugagagaaugaagagcuugaggagacugacagagguggugccagaggccuaggaagccauauuacaguagcuggagaaugaagaaaaggaacuguugcuaguuuagaagaggaguugugccaggaaaccaccaauuacaauacuguguaauaaguggaaugagagaagaauauacagaguauaaugggaauauagucccgggcuuaucuucuaaacuggaguguuggaaggcaucccaagaagaagaggcccuuuagcuugaagaaugaaguaacaugauaaagagggaguucauugcauggaaaacaggauucuucagguagaggcaauagagaaaaaggcaaaauccacaauuaaacaguguggcuggaauggaagauauaaacuuagauguuagguuaguuaccuuaaaaguaaccuguuuuugguuuagaggccuggugaaggcuguuauucugguuguaguuuugaagacagaauggcuuaguacacaucguagauagugaauaaauguuuguugaaugaagagauauacaaucaaauaugcuuuuaguccuucauguuuucaguggaaaaagagcaaaauccacaaaaauuaaacuuguccuuuccacucuuucugccuggaaaauuaaucauccuucaaauacuugauaccuuuccuuuauucagggacaccugauaaagugauaaagugucaccuuauuuuugaagccuuccuugacucuucaggccaaguguugcuuccucccacaugcuaucauaagcccuaagccugcuauagaauuuauauugcacuuuuuccuguuuauauuucugaagauucauagcucauauuuuugagggcuuacugugcuguguuucauaguaugauuauguuuaaccuuuucagucaucuuauaaggcaaagauuccauaauugugguucauuuuacaaagagaauacugccauguaaacaggauaagcauuuuguccaaacuuguacugcaagauguggucaaggcuggacucagauucagaccuagcugauuuccaaggcugugcucugaaccaccauaucauacugucucaaaauuuaauuaaauuaaugugcuuaauuuuaaaauauuuuaaaaaucuagccuauaaaauuuacuuguuauauguaaauaaauagaaaauguuuguauaaugaucuguaguuaucuguuauugcuuugaauacuaauccaaagaauuuauuacuuuuuaaaaugaaauaugaaagauacugacauuaacaauaaauguuuccagcacuguuauucacuguuuagugauuagugauguuugcgaauuaaugauaacaaggcuuucauugugauuuaucaucuuaguugguaucaguacagucuuuuaaaauagcauaauggauaagagcacagauguuggagcaaaccugcauuugaaucuccauucugccucuuacuaccugugugauuugggcaaguuaguucauuucagaccgcaaugcccucauggucaacuggagauaauaaugccugucucacaggauuacuaaaagaauuaaaugaaauaguccauguauuuuuguuuaguaaaaugucuaauauuuagagcucaaauaguagcuacuauucauaauuuaaguuuuagugcuuuuggaacucaauucauaagaaaauagauauagugcaaacaaaauguuacuuuuuuaaaaggaauuuucaagcuauuauacaguugucccuugguaaacacagaggaggguugguuccaggaccuccuguguauaccaaaauccacacauacucaaguccugcaucagcccaacagaaccuacauaucuggaaagucagcccuucauacacgcagguuucacauccugcaaauacuguauuuucuaucuguuauuuaguugaaaaaacucugaguauaagugcauccaugcaguucaaacccaaguuauuaaauauacccucuuacucuaauuacaaaaguaauuagauuuuaguuauauagucuucauuuuuccucucuugggcuacucagauuuuucuuuguuuuauuauaacuucacauucuuaagacaauuaaccauuuguuuuguucuguuguauguuuuugguggggaaaagggacagaacuuaggaaaagggugcuuuguauucuaagauauuaaaacuauguucacacuaagaaauugaagcugcuuaagaugauuuuaucuuguuauucuaggguaaaacucauucacagcucuuaauaauugaucguggcuuugauccuguguccacuguccugcaugaacugaccuuucaggcaauggcauaugaucuacuaccaauugagaaugauacauacaagcaaguauaacuugaagggcauauaaagggcauauacaaacaggauagaauaugagcauuuaaugauuuauauaggcaccagaaaucugaaagccccuauaaccuuuucuauucagagacuuuauccuucucuuauuccuacaguuauagucuuugacagauaauguugaccuuguaaauuaaaguguaauuugauugcuuuggagcauuuuugguguguuugcuuccuuaacuguguguacaguagagcuacauuuaaacacagggaauuuggcccuuuugcuuuuaaaaguaaauaccaggcucacuaucauugaaggagaaaccauauucaaaauuguuaggcuauaauuguucugaaucauacauucaaaaguguaugugucuuaucaacauaaaguauuuuaaaagauuggaacacuagaaaacuaaauaggauggcuauugaggacaacaggcauaguuuuaccauuuugguaccuucuacugaguuaaucuugguauaaacauauuuacuuuaaaaguaaugucaaauaaaaaccuaaaugaaaaaugaaauaguuuucuaucaaggaaucaucuuacuguaucucuguaucauuuaugguguauguguuacauacauuacaaauguuauuugaugucaugauuucugaauccaaacugguauuugucagcuaagauuuacugcuugaguacaguaauaaaaaugaaaauaguuuucugaaauuuuauguuuaaacuaauuuguuaguuuuaagauacagacacuugugauaguuaugauacuguuuuuuuucuuaaauauuguuaaaauuuguauuuucuauuguauuuuuauuugcauucuggucaaaucuugguuucugaguuuuucucuguauuaucuguauuaauguuagauaacauagcuauuuuucuaauauaaaaguuauuuuaagcaguuuauucagaggggauauuauuuaccucuguuacccuguaggucucuaaacuuuuaaguagacuuauuuuuuaaaaagcuacuauacucccuucuuucugaaucaaaaacauucagagauaagaauuagauggaaguaaagcucccugugguuugugcuccaucacaauuuuuuuuuuuuuuuuuuuuuuuuuuaguagaggcaggguuuccccauguuggccaggcuagucuugaacuccugaccucaggugaucccccugccucggccucccaaagugcugggauugcaggggugagccaccacgcccagccuucaucacaguuuuuuauggaaacagaauacaaagcagcaggaagcucuaaguguccagauucaaguuuucauguuggugccuucuuuaaauuuacuuuuuuuuuuuuuucuuuuuuugagacagagucuuacucugucacccaggcuggagugcaguggcgcgaucucugcucauugcagccuucguccccugaguucaaaugauucccagccucagccucccaaguaacugggacuacaagugugcaccacugcgccuggcucauuuuuguguuuuuaguagaaaugggguuuugcuguguuggccaggcuggucucgaacuccuggccucacaugauccacccaccucggccucccaacuaaauuuacuuuuaaaaugggauauucaucaccugaguauugucaggcuuguuacucuuaucucuguuuacagaucacuuauaagucaaagguauuguguaagaacaaagugguauuuuaaaugacaaaagggcuuucauccuuagugcagccuuauauaauugagcacagugauucugucuuuggucaucuguaauccacacagguggaugguuuuauagauugauguguaauuuguggggguuauagaaacgauuauauucauauagcaaagucuauauguauuauuuguaguucagagcuaggaaaacucaaugcaguccuuccugaucuugacucaggaaaucaguaguuccaaggaugauucagucuugucuaguuccacaaauggaaggagggugucugcauaaaaagauaaggggaaucagucaggaagcccauuuugaauagcuucaugaaucccuuaaauuguugcucacuucagcagaacucauuaaagcuaucacaauuuuuauggcuuacauuaauuuuuuuuaaucucauuuucuuucucauucuguaaaggagaugugguuauaggguugggggagaauaaagaaacagaugauaaauguuugugaauuuuguaccaauucugaaacaccuucaauauuuaauagguuauauuggggaggauauuccuguuuuguuuuguuugagucagagucuugugcugucacucaggcuggagugcaguggugcgaucucugcucacugcaaacucugccucccagguucaagugauucuccugccucagccuccagaguaacugggauuacaggugugugucaccacacccugcuaaguuuuuguauuuuuuuuuagagacaggguuucaccuuguuagccaggcugguuuugaacuccugaccucaagugauccgcccaccuuggccuccgaaagugcuaaaauuacaggcgugagccacugcaccuggccgauauuccuguucuuaauggaaauuugauaauuguacuguggguuauuagcacaucaaaacaauguuguagggaauuagaacacaaagcguuaguauauugagucuuguucuuaaaguuaacuguaggacguugaauuuuuuuuauaaaguacaauuuugcugaacuaaaacucuaauaauggcaccuaaacugaauauuugaaaaugucuugguaggcuuaggacuuauuuuuaauguaaggauagcagcgugccuuaguuuugaguagguauucauuaccccccuaaaauaguggauuuuacuuuucaguuucuugaguugugucuugaaauuauuguuuguaaaaauguuucuuuugauuuuggagggaaaaaaaucaaaaaguuuuagugcuucugucuacuuguagauauaaaacagauggaaaagaaaaggaggccauccuugaagaagaagaugaccucuggguuagaauucgacaucgacauauugcgguuguguuagaguaugugaacucauuuuaauuuuuguuccauaauuuuuagacacuaugugauaguacauuuuguaaccuuaaaauaguucuguaaagaauuacaucuuagaaauuuaaagaauucucucacaauuugacagggaaauucccaagcuuaugaaagaaauuucaucaacaaagaaagcaacagaaggaaagguaagagucuuacuuaacuuucaaaguaauagugaaggugaauuuuaaaguuuguuuaaaaucuuuauuuuauuucuguaacuuuuuauuuuuggaaaguucuaacauggagguagagaaugaacuccuacguacccauugccuaguuucaauaguuaacaacauuuuugucuguccugcuucauuaaaauuuuuuuauuuuauuuuauuuuuugagacauagucucacucugccaugcaggcuggagugcaguugcgccaucucagcucacugcagucuccgccucccaggcucaagugauuguuuugccucagcgggauuacuggugugcaccaccacaccugacuaauuuuuguauuuuuaguagugacaagguuuugccauguuggccaggcuggucucaaacuccuggccucaagugaucugcccacuuuggugcugggauuacaggugugagccacugugccuggccauaaaguuuauuuuaaggccauuuagucaauuuuaucaaugcauuguugggauuuuacauucagauauaauuuauaaguaaagcacacaaaucuuaaauuuauacuggauaacuuuuacuuauauauacccuugaaaccaccacuuuaaaucaagauacagaacauuuucaucauuccagaauauucccucuuguccuuucccugucaguaccccuccugccagagguaaacucuauucuaauuuucaucaccauagauuguguucuugaacuucacauaaugagauucaccuguguuacguauuuuaguaauucauuuuuuucauuuguguauaguaguaauaccauuauguaaauauacaacaauuuguucaucuugucuccuuuugauggacauuuaguuuguuuccaguuugggauuauuaugaacaaagcugcuauggauuuuuuuguacauguaauuugguggacauacacacucuuucucuuggguauauuaagaguaaaauuauuggguuauaggguaggauuguguuuagcuuuaauagguaaugccaaaaguuuugcaaaguguuucaacugauuuacauccccaucagcaauaauugagugcucuaguugcuccauauugccaccaacacuugauauauucuugucuuuauuuucaauuaaaauuucauugcacgagaugguaucuuauugugguuuuaauuucaauuucucuaauguucuugugcauauuggccauuaggauauucuguuuugugaagugcccauugaaggucuuuugcccauuuuuaauugaguugucuguuuuucuuauuucuagaaguuauuuucuggauaugaguccuauacauguauuuauguauguauguaucuuuugaugaacagaagaucucaauuuuaaugaaaucuaauuuaucaauuuauuucuuuuauacuuucucuguguccuuagaagucuuggcuuacccugaggucauuaauauauucuucuguuuucuucaguaaggcugaucauuuuagcuuuuacauuuaagucuguaauucacuauauuaguccauucucacacugccaugaauaaauagcugagacuggguaauuuauaaagaaaagagguuuaauugacucacaguuccacauggcuggggaggccucaggaaacuuaacaaucauggcagaagccaccaugucacagggagaaugagugccaagcaaagggguaagccccuuauaaaaccaucagauuuugugugaacgcacuaucacaagaauagcauggggcaaaccgcccccaugauucaguuaucucuaccugguccugcccuugacauguggagauuauuacaguucaaggugagauuuggguagggaaacagagccaaaccguaucauucugccccugguaccucccauaucucauguccucacauuucaaaacacaaucaugcccuuccaacaguccccuacagucuuaacucauuccagcauuaacccaaaaguccaaguccagaguuucaucugagauaaggcaagucccuucugccuaugagccuauaaaaucaaaaacaaguuaguuacuuccuagauacaauggagguacaggcauuggguaaauacaccuguuccaaaugggagaaauuggccauaacagaggggcuuacaggccccaugcagguccaaaauccaauagggcagucauuaaaucuuaaaguuccaaaaggaucuccuuugacuccgugucucacaucugggucauguugaugcaaaagguggguucccauggcccuaggcagcucugccccuguggcuuugcaggauauagccccucucccagcugcuuucaugggcugguguugaguguaugcagcuuuuccaggcacauguugcaagcuguugguggaucuacuauucugggaucuggaggauggugacccgcuucucacaguucacuaggcagugccccaguggcaacuauguguggagguuccaaccccacauuucccuucugcacuacccuagcagagguucuccaugagggcuccaucccugcagcgaacuccggccuggacauccagacauuucuauacauccucugaaaucuaagcagagguucccaaaccucaguucuugacuucuaugcacccuguaagcccaacaccacguguaagccaccagcuugcaccaucugaagcaaugaccugaguucuacuuuggccccuuuuagccacagcugggaugcaggguaccaaaucccaagaccacacaaagcggcaaggcucugagccugacccacgaaaccauuuuuuccuccuuggccucuggaccugugaugggaggggcuaccacgaaggucucugacaugcccuggagacauuuuccccguuguuuuggugauuaacauuuggcuccuuguuucuuaugcagauuucagcagccagcuugaauuucucccccgaaaauggguuuuucuaucauaucgucaggcugcagauuuuucaaacuuuuaugcucugucaccucuugaauaaaugacugcugagaaguuucuucugccagauaacccuaaaucaucucucuugagaucaaaguuccccagaucucuagggcaaggacaaaaugccacuaaucucugcuaaagcauagcaagagucaccuuugcucuaguucccaagaaguuuaucaucuccagcugauaccaccucagccuggauuugauuauccauaucacugucagcauuuuggccaaaaucacucaaguuucuaggaaguuccaaacuuucccacauuuuccugucuucuucugagcccuccaaacuguucaaccucugccuguuacccaguuccaaaguuucuuccacauuuucaggugucuucacaguagcaccccacuccugguaccaaaacuguauuaguccauucucacgcuuuuaugaagaaauaccugagacuggguaauuuauaaagagauucaguugacucacaguuccauauggcugcagaggccucaggaaacuuauagucauggugaaaggcaccucuucacaggguggcaggggagagaaagaaugccgagugaaggaggaagccccuuauaagaccaucggaucucaugagaacucacucacuaucacaagaacagcaugggggaaacugcccccauuauucaguuaucuccacuugguccugcccuugacgcguggggauuauuacaauucaaggugagauuuggguggagacacagagccaaaccaugccauucacucaaauuaauuuugauuuauggugugagguaagggucuagcuucauuuuauuucgauauacauaucugauuacucaagcacuguuuauuguaaagaccauccuuucaccauugaguugcaguaaugcauuuguugugaaucaagugaccauaaaugugugggucuguggacuccauguccuuuuccauggucaauuugucuauccuuguaacaagaccacacugucuuaacuaguguaccuuuguaaugguuuugaaauuugguaguauaagucuuccagcuuuguucuucaagauugucucagcuguuacaaccuuugucuuuuaauacacauuuuagauucugcuugacaauuucaacagaaacauuuaacugaaauuuugauugggauuacaugaaucuguacacuaauuugggaagaacugacaaaaauauugcaucuucugauccaagaacauagaauauagcuccacuuauguagauaguuuaucucagccgcauuuuauaauuuucauuuuagugguauugcacauuuuuucuuuauuucuagguauuugauuuuuugguguuauaaaugguauuuuuuaaauuccauuuuacuuuauuaguauauaaaaugugauugauuuuuguauauuuaccuuggaucuggugaccuugcuaaauuuauuuuuuaauucuaguacuuuguuuauagauuggcuuuuuuguuuuuaagagaucggaacucuguuggccaggcuagucucugaauucaagcaauccccccacccuugccucccuaguagcugggacuacaggcagguaccagugcaccuagcuggauuuuuauauacacaguaauauaaucugugaauaaagaaaauuuagugucuuccuuucuaaauuaaucuuccagagguguccaaaggagagaauacagucauggguucuuaguuucuguuucggcuaguaaagucccuuccuuaucccucuuuuccacuuaucacuagagacagaaacuaaaaaccauggcuucaggcugcaaaaagccuaaaacaaaacagaacaacaacaacaacaaaauaagguggguuagacaagcuugucauacguuuaaaauuuuuuuuuuuuaguaguuaauaccuccugguucuggcugauaccuccaguauaacaugaaaucaaacuggugauaaugagcguccuugucucauucccagcuuuaugggaaaugaguucaauauuucaucauuaaguauuauguuaguuuuagguaguuuucuuuuaucagauuaaggauguuccuuucuauucuuaguuuaccaacagguuuuuauguguuucuguuuuuuguuuuuuucuuuuuucuuuuuuuuaagagacagggucuuguucugucacccaggcuggagugcaguggugcagucucaacucacugcagccucaaccucuugggcucaaacgauccucccaccucaggcccccaagcagcuggaauuacaggugugcaccaccaugcccagcuaauuuuuguguguuuuuaauagagacagaauuucaccauauugcucaggcuggucucgaacuccugagcucagacaauccuccugccucagccucucgaaaugcugagauuacaggcgugagccaccacacccagccuguuucuguuuucuuuuaaucaggaaauuucgauguuggauuucaucaaaggcauuuugauauugucuuuuuuuccccuuuauucuguuaaugugaugaauuacauuuauugacuuacuaacauaaaaguaaccauuucuagaauaaacuccacuugaucaugaugcaucauccuuuuccucuaucacuggauuuuguuugcuaauauuuuguuguaggauauuugcuucuauauuuaugagaaauacuuuucuguaauaguccuuuuuuguaauguucuugucagguuuuagcagcaagauuuuuuuggucuuaugaaaugaauugugaugcacacuuugucauuccauucucugaaagaguuuguguaagauuguuacugcuuguucuauugcugcuugaaagaauucaccauugaagcaguucaggcauagagacuucuuuauggggaggucuuucguuauaauuaaugauaaguuauuuaauagauauagaacuauuuaguuuuuuacuuuuucuucauuaguuuugggauaucgcauuuuucagggaauuugucuauuauaucuaaauuuugaaauguccucuuauccuuucaauauguguagaaucuauaguuagauuuuauuuacuaaucuugcuauuguuaauuuguuuauuccccuauauauuauuaauauccccugcaguccgggcacgguggcucacgucuguaaucccagcacuuggggaggccaaggcagacggaucaccugaggucaggaguuugagaccagucuggccaacauggugaaacccugucucuacuaaaaaaaauacaaaaauuagccgagcuugauggugccuaccuguaucccagcuacucgggaagcugaggcaggagaauugcuugaaccugggagacggagguugcagugagccaagauagugccacugcacuucagccuggagaaaagagugagacuccauguaaaaaaaaauaaaauaaaauucacugcauauguuauuaauauuucaaagaaccaacauuugucuuuguugauuuucacucuugcauguuuuaucuuuaauuagcugauuuuuacucaguuuuauuuccuuccuucagcuuacuuuguuuuaaaugaagcuuguccaaccuguggcccaugggucacauacagcccaggacggcugugaauguggcccaacacaaauuuguaaacuuucuuaaaacauuaugagauguuuuugugauuuuuuuuuuaaccucaucagcuauuguuaguguauuuuauauguggcccaagacaguucuucuuccaguguggcccagggaagccaaaauaucggacaccccugguuuaaauuuuuucuucuagcuuccugaguuggaguuuuagaacauugauuuccaaccuuucuucuguucuauuguauauauuuuauaguuauuuacaucuucaaacuuagcugcaucccaggaguuuuggaauaacuuauuuucauuuaguucaaaacauuuucuaacccuuauuaugauuucuucuuugacccauguguuauauagggaauacguuuuuaaauuucaaagcauuugggaauuuucuaguuaucuuucuguuacugaguuguaauuuaauuauacaguggucagagaaugugcacuauaugacaucagucuuuuaaaauauguuaagacuugauuuauggggcugggcaugguggcucgugccuguaaucccagcacuuugaguggccaaggcaggcgaaucacauguggcuaggaguucaagaccagccuggccaacauggcgaaaccccaucucuacuaaaaauacaaaaauuagccaugugugauggcacacaccuguggcuccagcuacucaggaggcugggcaacagagugagacucugucucaaaaaaaaaaaaaaaaaaauugauuucugaccuagcauauauuaucauaagugcccuauguguacuugaaaggaauauaaauucuguaugugucaguuaaaucaagaugguuaaucauguucaaaucuucuauuucuuuucugauuuuuuuuuaccugcucugucaguuacuagaagugguauauuaaaaacucugaucaugacugugaauuaguuuguuuuucuuuaguccuuucaacuuuugaaguuauauuaacugauaaagcuauguuaaguucauuauacauuuaagauagcuaucuuucuguugaauuuggccuuuuaucaucauaaaaugucccuuuuauuacuugcaguauuucuugucuugaggucuacuuugauguuaauaccacuauaucuucuuucuuuuguuaguguuuacauaguauaucuuuucccauccuuuacuuucaacuaccugugucuugauauuuaaaaugugcuucuuaaaaagagcuuguaguugaauuuuguuuuuuuauccagcccaaaaaucuuuuaauuagaaugcuuguuuaguucauauauauuucauguaauuauugauauaguuaaauuuauaucuaguaucuuguuuucacuucauuuuuuauauucuauucuuuuccuucuuuaucaagucuuuuuuaaaaauaaauuccauuucaucuccaauauaaacauuuguguuuugccuuuaguccuuccuuuaguuauuauacuggaaauuuaaaaauguauucuuacccuaguuuaauaguauguccugaauaugucauguccugaauaauucaggaaucuuauaauaguuuaacuuuauccccuuucucuuuugugcaguuguuucauguauuuuacuucaauguauguuauaaacucaagauguuauuuuuuucagaaagaaaaacccaaaaaaauaaaagcaagauguuauuuuguuauaaacacucaguagacuuuuauuauuacccacauauuuauacauucugguacuguuuauuucuuacugcucuucaguuuuuccagcuggguuagauugaauucucccagcuuucuuuuugucugagggcaucuucguuuugcaauuuuuucuaagauacuuuugcuggauuuggaauucaaaguuggcaauuuuuuuccuuucagcaauuuaaagcuuucaauacaucaccuucuggcuaccauaauuucugcugaaaaaaggcagcuguuaaguauuauuguuuuccugaagauaaacuguguuuauuaauauuuucucuguaucuuugauuuuuuagcaauuugaccaugauaugccuuacuguaaugugguuugcuugcuauuuauccuccaugggguuugcugagcuucuugagucacuggguugauaacuuucauuauguuuguaaaauucuuggucauuaucuccucacaucuuccuuuugucccauccucucucuucucucuuucugggaccccagucaacauguuuuuuagaucucuugacuguauucuauaucucuugcauucuguuaccuuuuuuuuuuuaaccucuccgcauugcaacugaauguucucuauuaaccugacuuugaguccccuacuucugucuucuguuguauucagucugcuauuaaacccauucauuguauccuuuugaaaacugagguauaaagcaaaauuuccccuuuguaguauacaguucugugaguuuugacaaaugcacacucucauauaaccacuaccacaaucaagauagagaauaaugucaucaccccccaaaauguccucaugcccguuugcagauaaccccuuaacucaguccccauccccugacaacuacuaaucuguuuucugacccuguaguuuugccuuuuccagaauguccaaugaauggaguaauacacuauggcucuuuucauuuagcauaaugcauuugagauucauucaugcugcaugcaagaguaguuucauuacuuuuuauugcugaguaguauuccaucauauggauguaccacaaguuguuuaucaauuuaccaguuucagaacauuuuaguuuuuccaguuguuggcaauuaugaauaaagcuacuaaaaauauucaccuucuucauaucagacauucaugucuaugaacagauguuaucauuugcuaacuuaaagucuuauauuuaacucuaggacauucauuggauuuuuagaaaauaaauucuaguucucuguuaaaauacuccaucuuuugauccauguaguccaucuuuuccucuguuuccacuuuaacauaaauguguuacuuugaagucuuuuucugccaacaacaucuuaggucuacuuuuugggaguuucuuuguuuuuacauuuugagguguucuuuucuuagcuuuuuuauugaugcauaguaacuguacauauuuaugaggcauguaauauguuuauacgugcauacaguguguaaugaucaaaucauuguauuuagaauacccaucaccuugaacauuuauuauuucuuuguguuggggacauuuccaaucuuuuccucuagcuauuuugaaauacaaaauauauguuaacuauagccaucauugugauaucaaacacuagaacuuauuccuuaucuugggucuacuuuuauugacuguuuugucacuugaguaucaaucacuuuccuguuucaccuauuaauguuuuauugugcuagacaugguggaugauacauugcagagguucuagaugaugcugucucuacacagaauguugaguuuuguucuggcaggcaguuaaguugcugaggaauaaucgugauucuguuguaacuucauguuagacaauguuaugguaaauuuauuucacuuuugcacugaguccuaaggcauagucccaggacugaauguguaggauguucacuuaggucucuuuacuuugucuagaucaggagaugcuaguauauucuuagcacuaagaccccucugaaaucuuguccaacauuuagccacccagaaguuguucuuuacuacaccuuugaggguuaugcccuguacaugugcagcuuagggguucaaggacaaucucuuuacacauuuuuggguuauguucugucuagcuccuuucuuuuuagcacucugcuucccaaaaucuaccucacagccccaagcucuuaucuccauuuuuuuuuuuuuuuuuuuuuuuuuugcacccagggagauaauugcucucuacuugaacuguauuuccuuucagugguguuuggaaaacaucuuuagggaaaggaagggugcgugcagggaucaccuuuggugcuuuccuucacucagcugucucagcugugagcuauuuuuauccauuacuugaaagcuauuguuuuauuuauuuguccaaucuuauuuauuuaugaagggagaguaauguugauaucagcuacguuauugugagugaaacuggaagccuccuaaauucuucuuucaaaaaaauugucaaauauucaguaaauuaacuagauuugauaauuuguaaaacucuaggauuucaaaguuguaauauggaauaacugaaucauaggcuugccuaaaaaaauguuugauuuuuccuagacaucacuuagugcucuuacccagcugaugaaaaagaugccccauuuccgaaaacagauuacuaagguaagcaguauuguauaugagauaccugauuaguuuuaguuuauauucaguuuauauucaguucuguaguucgauuuagcaguggguuucguggaauacuugguguuauuuguccucuaaaaccuuacuauaggucugagagauaucccauauaucuaagcuucuucauaacuucucuauauguauaaccuagauuuaucugaauccagcuuaaaguuucuauaucuuugucuugaauagccuaacagagucacauuuaucaaccuuacaagaaauucagcacuagauugacuaguggauguuauucuacauguuucuuuaaaguaauaguuacuuacuaguagauuuaagagcauuuaagcuguuuagucagguaaacuauuuuuuugcuccuuaaaaacacuaucagaauaaucuuaacauuuuugucauguugcacccuagucaaccaaugauuuuuguguguguuaaaauacuugaaacauuuagaaagauaaauagaauaugaacuugaagaacuucuggguauuuuucucauguuauuuuucauuacugucaaacucaacacaaauucaacaauucaaugcuuccaucccauuuaugcugucuguugauugccuccuguuguauuagucuguucucacauugcuguaaggaaauacccaggacuggguaauuuauaaaggaaagcggucuaauugacucacagaucuacauggcugggaaggccuuaggaaacuuacagucauggcagaaagcaaaggggaagccaggcaccuucuucacaaagcuacaggagggagaaguacaagcagggcacaugccagacacuuguaaaaccaucagaucucaugagaacucacuuacuauuaugagaacagcauggggaaaaucacucccaucaucccauguuccaaacacuucccaucaggucccucccacaacacauggggauuaugggaacuacaagaugagauuuagguggggacauagccaaaccauuucaccuguaaaucaccuucucauuuacuuccuuucuugagcuguucccuugcuuacauguuaccuucuuucaccucagcccauacuuucuuucaggccugucucaaaaguuuaauauuaccaguugcacaaaagucauuaaaauccuuuaaaugauugauuucuucuguuuuucagcaaguuguccaucuuaacuuagcagaagauugcaugaauaaguucaagcuuaauauagaaaagcucugcaaaacugaacagguaugugcagagucagaaaugccucuguucauaacaaauuucaaggauaaacuuuguaaguuaaaaccuaacuuuuugcuugauacagugguugguuuuuacagaaucacagacucucucuuaucaggggagccaccuaggcaguauuuaaugucauuccccgcuaacauuaacaaguagcuguagaguaucuuaguaaacagucccuccuaauauauuauauauuuuuuguuuaauggaaugauuuaaauuuugggagcaugauuucaggguggcauuauuggcaggaccuucucaguacgggauuuaauauagcauccagcagagcucauuuuacaaggggccuuuuauaucaugccucaacuguuuagaccauugccccucauagaauacaagcugcauguaauuuuaauuauucuaauagccauguuaaugcagguaaaaauuaaaaagugcaauuaauuuuacgaauaaguugggugcaguggugugugcuuauagucccagcuauucaggaggcugaggugggaggauugcuugaucccaggaguuugagggcagccugggcaagacccugucucuuuaaaaaaaaaaaagaaaaaaaaaacuuugacaaccugauguauucaaaauauuauuucaacauauaaucaguauaaaaaguuauuaauuagauaauuuugcauuguauuacuucaagucuccugguguuuuguaccuacagcacaucuuaauucagacugaucccauuucaaguguucaguagucauauguggcuaguggccacaguacuggauagcauagguuuagauuaaugauuuuuaucuucucugauuuauuuuuugaccuuuuguauuuuguauaaacaauaguuuacaagugauguucauauuuucuuguguaaugucaucaguguuccauuaaaauuugacaagauuuaauaauagauuuuguguguuuguuuuuuguuuuuuugagacggaguuucgcucuuguugcccaggcuagagugcaauggcccaaucauggcucacugcaaccucugcccaccggguucaagugagucuccugccucagccucccgaguagcugggauuauaggcaccugccaccacgcccggcuaauuuuuuguauuuuuaguacagaugggguuuuaccauguuggccaggcuagucuccaacuccugaccucaggugaucugccuuggccucccaaagugcugggauuacaggcgugagccacuguacccagccaauaauagauguuuuuaacuaaaaaaugaauuuugguuauagaucacugacaauauuuuauuuucauuaaggaccuggcacuuggaacugaugcagaaggacagaaggugaaagauuccaugcgaguacuccuuccaguucuacucaacaaaaaucaugauaauugugauaaaauaagagcaauucuacuuuauaucuucaguauuaaugguaauggagauaaucacuuuuuaauaaguauuuuacuauugaucauaaaagaaucuuugaaaacugaaagauaguugcugaacuugguuaagauaaaagggaaaauaugaaaucgagagaagacugaaggagauauaauuugacuguuuuuuauuuuaaaagcuucauucauggguacuaccuaaagccuugaaauuauuuugguagcaauugugugauugugcacucauauuuuuaccuauuuaaggaacuacggaagaaaauuuggacagguugauccagaauguaaagauagaaaaugagagugacaugauucguaacuggaguuaccuugguguucccauuguuccccaaguaagaagucuuauguuguguauauacuuuauauguauguguauguaugguuguauguauuaacuguuuuuuuuuuuuauguggacagucuucuuaaguucacucuauagauuuugaauaaguaagcaauuaaagauuuuguucucuuuuccauauguaauuugggcaaaugcaguuuucuagcgaauuuguauuuuauggcuucugucauaauucacuacuuacauuuuugucuuuaugauucauuuauaacaauugucauauuuuaguuaaacguguaaccuuuaacuauaauauggcagagaaaauaaguauauauuuucuugauuaaaaaaauuuaggcucgcuggguaugguggcucacaccuguaaucccaacacucugggagacgcugaggcaggaggauuucuugagcccaggaguucgagaccagccugggcaucauaguaagaccucgccucuacaaaaaacaaaaaaauaaccagguguguugguguguaccuguagucccagcuacucaggaggcugaggaucucauaagcucaggaggucaaggcugcagugggccaaaaucacaccacuguacuccagcacaaagugagacucugucucaaaaaaaaaaacaaaaaaaaaaggcucaaagucaaauuuugaagagcucuauuuagaaucucacucuuucccaucuuuuuuuuuuuuuuuugagacagaggcucucucuguagcacaggcuggagugcaguggcaugaccucggcucacggcaaccucugccucccagguucaagcaacuuuccugccucagccucccaucugggauuacaggcgccugccauccgcccagcuaauuuuuguauuuuuaguagagacaggguuucacucugucggccaggcugcucucaaacuccugaccucaggugaucugcccgccucagccucccaaaguucugggauuacaggugugagccacugcaucuggccccaucaaguuuuuuuguguguauguguguguguguguuuuuuuuuugagacguagucucacucugucacccaggcuggagugcaguggcucgaucucggcucacugcaagcucugccuccuggguuuaugccauucuccugccucagccucccuaguagcugggacuacagccaucaaguuuuauaauacuuuuauuuuaauagacauauguucugauaugauuauaaauaaauuuuagcauuaaagcacaaaauacuguucaguggaguuaugcgaccacacucagauuuuuuaaaauaggcaucuccacucuuaguuuuaagucaaauacaauauaguauuuacugguaaauuaaauaucuucguuaggaaacguaagaguauuauauuugaauagaauuacugguuuuuaauuuuuuuccucuaauuguauuagucucaacaaggcaaaccguuaagaaaggaucggucugcagaagaaacuuuucagcucucucgguggacaccuuuuaucaaagauauuauggagguaaaaaucauuaaaauguuuuuuucuaccugagugcccucuuuagaguauucuuuacuuuuuguaguuuaugucagucugaguauauguauugggcaggaaguuucugcagugguuggaggcuucacaaaaaagccuguaucugggaaacucuugaagauucuucuucuuuuuuuuuuuuuuuuuuuuucuuuuugagacagagugucacucuaucacccaggcuggagugcaguggcacagucuuggcucacugcaaccuucgccucccagguuccagcaauucucuugccucagccucccgaguagcugggacuacaggcacacgccaccaugccuggcuaauuuuuguauuuuuaguggagacaggguuucacuauguuggccaggcuggucucgaacuccugaccucaugauccacccaccuuggccucccaaagugcugggauuacaggugugagccacugcgcccggcugaagauucuuuucuuaaagaccucagacaaacucacaccacugacuguuucaaaaaaaauaaaauaaacacauauaugcuuuauaaaaaauacugcuuuguuuuaauaacuguauguggcaaaauauaauuuauuugaaugaaaguucaacaaaauaacauuuguauguggaccacuauuaaaaaguauuagaugccaauauucuuggaaauguuuuuggauuaaaauguaaacuucauuauaguuugcugucagaugaaucaugccuuuaauacuguuuacacuuagagaacauuauucaauuauaggaaauuauaaaaugagcuaauuuuaaaauuaugagcuuaauaaaaucaugacacugauucuucggucaugaucauauaguuuuuauuccccuuuuccuuugacuuaaaccccaguuuauacuuucuuuggggagcuaauuugguacagugcauaacuaugauuucucuguuuugcuuggcuaauuuuauguuauucacacaugcuuaaacauauaugaaaaaucuaaagaauuuagacuuuguuuucucuaacauaagaauuuuuuuuccuuucucacagggaugauauagaacuaaguaguuucuuauggcuaguuuuuuguuuuuuuguuuuuaaacauauuccuaaucaguuuaccauggcuaguauuuguaaaauaagaaaugacuuucuugaaccccuuaacaaagauuugcauguuaaauucagaaaauacacauuuggauccaugacagucuuaggccuuuagaauuucuccugaaacuugauuuccucccuucuugcagucuuacugaaauauucuuggacuacugaguacuuugugcccaauccaugugcccacuuguuaauacuacuuguacuaccaugccguaaagcaguggucuccauacuuuucaguucaugcacaccuaaccauaaaaaaaaugugagcaugaaccuauuuacuuauaaguuaagcauuacuguaauaaaaaauauauaaucuauguauacaguauauuuauauacauacauauaucauaaaaucuaacauugaaaaaagggaaaauuuuaaagaauaaaaugaaaaggaaaacuucccauaucccauugaauugucuugaguaccccuaggccauagcaguaguagcuaugaagggcaaagcuuuagaagugugucacgacuggaauaaugauuagagacccccggcaccauagaacuaaaggcucugauaaggugccuggaauccuuauaacagcauggggacccuccaaaugaagaaagggagucaugcagcaaauauugguguaauaaguaaaugauuucacugauuuuugaaggaaauaagguuugugaguuucaaagaaaagacuaaucuuauacuaaauauuuaugucuaagguuccucaauugcaaaugcaaguuuugaccuuuaugccaaacaaaguccugcaauuuacaauuuuauugauggaauuaacucuuuccuuccuuaggaugcuauugauaauagauuagauucaaaagaauggccauauuguucccaguguccagcaguauggaaugguucaggagcuguaagguaaauucuacaagugaaaaucaaugaaauuuucauucuacggacuaauaauuuaaaaugguacacagauacucauauuuggcaacuuucuuucaaguauauaauccuguauuuuuucuuuaacuguaacuuguuuuaaaugaauccagauaagcaauaugaaaauguacuuuauuauaaaaaauauuuucaugaaacaagaaguauuuccuuccccaccuccucuuccuucacauagcagagaccuuaauccuuuuugauaauuauuuuuguguugagguacuuuaaacauuuaaaaagauacagagaauguuacaaugcauacccuuaugcccagugcccagcuuauuaacuaaaucauuauaauucaagcuuccuguauaucacacuaugguuuuauuauuuucccuuauuuucuguccugaauuugguguuuauugccuguaugucuuuauacuuuuucuacauauguuuguauccuaaacagugucuugaguuauaucuugcaggauuuccucuugaucuuuggcuuucagccuuuaacuguguugugucuagguauaguucucuuuguguuuauucuaccugaggauuguugaguuucuuaaaucugcaaguuaauaauuuucaucaaauuugggaaguuuucaggcauuauuuuuuucaaauauuuuucugcuccuuucucucuccuuccuuucuuucugaaacuccuguuacacauaaguuggaggguuugacauuguccugugaguuacugaggcucuuuucuuucaucuuuuuaaaauuuguuauuguacuuucacauguagaauuuccauuugauuuuuuuaaauuuccauuucugacuguugagauucccuguuguuaacuuguuaccauauuuuucuuuuuaauucuuuugaucauauuuauaauugcuuggaagucccuaacaucugagucuacucaggguuaauuccuacugaauguuuuuuuuucccccaaguaugagucacacauuccuguuucuuuguauaucuacuaauuuuugguugaaaauuggaccuuuuagauaauguauuauagcaacuccaaauuguuuuaguaauuuguguggacuuugaacuauggaaucuuucucucuugcucucuuguagccacugauguccuuguugaguuuuuaaaauuuuuuaauuuuuuaucuuagcuucuagugguugccccuaugucuguguaguuuagaggucagucaguuaucuguucagacacuucaagccuguauggcuuccauccucuacugaucaagcugaguguggguuagggguugcauuccaaaauaggcaguucuuaagucucccuccuuuuuuuaauuuuuuuuuuuuuuuuaaauagaggcaaggccucucucuguugcccacacuggagugcaggagugcaguggcaugaucguagcuuacuauaaacucaaacgcaugggcucaggugagccucccaccucagccucccagguagcuaagguuccagguauaugccaccacacccagcuaauuuuuaaaugucuuguagagacagggucucacuauguugcccaggcuggucuugaacuccugggcucaagcgaucuuccugccucagccucccaaagcacugggauuauagaugugagacacugcagccagcccuuuuuucccucauuuuuuuuccuggacuuucucagguuuuccccacacaugcauaguuuagcagucaacuaaugauguguagagagcuuaucuuuucuuucuuuggcuucuuuacuucugggauuuccuuauuaaauuucuaccuggccgggugcgguggcucaugccuguaaucccagcacuuugggaggccgaggcgggcagaucacuugaggucaggaguucgagaccagccugaucaacauagugaaaccccaucucuacuaaaaauacaaaaauuagccgggcaugguggcacacuccuguaaucccagcuauucaggaggcugaggcaggagaaucgcuugaaccugggagguggagguugcagugagccaagaucaugccacugcacuccagccuaggugacagagcaagacuccaccucaaauuaauuaauuaauuaauuuauuuauuuguaccugauuggcugcccauccuaaguugagaccacaccuagcaaagcugcaggauuuuguacucgccucacugccccaccuugaaucaagucuuccaccaaugcaguaaagcuauaacuuuuaucugacugagcugggagagcagugaggguuagaugcagcccaggcuagaagguuacauauucaccaccaccguucuuaccagauauguuagcagauauucaagauuaaaugcuucucaauuuguugucugccuaugguuuccaguuaaccugaaauguuuuguuuuguuuuccccacaauuucauccaggaauauacuuguuuucuuagaggggaaucuccugaccaccuuauucugccaugaccacaagugcucucuaucuuauguuuuuaaacuuaauauagugucauauuguguguccuccugcagccugcuuuuuuguuucugucacauuauguuugugaaauuuaucccagacugauacaugcauaaauuuucacugcuaguugguauauaguuauaugaguauagcaacuuauucaucuguuuuccacaugauagaaauuuaggcuaucucaaaacuggcauuauuacaaacaguaugcagugagcauucuuguacuuuuacguauaucuggauagggugcuucccuuggacugaggacuuuucuuuacuuuuguuuuauuuuuuccuuuucuacaaaagguuuggagguuauguuaucuauuuuuauucuuguagcaguuuauuacuaagcauauuugacucaacaaagucgaagauuaauuaguaucucugcccuccucuugaacaauacaagaaccuuagaccaacuggauguaaaccaugcaccccuuaaauguuauaauacuucauuuguguucacuuuguaucuuuuuuaccccccauauuacuaagcagcauuauugguuuuuuaaaauucaguuguaugugcaugugaaccuguuaaaucgcccaccaccccuuucgugugggcucaguuucuuucuuucugaaguguauccuuugaugcgggucuguuggugguagucuuuuuuauuuuuuauuuuuuuccaagacagagucuugcucugucauccaggccgcagugcaguggcacgaucucggcucacuacaaccugugccucccggacucaagcaguccucgugucucagccuccugacuagcugggauuacagaugugcaccaccacacccugcugauuuuuguauuuuuagcagagacaggguuucaccauguuguccaggcuggucucaaacuccugaccuuugaucuacgcaccucggccucccaaagugcugggauuacaggugugcgccacuacgccuggccagcggugguagucuuuacaguuuuauccguuucuucauuuggucguuguucuuagccagcuaugaauuucuaagagcugaguuauguucagucaacacuuguagaaaauauucugcuguuuccaggguucuacuuuagcucuugggaagguggaggggguuguguuuucugucagucuuguaccuuuguaaauaauuaaccuuuuuucucugguuguuuuuuguccucgguucuguauauucucugugcuauguguaucugaggauuuauuuuuauuucuuucuuuggaauucauuuauguuuccugaaucugaggauuuacaucuuucauaaauucuucaaauauugccacuucuguagucuugguuuuguuagaacaucuuauucugucauaaugucucuuaauuucuuaaacuuuuuuguuucuucugcugguguuucauucuagaaauuuuucuucagauuuaguuuucaguucuuuaggucucucuuacacugugucucaucugcuguauaagcuguuuuuucuuuuucuauuuucagugacuuuauuuuucuguuuuagaaguucucauguuucuuuuuuaaacaugcuuggacuuuuuguuauuucuuauuuugucauacucucuauccuccuuuauugucuauugucauuuuaaacauaccuaauuuguagucuauaucuaauaaauucacuaauuuauacucuuuggguucaauucuguugccuuuuauuucugcagacucauaguuacuuauuucaguaugugucuuguaauuuugaaugcugaguuuauuucaguagccagcauugagaacgcaucccuucaggcagguuuugcaugugcuuuugccagauuagagguuuuuucuuuuuuguauuaaugucucaguuugggguuccucagaccaugaagguaguaugauuaauaccuaagacucugugagacaggccuguggcuaaauuaucagaggagaagcuuccuugcaucuccccuugccuuugagguuguccugaccuuaugcagggugucagcucccaaucuguaccuugcacaguacccagggcucggccccuuguuugcuaacaucagaaaauacuccacaaggcagaccaagccucaacucaguuuaccauucuaguauuuagcuuccuuuuuaccaauagcccuggagauuucucugacuuguuuacucucagcuaugcuuuaaaaacauguuuccucuuaaucagugcuccuuggugcuauuuagagggaaguuuucaggaucuagggauuuaauuaucuuuauaucucucagucuucacaugugugugaaacaaauuaaauauaaucccguuacucuaaaauugcuauucagaagcuuagaaauuguuagaauuguuuugagcaguguugucuccuuuucuuuugccuucuuacucuauuucucucuguugaaacaguucuuaagccaaaguuauuaauacguccuugacuuugggaacaagagugggucuuguuccuguuucaucuuucaaaaggaaaggaaauuuuuaauuuuaguuuuuaaaauuuguuuccuguuguucacugccucauucuuuaagguaaugaauggaagcaaucaucugaaaggcuagauucagauuuuuuuuuuuuuuuuuuuuuuugagacggagucucgcucugucacccaggcuagaguccaguggugugaucuuggcucacugcaaccuccaccucccagguucaagcgauucuucugccucaguuuccugaguaacugggacuacaggcaugcgccaccaugcccagcuaauuuuuguauuuuuaguagagaggggguuucaccauguuggccagaauggucucgaucucuugacuucaugauccgcccaccucggccucccgaagugcugggauuacagacgugagccaccacgcccagccaagaacauuauuaaaaguuugcuauggggcugggugccguggugcaccccuguaaguccaccuacuugaggcugaggugggaggauugcuugagccuaagaguucgaggcuguagugcccugugaugaugcugguccgcagcugcugcacuguagccuaggcaacauagcaagaccccaucucuaacaaaacaaaaauuugcuaugagauccuauacugcaaggcauucuaggucauccagaacaguggcucucaaaguagguaacaaaaugaacaauuggguacuuauuuuuaccuaaaaaagaagaaauuaaguuuuacuaauauauacuaguacacauaugucauuuacacauuaauauauuuguuuauaaaugaauguuuauuuugaaauauuuacuuuucaaauaaaagcuaaaaauuuuuaccaguggagcuugugaacaaaaaaaguaauuccuaugcucuagagcagugcuagccaauagaacuuucugcagugauagaaagguucuauauuggcacuguccaguaugacagccacuagcuacauguggcuuuuggguacuggauauguggcuaaguauggaugaagaacugaauuucuuauuucauuuaauuucaacuaauuuaaauuuaaauagccucauguggcuaguggcuacuauaugggauucuggggaucuagagcaaucuggaggaggaaugguaaaaguaaugacuacuauuuauugaguacuuacccaacaccagauucuguacuuaguguguucuguacauuguuucauuucauccuuguaacagccuuugagguuuagagagaaguuaaguaauuuucugaaagucauacugaaucaaaaacaagcagaauaaaaaucgaaacacaggucuaauucuuaacagccaaccuccuaccaucguagguuccugaauuccauuccaucaaggaacaaccuaauacuauaucagcuccaaaguauuacuugccccuuuccccuucacaucuucaaaaccuuuuucagugccacucucuaauuuuuuuuuaauuucaagaagcugcagacuucucagguauauuauuucuucuuaugaaauaauaagggagguuguuagcucuacucuauauguuaaaaugccaagccagauuaugcaugauuuguuagaauuguuuuugaaauguggcuguccugcuuaagucuugguuagucauacuaugguuaagucauuuccuuaaaaaucaauguaauugggccgggcgcgguggcuuaugccuguuaucccagcacuuugggaggccaagguaggcagaucacgaggucaggaguucaagaccagcguggccaacauggugaaacccugucucuacuaaaaauacaaaaauuagcugggcaugguggcacaugccuguaauccuagcuacucgggaggcugaaacaggagaauugcuugaacugugacccaggaggcggagguugcagugaaccaagaucgcuccacugcaguccagccugggcuacaaagugagacuccaccucaaaaaaaaaaaaaaaaaaaaaaaaucaauguaauugguagcaaguuugaguuugguugaguuaggcuuuuuaagucuacaagcauuauggcuuuggaaauguuuauaacauguuuacuuuuuuuuuuuuaaauuacuuuuuagugcucgccagaaacccagagcuaauuauuuagaagaccgaaaaaaugggucaaagcugauuguuuuuguaauuggagggaucacauacucugaagugcguugugcuuaugaaguuucucaggcacauaaauccugugaaguuauuauugguaagacuuucauuuucuucuuuucuguuuuuuuuuuuuuuuuugagacuaagucucggucuugucccccaggcuggaguggaauggcgcaaucuuggcucaccgcaaccuccgccucccagguucaagcgauucuucugccucagccuccugaauagcuggaauuacaggugucugccaccacgccuggcuaauuuuuguauuuuuaguagagacaggguuucaccauguuggccaggcuggucucaaacuccugaccuuaggugauccgcccgccucggccucccaaagugcugggauuacagacaugagccaccgcacccagccuucuuuucuguuuuuaaacaaacucuaaaugcaaaaguauacauguaaaauguuaucuuguguuauacauuugagacaaaauuuaaugcaaaaaaauuguuaaccauagaauguguuuugucugaugugcuggaguuuuuuccuaguugacuuuuugauaguuuuauuuuaaaaugugcuuauuugaggaaaaggagcuugcuccuuuaaaauaguauguucuguacguuuguuuaaccauuaaauaguuuuugaggcacaaauacauuucuacuucaaaaauauuuugaauuuuuuguggauauggacaugacauuggcaaggccuguguggaauuaaguuuuaagaauuucaggccaggcuaguggcucaggccuguaauuccagcacuuugggaggccaaagcagaagggucacuugaggccaggaguuugaaaccagccugggcaauaaagcaaaacuccgucucuacaaaaaauuaaaaaauaagaauuucagucaaagccaaugauagguaaacucuccugacccauggaggcgauggaucuguguguuaagccuugaccugcagcacugcuuaguggaucucuauuauugaacaauaacuguuauagugcugaggauaggauaaucccguuuugcccuucauuauaccaacguauagcacaaaguagacaaagcacuaggaauggccgcuguuucugaaaaguuacugaacaugcucaguggugaagaaggauugaaauauugcagcauaggcagauuucaggaagaugucuuacagaaauuuuguuacauuaccccaggcuacugcacuuuacauauuugaaggacaacacauuauauuaagcgaaggaaaauugauuuaacugcuggccucugaaaaauucucuuuucuccuaccagguucuacacauguuuuaacacccaaaaagcuguuggaugauauaaagaugcugaauaaacccaaggauaaagucuccuuaauuaaagaugaauagcauuucuuuuuggaggguuuagagauucuuacuaauauguugaacuaaaauagaaagaaaauguugcugucauguaauuuaaacaauguaaauauuuuauggaauaauggcuuuucaaauacauuucuuaaggaacuguuuaugauuauuacuggauuugucauuuuugauaauuuaaauauugcugcugcuuuguagaugaugagaagaaauguuaaagugcuuucuaaaaggaaauuuuuucaccuuuggaggagaauauauuagaguuguggguaauuuuucacagccaccuauguacauacuaauuacccauuggauacuuauaucuaaaagucucaugcugaaguauaguuuuugggaaagaaugauuuuaaauaaagagauuguaaaaguaaaaaacuguaaauguauauguaugauagaauuguuuccucuaaguguaguuuuucuuucaacuaaaauucaguuuauguguaaaauaauucagucauuaauagaaauggagugauuucacaguguguacuguuuugccacauacuucuaaagaacacaauuuuauauaauuuugaaaucauguauguuuaaauuagaaaaccaaaaaucaugaacauucuaagagaaaauaaauauagaauuuaaaaaauua

SEQ ID NO: 191332 - RNA, 26612 nt, Homo sapiens
uuccauuugaaagacacucauuuauuuguuaauaacacaagccaaacaaaaacauaucuggggaugaaucugcgaaaccuacuaggguuaaaauuuuacuucucuuaauuguuuggcuuccaaaacauauuuggcuuccaaaacagauucaaauucaaaaaauauuuacgaccagcugugguggcucaugccuguaaucccagcacuuugggaggccaaggugggcggaucacgaggucaggagauggagaccauccuagccaacauggugaaaccccgucucuacuaaaaaugcaaaaauuaucuggguauggugguacgugccuggagucccagcuacucgggaggcugaggcuggagaaucacuucaaccuggaaggcggagguugcagugagcugagauugugccacugcacuccaacuuggugacagagugagacucugucucaaaaaaaaugaauaaauaaaauaaaaaauaaauauguacaaagugcccacuagguagaagguauauaucauuagaaugagacaaugccuauuaaauguuauuguugccgggugcacuggcucacgccuguaaucccaccacuuugggaggccgaggcgggcagaucacgaggucaggaguucgaaaccagccugaccaauauggugaaacccugucucuacuaaaaauacaaaaauuagcugggcauggugguguaauaccaacuacucaggaagcugaggcaguagaauugcuugaacccgggaggcagagguugcagugagccaagaucacaccacagcaccccagccugggugacagaacgagacugucucaaaaaaaaaaaaaaaaaaggaaaauguuauuguugucacaacaaguacauuugcauaaaguugccucauuauacuugagaugugauuucagcaaagauuagaauuauacccaaauuacagaucaaaucuauaucccugauuuaauuaauuacauaaaaaagaaaaauguauuuacuucagguguaaagaauauuuuauuucaauacuucaauauugaaaucagcuaucacacauauccaccaacugauauuucauuguccaucucucaggagauauucaaagugagauuaauuuaaugaagccuucucagcaaaccuagaacacuguacuucaucuucaaauuuaagucauagccuuuaauaaguuacuuccuagucauuauuuuauaguauuuaugaaauagugcaauauaucaaugagguaucauuuaagaggcaaauacucuauagauuuggauuugucaucccaauuccuuggcauucaauaauauaaguaucuuuagcggcgucuucuucaucuucugauuucuucacaauaaauuuagccugaaaucagaagaggaguauauaaguaauacgaagagagauggaggaaagagcccacaacuccaacuuauguaggcagagaguuaaugucaagcccauuuuauugaaaaaccuacagagacacaaagaucaaaugauugaugagaaagaaacuuaauagccucaagauaacacauuucauuguacaaccaugguucuucuucagagguauacauaccugugaguuuuguccaaauauauaugccugggccccuuccacgcacacugaaucagaaagcucagauguacagcuuaggcaaauaacaauuuugaaaccucaaaugguaauuuuaaugcaacuguauucccuaugcccuaaaauuuuucugaaacauuucuacuuuuaucuugucaagucacaaauuacccuuuaauuucuuuacauuuuuucuugcuaauuuaguucccuauauauaucguucaaaagauccaguucagagaagguauguggggaggagggguggugguggugauuaacaucuuccuucaucuuuaauguacugggcuuaacaucacauuuuucacuuaguaacuaaaguuggcuuugaaauauuuuaccuguaucauuguauuuugcuuuuguuuuuguucuguuuuugagacagagucuugcucugucacccaggcugcagugcaguggcaugaacacggcucacugcagccucaacuuccuggguucaagggauccuccugccucagccuccaguguagcugggaccacaggcacaugccaccaugccuggcuaauuuuuaauucuguuguauaggcagggucucacuuuguugcccaggcucaaacuccuaggcugaagugauccuccugcgucagcuuccuaaagcgcugggauuacaggcaugagucauugugccuggccuauaucacuguauuuugaaaacaucauuauuuuuaaagcaaaugugauucauuuuaacaaaacuaaauuuagaaucaaaacaacuagccaggugcaguggugcacaccuauaaucccagcuauucugagguggaaggaucauuugaguucaguucaggaggcuggccugggcaacacaggaagacuccucacaacucccaucaacgucuuaaaaaaaaaaaucaaaacaauuaaauagguuaaguuuguggcaaaaggauuucaaauaugccuaaaaucuuaggauucuuggaagcacaauuugaaaaccaucacuugggggccuuacugaaugaauaguaauguuuaaaaauucuuucacuuucagcauuacaugguaauguacugacacagaguggacacuugaaauuacuguugaaugaauaaaugcugaauucugagcuagguaaccauauuaauuaauuaguaauauaugcaugcguuuauauauuuuucaaauuacaagcauuauguaaauaugaaacacacguagcagcuaugaaaaucauuucuagccuauacauaaaccuacuuaaaacuacaaauauguagaccugaaaggagcauagcaggccuaucuagcuuaagucugauuuuacagauaacuauuugcauugagacaaagaaagauaagaaacuugccccaagucacccaguuauacacaacaaagcugaccaagauacaagcuauacacagguucauagcacuuuccguuauguauacauuucaaauaacaaguaagcaucuacuauauguaaaguacugugaaaaguaaagaauauaaugaauaaaaccugaucucugcuauuaaggagaucaaucuauaaggagagacagacaaguaauaguuauaaauacagcauaaguagaguaacaaaaaaaauagaguuaacacucuugacaucaaauacaauuugccuuuaauucccaucagucuuuccuacaauuuaacaaaaacuuaucuauguuucuuaauaacaauuaaaaguauacauaauuaagaaucaaacugggcacaguagcucacagcuguaaucacggcauuugggaagcugaggugggaggaucacuugagcccaggaguucaggaccagccugggcaacacagggagaucccgucucucaaaaaacaaaaacaaaaacaaaaaaaaaauuagcagggugugguggugcacagcugcaguccuagcuacuugauaggcugaggugaaaggaucacuugagcccaggaguucggggcuacugugagcuaugauacugccauuguaaucuagccugggcaacagagcaagccccugucucuuaaaagaaaaaaaaaaaagaaaggccaggcgcgguggcucaugccuguaaucccugcacuuugggaggccaaggcaggcagaucgcguaaggccaggaguuugagaccagccuagcuaacacagugaaacccugucucugcuaaaaaguacaaaaauuagcuggacaugguggcacacgccuguaaucccagcuacucuggaggcugaggcaugagaauugcuugaaccugggaggcagagguugcugugagccaagacugugccacugcacuccaaccugggcuaacagagcaagacucuaucuuaagaaaaaaaaaaagaaaagaaaaaggaucaucauacaaauaggaguagggcagcaacagugguuuuguguaugggacacuucuguaaugauuaauuuuuuaaauuaauauauguuacuuuugucacuuuaaaaaaugcuuaagacuagggcugggcaugcuggcuuacaccuguaauccuagcgcuuugggagauugaggucagaggacugcuugagcccaggaguucaagaccagccugggaauguggcaagacuccaucucuacaaaacaucaaaaaauuagccaggugugguggcacacucccguagccccagcuacuugggaggcugcggugggaggaucauuugagagcccaggagguuugugccacugcaauccagccugggcaacagugugagacccugucucaaaaacaauaauaauaaaaaugcuuaagauuagcaacuucccuuauaaaauuguuacaaauuuuauauuucuuuauaaaauuacuuuauaaagaauaagcaaaaugggaaauaugcuacauguuacugaaauaagcaagaaaugaaguuguaugcauuaacugcaaaaaaugcaaagagaaacgauuuaggagaagaggaaaacaccuaaaugucaacagugguuuuaccggcaaggggaaauuaugagaaggcuuuuccccucuauuuccuauaaagaaauuacauuaguuucaugaugaaauauaccuauuguuucuuuaaauuaacaauccaggccaggcacaguggcucacaccuauaaucacaacacuuugggaggccaagguggacagaucaccugagcuaugaaguuugagaccagccuaagcaacauggcaaaaccccaucucuacaaaaauuagaaaaauuagccaggugugguggcaugugccuguaauccuagcuacuugggaggcuaaggcaggagaaucacuugagccugggaggcagaaguugcagugagccgagaucaugccauugcacuccagccugggcaacagugugagacccugucucaaaaaaaaaaaaaaaaagaauccuguaggaaagguaugaauaugagcucauauaaugauaaauccuucuucauuaaaaacuguacgucaacucuacuaaauuucagaggacagugaauauuaguuucaacaaauauucuauuuuaccaauagaaucaagaaaauaaaaugucuaaaauuuuauauaaauuuuuuuauagccaacuaugaaucccuugugauuugauaucauaguucacaacaaaacaucuuuacuuacucuguaaggcaguaccacacagugauuauaacauggguuuugaaguaugcuuucccagguuugcucaaagcucagcucugccacuaaaaauccauguggccuugaacaauuuaaugaaucucucugccucacuuuacucauauuuauaaugggaauaauaauaaauagccaccuacaauaguuaugcugaguagacaguuuagauaaauugcuaaauuagcucagugccugucacacaggaaacagugauagcaauuaugauuacuauuaaguuuccuauuaaaauuuaacccaaaauuggcuaaaauaaaaaucaaaauaucaauuucccuuucugauagaauacucaccuuugcuauuuguucagcaaaauguaucgcgguuugcguauggaguguaacugguccuguuuuuauucuggaaacuccauuggcuaaugccaugaaaacaaucagcuauuuaaaaaagaacaaagaaaaaccucacacauuuauuaauauuuggcauuauaauuccacugcugcccauaauaaaaauacuacuagaaauaaaaauugcuaaaacagaauuucuauuucuuuagguuuccagacauacucagaagaugacagaaaaccuauguuacccuaagucugugaguaguacaaaaaggcuugguagcagcucucaacauauaauuuuuuaaauuaauauuuacaaguaaaauacagaacaguaauauacuuagaccaacuaucucuacaaguugguauauauaauaugauguuuauucuacucucuuaaauuacauuuuaacagcugaauagacagacuaauacugggacuuuacugggaguuuaaaguagaccugggcaaggaggaggagacuagaaauaacagaaacugucuuaagaaacaggucaagaaaucucgaggacuauauuucuaaauguggacacuacugauuugggacuaaggagacaaaaguaugguagaaaggaaaaucuauaaagauaacagaccauaaaaacaauauuuggaaauauucaguaucacuucucacugugagugaacgugcuaaguuuuuuuuguuuuucguuuuuuuuuuuuuuuuuuuuuugagacggagucuugcucugccacccaggcuggagugcaguggcgcauucucggcucacugcaaaacuccgccucccagguucacgccuuucuccugccucagccucccgaguagcuacgacuacaggcacccgccaccacgcccggcuaauuuuuuguauuuuuucaguagagacgggguuucaccguguuagccaggauggucucgaucucuugaccucgugauccgcccaccucggccucccaaagugcugggauuacaggcuugagccaccgcgccaugcaacgugcuaaguuugagaggucugugacacguccaaguggagguguugacaggcauaggggauauuaugagcaaggaguuaaagagaaaggccugggcuucggauauaaauuugggaguugucagcauaaagacgguacuuaagccaugagacuggacaaacuaagagagggagcaacuacagaaaaagaaaacaaguauaagccaaaguccaggggcucaucaaaauuuagaaguuggccaggcacaguggcucauggcccuuaaucucaaaacucugggaggccaaagugggaggaucacuugggugccagaguuuaggauuagccuggucaacauacugagaccucgucucuauaaaaauuaaaacaaaaaaaaguuuuaaauuagguaggcaugacagcaugugccuguaggccuagcuacucaggaagcugaagcaggaggaucacuugaaaccaggaguucgagaccagccugggcaacauagcaagacucugucuccaccaaaaaaaaaaaaauuguuguugagaagaugaaaaccauaauaaacuagcaaaggagacuagaauguauggccagugagauaggaagauaacaguauuucagaaaccaaggaaagaaaauacuucaaaaaggaaggaguggucaauugcgcaaaacacuguagacacguaaaguaaaaugagggcugaaauuugaggaaugcaaaucccagaauauuuuuuuaaauuauugaaguaggacuugcuaauuagugucugaaagucaauuauuuaaauugauauucaaucuaccacauauucaaaucuaacagguuagaggguuuuuaaccuaaaugugucauuaccuggucuugcagauacucauccacaguaccaccaugucuaagauuugcuaauagcauuucggcagcuucaauuccaacuuugucugcauuuacaccuuaagauaagcacaacauuaaaacaaaacaaaacaaaacaaaacaaaacuaauuacuaagagacaaaaaguuugguauaucccaauuagcacugguauacaauuuuuaggccucaaaaacccacucaaugcaccuuuuagaauaagaucuuuaguuauuuaauauucugaguguuugggauacacaagucuuauaccuuuaaauauacuaguggaggaaaauauaggcuucauuaguccuauuuaaaauguacuaauuuauaaagccaguuuauaaguuaaguuaugacccuauaaugcuaugccucaauuucaaaaauuaaaacuugcagccaggcaugguggcucaugccuguaaucccaggacuuugagaagcuaagguguaagaauugcuugaggccaggaauucaaggcuggccugggcaacauagcuagacgccaucuaccaaacaaacaaauuccccucccaaauccuagaaaagcaugcguguuacaauuagucugcagguaauuccaucagaauuaaagaauuuggcucagugcgguggcucacgccuguaaucccaaugcuuugggaggcugaggcggauggaucacuugaggucaggaguuugaggccagccuggccaaaauggcaaaaccccaucucuacuaaaaauacaaaauuuagcugggcaugguggugcaugccuguaaucccagcugcucaggaggcugaggcaagagaaucacuugaaccugggagguggagguugcagugagcugagauugugccacuguacuccauccugggugacagagcaggacucugccaaaaaaaaaaaaaaaauuaaagaauuuuuuuaaagucaggaaauuacauuuuauguaaaaaaagagcauauaacauuaucagauaaaauauuuuagaguuuuauuuccucuaagauuugaacagguauucgcuuauuuuaaauauaagucagaauauuuacccucuugcccuauucccuaucucuccauacauauuccaaaucuuugguacaacacugaauacaaaguaagucugucacaaguaguagaaugccacauuauuauuuuaagguauuuacucucaacuaaaaaauucuuggcugcaaaugaaaacgucuuaugaaaaaugaaaaugugguuaguuuuguuucuauuuuauauuugcaaauuuacuugauuauauaugauaaaauuuuccccaaaguggaaauuguagaauuuuaacucuauuuuucuuuguuuuucuuguuuuuucuuguuuuuucuuuuuuuuuuuuuucuuuuuuuuuuuuagcgacuaggucucacuacguugccuggacuggucucaaacuccugaacucaagugauccucccgcuucagccucccaaaguguuagaauuccaggcaugagccaucaugcccagaaacucuauuuuucuuuauaguagucauaauaauauaauaaauuacccucuuuauauuaucaauuggccaaguauuuacgugacugaaugaaaugguuugaaacauguuuugugaaucuugacuucuuguuagccacugccauuuccucuucuagaagauggagaugauaauaauuaugcugcaaaguuguuauagaaauuagagauaauauuuauaaagcaucuauuacccagacuaguacauaaaaagcuauuaauaauaacacagguugaguaacccuuaucugaaaugcuugggacuagaagguuucagauuuuggauuuuuaaaaaauuuuggaauauuugagccaggcaugguggcucaugccuauaaucccagcacuuugggaggccaaggcgggcagaucacuugagaugaggaauucgagaccagacuggccaacauggugaaauacuaaaaauacaaaaauuagccaggcaugguugugugcgauuguaguuuuagcuacucaggaggcugagggacaacaaucucuugaacucgggaggcggagguuauggugagcugagaucgugccacugcacuccagccugggugacacaugagauucugucucaaaauuaaaaaaaaaaaaaaaaaaaaaaaggaauauuuggauauacauaaugagauagcuuggggaugcgacccaagucuacacaugaaauucagcuaagcacaguggcucacgccuguaaucccagcauuuugggagguggaggcaggcagauagcuugaguacaggaguucaagacuagccuggccaacauggugaaacucugucucuacuaaaauagccaggcaugguggcgcacacuaauaauuccagcuacucgggagucuguggugggaagcucucuagagcucaggaggcagagguugcaguaagccaagauugcaccacuccacucuagacugggcaagagaguaagacucccaucucaauaaauaaauaaacaaaccugaaauucauuaauguucauacauaccuuacacacauagcuugaaggcaaccuuauacaauguuuuaaaugauuuugugcauaaaacaaaguuuuguggcauacugccacuugaaaagcuucugauuuuggaauauuucagauuuuagauuuuuggauuaggaaugcucaaccuguaggaguauugcauacccacuauuuaucuaccaugcuaaguaauagaaaccagauccuuugcuaaggaggcauuuaaaauacacauauauuagaaaauuagaggauaauuaagugcuaacucugugauauaaacuauauacccgacaggaguucagaaaaguaagagauuauauagguucuagaauaauuugagguuucauaaagcaugaaggacuuaagugaguccuugaaaaacagcuaaaauagggauggaggauguaaaggaaaaggaaagaacuuccggcuuuguaguacuagaaaacagcagguacacuaaaguuuucugccauguagcaaagaauuccucagagccauucacauuccuuuccacccagccaccuugauaguaauggcaugaaugguucuacauuacuaacugccauuacuagcagucuguagcaacugaacauaauaagcaaaauaugagaaucuugcuuauuaguauuauacacaccaaaagcaaaaucucaauuucuucugaaaucuuaaugcuuuucuaacuaauugccaaucuucucacauuuuggauguuuuuaaacaaaggucucaaggacuuguuuuaggacaucagagagaugccaugaggccggcacgguggcucacgccuguaaucccagcacuuugggaggcagauuacuugaggucaggaguucgaaaccagccuggccaacacugugaaaccccgucucuaccaaaaauacaaaaauuagccggcaugguggcacacacuuguaaucccagcuacuugggaggcugcggugggaggauugcuugaacacaggaggcggagguugcagugagccgagauugcuccauugcacucuagccugggcgacaaagcaagauuccgucucgaaaaaaaaaaacaaaaacaaaaacagagagaugcccugaauuaccacauacacugagggagggaaggaaggugcuugcuauaagugaggcaauuacuauacaaaggaaauaaagauugauuaaccagaggcacaauucauuucagcagauuauuuugcucccauaguaaagaauauaacuaacuguaagauaagaguaaugaaagaucacacagauacgcaacaauggaaagacaaaacacauucugucuauaaugcaaucacuuaaaguuggaagggauccuuaaacauagaucacaaucacgguccaauaucauuuuucagauaaggaaagcccagagucacuaugcaugauaaugacaggacaugggacuaaaauuuaggucuucucacucucuguuuagugcucucuaucauaacacacugccucagucuaaaacagcgagauuuucucagacaaaacaaaaucucaccguuuuaaaauaaaauugaagaauguuauaguuagaaggauuuuggagauucuccaggcuaaucuucuugcucaacauauaaggaaacuaagaucaaaaugguuauaguaacugagacaaugauaaagacaucucuaguuacaacuuccugccucuaccaccuauggugguauugacaagcagccaauguuccuucuggugauaacccuaagaaauuaggauucaaggucugguaguuuuguuuuauuuuuuugagacagggucuugcucuaucaccuaggcuggagugcaguggugugaucucagcucacugcaaccuacaccuccugggcucaagugauccucccgccuccugccucagcauuuagaguagcugggacuacaagcacaugccaccaugcucaaguaauuuuuguauuuuuuguagagacaggguuucgccauguugcccagauuggucuugaacacuuggguucaagugaucugcucaccuuggccucccaaagugcugggauuacaggcauacgccaccacacccagccccuaaauccaguaauuuucuaguuaauuuaaaucagaaaugaaaggggaucuggauaauagaggucaugacauucucucugagauccuuaauauauagacaagcuggauugagaagaccacaaguuacuuuugcauuugcuaacaucucauuugacugaugugcaugauaggaaccaaggaaggauaccaggaggagucagucaaucucagcaggcauguugcucucuccucuauucucuccuaacacccuaagucuaaaaauaaguacuguguacucuacaaguguuuuauccaaaaacuacuuuaaaguacaaguugcuucaugugacaaagugagaaaaaaaugcugacagaacauuagaaaauuuuuuucaggccugguaaaaaaauuccauguauuacugauaaaguaaugaucccuuuacaaucaaucucaacgcagcauaucuaaaauuaucaucuacccuggcaaacuaacucuaccccguauauucacaagagguaaauauauccaguuaccuaagccagacaucuagaaggucauacuuuacacugccuuccucacuucccauacccaacuggccagcaaauauuguccauucaccuuugcaaauacccuuuuaucaguauucaccucucuagcccagcauuccuuggcacaggcccuuaccauucugaccugaauuguaaugaacucuuaucuuccugccucuaauauggcuuucuucuacuucucugaauuaucuuucaaaaacucucauaucacaucccucauuaaaugcucuauauuucaggaugaaauguaaauuccuagauauaaccuauagccuuucagaaucuggccugucgauauuucuguugucaucucucuccauucccuuacccagaucuauuauccacuugcaguugcuugcucaaacacagaacacuauuuuuuuggugacagggucucacugugucacccagacuggaaugcaguggugcaaucauagcucauugcagccuugaacaucuuaggaucaagcaauccucccgcuucagccuccugagcagcugggacuauaggugugagccaccauauggggcuacuuaaaaaaaaaaaaauuuuaagagauggaaucuugccauguuggccaggcuguugucaaacuccuggcucaagcaaucauccugcuucagccucccgaguagcuuggacuaaagcugcaugccaccucacccagaauacuuuuguaugucaaauuucuuuguccuuccuccuuagcucucacuuuucuauccagcuaacuucuauuuacccacagaacccacuggaggaccauuaaauggcagaaggcagauuuggugucaaucaguccccagaaggauucccuuugcuuccccuguauuccuaugguacccuggggauaccacuaucauagaacuggucuguuuccucugccagaauaacccaggaggcaggaaucauagcugucacuuuugaaucccuaguacacaguaccuggcacauuugguaaccaguaauacaaacaaacucacacuucucccaaugccugcuaaguacuuauuacuuguaauaugucugcuccuagucuccguuuuauauuuguauucucuuugcuucuaaagacuguuguagauagugcaugcaguggcucaauauccacacugauuccucacugcaccuaauauguaauuaguauaugccaaauacauauuuuagaucacuauuucucaaacuucaguauacauuaaaaguaccuggaaaguuuguuaaaauggauuccugggccccacucccacagauucuaauucaauacgucugagguaggucccaaaaucuguauuucuaacgaacucccaguugaugcugacaaguuugccugucugccaaccacauuuugaauagcacaguuuuagacagaauucauuuaugugaguucaacuggaaauggugauuuuauuuauucucuugaucagauuugaugcccaacuaguucuagauuuaccaacugagcaaacugaagaauuccuaauuuuuuuuguauucaguaguaauaguguggcuuaacagcauagcuaggguaaacauuuuuauuuguuuauuuauuuugcaaagacaaagucucacuacauugcccaggauagucuugaacuucuggucucaguaauccucccaccucagccucccaaagugcuaggauuacaguuguguaccacugugcccagcuugguaagcauuuuuaaagaugcuacaaaguaggaauaaagcaaucaaugaccacgcaaacaacuagaaguucaccuaaaaguugccugauugguaaaaguaacuuuaaauauuaacaaacacaugcauguauguaucuucucucucuaauauaccaaaccuuaaacaaauuucccuuucacaaaaacauucaaaauucugaaaucaccaauguaauaacugaugcagagaagaaucaucaauagauguuaaaaccacuggaugaaagcuguuaugggugcaggauaaccagauggccucaaaauauuuucuuggaucacuaguuaauuacaaagguaaaaggaacuuucauggcagacagaucugcaggacacaccuccuuaaccaagugaucacacucaaccucaccaauaaaggagaaacuaacaucaugugcccccugccgugauacaguggaauguacacaaaaucaccuauguaguauucuuaauaaaaauguuuaaucugaauauaucaugagacaaucagacaaauuuaaauugugggaaacucugugagaaaauggccuggacucuuaaaaaugucaguaucaugaaaugaacaacaacaaaaaagguaaugggaggauuguguauuaaaagagggacuaaagagacuugagaaacaaaugcuaugugcccccccccaaaaaaaaaaauuccacaucgcucuaaauaauauuuuggaaacaauucauuauguaugaagcuaucuggugugucagaauaaaacaaauucuucagguguaaaaaugguauuauaauuauguaguuauugcucuuuggacauauaugcugcaguauucaggggugagacauggcaccugcaacuuauauugaaauggcucagaaauauacacaacaaacuaaauguucauaacuagugaaucuaagagaagguuguauggaugacuaguugaacuagucauucaacuuuuccauagguuugaaauuuuccaaaguauaaaggugggagaaagacugaaagucugaaaguguaauugacucuaaaagagaaucaauuaacuacauccuuuuaaacuuucauccaucauucuauaacauuccaauccugauggauuaaagaauucugcaguagcauugggaacuauggacccccuucauuuaucuuaccucguuuaccaagcgaugauccagcaaacaaacagccaguggaggucucagcaauaauucuaugcaagaaaaaaaguuauuacuaccuuugcuauaaauguuccaaauuuaugcaaauacaacaaaagagaacaaugacuauuaaauaggcagaacuaaaucugggcaacaaauugcaaaaguaaaaauucuucauauagagugguaugauuaacauugucuaucuuaaucagaccaguaguauccuuuaccacuugaccaggagaagucacaccagauucuaauucacagguuaagaaaugucuaccaugccccccaacaaguuaacaugucauuagcacuaagugguaccauuucacaggcacacaguacuauaaaguguuucagaauuaucuuaaauaaaaaggucguuaugcagagacuuugguauuguucuacgguuuuuagauaguguuaucauaaguagagcaagcguuuacuuuaaaccuuuuaauggaaauucugaaugagaggauuuggaacuuaaauauccaaaaaugguacuuuuauacuucaaaaacaucaguuaaagaauuuguacuaauacuuaaaucuauaacuccuaacugaauuaacauaauaguucuagucugguuuuuuuugagauggagucucgcuuugucgccaggcuggagugcaguggugugaucucagcucacugcaacauccgccucccagguucaagugauucuccugccucagccucccaaguagcugggacuacaggugugcaccaccacgcccagcuaauuuuuguauuuuuaguagagacaggguuucaccauguuggccaggaugaucuugaucucuugaccuugugaucugcccgccucagccucccaaagugcugggauuacagguguaagccaccgcgccuggccucuagucugguuuuaaaaagcucuuugcuauauuuauuugugaacugauuucacauuugacguauuuuaugcaacuggaaauauucucauaggacuagcuuuaaagccuaacuucugauuaaacguuuaaguucacuauauaagggaaagggaucuuacaagguaacaaaaggcaagccauccucagaaaaaauucagaauaauugucuuaauuuaucauacugguguuuuagguaggaauguccuuaaaaauauaaacugaggcugggcacaguggcucaugccuguaaucccagcacuuugggaggccaaggcagguggaucaugaggucaggagaucaagaccacccuggcuaacacggugaaacccugucucuacuaaaaauacaaaaaauuagcugggcgugguggugggcgccuguagucccagcuacucaggaggcucaggcagaagaauggcaugaacccaggaggcggagcuugcagugagccaagaucacaccacggcacuccagccuggacaacagagcgagacuccaccucaauaaauaaauaaauaaauaaauacuucuuaaaacuauaaacuuaagcaagaaacccuaaaaaucuuuaauuuaauuagauaacuauuuuaggguucucaacuaauguguaggaaaaaguauugucucacauuauuccauuuccauugccaaaugcuuggucuuuagguucuugaacaggcuggauguuaacauacaaaucccggaucuccuuucugaugcaucuaacugcugccgcugccauaucuuuugcuaccuauuuuagcaagacagaaaaauagaauaaaacaauuacugauuauuuggaaaauuguuuucaagacuucaaagacacauaaaauaauugguagcuuuuacaugcauuauuuaauaacuugauuuucaagagagcacugaauuuuuaaauaugcuuaugcaaauuaauuuuauuuuuguuaauuaauguauccauuaauacauauauuucaucuuuuauuuuagguucaggagguacaugugcagguuuguuacauggguaaauuacaugucgcugagaucugguauaugaaugaucccaucaccuagguagugaacacaguaccugauaguguuucaacccucagcccccuuccacccuccucccauuagcaguccccaguguucccaucuuuauguccauguguauucaaugcguagcuuccacuuaugagaacaugugguauuugguuuucuguucccacauuaauuugcuuaggauaauggccuccagcugcagccauauugccacaaaggacauuauuucuuuccuuaaaaaaauguuaaguucucucaauaauuucaaaauuuaguugacauaauauuuaucaagacacacauauauuuuauuucuaagaacaucuaaacaacuuacuuuaaauggcaaaacaccagcaacgaaagcucuuccauauaucuuagucacacagccacgcucaguuaaauuuauaggguucaauuguuuaacuggugacauucgaacaaucacuucaccacccccuuuuggguaauauccccuaugaaaaguauaacaaaugcccacauaaacugauugcaugacaaaaacaaagcucuauauuacaauaaaaugacaugucaaugauauccaaacauguaauccauggaaaggucuaaauauuuuaggucuguauuuuguaaaauuuuauacauuaaaaaacaaaauuuugucuguacuauacaaugugguagccuugagauaugugaaacuauuaaaauuaaauaaaauuuaaaaaucagcuccccagcugcacuagccacauuuuaagugcucaauagucacauuuggcuagugacuaccauauuggacagcauagauauggaacauauaccccaaugcagaaaguucuauuugacagggcuauuguagaauauaagcgccuugagggcuagacuuaccuauauuguuccugcuauuuuccugugccuaaaacaaugucuggcacaugguagguccucaaauaaauauaugaugaauauuuaaguagcaaaacacuuaaaaaguuuuaauucaauuaauuggugucauuuauuuuacagcagacggugagaagacaguacuccuccccucaaagagcucaccaucugguagggagauggcuccacacacugucuacuagaauacaggucaggcuauaagaaaggcuacaacauaggugcaaauaugaauucugauugaggcacaaucacaguucauaaagaauuauaaguuucacguugaaaaaaacauaggauuucuaacuuuugggagagcaggggaagaauaacaugaacaaagacacaaaaguccaaaggcacaaagcauauuuaaggaauaacaagcaaacauauuguuagaauacauaacacguugaaaggaggagagggacgaagaaguuagaaaaguuagggcaagacuucaaagcacuuaaaugccacaccaagaaauauggccuagugauuguguggcagaagggaagccuuaaagagaaauaaccugaaugcccaauguguuucuuaggaaaacaauucugaucacauuguggaagagaauuccuuuuaugaccccuuagugucuaguccaguugucuacacacagugagcacuuaagcugugcuggggcaugaaauaucacuagauaugaggguaccucacugugaaaauucccuugaaaauauuuucccuagaaauaaauaaccaugauguguagcugcucucgaguccccaugcuccugcuauucauuauuuuuaagccacaaaguacaauuacuucuuacaagagaugcaauguauuaaguggguaccagaaagacaguucucuaagggucuaacuuuuccacuacuucuagcguaaguaauagauccuaacauuuaagaaacaagcaacuuaccuuguuuuaaugucacaauuaaauaugaaaccaaauuuuucaacaauuggcuugaagaccugaaaaaaucaguuuuuaucauuagguuaaucagcaauauucacuaauuuaacaaguguauuuauuaaacaaaagcgcuuugcuggcuaguaacugggugcuauagguaaacaguguuauaagaauauguaggcugguuccauuuuuuucaaauaaaaaaacugauauguagcuaaauuuaaaaguuugacauuuauuuaaucagagcugugcaagucuaucuaacgaaaaaaauuggaacuuaggauauuugauaucagugguuauucuacuccgaaggccaauacuuccucacgcaucucaauauaguacauuuaagaaaugaggggguauuggugaagagcauuccauucugucaucucaauuuuuuguacaguugaaaucucauuccacagacaaugcuuuaacauuauaaacauaagcauuuuccugacaucauaaaauuauuccuaaacaaaaucugaaugacuccauggcauccuagccuaauugacuuaacgguucuccaaguuuucauuauuagauaaugauauaucuuauauaaugauaauuacaguauauaaugcucuguucaaauaccuuuaacauuuaucuuuagcugaacuuugcaauauugaauuagaggaguuuccuugaagucaaauuauuaggugaggagagauuaauuuuuauuauacaucccaucgaacugacuuugaaaagauuauaccaucuauuagaauggcaauauuucagagaaagaugguguuuaagccugaugucuaaggcaacucuuugagaucuacucuagagauuuacuuauuucucuggguugucuccuauguauccaggagguauacagguuauuaaccuuguuuuguguuuuuuuuuaaaggcagaaaaagcuuaacaaauaaaaaccugaaaauaucaagugcuaggauggauacagaacagcuggaacccucuauuugauauuuauuuuuauuuuagagauggggucucgcuauguuacccaggcuagacuccagcuuaagcucaagagauccucccaccucacccuaccaaguauuaaauagcugggacuauaggcacacaccacugugcccacuucagcuggaacucucauauaguacugguaauaaugcaaaauguagccacuuuggaagcuaaaauaaccuggcuauguauuauaaaguuagacauuugcuuauuauaacaacccagcaaguauuuucccaagagaaaugaaaauguacaaucacacaaaaacuuguauaugaauguuaacaguaacuuaauuuauaauugccaaaaucuggaaacacccaaaugcccuucaauagaugaauggauaugcaaacugguacauccauauacgagaacacaacucaaguuuucauugcagauacaagcaacauggaugaaucucaaauguauuauggagagcaaaaaacccagacucaaagccuacguacaguauuaucccuuauaugacauucugaacaaaaggcaaaacuaugacagaaaacagaucagcaguugccaggggcugaggcucaggacugauuacaaaaacguauaagggaauuuuuuagaguaacggaacuauucuaugucuugauugugguagaugguucauaacugugaaucaugucacugucaaaaaucacagaacugcauguuaaaaaggguggauucaauugaaaaaauuacacuuuaauaaaucuagaagaaaaaagauuauaccacuuuucucucccacuaguuauaugagcaugccaguauuuuuuaaaucauuuuuuaaauguuugauccuagaauggaaggggcuuaauagaaaaaaaaaguuugaguuucccuccaaaucauaauccuuguauuuauaaaauaacacaucacaacugauauaauuuauaucacacucgagguguuuuuuguuuuuuuaaagacagcaucuugcuuuaucacccaggauggagugccaacauagcucacugcaaacucaaccucccaggcucaagugauccucccaccucagccuccugaguagcuuggacaggugugcaccaccaugccuggcuaauuuuucuguguguaguguuuuuuguuuuuuauuuauauuauuuuuuuguagagaugggauuucaccauguugcccaggcuggucuugaacuucuaagcucaagugaucugccuaccucagccucccagagugcuaggauuacaggugugagccaccacaccgggcccuacacuugaguuuuuuuuuuuaauucacuauaaacacuauuccaagauauaacaacaaacuuaaaguaaacauaauuccccacccccuacugcaauagacacauuugggaggcugaggugggaggauccuuagagcucaggaguucaagaccagccuaggcaacauagugaggcaucgacucuacaaaaaauuuaaaaaaauuggcugggugugugccuguagucccagcuacucaggaggccaagacaggaggauugcuugagcucaggagguugaguaugcagugagcugugauaugcaacuguacuccagccuuggcaacagcacugucucaaaaaaaaaaagaaagaaagaaagaaaagacaccaugaagagauaaacaagaaagucacaaaaaaacacucaggauauauuuagagaauggagacucagaagcauguaugagaucaucuuaguuugucaacaacaaaagcccuuaccaucacuguauaaucgaucuguggugccauuucagcauuaguuccaccuuucaaaugaaguucugauggagaagcagcaaagagaacacacggcauugagaccugcaucaagaggcacacacuccuaaggagaaggcagaaggggcuuauuuucauuuucuuuucugcauuuucuuuucaaacucuuaaauaagcuauauucuuguucaucacuaccaacuaaagcacagacaacugugaaggcagguauaugccauugaguuucuaguuaaaaaacauuuuagugucugaauaguaaaauccugaauuuuaaagaaaaacaguauuucaccauagaaaaauagcuuuaaaugauaaccaaaccugggucugaaucuucaacuaaacacauuagcugugugaccuuggcuaaguucugauacuuuucuuuauauuacaaaaaaguaaaaaagaaaaaaaauuaaaaauaaaaccuucuucaaaaguuuuacaaaagaauucuugaaacuagcaguuuaugaaaaugcuuucaaaauagacaaggucuggauaugauuaguuacuauauaacaagguacuguuccagguauaaagauauaguuccugucauuguggaguucaugauaugauagaauaauauuuuacgcagccauaaaagagaaugaguucauguccuuugcagggacauggaugaagcuggaaaccaucauucucaguaaacuaacauaggaacagaaaagcaaacgcugcauguucucacucauaaguggcaguugaacaaugagaacacaugggcacagggaggggaacaucacacaccagggcuugucggggggcagguggcaaggggagggagagcacuaggacaaauaccuaaugcaugcagggcuuaaaaccuagaugaccaguugaugggugcagcaaaccacuauggcacauguguacauaugugacaaaccugcacauucugcacauguauccagaacuuaaaguauaauaaaauauuuuaauaauuauuaauuuuaauaauaacaaacacucacagcuuggccgggcgugguggcucaugccuguaucccagcacuuugggagacagaggugggaugaucacucgagcccaggaguucaaaaccaaucugggcaacauagugagacuccaucuuuacaaaaaauuuaaaaauuaaccaggcauuguggugcacgccuguagucucagcacuuuaggagaaucgccugagcccaagaggucaaggcuacagugagccaugaucaugccacugcacuccagccugggagaccaaaaaaaaaaaaaaaaaagacugauagcuaaauauuucacaugggaaguuuuagugaaguaauccuugcuuuacuugccuguuugguccuuauagucaaauaaugugagaaaucacaagaaauaguuauguaacaugaugaauuucauaaagugaaacacuuggucauuaucuuuucuuuuuuugagacaggggcuccuuccaucacccaggcuggagugcagcggcacaaucucaguucacugcaccuuccaccuccaaggcucaagccucagcuucucaaguagaugggacuaccggcauguaccaccaugcccagcuaauuuuuauuuauauauauaaauauauaaauauauauauaugacgggguuuugccauguugcccaggcuggucucaaauuugugagcucaagcgauccacccaccucggccucccaaagugcugggacuacaggcgugagccaccgcaccuggccugguuguuuucuaaaugagccauuaucucccuucuccaaaguuaagugaaagcaaucauauucauaaguaguuugaaagggaauucgacauagccucuuagcuaucaaaagacagaucuuuauuuaacucacuuacacaaugaugcuuaaguauugaacugggaagucucuaucaguaauaaugaauuucauuaauucaaugaauauuuauuggacaggugugguggcucacacuuauaaucccaaaacuuugggaggccaacguggguggauugcuugagcuuaggaauucgagaccagcugaaaaacauggcgaaaccuugucucuuuaaaaaauacaaaaauuagcggggcauggugcugugugccuauggucccagccacgcaggaggcugaggugggaggaccuguugggcccaggaguuacagcuuacagugagcagugauugcaccacugcacccccgccugggcaagagggauaccuugucucaaaaaaaaaaaacauaaaaguagggaaacaagcucauagacauuaagcaacuugcccagaaaguggcaaaaccuggacuuaaacccagguuacuuaaauggaauguuaagugauacauacccugcugucuugguaucugcuguguggauuccaccuuugaucuucucugguguaaagguuauuucuguugagccaauuucugcccccuccaguugcccaucacacaaaucucgaaucauuuccaguccagauaaauguugaggccuucaggucauaauacugcaucaaaacgugugcauucagacugccuacauccccacauuuuaugacaaauuuauaaaacugcaauggcaagaaaacagcaaggucuaaccacaguaagugccacaucuucagugucagcuuccuuuuggguuuuuaugcaccuagacuaccugcuaguauguaucauuuuaacacuuccuugcagaccaguuauuucugacuauaaauacauacccugauauauugcugcaaauuagaagugugcuaaagaagaaaacuaauaguuauuucagugccaccagucucgcuugcacuugacugaacaaucuauggugccuguaugggcugaacuauguucccccuaaauuaauaugcugagacuguaacccuccguaucucagaaugugacuauauuuggagauagagccuuuaaagagauaauuaaguuaaaauaaggccaccauacaaucuuacugguguccuuauaaaaaaaaaaaaaacuagaacauacagagacgcuaggggcaagguacacagaggaaccaccaugugaagaggcaaaaagacaggccuggagcagauccuuuucucauggcucucagaggaaaccaaccuugucaggaccuugaucuuggacuuccagccuccagaacugugaggaaauaaauuucuguuguuuaagcuccacucuguguguggcauuuuguuauggcagcccuagcaaacuaauacaacaccuacagccuaaugaauuggauuccccuguuggugaacuggagggcugcaaacuaugacaaaggcaauuaacauuaacauaucaguaauugccuuuugguaauuucaaaacuguagacaaaagacugagaccgcugauuuauuaaaauguaauaaauacagaauacauacaaagcaaucaguguggcuucaaaccuggguccucuucuagcaggugcauguaccugaagcucaacuaguggcaugcccagcuacccagacagaagaaauaaggucaaaugucaagguguuucccucuccacaacagauaauucuggucauaacagcucucuggagguaugaaugaaggcugggauaacacaucucaggauucuuuccuguuuuaugauucuaaaacugacagcagaaccagaaugcacugguuauaaaacaggguuuccucuggcgucacaagcauuucugcccuaucuaucuugccagcucauacgugcuguucggauauuuggaaugcccggugaggugagaaaacauuuuaaaagcuagcucuucagcaaaugacacuauuuagucaaacagagaaaacucgagaccauuucuaaacucaccccuccaggcuuucaagacuuuacaacccaggccaccgcccaggcagagugccccgcccuggaucgcccauaccugcgucugggaccuucuggguuccaccacucggacucccgaugccccagcccggcagcccgaccccccgaucccccagcuucacggcccaacucccccuccagccagauuuaccucaggccuggcgugcuccggccggcucggaucuucugcacccgcaaggggaggccuaggagacagcucaaggccguagagacucucaggaucuggccgcccugcaaagguugggguacagggagaagagaaguaagcacaccgguggugagagcuccccuccuuaguuaggcugcagccccggccgcuucgcucuguacucaccccuuccaugaugcugccaucgaccuccacccgcggccccgccaugggggacacccuggggcccagcccgcagcgacaaagccuccgccagagcgggagaaagaagagacguuggcucccgcccaguaguucagaaaccuugguucaugccuggggcgcaggagccugacgagaaagcggaagaagcggcgccucucgggacacuggagucagcagaaacgaacccccggguucgcccaguuccgcagucagugcgcaugcgc

SEQ ID NO: 191333 - RNA, 26612 nt, Homo sapiens
gcgcaugcgcacugacugcggaacugggcgaacccggggguucguuucugcugacuccagugucccgagaggcgccgcuucuuccgcuuucucgucaggcuccugcgccccaggcaugaaccaagguuucugaacuacugggcgggagccaacgucucuucuuucucccgcucuggcggaggcuuugucgcugcgggcugggccccagggugucccccauggcggggccgcggguggaggucgauggcagcaucauggaaggggugaguacagagcgaagcggccggggcugcagccuaacuaaggaggggagcucucaccaccggugugcuuacuucucuucucccuguaccccaaccuuugcagggcggccagauccugagagucucuacggccuugagcugucuccuaggccuccccuugcgggugcagaagauccgagccggccggagcacgccaggccugagguaaaucuggcuggagggggaguugggccgugaagcugggggaucggggggucgggcugccgggcuggggcaucgggaguccgagugguggaacccagaaggucccagacgcagguaugggcgauccagggcggggcacucugccugggcgguggccuggguuguaaagucuugaaagccuggaggggugaguuuagaaauggucucgaguuuucucuguuugacuaaauagugucauuugcugaagagcuagcuuuuaaaauguuuucucaccucaccgggcauuccaaauauccgaacagcacguaugagcuggcaagauagauagggcagaaaugcuugugacgccagaggaaacccuguuuuauaaccagugcauucugguucugcugucaguuuuagaaucauaaaacaggaaagaauccugagauguguuaucccagccuucauucauaccuccagagagcuguuaugaccagaauuaucuguuguggagagggaaacaccuugacauuugaccuuauuucuucugucuggguagcugggcaugccacuaguugagcuucagguacaugcaccugcuagaagaggacccagguuugaagccacacugauugcuuuguauguauucuguauuuauuacauuuuaauaaaucagcggucucagucuuuugucuacaguuuugaaauuaccaaaaggcaauuacugauauguuaauguuaauugccuuugucauaguuugcagcccuccaguucaccaacaggggaauccaauucauuaggcuguagguguuguauuaguuugcuagggcugccauaacaaaaugccacacacagaguggagcuuaaacaacagaaauuuauuuccucacaguucuggaggcuggaaguccaagaucaagguccugacaagguugguuuccucugagagccaugagaaaaggaucugcuccaggccugucuuuuugccucuucacauggugguuccucuguguaccuugccccuagcgucucuguauguucuaguuuuuuuuuuuuuuauaaggacaccaguaagauuguaugguggccuuauuuuaacuuaauuaucucuuuaaaggcucuaucuccaaauauagucacauucugagauacggaggguuacagucucagcauauuaauuuagggggaacauaguucagcccauacaggcaccauagauuguucagucaagugcaagcgagacugguggcacugaaauaacuauuaguuuucuucuuuagcacacuucuaauuugcagcaauauaucaggguauguauuuauagucagaaauaacuggucugcaaggaaguguuaaaaugauacauacuagcagguagucuaggugcauaaaaacccaaaaggaagcugacacugaagauguggcacuuacugugguuagaccuugcuguuuucuugccauugcaguuuuauaaauuugucauaaaauguggggauguaggcagucugaaugcacacguuuugaugcaguauuaugaccugaaggccucaacauuuaucuggacuggaaaugauucgagauuugugugaugggcaacuggagggggcagaaauuggcucaacagaaauaaccuuuacaccagagaagaucaaagguggaauccacacagcagauaccaagacagcaggguauguaucacuuaacauuccauuuaaguaaccuggguuuaaguccagguuuugccacuuucugggcaaguugcuuaaugucuaugagcuuguuucccuacuuuuauguuuuuuuuuuuugagacaagguaucccucuugcccaggcgggggugcaguggugcaaucacugcucacuguaagcuguaacuccugggcccaacagguccucccaccucagccuccugcguggcugggaccauaggcacacagcaccaugccccgcuaauuuuuguauuuuuuaaagagacaagguuucgccauguuuuucagcuggucucgaauuccuaagcucaagcaauccacccacguuggccucccaaaguuuugggauuauaagugugagccaccacaccuguccaauaaauauucauugaauuaaugaaauucauuauuacugauagagacuucccaguucaauacuuaagcaucauuguguaagugaguuaaauaaagaucugucuuuugauagcuaagaggcuaugucgaauucccuuucaaacuacuuaugaauaugauugcuuucacuuaacuuuggagaagggagauaauggcucauuuagaaaacaaccaggccaggugcgguggcucacgccuguagucccagcacuuugggaggccgagguggguggaucgcuugagcucacaaauuugagaccagccugggcaacauggcaaaaccccgucauauauauauauuuauauauuuauauauauaaauaaaaauuagcugggcauggugguacaugccgguagucccaucuacuugagaagcugaggcuugagccuuggagguggaaggugcagugaacugagauugugccgcugcacuccagccugggugauggaaggagccccugucucaaaaaaagaaaagauaaugaccaaguguuucacuuuaugaaauucaucauguuacauaacuauuucuugugauuucucacauuauuugacuauaaggaccaaacaggcaaguaaagcaaggauuacuucacuaaaacuucccaugugaaauauuuagcuaucagucuuuuuuuuuuuuuuuuuuggucucccaggcuggagugcaguggcaugaucauggcucacuguagccuugaccucuugggcucaggcgauucuccuaaagugcugagacuacaggcgugcaccacaaugccugguuaauuuuuaaauuuuuuguaaagauggagucucacuauguugcccagauugguuuugaacuccugggcucgagugaucaucccaccucugucucccaaagugcugggauacaggcaugagccaccacgcccggccaagcugugaguguuuguuauuauuaaaauuaauaauuauuaaaauauuuuauuauacuuuaaguucuggauacaugugcagaaugugcagguuugucacauauguacacaugugccauagugguuugcugcacccaucaacuggucaucuagguuuuaagcccugcaugcauuagguauuuguccuagugcucucccuccccuugccaccugccccccgacaagcccuggugugugauguuccccucccugugcccauguguucucauuguucaacugccacuuaugagugagaacaugcagcguuugcuuuucuguuccuauguuaguuuacugagaaugaugguuuccagcuucauccaugucccugcaaaggacaugaacucauucucuuuuauggcugcguaaaauauuauucuaucauaucaugaacuccacaaugacaggaacuauaucuuuauaccuggaacaguaccuuguuauauaguaacuaaucauauccagaccuugucuauuuugaaagcauuuucauaaacugcuaguuucaagaauucuuuuguaaaacuuuugaagaagguuuuauuuuuaauuuuuuuucuuuuuuacuuuuuuguaauauaaagaaaaguaucagaacuuagccaaggucacacagcuaauguguuuaguugaagauucagacccagguuugguuaucauuuaaagcuauuuuucuauggugaaauacuguuuuucuuuaaaauucaggauuuuacuauucagacacuaaaauguuuuuuaacuagaaacucaauggcauauaccugccuucacaguugucugugcuuuaguugguagugaugaacaagaauauagcuuauuuaagaguuugaaaagaaaaugcagaaaagaaaaugaaaauaagccccuucugccuucuccuuaggagugugugccucuugaugcaggucucaaugccguguguucucuuugcugcuucuccaucagaacuucauuugaaagguggaacuaaugcugaaauggcaccacagaucgauuauacagugaugguaagggcuuuuguuguugacaaacuaagaugaucucauacaugcuucugagucuccauucucuaaauauauccugaguguuuuuuugugacuuucuuguuuaucucuucauggugucuuuucuuucuuucuuucuuuuuuuuuuugagacagugcuguugccaaggcuggaguacaguugcauaucacagcucacugcauacucaaccuccugagcucaagcaauccuccugucuuggccuccugaguagcugggacuacaggcacacacccagccaauuuuuuuaaauuuuuuguagagucgaugccucacuauguugccuaggcuggucuugaacuccugagcucuaaggauccucccaccucagccucccaaaugugucuauugcaguaggggguggggaauuauguuuacuuuaaguuuguuguuauaucuuggaauaguguuuauagugaauuaaaaaaaaaaacucaaguguagggcccggugugguggcucacaccuguaauccuagcacucugggaggcugagguaggcagaucacuugagcuuagaaguucaagaccagccugggcaacauggugaaaucccaucucuacaaaaaaauaauauaaauaaaaaacaaaaaacacuacacacagaaaaauuagccaggcaugguggugcacaccuguccaagcuacucaggaggcugaggugggaggaucacuugagccugggagguugaguuugcagugagcuauguuggcacuccauccugggugauaaagcaagaugcugucuuuaaaaaaacaaaaaacaccucgagugugauauaaauuauaucaguugugauguguuauuuuauaaauacaaggauuaugauuuggagggaaacucaaacuuuuuuuuucuauuaagccccuuccauucuaggaucaaacauuuaaaaaaugauuuaaaaaauacuggcaugcucauauaacuagugggagagaaaagugguauaaucuuuuuucuucuagauuuauuaaaguguaauuuuuucaauugaauccacccuuuuuaacaugcaguucugugauuuuugacagugacaugauucacaguuaugaaccaucuaccacaaucaagacauagaauaguuccguuacucuaaaaaauucccuuauacguuuuuguaaucaguccugagccucagccccuggcaacugcugaucuguuuucugucauaguuuugccuuuuguucagaaugucauauaagggauaauacuguacguaggcuuugagucuggguuuuuugcucuccauaauacauuugagauucauccauguugcuuguaucugcaaugaaaacuugaguuguguucucguauauggauguaccaguuugcauauccauucaucuauugaagggcauuuggguguuuccagauuuuggcaauuauaaauuaaguuacuguuaacauucauauacaaguuuuugugugauuguacauuuucauuucucuugggaaaauacuugcuggguuguuauaauaagcaaaugucuaacuuuauaauacauagccagguuauuuuagcuuccaaaguggcuacauuuugcauuauuaccaguacuauaugagaguuccagcugaagugggcacaguggugugugccuauagucccagcuauuuaauacuugguagggugaggugggaggaucucuugagcuuaagcuggagucuagccuggguaacauagcgagaccccaucucuaaaauaaaaauaaauaucaaauagaggguuccagcuguucuguauccauccuagcacuugauauuuucagguuuuuauuuguuaagcuuuuucugccuuuaaaaaaaaacacaaaacaagguuaauaaccuguauaccuccuggauacauaggagacaacccagagaaauaaguaaaucucuagaguagaucucaaagaguugccuuagacaucaggcuuaaacaccaucuuucucugaaauauugccauucuaauagaugguauaaucuuuucaaagucaguucgaugggauguauaauaaaaauuaaucucuccucaccuaauaauuugacuucaaggaaacuccucuaauucaauauugcaaaguucagcuaaagauaaauguuaaagguauuugaacagagcauuauauacuguaauuaucauuauauaagauauaucauuaucuaauaaugaaaacuuggagaaccguuaagucaauuaggcuaggaugccauggagucauucagauuuuguuuaggaauaauuuuaugaugucaggaaaaugcuuauguuuauaauguuaaagcauugucuguggaaugagauuucaacuguacaaaaaauugagaugacagaauggaaugcucuucaccaauacccccucauuucuuaaauguacuauauugagaugcgugaggaaguauuggccuucggaguagaauaaccacugauaucaaauauccuaaguuccaauuuuuuucguuagauagacuugcacagcucugauuaaauaaaugucaaacuuuuaaauuuagcuacauaucaguuuuuuuauuugaaaaaaauggaaccagccuacauauucuuauaacacuguuuaccuauagcacccaguuacuagccagcaaagcgcuuuuguuuaauaaauacacuuguuaaauuagugaauauugcugauuaaccuaaugauaaaaacugauuuuuucaggucuucaagccaauuguugaaaaauuugguuucauauuuaauugugacauuaaaacaagguaaguugcuuguuucuuaaauguuaggaucuauuacuuacgcuagaaguaguggaaaaguuagacccuuagagaacugucuuucugguacccacuuaauacauugcaucucuuguaagaaguaauuguacuuuguggcuuaaaaauaaugaauagcaggagcauggggacucgagagcagcuacacaucaugguuauuuauuucuagggaaaauauuuucaagggaauuuucacagugagguacccucauaucuagugauauuucaugccccagcacagcuuaagugcucacuguguguagacaacuggacuagacacuaaggggucauaaaaggaauucucuuccacaaugugaucagaauuguuuuccuaagaaacacauugggcauucagguuauuucucuuuaaggcuucccuucugccacacaaucacuaggccauauuucuugguguggcauuuaagugcuuugaagucuugcccuaacuuuucuaacuucuucgucccucuccuccuuucaacguguuauguauucuaacaauauguuugcuuguuauuccuuaaauaugcuuugugccuuuggacuuuugugucuuuguucauguuauucuuccccugcucucccaaaaguuagaaauccuauguuuuuuucaacgugaaacuuauaauucuuuaugaacugugauugugccucaaucagaauucauauuugcaccuauguuguagccuuucuuauagccugaccuguauucuaguagacaguguguggagccaucucccuaccagauggugagcucuuugaggggaggaguacugucuucucaccgucugcuguaaaauaaaugacaccaauuaauugaauuaaaacuuuuuaaguguuuugcuacuuaaauauucaucauauauuuauuugaggaccuaccaugugccagacauuguuuuaggcacaggaaaauagcaggaacaauauagguaagucuagcccucaaggcgcuuauauucuacaauagcccugucaaauagaacuuucugcauugggguauauguuccauaucuaugcuguccaauaugguagucacuagccaaaugugacuauugagcacuuaaaauguggcuagugcagcuggggagcugauuuuuaaauuuuauuuaauuuuaauaguuucacauaucucaaggcuaccacauuguauaguacagacaaaauuuuguuuuuuaauguauaaaauuuuacaaaauacagaccuaaaauauuuagaccuuuccauggauuacauguuuggauaucauugacaugucauuuuauuguaauauagagcuuuguuuuugucaugcaaucaguuuaugugggcauuuguuauacuuuucauaggggauauuacccaaaaggggguggugaagugauuguucgaaugucaccaguuaaacaauugaacccuauaaauuuaacugagcguggcugugugacuaagauauauggaagagcuuucguugcugguguuuugccauuuaaaguaaguuguuuagauguucuuagaaauaaaauauaugugugucuugauaaauauuaugucaacuaaauuuugaaauuauugagagaacuuaacauuuuuuuaaggaaagaaauaauguccuuuguggcaauauggcugcagcuggaggccauuauccuaagcaaauuaaugugggaacagaaaaccaaauaccacauguucucauaaguggaagcuacgcauugaauacacauggacauaaagaugggaacacuggggacugcuaaugggaggaggguggaagggggcugaggguugaaacacuaucagguacuguguucacuaccuaggugaugggaucauucauauaccagaucucagcgacauguaauuuacccauguaacaaaccugcacauguaccuccugaaccuaaaauaaaagaugaaauauauguauuaauggauacauuaauuaacaaaaauaaaauuaauuugcauaagcauauuuaaaaauucagugcucucuugaaaaucaaguuauuaaauaaugcauguaaaagcuaccaauuauuuuaugugucuuugaagucuugaaaacaauuuuccaaauaaucaguaauuguuuuauucuauuuuucugucuugcuaaaauagguagcaaaagauauggcagcggcagcaguuagaugcaucagaaaggagauccgggauuuguauguuaacauccagccuguucaagaaccuaaagaccaagcauuuggcaauggaaauggaauaaugugagacaauacuuuuuccuacacauuaguugagaacccuaaaauaguuaucuaauuaaauuaaagauuuuuaggguuucuugcuuaaguuuauaguuuuaagaaguauuuauuuauuuauuuauuuauugagguggagucucgcucuguuguccaggcuggagugccguggugugaucuuggcucacugcaagcuccgccuccuggguucaugccauucuucugccugagccuccugaguagcugggacuacaggcgcccaccaccacgcccagcuaauuuuuuguauuuuuaguagagacaggguuucaccguguuagccaggguggucuugaucuccugaccucaugauccaccugccuuggccucccaaagugcugggauuacaggcaugagccacugugcccagccucaguuuauauuuuuaaggacauuccuaccuaaaacaccaguaugauaaauuaagacaauuauucugaauuuuuucugaggauggcuugccuuuuguuaccuuguaagaucccuuucccuuauauagugaacuuaaacguuuaaucagaaguuaggcuuuaaagcuaguccuaugagaauauuuccaguugcauaaaauacgucaaaugugaaaucaguucacaaauaaauauagcaaagagcuuuuuaaaaccagacuagaggccaggcgcgguggcuuacaccuguaaucccagcacuuugggaggcugaggcgggcagaucacaaggucaagagaucaagaucauccuggccaacauggugaaacccugucucuacuaaaaauacaaaaauuagcugggcgugguggugcacaccuguagucccagcuacuugggaggcugaggcaggagaaucacuugaaccugggaggcggauguugcagugagcugagaucacaccacugcacuccagccuggcgacaaagcgagacuccaucucaaaaaaaaccagacuagaacuauuauguuaauucaguuaggaguuauagauuuaaguauuaguacaaauucuuuaacugauguuuuugaaguauaaaaguaccauuuuuggauauuuaaguuccaaauccucucauucagaauuuccauuaaaagguuuaaaguaaacgcuugcucuacuuaugauaacacuaucuaaaaaccguagaacaauaccaaagucucugcauaacgaccuuuuuauuuaagauaauucugaaacacuuuauaguacugugugccugugaaaugguaccacuuagugcuaaugacauguuaacuuguuggggggcaugguagacauuucuuaaccugugaauuagaaucuggugugacuucuccuggucaagugguaaaggauacuacuggucugauuaagauagacaauguuaaucauaccacucuauaugaagaauuuuuacuuuugcaauuuguugcccagauuuaguucugccuauuuaauagucauuguucucuuuuguuguauuugcauaaauuuggaacauuuauagcaaagguaguaauaacuuuuuuucuugcauagaauuauugcugagaccuccacuggcuguuuguuugcuggaucaucgcuugguaaacgagguaagauaaaugaaggggguccauaguucccaaugcuacugcagaauucuuuaauccaucaggauuggaauguuauagaaugauggaugaaaguuuaaaaggauguaguuaauugauucucuuuuagagucaauuacacuuucagacuuucagucuuucucccaccuuuauacuuuggaaaauuucaaaccuauggaaaaguugaaugacuaguucaacuagucauccauacaaccuucucuuagauucacuaguuaugaacauuuaguuuguuguguauauuucugagccauuucaauauaaguugcaggugccaugucucaccccugaauacugcagcauauauguccaaagagcaauaacuacauaauuauaauaccauuuuuacaccugaagaauuuguuuuauucugacacaccagauagcuucauacauaaugaauuguuuccaaaauauuauuuagagcgauguggaauuuuuuuuuuugggggggggcacauagcauuuguuucucaagucucuuuagucccucuuuuaauacacaauccucccauuaccuuuuuuguuguuguucauuucaugauacugacauuuuuaagaguccaggccauuuucucacagaguuucccacaauuuaaauuugucugauugucucaugauauauucagauuaaacauuuuuauuaagaauacuacauaggugauuuuguguacauuccacuguaucacggcagggggcacaugauguuaguuucuccuuuauuggugagguugagugugaucacuugguuaaggagguguguccugcagaucugucugccaugaaaguuccuuuuaccuuuguaauuaacuagugauccaagaaaauauuuugaggccaucugguuauccugcacccauaacagcuuucauccagugguuuuaacaucuauugaugauucuucucugcaucaguuauuacauuggugauuucagaauuuugaauguuuuugugaaagggaaauuuguuuaagguuugguauauuagagagagaagauacauacaugcauguguuuguuaauauuuaaaguuacuuuuaccaaucaggcaacuuuuaggugaacuucuaguuguuugcguggucauugauugcuuuauuccuacuuuguagcaucuuuaaaaaugcuuaccaagcugggcacagugguacacaacuguaauccuagcacuuugggaggcugaggugggaggauuacugagaccagaaguucaagacuauccugggcaauguagugagacuuugucuuugcaaaauaaauaaacaaauaaaaauguuuacccuagcuaugcuguuaagccacacuauuacuacugaauacaaaaaaaauuaggaauucuucaguuugcucaguugguaaaucuagaacuaguugggcaucaaaucugaucaagagaauaaauaaaaucaccauuuccaguugaacucacauaaaugaauucugucuaaaacugugcuauucaaaaugugguuggcagacaggcaaacuugucagcaucaacugggaguucguuagaaauacagauuuugggaccuaccucagacguauugaauuagaaucugugggaguggggcccaggaauccauuuuaacaaacuuuccagguacuuuuaauguauacugaaguuugagaaauagugaucuaaaauauguauuuggcauauacuaauuacauauuaggugcagugaggaaucaguguggauauugagccacugcaugcacuaucuacaacagucuuuagaagcaaagagaauacaaauauaaaacggagacuaggagcagacauauuacaaguaauaaguacuuagcaggcauugggagaagugugaguuuguuuguauuacugguuaccaaaugugccagguacuguguacuagggauucaaaagugacagcuaugauuccugccuccuggguuauucuggcagaggaaacagaccaguucuaugauagugguauccccaggguaccauaggaauacaggggaagcaaagggaauccuucuggggacugauugacaccaaaucugccuucugccauuuaaugguccuccaguggguucuguggguaaauagaaguuagcuggauagaaaagugagagcuaaggaggaaggacaaagaaauuugacauacaaaaguauucugggugagguggcaugcagcuuuaguccaagcuacucgggaggcugaagcaggaugauugcuugagccaggaguuugacaacagccuggccaacauggcaagauuccaucucuuaaaauuuuuuuuuuuuuaaguagccccauaugguggcucacaccuauagucccagcugcucaggaggcugaagcgggaggauugcuugauccuaagauguucaaggcugcaaugagcuaugauugcaccacugcauuccagucugggugacacagugagacccugucaccaaaaaaauaguguucuguguuugagcaagcaacugcaaguggauaauagaucuggguaagggaauggagagagaugacaacagaaauaucgacaggccagauucugaaaggcuauagguuauaucuaggaauuuacauuucauccugaaauauagagcauuuaaugagggaugugauaugagaguuuuugaaagauaauucagagaaguagaagaaagccauauuagaggcaggaagauaagaguucauuacaauucaggucagaaugguaagggccugugccaaggaaugcugggcuagagaggugaauacugauaaaaggguauuugcaaaggugaauggacaauauuugcuggccaguuggguaugggaagugaggaaggcaguguaaaguaugaccuucuagaugucuggcuuagguaacuggauauauuuaccucuugugaauauacgggguagaguuaguuugccaggguagaugauaauuuuagauaugcugcguugagauugauuguaaagggaucauuacuuuaucaguaauacauggaauuuuuuuaccaggccugaaaaaaauuuucuaauguucugucagcauuuuuuucucacuuugucacaugaagcaacuuguacuuuaaaguaguuuuuggauaaaacacuuguagaguacacaguacuuauuuuuagacuuaggguguuaggagagaauagaggagagagcaacaugccugcugagauugacugacuccuccugguauccuuccuugguuccuaucaugcacaucagucaaaugagauguuagcaaaugcaaaaguaacuuguggucuucucaauccagcuugucuauauauuaaggaucucagagagaaugucaugaccucuauuauccagauccccuuucauuucugauuuaaauuaacuagaaaauuacuggauuuaggggcugggugugguggcguaugccuguaaucccagcacuuugggaggccaaggugagcagaucacuugaacccaaguguucaagaccaaucugggcaacauggcgaaacccugucucuacaaaaaauacaaaaauuacuugagcaugguggcaugugcuuguagucccagcuacucuaaaugcugaggcaggaggcgggaggaucacuugagcccaggagguguagguugcagugagcugagaucacaccacugcacuccagccuaggugauagagcaagacccugucucaaaaaaauaaaacaaaacuaccagaccuugaauccuaauuucuuaggguuaucaccagaaggaacauuggcugcuugucaauaccaccauaggugguagaggcaggaaguuguaacuagagaugucuuuaucauugucucaguuacuauaaccauuuugaucuuaguuuccuuauauguugagcaagaagauuagccuggagaaucuccaaaauccuucuaacuauaacauucuucaauuuuauuuuaaaacggugagauuuuguuuugucugagaaaaucucgcuguuuuagacugaggcaguguguuaugauagagagcacuaaacagagagugagaagaccuaaauuuuagucccauguccugucauuaucaugcauagugacucugggcuuuccuuaucugaaaaaugauauuggaccgugauugugaucuauguuuaaggaucccuuccaacuuuaagugauugcauuauagacagaauguguuuugucuuuccauuguugcguaucugugugaucuuucauuacucuuaucuuacaguuaguuauauucuuuacuaugggagcaaaauaaucugcugaaaugaauugugccucugguuaaucaaucuuuauuuccuuuguauaguaauugccucacuuauagcaagcaccuuccuucccucccucaguguaugugguaauucagggcaucucucuguuuuuguuuuuguuuuuuuuuuucgagacggaaucuugcuuugucgcccaggcuagagugcaauggagcaaucucggcucacugcaaccuccgccuccuguguucaagcaauccucccaccgcagccucccaaguagcugggauuacaagugugugccaccaugccggcuaauuuuuguauuuuugguagagacgggguuucacaguguuggccaggcugguuucgaacuccugaccucaaguaaucugccucccaaagugcugggauuacaggcgugagccaccgugccggccucauggcaucucucugauguccuaaaacaaguccuugagaccuuuguuuaaaaacauccaaaaugugagaagauuggcaauuaguuagaaaagcauuaagauuucagaagaaauugagauuuugcuuuugguguguauaauacuaauaagcaagauucucauauuuugcuuauuauguucaguugcuacagacugcuaguaauggcaguuaguaauguagaaccauucaugccauuacuaucaagguggcuggguggaaaggaaugugaauggcucugaggaauucuuugcuacauggcagaaaacuuuaguguaccugcuguuuucuaguacuacaaagccggaaguucuuuccuuuuccuuuacauccuccaucccuauuuuagcuguuuuucaaggacucacuuaaguccuucaugcuuuaugaaaccucaaauuauucuagaaccuauauaaucucuuacuuuucugaacuccugucggguauauaguuuauaucacagaguuagcacuuaauuauccucuaauuuucuaauauauguguauuuuaaaugccuccuuagcaaaggaucugguuucuauuacuuagcaugguagauaaauaguggguaugcaauacuccuacagguugagcauuccuaauccaaaaaucuaaaaucugaaauauuccaaaaucagaagcuuuucaaguggcaguaugccacaaaacuuuguuuuaugcacaaaaucauuuaaaacauuguauaagguugccuucaagcuauguguguaagguauguaugaacauuaaugaauuucagguuuguuuauuuauuuauugagaugggagucuuacucucuugcccagucuagaguggaguggugcaaucuuggcuuacugcaaccucugccuccugagcucuagagagcuucccaccacagacucccgaguagcuggaauuauuagugugcgccaccaugccuggcuauuuuaguagagacagaguuucaccauguuggccaggcuagucuugaacuccuguacucaagcuaucugccugccuccaccucccaaaaugcugggauuacaggcgugagccacugugcuuagcugaauuucauguguagacuugggucgcauccccaagcuaucucauuauguauauccaaauauuccuuuuuuuuuuuuuuuuuuuuuuuaauuuugagacagaaucucaugugucacccaggcuggagugcaguggcacgaucucagcucaccauaaccuccgccucccgaguucaagagauuguugucccucagccuccugaguagcuaaaacuacaaucgcacacaaccaugccuggcuaauuuuuguauuuuuaguauuucaccauguuggccagucuggucucgaauuccucaucucaagugaucugcccgccuuggccucccaaagugcugggauuauaggcaugagccaccaugccuggcucaaauauuccaaaauuuuuuaaaaauccaaaaucugaaaccuucuagucccaagcauuucagauaaggguuacucaaccuguguuauuauuaauagcuuuuuauguacuagucuggguaauagaugcuuuauaaauauuaucucuaauuucuauaacaacuuugcagcauaauuauuaucaucuccaucuucuagaagaggaaauggcaguggcuaacaagaagucaagauucacaaaacauguuucaaaccauuucauucagucacguaaauacuuggccaauugauaauauaaagaggguaauuuauuauauuauuaugacuacuauaaagaaaaauagaguuucugggcaugauggcucaugccuggaauucuaacacuuugggaggcugaagcgggaggaucacuugaguucaggaguuugagaccaguccaggcaacguagugagaccuagucgcuaaaaaaaaaaaagaaaaaaaaaaaaaagaaaaaacaagaaaaaacaagaaaaacaaagaaaaauagaguuaaaauucuacaauuuccacuuuggggaaaauuuuaucauauauaaucaaguaaauuugcaaauauaaaauagaaacaaaacuaaccacauuuucauuuuucauaagacguuuucauuugcagccaagaauuuuuuaguugagaguaaauaccuuaaaauaauaauguggcauucuacuacuugugacagacuuacuuuguauucaguguuguaccaaagauuuggaauauguauggagagauagggaauagggcaagaggguaaauauucugacuuauauuuaaaauaagcgaauaccuguucaaaucuuagaggaaauaaaacucuaaaauauuuuaucugauaauguuauaugcucuuuuuuuacauaaaauguaauuuccugacuuuaaaaaaauucuuuaauuuuuuuuuuuuuuuuggcagaguccugcucugucacccaggauggaguacaguggcacaaucucagcucacugcaaccuccaccucccagguucaagugauucucuugccucagccuccugagcagcugggauuacaggcaugcaccaccaugcccagcuaaauuuuguauuuuuaguagagaugggguuuugccauuuuggccaggcuggccucaaacuccugaccucaagugauccauccgccucagccucccaaagcauugggauuacaggcgugagccaccgcacugagccaaauucuuuaauucugauggaauuaccugcagacuaauuguaacacgcaugcuuuucuaggauuugggaggggaauuuguuuguuugguagauggcgucuagcuauguugcccaggccagccuugaauuccuggccucaagcaauucuuacaccuuagcuucucaaaguccugggauuacaggcaugagccaccaugccuggcugcaaguuuuaauuuuugaaauugaggcauagcauuauagggucauaacuuaacuuauaaacuggcuuuauaaauuaguacauuuuaaauaggacuaaugaagccuauauuuuccuccacuaguauauuuaaagguauaagacuuguguaucccaaacacucagaauauuaaauaacuaaagaucuuauucuaaaaggugcauugaguggguuuuugaggccuaaaaauuguauaccagugcuaauugggauauaccaaacuuuuugucucuuaguaauuaguuuuguuuuguuuuguuuuguuuuguuuuaauguugugcuuaucuuaagguguaaaugcagacaaaguuggaauugaagcugccgaaaugcuauuagcaaaucuuagacauggugguacuguggaugaguaucugcaagaccagguaaugacacauuuagguuaaaaacccucuaaccuguuagauuugaauaugugguagauugaauaucaauuuaaauaauugacuuucagacacuaauuagcaaguccuacuucaauaauuuaaaaaaauauucugggauuugcauuccucaaauuucagcccucauuuuacuuuacgugucuacaguguuuugcgcaauugaccacuccuuccuuuuugaaguauuuucuuuccuugguuucugaaauacuguuaucuuccuaucucacuggccauacauucuagucuccuuugcuaguuuauuaugguuuucaucuucucaacaacaauuuuuuuuuuuuugguggagacagagucuugcuauguugcccaggcuggucucgaacuccugguuucaagugauccuccugcuucagcuuccugaguagcuaggccuacaggcacaugcugucaugccuaccuaauuuaaaacuuuuuuuuguuuuaauuuuuauagagacgaggucucaguauguugaccaggcuaauccuaaacucuggcacccaagugauccucccacuuuggccucccagaguuuugagauuaagggccaugagccacugugccuggccaacuucuaaauuuugaugagccccuggacuuuggcuuauacuuguuuucuuuuucuguaguugcucccucucuuaguuuguccagucucauggcuuaaguaccgucuuuaugcugacaacucccaaauuuauauccgaagcccaggccuuucucuuuaacuccuugcucauaauauccccuaugccugucaacaccuccacuuggacgugucacagaccucucaaacuuagcacguugcauggcgcgguggcucaagccuguaaucccagcacuuugggaggccgaggugggcggaucacgaggucaagagaucgagaccauccuggcuaacacggugaaaccccgucucuacugaaaaaauacaaaaaauuagccgggcgugguggcgggugccuguagucguagcuacucgggaggcugaggcaggagaaaggcgugaaccugggaggcggaguuuugcagugagccgagaaugcgccacugcacuccagccuggguggcagagcaagacuccgucucaaaaaaaaaaaaaaaaaaaaaacgaaaaacaaaaaaaacuuagcacguucacucacagugagaagugauacugaauauuuccaaauauuguuuuuauggucuguuaucuuuauagauuuuccuuucuaccauacuuuugucuccuuagucccaaaucaguaguguccacauuuagaaauauaguccucgagauuucuugaccuguuucuuaagacaguuucuguuauuucuagucuccuccuccuugcccaggucuacuuuaaacucccaguaaagucccaguauuagucugucuauucagcuguuaaaauguaauuuaagagaguagaauaaacaucauauuauauauaccaacuuguagagauaguuggucuaaguauauuacuguucuguauuuuacuuguaaauauuaauuuaaaaaauuauauguugagagcugcuaccaagccuuuuuguacuacucacagacuuaggguaacauagguuuucugucaucuucugaguaugucuggaaaccuaaagaaauagaaauucuguuuuagcaauuuuuauuucuaguaguauuuuuauuaugggcagcaguggaauuauaaugccaaauauuaauaaaugugugagguuuuucuuuguucuuuuuuaaauagcugauuguuuucauggcauuagccaauggaguuuccagaauaaaaacaggaccaguuacacuccauacgcaaaccgcgauacauuuugcugaacaaauagcaaaggugaguauucuaucagaaagggaaauugauauuuugauuuuuauuuuagccaauuuuggguuaaauuuuaauaggaaacuuaauaguaaucauaauugcuaucacuguuuccugugugacaggcacugagcuaauuuagcaauuuaucuaaacugucuacucagcauaacuauuguagguggcuauuuauuauuauucccauuauaaauaugaguaaagugaggcagagagauucauuaaauuguucaaggccacauggauuuuuaguggcagagcugagcuuugagcaaaccugggaaagcauacuucaaaacccauguuauaaucacugugugguacugccuuacagaguaaguaaagauguuuuguugugaacuaugauaucaaaucacaagggauucauaguuggcuauaaaaaaauuuauauaaaauuuuagacauuuuauuuucuugauucuauugguaaaauagaauauuuguugaaacuaauauucacuguccucugaaauuuaguagaguugacguacaguuuuuaaugaagaaggauuuaucauuauaugagcucauauucauaccuuuccuacaggauucuuuuuuuuuuuuuuuuugagacagggucucacacuguugcccaggcuggagugcaauggcaugaucucggcucacugcaacuucugccucccaggcucaagugauucuccugccuuagccucccaaguagcuaggauuacaggcacaugccaccacaccuggcuaauuuuucuaauuuuuguagagaugggguuuugccauguugcuuaggcuggucucaaacuucauagcucaggugaucuguccaccuuggccucccaaaguguugugauuauaggugugagccacugugccuggccuggauuguuaauuuaaagaaacaauagguauauuucaucaugaaacuaauguaauuucuuuauaggaaauagaggggaaaagccuucucauaauuuccccuugccgguaaaaccacuguugacauuuagguguuuuccucuucuccuaaaucguuucucuuugcauuuuuugcaguuaaugcauacaacuucauuucuugcuuauuucaguaacauguagcauauuucccauuuugcuuauucuuuauaaaguaauuuuauaaagaaauauaaaauuuguaacaauuuuauaagggaaguugcuaaucuuaagcauuuuuauuauuauuguuuuugagacagggucucacacuguugcccaggcuggauugcaguggcacaaaccuccugggcucucaaaugauccucccaccgcagccucccaaguagcuggggcuacgggagugugccaccacaccuggcuaauuuuuugauguuuuguagagauggagucuugccacauucccaggcuggucuugaacuccugggcucaagcaguccucugaccucaaucucccaaagcgcuaggauuacagguguaagccagcaugcccagcccuagucuuaagcauuuuuuaaagugacaaaaguaacauauauuaauuuaaaaaauuaaucauuacagaagugucccauacacaaaaccacuguugcugcccuacuccuauuuguaugaugauccuuuuucuuuucuuuuuuuuuuucuuaagauagagucuugcucuguuagcccagguuggagugcaguggcacagucuuggcucacagcaaccucugccucccagguucaagcaauucucaugccucagccuccagaguagcugggauuacaggcgugugccaccauguccagcuaauuuuuguacuuuuuagcagagacaggguuucacuguguuagcuaggcuggucucaaacuccuggccuuacgcgaucugccugccuuggccucccaaagugcagggauuacaggcaugagccaccgcgccuggccuuucuuuuuuuuuuuucuuuuaagagacaggggcuugcucuguugcccaggcuagauuacaauggcaguaucauagcucacaguagccccgaacuccugggcucaagugauccuuucaccucagccuaucaaguagcuaggacugcagcugugcaccaccacacccugcuaauuuuuuuuuuguuuuuguuuuuguuuuuugagagacgggaucucccuguguugcccaggcugguccugaacuccugggcucaagugauccucccaccucagcuucccaaaugccgugauuacagcugugagcuacugugcccaguuugauucuuaauuauguauacuuuuaauuguuauuaagaaacauagauaaguuuuuguuaaauuguaggaaagacugaugggaauuaaaggcaaauuguauuugaugucaagaguguuaacucuauuuuuuuuguuacucuacuuaugcuguauuuauaacuauuacuugucugucucuccuuauagauugaucuccuuaauagcagagaucagguuuuauucauuauauucuuuacuuuucacaguacuuuacauauaguagaugcuuacuuguuauuugaaauguauacauaacggaaagugcuaugaaccuguguauagcuuguaucuuggucagcuuuguuguguauaacugggugacuuggggcaaguuucuuaucuuucuuugucucaaugcaaauaguuaucuguaaaaucagacuuaagcuagauaggccugcuaugcuccuuucaggucuacauauuuguaguuuuaaguagguuuauguauaggcuagaaaugauuuucauagcugcuacguguguuucauauuuacauaaugcuuguaauuugaaaaauauauaaacgcaugcauauauuacuaauuaauuaauaugguuaccuagcucagaauucagcauuuauucauucaacaguaauuucaaguguccacucugugucaguacauuaccauguaaugcugaaagugaaagaauuuuuaaacauuacuauucauucaguaaggcccccaagugaugguuuucaaauugugcuuccaagaauccuaagauuuuaggcauauuugaaauccuuuugccacaaacuuaaccuauuuaauuguuuugauuuuuuuuuuuaagacguugaugggaguugugaggagucuuccuguguugcccaggccagccuccugaacugaacucaaaugauccuuccaccucagaauagcugggauuauaggugugcaccacugcaccuggcuaguuguuuugauucuaaauuuaguuuuguuaaaaugaaucacauuugcuuuaaaaauaaugauguuuucaaaauacagugauauaggccaggcacaaugacucaugccuguaaucccagcgcuuuaggaagcugacgcaggaggaucacuucagccuaggaguuugagccugggcaacaaagugagacccugccuauacaacagaauuaaaaauuagccaggcaugguggcaugugccuguggucccagcuacacuggaggcugaggcaggaggaucccuugaacccaggaaguugaggcugcagugagccguguucaugccacugcacugcagccugggugacagagcaagacucugucucaaaaacagaacaaaaacaaaagcaaaauacaaugauacagguaaaauauuucaaagccaacuuuaguuacuaagugaaaaaugugauguuaagcccaguacauuaaagaugaaggaagauguuaaucaccaccaccaccccuccuccccacauaccuucucugaacuggaucuuuugaacgauauauauagggaacuaaauuagcaagaaaaaauguaaagaaauuaaaggguaauuugugacuugacaagauaaaaguagaaauguuucagaaaaauuuuagggcauagggaauacaguugcauuaaaauuaccauuugagguuucaaaauuguuauuugccuaagcuguacaucugagcuuucugauucagugugcguggaaggggcccaggcauauauauuuggacaaaacucacagguauguauaccucugaagaagaaccaugguuguacaaugaaauguguuaucuugaggcuauuaaguuucuuucucaucaaucauuugaucuuugugucucuguagguuuuucaauaaaaugggcuugacauuaacucucugccuacauaaguuggaguugugggcucuuuccuccaucucucuucguauuacuuauauacuccucuucugauuucaggcuaaauuuauugugaagaaaucagaagaugaagaagacgccgcuaaagauacuuauauuauugaaugccaaggaauugggaugacaaauccaaaucuauagaguauuugccucuuaaaugauaccucauugauauauugcacuauuucauaaauacuauaaaauaaugacuaggaaguaacuuauuaaaggcuaugacuuaaauuugaagaugaaguacaguguucuagguuugcugagaaggcuucauuaaauuaaucucacuuugaauaucuccugagagauggacaaugaaauaucaguugguggauaugugugauagcugauuucaauauugaaguauugaaauaaaauauucuuuacaccugaaguaaauacauuuuucuuuuuuauguaauuaauuaaaucagggauauagauuugaucuguaauuuggguauaauucuaaucuuugcugaaaucacaucucaaguauaaugaggcaacuuuaugcaaauguacuuguugugacaacaauaacauuuuccuuuuuuuuuuuuuuuuuugagacagucucguucugucacccaggcuggggugcuguggugugaucuuggcucacugcaaccucugccucccggguucaagcaauucuacugccucagcuuccugaguaguugguauuacaccaccaugcccagcuaauuuuuguauuuuuaguagagacaggguuucaccauauuggucaggcugguuucgaacuccugaccucgugaucugcccgccucggccucccaaaguggugggauuacaggcgugagccagugcacccggcaacaauaacauuuaauaggcauugucucauucuaaugauauauaccuucuaccuagugggcacuuuguacauauuuauuuuuuauuuuauuuauucauuuuuuuugagacagagucucacucugucaccaaguuggagugcaguggcacaaucucagcucacugcaaccuccgccuuccagguugaagugauucuccagccucagccucccgaguagcugggacuccaggcacguaccaccauacccagauaauuuuugcauuuuuaguagagacgggguuucaccauguuggcuaggauggucuccaucuccugaccucgugauccgcccaccuuggccucccaaagugcugggauuacaggcaugagccaccacagcuggucguaaauauuuuuugaauuugaaucuguuuuggaagccaaauauguuuuggaagccaaacaauuaagagaaguaaaauuuuaacccuaguagguuucgcagauucauccccagauauguuuuuguuuggcuuguguuauuaacaaauaaaugagugucuuucaaauggaa

SEQ ID NO: 191334 - RNA, 149543 nt, Homo sapiens
acuaagaccgcaaggcauucauuuccuccuacgguggaugcggacgccgggaggaggagagccccagagagaggagcugggagcggaggcgcaggcaaugcucagcccuggauguagcugagaggcugggagaagagacgaccgcuggagaccgagcggcguggggaagaccuaggggggugggugggggaagcagacaggagaacacucgaaaucaagcgcuuuacagauuauuuuauuuuguauagagaacacguagcgacuccgaagaucagccccaaugaacaugucaguguugacuuuacaagaauaugaauucgaaaagcaguucaacgagaaugaagccauccaauggaugcaggaaaacugguacgugaugcuuucgccugauacuguucccgggagcccugcgcgucuucccggagugccuuaaugucgguauucccugccugggcgugaauggagcgaugaaucgcgggcagccagcugaucgcugaguucucgggucucccgggugcaggagacgcuggggggggggggguacaugaagcgcgaggucugugggugccccugugugaaccgcggcuacauaggcaucuuuuauauagauuauauaacacagaacauaugugugugcacagggugaugucugcgcgacagggaaggcgggagagaugccacaguccagaucgccuaccugugcuccccuccccucccccgguuuucaucuagauuuggguuuucucgcuuggccucucccgcaaccggagugugaaaggcaguggagggaggaccuugucuccuguugccuuuaacccucucccgcccgccgcccuuggcccugguccucgcugucucuccaucccucguguccuuccuuucuccuugcagcgcuccuacuucaccguccuccucugucugccgcuccucaggcggaugcccccuuuuuaguaccccuuuccccacgcgguucccuuuccgguuucauagagagaccgggugggagggaggaggggacaaugaaaacaguaauaaaugaaugaacccgagcgaguggagccacgccauuauuaaguuucuguuuuacggaaacgccuuuuggacacacuucuaauucugugcguagcugcugauuggaguucaggcacacagauuaaaagccccuccgucugcagaguccuuaggggcucuucccuaggaaacuaauaaucagggaaaacaccuuucuuguuuacuguaguccccccgccagaccuuuugaaaaucccugugugggaggcgauccagugucaccuugcaauauuuaacagaggagggugugcucaucucgcuucuuguagacaggguuguggcagaggcauuccucuccuccccuuaacuucgggucuggcgaucuguaaaguucaagcccaacgcaccccggagcuaggcaaggggccggcagcccgggggauggcuugaccggggagggucgggccgcagggucucccgggagccgggggauuccgcccgccgcgugcgcgagcgcgcgugccccgcgcccucccgccugcccucuucaacuggaaaccagaaacgccggcgcgccuguggccugggcggguuggugcaguaggagcuggugccacggggccgcagcugcgaaaaggggguuucaacuuccuguccuccagcccccuggagucgccggccagugucgggaggcccggccgccgcuuccuucuccucccgcccggccggagcgcgcccacucccagcuucccgcgggcugguccgggccccaauggccauuugcggcggcugccgggcggagcccgccuccugggccgcgcgcaccggcggggcaggccugcuuggggugagcugcggcguggcugguggcggcggugggcuaggggcccaagggccgcgucuggcccgagccggagccuaagaggcggggacgcgggccgcucggaaggacuggaagugcagcagccacacaggcacagggcuggugcccucccgggccgcugaggccagggggugcagggguggguccggaaggagguuggacacuaagggucgagaccgcagauagaccucggcguuucggggcagccgaggccccucgagccccaccgcccgggguccuucucuggaugcacuuccuccucccgcuuaggggguggugcuggaggcggggagggggcgguggccggagccggcgggcgccggaaccgcgcugcuggcuagccccgggcccgggucuucuccgcacauguuugucauauccuccagccggccuguucgggcccacaguccucccgcauuagccuguguggucaguguggucagcauuugcuucugugccgaaucucugacuugcugcguccugguuuaaccugcucuuccggaguccgcuuucccucgcuuugcuggcugaccccauucacuguacgcccgccauuccuagcccacugcagucgauacugccucuuauuuacuuguugcuuuuucucugaggccacuuccuaggccugcuucagguaccauuucccgccucuucucuccauucacucaguacugagccagacaggucucagcccucgugggacugaaaaugacaaaaaugugccaacguaucuacuccuguuagguucugaccacuguuuccuccuaguucuuuaucuguaccuuucuucuggcaauauccuuuacuguuauauacaugguuauuaacuuacagaccaucagcucuucagguuacgguucuugucaucccacucuugauucugcaaagcaccuagcagagugcuuugcauaaggcacauucuugagaaaauguccagugaguugaaauggugauuggugcccauuuuauugccagcacuacucguuaauacccgaagguuaacaggcuagaacuugcauaccguggcagagucacaucuugggauuuuucccuuccuggcuucugcucucuguugauguuauguucuuagauugcuuauugcagucaaagaacccugcuggcuguuaccccucccuugcaacucuuccugacccuaauugucuuacuuucauguuuuuuuuuaaaugccagauuuugugcauuucucccaauaucccagggugcccaauuuuaucucuccucccuccccaaaaacuguacagccaaaaagacuuuaaacacuuuuuaaaauuuaauuuuauuagccgggugugguggcuccugccuguaaucccagcacuuugggaggcugagguggguggauuaccugacgacaggaguucgagaccagccaggccaauauggugaaaccccaucucuacuaaaaauacaaaaaaauuagccgagcgugguggcgggugccuguaaucccagcuacucgggagguugaggcaggagaauugcuugaacccgggagguucaaauuaaagcuuuuaguuuuuauuuuuaauagaauccagcuaaugcaggacaaaaagucuugaaccagauuuucuuuucacucccuuuuuaauaggagaagggaacuccauaaccaaggcuuagacccucuugaggagagaggaacuugaggaaaccauaaaaucuuaccuuuuucagacucauuaacuuaaaaugguuugaaauagcuucuggaggaaaaacaugauauagugaagcuucuacucugucuuuugggaauuuaugguuguccuuauaaaucucuucuuaguaacaggcaaaacuuguuaauuuagagaauuaaaacauccucucucaaaagugaacuacauuggcuuuugaagaacugugagaauggccaggaguaguauuuugccaguaugcugccuuugcuaacuagcaucauuuaagaggaccuaaaauaagaauacuuuauuaaacauacgcuauaauccauacuuacuaaccauagcgcaaauuaauguuaacauacccuauaauccauacuuacuaaccauagcacguguuaauggaauggggcccgacuuuuggaguagcauuuguauaaacccuaaaggguucaacugaggcuaguuuucaaguuuauugcugcuuuaaugaaucauuaaccucauacucauuggccuagccaugaaaguaaauacugcagacuuuuuuuacuuugcuagcaaaaaguuucauauauaauagguuagaauagcaauugaaaugcaaaguaauaaguguauucccuuguagaaucauccugggccucaucuugaaacuacauguccagugaaaaauauccugucugguuauauuaucuggucaaugagaguuuauuacaugagguagagaaaaaugucugcucauagguccaaauaggaguuuugaauucuaauuuucacugaaaaguccuugcaauuuuacaacauugaaaauagagacauuuugcucuuuuaugagaugucuggccuuuaccuguuuuucucacuaagagcugacuuaaguuggaagugcugcuagccagggagcaaaaucaccuggugauugcuaaggcgacauauaauucauugagugagaagggaagcugggcucucucugccuucucuuucagcagccugccagguuugugcuaacagcaguggaugcuaguugcuccaguuguaauugucuagccaaugaugauuaucuucugaugucggcugacacggugcccaccaauaggaaagcaggaggccugugcugacugcuguaacauuauguaugugaggugacgucuucaaagggcuugccuagaacuucaugaaacccucccccucuccuggcauucuccacacauccagccuuucaaagcuuuauauauuuuucugacuuuucuccccacucacucccuuggugguguaaaaggguuuacuuguuuuaacauuuuguauucuguauuauagagucuauaagauaguauaggaauuuuaagaauuaaaugcuguucagcugaggaagccuuuuuauucacaaauuuguuuuuaccaaagguaaaaauggagugaaacauuuuauuuuauuuuguuuuauuuuugagacagggucucacucuguugcccaggcuggagugcaguggcacaaucuuggcucacugcaaccucugccuccggguuccagugauucuuaugucucaaccucccaagcagcugggauuacaggugccugccaugacaccaagcuaauuuuuguauuuuuaguagagaugggaauucaccguguuggucagguuggucuugaacuccugaccucaaguaauccgcccaccucggccuccgaaagugcugagauaacaggcuugagccacugcaaccggccgugaaacauuuuaaaaggaguuguacaucuauaucuuuuuuguaggugaaguuuggaaaguaacacgauguacaauuucaugauuaaagaacauaaaaagcacuaaaaaccuguguuagcauuuaacucaaauauagcagcauaaaaaauauagcagcauaauguuaaugaaacuguucaaaugcagacauaguauuuggcuguuguuuuucauuuagugaggauugcuuugaauugcuuccugaagucuuccuugcaaccuucuacauucauuuguaagaaaaauggcuggaaaacagugcaucugugacuauggaacagaguaggccagaguuucauuucaucauuaacauugcagcaacaaauuuggucagcucuguaggaauauagugugucuauauuguacucaugucacuugcuguuuauuuugagguaucacaguucauauugauuuaggauuaaaacuugugugaggaucauaacaugacauucaauaauuuuuagaaagcacugggauguaggcauauguacuagguuaagagugagaagaaugagaaaauacauagagaaaaaacguguaaucugugugggguccuagaaaauaauguaaaguugugcuggagcuuugauaugaacuuucauguaucuuuuaauaaauuauaaauauucaugcaauucuuguuuaggauuccaaaggaugaaagccagcuuaaugcaaaauauuuuaugauuauauuauccaucuguguauuuguacuaguuauaauuagugcuuaaaauuuuuucaugaagucuuuuucacauuggaaguaaaauuuugugaucuucagaggauugccuguugcuuuuuuguuugagggugauucuaaaugugucaaaguguauaacauuggaacuuaaugaaacuuuucaaaugcagacauaguauuucacuguuguuuuuccuuuagugaggauugcuuuaaauuucuuccugaaaucuuccucguaaccuucugcgugcauuuguaagaaaaauggcuggaaacuucaaagucaacuuauuccauaucuaagaguugccuuauauacuuccuugaaagaagaaucuuucuuuuucuuuuuuuucuuucuuucuuuuuuuuuuuuuucuuggauggaguuuugcccuuguugcccaggcuggagugcaauuguuccaucucggcuuacugcaaccucugccuccuggguucaagugauucuccuaccucaaccuccugaguagcuggguuuacaggcaugcgccacuacacccggcugauuuuuuuguauuuaguagaaacgaguuuucaccauguuagucaggcuggucucgaacuccugacuucaggugauccaccuaccucggccucccaaagugcugggauuacaggugugagccaccaugcccggccagaggaaucuuucagcuuagauaguggaagaguuaugagggggacggagguuuugaaauacuuagggggauauacaauaaccaucuaaucaauuuucuuuuucuuuucuuuuuuuugagccuggucuuggcucacugcaaccucugcuuccuggguucaagccucagccuccugaguaggugggauuacaggugcccggccccccaucuaaucagucuuuagacaacaaaguaaaaugaguguggcaccauucuggcaauucaggaauuuaucuuggcuuaagugaucugaaauauuucagguccaaguauuuuauuuucugaaaugaguuaaccaaacauugucuuaaugauuaacuuaauuuuucacauauggacacaggugagccaaacuguccuuuauuaauaggaaccagacaucauucuacaaaguuugccucagcccucccuuuacucuuuauguagcucacauccacccgcucccauuuacuucucauuuaucuuuuuuaggaggguuuagggaaaguuaccuguaccacauaugucauuucuguugauaacccuagguaaucugagugaaacuaugacuuggcuauauuguaauguuaaaacucauaacuucauuccuuuauccagauucugauuguacauguauucaggcagguacaaauguuggcauaguuauugagguuucugagaacuuuaaaaaaacccagcaucucuaauuauauuuacccuccaauaauuuauuuuagagauacauggguccuuuuuuaaaaaguauuguaugggucggguaugguggcucacaccuguaaucccagcacuuugggaggccgaggcaggcggaucacuugaugucaggaguucgagaccagccuggucaaaguggcgaaacccugucucuacaaaaaauacaaaaauuagcuggucauggugguacgcaccuguagucccagcuacucuggaugcugagacacaagaauggcaugaaccuggaggcggagguugcagugagcugagauuaugccacugcaaugcagcuugggcaacagagcaaaacugugucucaaaaaaaacacaaaaauugaaaaaaaaaaaaguggccgggcaugguggcuuauacuuguaaucccagcgcugugggaggcugagguggguggaucacuugaggucaggaguucgagaccagccuggccaacauggugaaacccuauuucuacuaaaacuacaaaaauuagccgggcgugguggcgggcgccuguaaucccagcuacuccaggggcugaggcaggagaaucgcuugaacccaggaggccgagguuccagugaggcgagauugcaccauugcacuccagccugggcaacagagugagacuccgucucaaaacaaaacaaaacaaaaaaaguauugcccaagaguaaagaauaugaauuuguaauuuuaaguugguugugcaauaguuaucccaaagcuuggaaccaugucagucaucuaaggucaagccuacacauuuaucaugauuccuuucugcauugaguguuugcgacuuuuaguuuuaagguuccuauuacuaggaaacccuuugcugaguuaguugcccacugugaacuuacugagauuuaacuuuaagucuuuacuuuguacaaaaaaaaaguacaggagaaaaaagacuuacacuuaccuuugcuaagauaaauuugcugagauaaauuagacaugcugauuguaaguaguuuugcuagaaaaucacucauaguuuuguaauacuuuuauuuacagggauucauauuucaguuuuuuuuuucuugcuaaaacuuuuauagaagaguuccuaguugugauauaaggaaaguuuuauugaugaaauauauuuuggggagggagaucuaccuccucaaaacacacaugagguuuauaauccaauuuuuuuuuuuuuuugagauggagucuggcucugucgcccaggcuggagugcaguggcaugaucucggcucagugcaagcucugccucccggguucacaccauucuccugccucagccucccgaguagcugggacuacaggcgcccacaaucacaccuggcuaauuuuucuauuuuuaguagagacgggguuucacuguguuagccaggauggucucgaucuccugaccuugugaucugcccaccucggccucccaaagugcugggauuacaggugugagccacugcgccaagcccuauaauccuauuuaaagugaaacaaguaaacaaguauaacuucauuuucuucuuuucucucucucucucucuuuuuuuuuuuuuuuuuuuuuugagacagagucuugcugugucucccagucugagugcaguggcaugaucuuggcuguuaguucacugcaacucccaccuucuggguucaagcaguuccccugccucagccuucugaguagcugggauuacaggcaccugccaccacaccugccuaauuuuuguauuuuuagcagagacgggguuucaccauguuggccaggcuggucucgaacuccuggccucaagugauccgcccaccucggccucccaaaguuuugggacuacaggcgugagccacugcgucuagccucucucucucuuuuuuaaauagagacagggucuugcuugucacccaggcuggagugcagugucacaaucauacuucacuguaaucucaaacuccgcuucuugguccaagcgaucuucuugccucagccucccaaguagcugggauuacaggcacgcaccaccuugcccaacuaauuuuuuuauuguauuggagagaugggggucuugcuauguugcccaggcugguuuugaacuguuggccucaagugauccucccaucucagcuucccaaagugcuaggauuacagguguaaaccaccacaccuagacagcaggguagauuuucuucauucaggagcaaugauacuaacaguuaauacaugguuaccugauugcaggcauccuuuuauaauguuuuacuuuuuuuuuuuuuuuugagaccgaguuucacucuuguugcccaguggagugcaauggcaugaucucgacucaccgcaaccucugccucccagguucaagcaacucuccgccucagccucuugaguagcugggauuacaggcauacgccaccaugccuggcuaauuuuuuuuguauauuuaguagagaugggguuucuuccauguuggucaggcuggucucgaacuccuaaccucaggugauccucccaccucggccucccaaagugcugggauaacagucaugagccaccgcgccuggccaauguuuuacguacuuuaacuguuaaacccuugcagccacccuuuaugaucuuuugcacgauggacaacucaggaaggggaguugggauuugcauguaggaaucagaaaaggaaaacuggguuccaggcuugaauaaggcuuggauggcuggugugaugaugaggggugugucacaaggccccaaucauccucuuauuugaauauuaauauaauauucaaucagaaaaacaaugcacuugaaaacuuggcugcacuggaaacgugucagguaucugugguuuuagucaaugaucucacaaaugucucuuuuguuaauaauuuucacuggguggauccugaauacuuaaggccagaauaaagcuuuggccuaugaaauauuuacugucugcucugugauauuaauuucuugcacucagcuugguucuagacccugggaauuuguguuuccaucugaucugcagccagacuuucuucccagcagguuuuaguguagcuacuuguaaauagccacccacuguugacaguaaaauaaaaauauguggguuggggauaucccuauucuugaaggucagcuccuacaaugugaagaaucacagaauaccuuuuguuucauuuuaguagcuuuaaauucuuuuccugauucuaagguaagaaauaguuacaggaaaagaaaugaaaugaaaacauuaagaaguauaaagaugucggaaaggaaacaccuuuaauucuuuuccagaggcugccacuguuauuuugcuccauuuccuucagccuuguuuccagguuuuuuaguaugccuuagaccauucaguaccuaaacugugacagccuggguucccuacuaugugccagggacugcacugaacagauuuacguacuaucacauuacaauuuuuuuuuuuuuuuuuuagauggaguuucauuccuguuacccaggcuggagugcaguggugugaucuuggcucacugcaaccucugccuccuggguucaagugauccuccugccucagccucccuauuaguugggacuacacaugcgugccaccaugccaggcuaauuuuuuguauuuuuaguagagacgggguuucacuggucucaaacuccugaucucaggugauccgccugccucggccucccaagcaauuuuuuuuuuuuuuucauuuugcugaggucuaacuugagaagccuucauuuguccaagcaguuagguuauaugcuuuuucucugcuuacuguuugcuacauaguaacucuugugaagagguggaaacuucauguccagucaaaaauggcuccagaaaggacugaaacaauagauacuauguaaauuaagggacaauuaagaggucaaaggaccucuuaauuguggugcuuaaucagaagaaauuuguuuuauggaguuuuccauaggaaaaggagugauuuucagacucuuuuacucauaugccucuaauagaaguuuaaaaaacuaugcacugccucacacauuuuuaaauuuucaucauaaauugaaauguuaaaauuguaauagaauaaauauaaaaugagugaagauaaggauuggcuaauuauaauaacuauuacaugacaucauaagauagguuuaccuacuuuauugaauaauacauaaugaauuugaaaucacggaacauugacauccacgguuuuauucaauugauaguuuuuuuuuuugaaacauuccauauauauguauauauauauguguauauauguauauauuuguguguguauauauauaaauauauauauauauauauauauuuuuuuuuuuuuuuuuuuugagacagagucucguucuguuaccuaggcuggagugcagugguguaaucucaacucacugcaaccuccaccuccuggguucaagugauucucccaccuuagcuuccugacuagcuggacuuacaggcacgugccaccaugcccgacucauuuuuguauuuuuaguagagacaggguuuuaccauguuggccaggguggucucgaacuccugaccuuaagugaccuccgccuccugaagugcugggauuagagccauugcaccugaacccauuccacuuauauuuaaaauaaucacuggcacuaacccauacugcuuguuuugaaucagaaacaucccaacauucagaauguagagagucugaucagaagaggacaaaagaaagacuaucacacugcuucucaguguuguuuauuuuuacguugugugggggccgguaggagagagauggguaggcuaucagaugucucaaaauaaguuuucuugacuguagagaagguuauagaugauagcauuuuuguguggguugguggucagcaggaauagucaccuacuuguuaagucacuuuauuuuuuuucuguuuguuuuuguuuuuguuuugucuuguuuuguuuugggacggagucucgcucuguugcccaggcuguaguacaguggugcaauuuuggcccacugcaaccuccgcuucccggguucaagcgauucuucugccucagccuccugaguagcugagacuacaggugccugccaccaugccuggcuaauuuuucuauuuuuaguagauacaggguuucaccauguuagccaggguggucucgaacuccugaccuugugauccgcccaccucggccucccaaagugcugggauuacaggugugagccaccgugcccagccuuaaauaaaucauuuucuuauucuucucuugguuauccaagaccucaggacuucucaggaagccccuuucaguccauuauacauggaguggcugauugaagguauuucuacauacugacuugaaaguucuauccuuucauuaaagguucuucuacauauugaccugaaagacagguuccuccaucaguccuccugucauccuaauugugacucuagcugacuuuuauuuccauuucugcaugguugucuuaauacuacuuguacauauuauguucucucuaggccuucuuuucuaagccauuucucaaauuuuauuugcaguccacugguaauccaccuagcuacuuaagaaaaauaaaauauuagcccucuuuugguuugaacaauuaaguauuaccuacuagaaaccucuaagagauuuauuaaaacuugcuaaaauuuggcacuuaguacauucaacacaguaagucuguacuagagacuugcucuugaguggggguaggagugggguucuaauuacauauucugcuaaaacggcugcaacucauugcuuuggaacauugcaaagcuccuacuguacauacaugacauucuacaaaauuuaaggacacuguuaucagugaauacaagguugccuugaguuguauuuaguuuugaauuacugcucuugcauucauauuaacaaaaauacuuuuuuugaaccuguauuuugugauugcugauauuaugugugauugcacuacuuugguuaguacuugguucuuugccagcucuuuguaaucacuaaauccuuuguccacugacaagagaaaaguguaggguaagaaaaagcuuuagaagcuugcuccauguccaugauccuuacccagguauugaaucagacuuacauaggguuuauuuuuccccaguacacacaugcacaggcuuaucucagggauucagauuuagcagaucuguggagggguccagacaaguguuacugugaaaaaccuucccacuugcccuagggagaagcacugcucuguaugaaacugauuccaucucucauucuuuggguuugucuucucaaaccaucgauuuuacagacugaacucuuccuuagcuaaucugcuuuaccugcuuugucaucuaugugggaccaguacauagcucagcaugaaaguacucaucucccuuuucuccuaccuguaauuuacaaccaauuccugugugaguuggcugucaguucccuuuuucucgguucauugugcuugccacugacuuccuuuagcuccccaggacuacuuuuagucuucuagauuccuaccucccauugucuuucugagucacugaucugaucuugucaucacaaugguuaaaaaccuucagugguuucccguuguuuuaaggucauucaaaaucuggcaccaaauucccuucuuaauguuaccucuagaagcagcccuuguccagugccuacuuaguugaaauuugaauuccaaagccuucuucucuccacccaucuauaucuauugcucuuuauuugugguucacuggcacuugguuuauaaauagauaaauauuuucucugaaaucagugcuuaccacagaauuuggcauauucaguguuugaauaguugaaugaaugcaugcauggacauacgaggcuguucauuaacuuuuaaauguaucugauuauauuaucuggcacugcuuuguauuucguuaagugaaucaugggagauuguccagucccuuaaaaauauuuuacucucuucaucugaucucauuuuuaagaagaaaacauaggcauuuaacaugacuaauuaucagugaauccaugcuaacuguuggggauuauuaguccuuuucuagauacucaaacuaucuauuccaaucagagagagaugauuuuuuuauuuuauauuuuauugauugauugauugauugagacagggucucacucuguugccuaggcuggaguacagugguacgaucucagcucacugcaacgucugccucccagucuaaagugauccucccacuucagccuuccaaauagcugggaccacaggcauacaccaccacgcauggcuaauuuuuguauuguuuguagagaugggauuuccccacguugcccaggcuggucuccugagcucaaagcaauccagauugcugggauuacagcugugagccaccgugccuggcugagaugacuuuuaaaaaaagacuucucuaaaguagaaggaaggguggaauuguaugcacaagaagaaaaaaaccuggaagaaaaacauacuaaagagguaaaaaaaaaauagaucuguaaaggugguaaaacaaugguuauuauuuaucuuuguugaugaaaagagcacagcacuguaaaauauuugaagagauuuauucugagccaaauaugagugaccauggccugagguauagucucaagagguccugagaacaugugcacaagguggcugguuuauagcuugguuuuacacauuuuagggagacauaagacgucagucaauacaugugagguauauauugguucugcccggaaagcaggacaacuugaauuagggaggggauguugcuuacagcuggguucaaauauuuucugauuggcaguuuguuaaaagaguuaaauuauuaucuaaaagccaggaaucaguagaaaagagugucuggguuaagauaagggguugugguucuacauaagguucuuagguagauaaagucucauacgugacugcccguaguagcaaagaaacauauuuuggguguuuuuuuguuuguuuguuuuuuaaauaaagucaucuagaagccucgggguaaaauauuuugauuuccuucuuuaucugucaugugauguuaugccagauucagguuuggagagauuuuaugauuuguauggugugacuccccagacccuuuagcuaggaauuugggcaagagagaaauaaggucagaguuuacuccuuauccuucugcuguuccaguuuucauuuuuuuuuuugagacggaguuuuguucuuguugcccaggcuggagugcaauggcgcaaucuuggcucaccgcaaccuccgccucccggguucaagugauucuccugccucagccucccagguagcugggauuacaagcaugggccaccacgccuggcuaauuuuguauuuuuaguagagacggaguuucuccauguuggucaggcuggucucgaacuaccgaccucaggugauccacccaccucggccucccacagugcugggauuacaagcaugagccaccgcgcccggccucccuguuccaguuuucuauaaucuguucauauuauauucuggguauauguggguggugugauuauccauguggucuuauuuucacauucuuugcauuaacuauaauguacuuaauguuuuaagauaaguuucauucuacaaagauguauguacaauaccugguaucagguaacaaucuuaaaaaaacuaauucauuuaaaaauaaacauuaaaauuagcaauacaauuaaacauaaagacaguuugugaggacauugaacugcccauucuuacuccaaaugaauuugcuuucuuagacugaggaggaggggccauauuguugaugucacaauaaacuuguuucuccuucuucaauaauaaauuacauaauuugauuuuuuuaauaggaaaggaucauacuucaagggaggaugauaaaaaacauuaauuuaacuuuagaauuacaacuuuuacaugugggcccaggaauguaucuaaugggacaaagguuccccagggacaaaagucaucuaaucuaauacagacaaaagguuaagcauaaaccugucccuagagugagaaaaaaaugaauagaauaauuggcucagggaccuuguggcaccuggaaacagaugcugcacacguaccuggaguacgugguuaacaaauaucuucaguaguacugcagaaugccuaggagauagugucugguuaagaggagcuagaaagauuuugauacucucugaaacgaaguuuagaaggggccagucugucuaguccagaggccaggcucuguggauccagagagccugguaugugugaucugcuugggagcaaugugacagggcuuuccacaggacugcuuugugaagcagaucauacuggucugggccauuucuagucuucuagacuuccuuucugagagaagaaagauggagaagguuaccuuucaguacacagaaaguagauguuuuguuuuguuuuacauuuuauuuuauuuucucuccucuccuccuuguuuuacaucuuaguuaacccuguaguugaucaaguuaacuaggaucuaggaaguuggcuuagaucuaugaagaccuggcuuuccaucccagucuuuuucucuccauugucuaugucccuagagguuagaggagacugguucaaaaucauauacaguuuuaacuuuauuuauuuauuuauuuagacagggucucacucuagucacucaggcuagagugcagaggugcgaucuugguuuacugcagccucaaccucccgggcucuggugauucucccaccucagccucccgaguaucugguauuacaggugcacaccaccacacuuagcuaauuuuuuguauuuuuaguagacauaggguuucacuguguugcccagguuggucuugaacuccuggagucgagcaauccacccgccucagccucucagaguguugggauuacaggcgugagccacugcgcccggccuuaauuuaauuuaauuuuuuuuuuuuugagacugggucuuacucugucucccacgcuggaggauaguggcacaaucauagcucacuguaaccucgaaugccuaagcucaagcaauccuuccgccucagccucccuaguagguaggauuacagggaugcauuaccacacccagcuaaauucuuaaauuauuuguagagacugagucuugcuauggggccugggcuggucuugaauuccgggucucaaguaaucuuucugccuuggcuucccaaagugcugggguuacagaugugaaccaccacacauggccuuggaauauaguuuuuaaaaaucucuauaaacagcucuuggcuauuuuuuguuccuauccuuuaucuaaauuuagacaaaauuucauucuuaagcuauagaccacuuaaauuauuauuucuggauauaagaaaacaaaguauaggccaggugugguggcucaugccuguaaucccagcacuuugggaggcugaggccgugaggccaggagaauugcuugauuccaggaguuugagaccaaccugggcaacauggugagaacucaucuugcuuuauuaaaaaaauaaaaauaaaaagagaaaauaauaauuagccagguuugauagcugcuuguagucucaacuauuugggaggcugaagcaggaggauugcuugagcccggaguuugaggcagcaguuaaccaugauuguacuacuccacuccaguagccugggcaacaaaaugagacccuguuccuauaaauacauacauacauauauaaguaaauaaauaaagcuuucuuaaugauuuggcuuauucuuuuuaaauccagcaaauguuaauucuaaacuuuaguucugcuguuagagugagacgagauuagcacauuauaucugcuaucugggcuuagauuguggguguuauuucacacagauaauucaggcaaacccgagauuuuuagggggugaacuugcauuauauggauacaauaagcacacucacaauagaaaacuauguggcauauacuaaaagaaaaaacucuaccguguuuuugagaauuauaccauggauaaguaacagaaggcucauccucagagaccuaagaguuugucuucugacuaaacauuuuauggcugauauuucuuccccacagagcauucaguguccagagacuccuuuuuccccagcaaugcuggagggaugaggaauagggagugugaagcugaugacauguucuaccuuuucaugauggaguacagaaaauaacuaaaauuaggugcuaaugguuguccuucuucaggauuaaauuuuacucaguggaaagaauauagguucuuuuauguuuauaguuuaucauaucuagaugugcuauaauagauuuaaacuguuuucucuagguaguuacaacauaacagcuccguaugucuuguuuauaugcaauaucuaggacauuuggaaugaaguaguuuuccaaagcauuauauaaauuaaguuuucauugaccuuaggccagaccaucaauagcuugcuaguugucuuuaauauuagcuuaaauuguauuuuuucaugugaaaaugaaaauaaauauucuuguuuucucuuuauuucauuuggguuuaaugauuuaauauuuuugcccuuuucuuuugaaauggaauuuugcucuuguugcccaggcuggagugcaguggcguaauuucggcucacugcaaccucagccucccgguuucaagcaauucuccugucucagccuccugaguagcugggauuacaggcaugugccaccacacccagcuaauuuuuuguauuuuuaguagagaugggguuucaccauguuggccaggcuggucucgaacuccugaccucaggugauccauccaccucagccuccuuaaaugcugggauuacaggcaugagccacuauaccuggccuauuuuugcccuauuuucugaaguuuacauacauguauuuuauuugucucgucaauuaaauuguauguaucuggaggccuagaauuaugaagguauacauauaaucuuuuuuuuuuuaaagauuuuaccuaacguagagaacuacuaggauucaucuugauaaauaaaaaaauacauacuuuugcagagacacuuguaaaagcauaaacauuaucaguuguaguuuucugcuucuuguggauaggcuuggagcagguaacuuuaauacauuguagaaaauuuaagaaacacaagugaaaagaagaaaacaaaugucacccugagauauacacuaacauuuugguguaagucuuucaaaacuuuuuauccaucuuuauguuuuuguuuguuuguuuuaggacagagucucucucugucaccgaggcugcugcagccucagucuucuggcucaagugauucuccagccucaggcucccaaguagcugagacuacaggcaagcaccaccacaccugacuaauuuuuugauuauuuguagagacgaggucucacuauguugcccagguugcucucaaguuucugagcuuaagcaguccugacuuggccucucaaagugcugggacuauaggugugagccaccgcgucuggcccauuuuccuuuuuuuuuuuuuagauggagucucacucucugucacucaggcuggcgugcaguggcacgaucuuggcuccaucucagcucacugcaaccuucaccuccccaguucaagcgauucuucugccucagccucccaaguaguagugacuauaggcgugcgccaccacacucggcuaauuuuuuuuuaguagagauggguuuucaccauauuggacaggcuggucucgaacuccugaccucaagauccgcccaccuuggccuccccaagugcuggaauuauagucgugagccacugugcacggcucguuuucuuuuuuacaaaaauauuaucauaguuuucauaccauauuuuucuguagccuaacuuuuaagaaauauauagaauggauauuucugcauguuguuaaauacuuccugcaccaaacuguaaaugagagaauuuguuucuuuaauguaauguucuggcugacacaugaaaagcuugaggagaugcaucucacucuuuuuagguagcacauuauuuuuuaaucauuuuuagacgacagggcaaagaaaacuaguagcuuuagagaaacacaaaauauacugaauaauaguauuacaauuguuuuaaguuugaccagucagguacaaaaugcaauaaguuucagauuauuuucuucauggauuaugucauuuuuggguaauacucaucaguuuggugugaagaacauuuaugccaaucagggaacuuuuaggauguuuucaacugcaaguaacagaacuuaauuaacuguagccuaaaacaugaagacuuuuaauuauuucacauaacaauaacuuugauuggaagccucagugguuguuuagugguuuuaauaauguuaucaaugaccuagguucuaucugaguuuccguuuugccauucauaaugugucaauaguuuuuucuucauggucacaagguggcugccauaucaccaagcuucccacacaagcaucucaagcagaaagaaaggagcaguggcaugggagccuuuuuauuugcuuucuugucaaggcaaagccuccaagccaacuugcacucaguaaguuuauaaaaggauaugcucuuauuuuauuauuauuauuauuauuuauuaauuuauuuuuuaagaaacaauguuucacucugucagccaggcuggcgugcaguggcaugauuacagcuuauugcagucucauauuccugggcuuaaaugauccuccuaucuuagccucccaaguaguuugaacuacaggacaugccaccacaccugacaaauucuaaaauuuuuuguagagauggggucaugcuauguugcccagguuggucuugaacucuuauccucaagaaauccuccagccuuagccucucaaucacugggauuacaagcaugagccaacaugccuagaucugcucuuauuauugcuauaauuucaugccaucagccaggccuggugauguguuucacucuuggaccauucacugacagaggauggggauugcuuuccuacaccaacucuuaaaugacaaagaggccgggcgugguggcucacgccuguaaucucgcacuuugggaggccgaggcaggcagaccaccugaggucaggaguucgagaccagucugaccaacauggagaaacccugucucuucuaaaaauacaaaauuagcugggcaugguggcacaugccuguaaucccagcuacucgggaggcugaggcaggagaaucgcuugaaccugggagacagguugcagugagccgagaucgugccauugcacuccagccugggcaacaagaaugaaacuccaucucaaaaauaaugacaaagaaugacaaagagagugaucgccuugagaggcuuaaaccagucuugcacuuugucucucaagggccaggcacauugcccuccacacaauaucggguaaaguuuaucuguuggcaaaggagggggauuggguuggcuauaaguuaucuuugaccacgcuagcacaaaaauguauacucucagaagaaagaaacaauuucagguugcgguaaaaaucauguugggacuuuuuacaugacucuucacaaauggaaauuucuucuaaaaaaauagaaacuuugaggcuaggcgcaguggcucaugccuguaaucucagcacuuugggaggccaaggugggcagaucacaaagucaggaguuugaaaccagccugccaacauggugaaaccccaucucuguuaaaaauacaaaaauuauccaggugugaugguaugugccuguagucccagcuacuugagaggcugaggcaggagaaucacuugaaccugggagguggagguugcagugagccaagaucacgccacugcauuccagcgugagcaacagagugagacuccaucucaaaaaauaaauaaauaaauaaauaaauaagguagaaacauugauuuauucaugguguuguuaaauguaaacuauugaguaaauuacucuuuaaucucugaagauagagcucuagauacuuucuuguucuuuuuuuuuuuuuuuaacucaccacuaugccaaugaggagagcucuagauacaaacuuccuaauggaaguggaagaauaaugauuuaaacaaguacaaaugauuaagaaagaauaguuuuacacauuacaugacaugagauccuaaaacaugaccccacauugagaaagcucugugaccauugauacuggaaucuaucauucaucaucaguuacucagcacauaauaaagaucucacuuacccuuccuaugaaggcaugacuuagacuuuauuugcuguuacugucucuguuggaucauaugauaguaacaucauaaagagggaugauagauguaauguaacucuagggcuagacugccugaguucugauccuuguucagcuuuguaaccuuggagaggguaaaagucuucuauaaagcauaguuuaauaauaauaaacuaaccugauaagaguuguuauauugauuaaaugaguuaauauauguaaagcuuucacugaugcuguauauguuuuaguuauguuguuaucauugauguuacuuacauaugucaguauuuaaaauuuuacacacuacauuuacuuuaucucauagucuccuucaacccuauaaaauaggauuuuucaucuccauuuuauaggugagaacauuauauuuaugucuuuuuuuuuugagacagagucuugcucuguugcccaggcuggagugcaguagcgcaauguuggcucacugcaaccucucccucuggggucaagcgauuuucaugucccagccucccguguagcugggauuauaagcgugcaccaccacgcguggcuaauuuuuguauuuuuuguagagacaguguuucgccguguuggcuggcuggucucaaacuccuagccucaagugaucugcccgccucagccucccaaaguauugcgauuacaggcaugagccacugugacuggccgauacuuaugucuugauuguauaugagcccaacagugauuugauuuuuuuuuuuaguuuuuuaaauuauaaauuauauuuauaguauaaacaaauuauaacauacauggaauuuacacauucuuagauuauuugguccguaaaauuagauuaagaagaagcgaaaggaaugauuaguuaauacauaggauacuaacaaguauccuaugaguuaauugcacucuauaagaauaauuagguuguucauuuagugcauuauauucuugggaugguuuuaggugcaucuaaaucuaaauaugccaacuuugaagcaaaaguaaaaauguagguaaaggucauguuauauagugugacaauuucuugugcuuuacauguauucuauaguuguagaauuuccaucugugacuaauaggucuuauagcagaaaagcaaauucauuuuagugaacguguguugacauuauaggaaugucaaccuagcacaucaggaauucuaaggucaauagaaaacuugguaagucuagucugauucaguagggccacaggcaaaaagagauaccauuugaccuuuuuaaaaaauguauguucaaaaguaaaagcauucauuauuaugagaauauauauuuaaaaugccugaaggccaggcgcaguggcucacaccuguaauuucagcacuuggggaggccaaggcaggcagaucacuugaggccggggguucaagaccagccuggccaacauggugaaaccccaucucuacugaaaauacaaaaaucagccgggcauauggugggaugggccuguaaucucagguacucaggaggcugaggcaggagaaucucuugaguugcggagguggagguugcagugagccgagauuacgccacugcaguccagccugaacaacagaguaagacucugucucaaaaaaaaaaaaaaaaagacugucuuucuuuacauccugauauuuuaaaaucuuuuucuuucuuuuuaaaaaaaguuuuuaaauuucuaauuuuuguggguuaaucuuuuuuaaaauuuacauugaaagucaugcuauuuuuucuauccaacgaauauuuaucuugcuuuuuuauauuuuuauuuuuuuaacuuuuauuuuaggcuugaggguacaugugaagguuuguuacauagguaaacaugugucauggggauuuguuguacauauuauuucaucacccagguauuaagccuaguacccaaaagugaucuuuucugcuccucucccuccucccaaccuccuccaucaaguagaccucauuguuguuucuuuguauucauaaguucuuaucauuuagcucccaagguaaugcuauuuuaucuuauuucuugccagagcaucuagcaguaggaccaaucaguugaucgaggaauuuauuauuauuauuauuauuauuauuauuauuauuuuccuuuaccugauuucuaguucugcaaaaggccaccuuuacuuugcccuguuauuaaacaguccaugucacuugaccugaucaaggaauuuuuuacaguugaggaaauuuuggcaaaaugcagccauaggcugagugacauggacuguuuaauaacagggcaaaguaaagguggccuuuugcagaacuagaauaucagguaaaggaaaccauucuuaucaggucuaauacaauuuuagaugauagucugaaucuuucagaauguaugagaccuggauguucuaggaugagaauggcugguuguggguaucacuagugacauaaacagaacuuggaacaguuauugccauccugggacuagcacucagagaacacauuggucugcugggaucacaucucaccugcuucccauuacugccuacuucugugccuugacagccugaguucauauuucucucuguuuguucucaugcuugacuaagucacacccaauaauuuguucugucugggcggagaagcaggucauaggugcuauuugaauacacagauaggcagaucaagucaguggaugaaauaguacacuauuauggcaauaaauggcaugcuuuuugucuuuauuacacaaaccuguggguuuacuuagcacaagacaaaugggaaggugucacuggaacauaagcauaugagaauccacauaggcauaugcagugugucucuccuuuugcauucuuuguugugcuuaggacuugaagacaagaagguuugggagguccagggaguauuguugguuuuccuuuuuccccugcaugugacacucaaugaaaagucuccauauuccagggguauauguccauuguuucacuguaacaagacuuaaaagcucuuagcagaguuuacaguaaaaaacaucagcaagaauuuuuaaguacuuugggcuaaugcaguuauuuauuuuuguaagcauauauuuuaaacuaaguaaaaucagaucucaaaaagacguuucuuaagaagaaggguauucacuuaacuaagcaaccagugucaaguguggaugcuauccuagaaggcucuucuuucucagugccuaauccauguaccugggauggauuaguacuaucuaccucuaauccuuguacuuugcaggagguccaggcaauucucauuacuugcuguaguuaugcuuuauaaaguugcuggggguacugaauuagcaaacacugaaucauugcucccagguggaauauaagaauuaaguuccuacaagugucuggucacaacauuuucaacaauugaucaauacaugacuuucuuuuaagugugcuucuguuaaagacgucuuuuguaugugaguggaaaaacucaaaacuguuuuuccucuguucucacaccacuacccaagcaagcaguaaauucugcagcagacauccacuggguguccuccaguucaauuuugacacuaucugcuuggagauagggacagaucccacagguuaaagucccaauccccaagacuaccugcucuccccagccaagagucacaugucugggucucuggaauuucugaccucugaguggcuucaaguugggauucucaugacuuuggguugcacuaauuugcuagacaggcucagagaacucagggaaacacauguauuaguuuauuauaaaggauguuauaagucugggcacaguagcucacaacugaaaucucagcaccguggggaccaaggcuggaggauugcuugagcccagaaauucgagaccagccugggcaauauagugagaccuugucucuacaaaaagcuaaaaaauaagccaagugugguggcaugcaccuguagucccaguuacuugggagucugaggugggaggaaagagcacaggaggcagaggcugcagugagccaagauagugcuacuguacuccagccuggacaacacagagagagacccugucucaaccaaaaaaaaaaaaaaaaaaaaaaaaaagaggauauuaugcaagauacagaugaaaagauacauagggcaauguaugggagaagagcuuggagcuuccacguccucccuacgugcaccacccuccaguaaccuccaggugcucagcuaucuggaaauucuccaaacccaaucuugagcuucuuauggagacuucauuguguagguaugauugacaaccaugcagaaaugugauuggacaaaaaagguaugaucuaauacuauuuauuuauuuauuuauuuauuuauuuauuuauuuuugagauggaguuucacucuuguugcccaggcuggagugcaauggcgcgaucuuggcucacugcaaccucugauucccagguucaagcgauucuccuggcucagccucccaaguagcugggacuacaggcaucaaccaccacacccagcuaauuuuguauuguuaguagagaugggguuucaccauguuggucaggcuggucucaguuuaaacugaccuccggugaucugccugccuuggccucccaaagugcuaggauuacaggcaugagccacagcgccuggccaaccuaauacucauugacugagcgggaaacccagcaaggccugucuguucagauucuucuuggccugugugucacauuccuuccuccaggguaaggggcaagaucccuucugaauugagggucucaggacucaaucagaaaggccugggaagguuagaguucugccuugggcuggggaaaccagggcaagggaaggucagagagagagagauuccauuuuuugaggccuuuuucugggccuaaagugccccaacauuauaacaaaagacuuuaacagggcugugggaguugcgagccaggagcuguggaugaaaccuguauauauaauaucacacaucuuauuuaauauauuguugauuuguugacauugagcuugcagucaauaucaacucaugccugaacuaagcuaaucuaacguguuuuucuaaggcaaaucauaaucuugugguuaagaacacuccucagcaugucagcacuagaggccaauuuaaauagggaaaucaugaaaaagcacaaaaauguaagaaagguaggaccaaguacacugcaaaaaggacauuuguuuagagaaugagaguccaaaaaagaagcagagcaucacuugguuuagccucagcuagggaugugcacauugggcaacuuaauuuuuucacugcucuuugcaugaccacaaaugacuacaaaaguacuaugaguauugauuuggagguuacaaauaaauuuuagcgaguaugcuaaauaaguaugaauucuuaguaaugaggaucagcuguauucuguucuagaaguaacaugcaaaguucaagccuuuaucuuguuuuuugcauaauucaaauuuauaauggcagcacacaaccuauacuuagcaguaaauauaucacaaaaugcugauaagggaacuuuauuuucauauagagaacuugucuuuucaaauuuaaaucauaaagcauguucuuaaggcuggagauuuaaaaaauuuauaaaucuaauaaauauagaaaacaaaauauaggcugggcucaguggcucacgccuauaauccuagcacuuugggaggccaaaguggguggaucaccugagguuaggcguucgaggccagucuggccaacaugguaaaacaugguaaacccccaucucuacuaaaaauacaaaaauuagccagguguggugucacacgccuuuagucccagcuacuugggaggcugaagcaagagaaucgcuugaaccugggaggcagagguugcagugagcugagaucgcaccauugcacucagccugggcaacaagagggaaacuccaucucaaaaaaaaaaaaaaagaaagaaagaaaagaaaacuaaauauaaaaugaauauaagcauaaauucauaaaaauaaaaauuuucuuaaaauuagaucaaaaauuuuuguuuccuaagggagaauccagagagaacugggaagaagaguggauaauuuccaaacaccugugugugcucacacacacaccgugaauccuucaccauuguuuuaauauggaagaugauuggaguguguuuucuagaaauucugaauaauacuuauuuaaagacuucuauugggcuggccaggcaugguggcucacgccuguaaucccagcacuuugggaggcugagguguguggaucaccugaggucaggaguuacaggccagccagccuggccaacauggugaaaucccaucucuacuaaaaauacaaaaauuagcugggcaugguguuaggcaccuguagucccagcuacuagggaggcuaaggcaggagaaucacuugaacccaggagguagagauugcagugagccgagaucgcaccacugcacuccaaccuggguggcagagcgagacuccgucucaaaaaaaaaaaaacaaaacaaaaaaccccaaaacucuguuggggucgggugcaguggcucacaccuguaauucuagcacuuugggaggccaagguggguggacccugucucuaccaaaaauacaaaaauuagccaggugugguggcauacaccugcagucccagcaacuugggaggcugagaugggagaauugcuugagcccaagaggucuaggcuacaguaagccaugauggugccauugcaaaccagccugggugacagagugagacccuuucucaaagaaaauaacauuuaaaaaagacuuacuggacguuuaauaaggauauuauuaacuaauaaucauugagcuuaccacguacccacuaaaggcuucaugaacauuaauuuaauuaacccuccauuuuaugaaguaggcuuugugauugggcaugucuuggagaugagguuaaguaacuuggaaaaggugggacaccuggugauuggcagagugaggcuucaaacccaggcagucuagguccacacugccuguccacagagucugggucucuccugcuuuggcuuaugacgucagcaccuacugggaaaauuacagaaaccauuuucaaaggugauauuuugaaaagcauaugguggggcucauuuuguuuaaaugagcucugcacaaugaaagcacgugagagcaguuuuugaaaaaguucugauugcauccauugaauuugacuuuuuuuuuuuuucuuuuuuagacagucuugcucugucgcccaggcuggaguacaauggcacgaucuuggcucacagcagccucugccuccuggguucaagugauuuuugugccucagucacccaaguagcugggauuacaggcaugcaacaccaugccuagcuaacuuuugcauauuuuuuuaguagagacgggguuucgccuuguugcccaagccggucucgaacucugggcuuccagcaaucugcccaccucagacucccaaagugcugggauuacaggcaugagccaucacacuggccugaauuugacccuuacucuaaugauuuauagccauauaauucucaugcaauaagcuaaaaauacaccuaaaaaugauuuacucucaaaggguuuuaacuuuuuuucauugaaucucuuuuauguucacuuaaauuuuggcucuguucauaaauugauacaaagacaaaauuuccacuaaaauauuaaucuuaaguaguagacguuuucuaacuauaccuuccaauuggaauuaagcauuuaaucuaaaauuauauaucaaaaauacaagaaagaacuuccuuaauugccuggauauguuucugccucucaaggccucagaaaguuuuguacaaacuguuagaauagcccuaaucauggagauagguguuuuauuuuuucucuccaaaagcauaagagagguugggugcagcagcucacgccuguaaucccagcacuuugggaggccagggugggaggauggcuugaggccaggaguuugagaccagccugagcagcacagggagacccugucucuacauacaaacauacauacauacauacauacauacauacauacauacauacauacauacauacauaacugaggugguggcaggcacccuguagucccagcuacuuguggaagcugaggaucauugcaccacugcacuccagccugggcaacagagugagacucugccucaagaaaauaaauaaaauuuauaauguucccccuucacuccccucucugcaaccaaaaaaacauccuuuaguaacucuuauguaaccauuaaaacuauauuauagaagaauauaucuugacaaaaaaaauguauaccacauguugcagaaaacucugcuuaugaaacagcauguauaauaacaaggccaauuuguaaacacacacagagagagacauauuuacaguuaguauaagguuaaguacuuaacgcuguauguacuaaaacacaaguccuuuuacugugcauguaaaaauacucuaauagcgauuacauuuugaagaugggauaaaguuuuuauuccugagaaccagaagugugucucaaugcaccuaauauuuuugccaguggagagauacugaaacccugugaucuucagcuacugugugcauucagacuguuuggucuucuugggucaagucagcuggugauuacuaaaugaugagagugugccugacaugcaggagacaggugagaagacaaagaaauagaaggcaauguccuagcauuggcagacagacagacccucuguauauauuucaacuuauuuggaucacagucuguuuaggaaggcagauguacaugcaaaauacaguagaaugcuacagaaaaagaacaaauauuccagugcuggaauauaguauuauaguaacuauaguauagaaaaucacuaugugcuaagaaauuuagaaacacuccagcaaaaggcagggacuuugagagcuaauaguuggguugaugaaaaaggaagacggaguuuccuuucauggugguagcaccagaauacucaugaugucuuauaugcuaaccaugagggcugaccaugcugagauuaacaggcaguguucauugccuucuggcagcaagggcaaaaguggaaacacaagaauuuuuucuuuuuuuugagacggaguuucacugucaccaggcuggagugcaguggcgcgaucucggcucauuuacaaccccuccucccggguucaagcgauucuccugccuuagcccuucuaguagcugggacuacagggcgcguaccaccacacccagguaauuuuuauauuuuuaguagagaugggguuucacgguuguuggccgggauggucucgaucucuugaccucgugauccaccugccuuggccucccaaagugcugggauuacaggcgugagccaccgcgccuggcugaaacacaagaauuuaagagaauucuuguuaucugaaaagaaaggugaugucucauuauugcucaaguaaguuaagaacaaaccaagguccuagcccaaagacaacaacauuugaaggaaaaucagggauauaaugucaaagaacacugcaguccaggggcgaaaugaaugugccuugagcaacuucucuaggaucucacuugauagcaggcugggauuuauaguacccaggggaaggcugacaguaucuuuccuccagaucagcucugagcugggcuuuuguugauaagcugucccaggagugcugaggcucugucacugacagaggaggcagauguauugaaagcaggaucguggguugauaauuuguuagggauguagagaagccuaacugguuuucuuacguggaaaagaccacccucuuuucccacuucccagaugugcuaaacucuucuggcagaggauauaggauuguccuuggggaauuagccuuggguucacuccaaugcauggguaaauguuugguuuugcaaggcagguguuaccuggccagcuccacauacuuuauuacaaaaauccuccuguuaguucugacaggaaugcaucauaauuguuauuuuauaguugaggaagcugacucucaaagaagugauuaacucaucucugugugugauucagaugagauuagaaccgcccagcuccugagaccaugcuacuuccugccuaccacagccacaugugcuacagagaacaaagcugaagugcaggcugcugugucucugagcuagacaaccugagcucaucccuccuguuucuugcagugcuauuaaaauggaggauuugaugagcagcaguagcugagaggagaaucagccuggccugacuaagguuuaugugggguuugaggaauaaaguuggguugugagggucgauuggaagcuuggaagccaggcuaaggaguuggaguaggucugcuagacaggaaggaaccacaaaaucaggaacauaaugguggaagggccuccuguaaauugucgauacuuaacuauuuuggccuaugaauggcaauagcacaugguuccacuaaacaggugcccugguauuguuuucugugagaggauaauggagaggguugcuuauaguuuguagauaucuagcaaauggucuguuuugcuaguccagcuagucagaaaccaguccucuuuuugaagaauagagaucaaaccugcucuacaagcuuauauguuuaccacaauuuggguggcaugauaaagacuaaaugcacagaaaggccacauaccacauuacauucaggaaauccuuucuuaguugggugugguggggugcacguguagucccagcuccucgagagguugaggugggaggauugcuugagccuggggggcagagguuguagugagcugugauugugcuacugcacuccaaccugggcaacagagugagacucugucucaaaaaaaagaaauuccccaaaacaagaaauucuuucaucagaaauaaaugagcagccuaccaacccaccugccuuccaaccugaguguuuuuuuuuuuuucuuuuuuuuuuuuuuuuugagacagggucccacuuucacccaggcuggagugcaguggcgugaucauggcucauuguagccuugaccucccugggcucaagcgguccucccaccucauccuccugaguagcugggacuacaggugcaugccaccacaccgggcuaauuuuucuauuuuuuguagagaugggcuuucgccacguugccucagcuuguuucugccuuggcuucccaaagugcugggauuacaggcaugagccaccucacccggcugugcuugcuuucuugugacaaauguucauggcaucuuguggcagacuuaugaaagcugaguuaggucaaaguguuuccuuagugccuagcucagaauacucaugcuauacaaaccguuuuacuuuuuccuuuccuaggguggccuuggcuucaucuucccucaccuuaacuugucaucagggcagcaguguaucaaacucugggaccuguggauucagacacaguuucaauucugccuuugcuacuuaaugacuuggugaacuugagcacauucauuaaccucccuaggcccccauuucuaagugugaaauugagauaaucaaauuaggcuguaguaauaauuaaacuaguuaaggugugucaauggcuuacaaaauguccagcacuuucuaggcucuccaugaaaaguagcuuuuacuggcaugacucucagcagauauuuuaguauuauuuugcuuucaacugaguaaugaauuccuagccaacauuuuugaacuucucauuacacauucagaaaugucaugucacaaccagggcuaagaacuuuucauugcucccaaauugccugucacuaugacucagauuuacccaccugauaaggaagauuccuugaccuuaacucaccauucgaucuuacaguuaguucucccauugcucuauaaguaucuuaugacccuggcaaauuaaaccacuggaauaucucucuucuuucucuauuucugaaacuuagaaagcccaacucagugcugccaccuucauacaaccuuuuaagguuuugaacuuuuaaucuuaaacucuuccauuuuugcuuuucauuuggcagugguagauuuucucauauuaaagucaguugugacuuguauaucacccuucuagcauuuuauacucauugaugauaagacuuggccuucaucccagucugcuacacuaugcggucaguccauaacuguuaaauuucagugacucaguuugaugaauauuuauugaggagccuguauuugccagacucuguuccaggcacaaggccgcuguucucagagaccguucauaccacuaggacacaaacacuaaacauguaaacaaguauauagacaaaauaacauuagauguugcuaacugcuauaaagaaaauagugugauaggaggugacuuggggccagagggagcuguuuuagcuagggggucagggaaagccuuacuaaaggauuggcaucugaccuaguagcaaaugagaagaccauguuagcccugggcccaucuaggagaagagagauccagauaggacacaacaaauacaaagcccccucaggugaacuguguauggcuucgcacccaaguaggcuucugcuuucuguuuugugucugaauaccucagauauugauugcacauuugaauuguaguuuggaguucauauauucucagugugauucuguacuauuuuuaucuaaaugauugggucuuucuucauucacagggacugauuuuccccuacauagucuuggacacagaccauuuaguucaaaccccagcugcaccacugacuaucugggugaccucaaguaaauuguucacuccugaagacucaguuuucucuucaucaaugagugucccaauaacugcuuugcagaguugugaaaaucuaauuaaauaaugucuauuaacuaguauguaguagaagcucaguaaacaguggaauuuauuauguugcauaucacauuuguguaccuuaaaauuuggcguacuucagcacauucauuaaccuccuguagggaggcaggaggaaaauggcaacuuuaauuuucuggggaaaacagucauccaaaauaucuauauauucaggccuggcacaguuguucacaccuguaaucccagcacuuugggaggcugaggugggugggauugcaugagccuaggaguuggagacuagcuugggcaacauagcaaaacccuguauccaaaaaauagaaaaaaaauuaggcauaguggcaugugccuguagucucaacaacucagaaggcugaggugggaggaucaccugagccugaagagcucaaggcuacagugagcugugauugcgccacugcacuccagccugggcaacacauugagacccugucucaaaaaauaaaauaaacccacaacccacaagaugucuauauucagcaaaaugguucagcacagccucuugaaaucacuacauuaaaguuuuacugagucugacuaaaauuaagaaaaaauuuugguugucuguuaccuuuauaauuaauuuuacuauggguaaucuuucaaucauuugcucaguuuucuacuguuagcauucuuuuaguuuauuuuuuaacuuuagauuaaaacaauuauaaacuaggcaugguauaaaauuuaaaauguuccacaaggguaugcagugaaaaaguauuuuauauaaaggacuacaucccuuuccccaaccacacaauucuccucccugcggauagccagugugcucuucagagauguuuugugugcacaaaagcaauuacaaauaaugagauucucauuauuccagguagauauguucuguaaagucaccgcaaacacugaacuugugaauauggaacccuugcacuuagggaaauacagcguuaguuuccugagagcuuuugguuacaauauuucugaucaacacauaaccuaguuuuguguguguuucugcuuaaaauaccuuauuuaacauauauuguugauuccuuaacauggaacucacagccaacagcacuaacucaugccugaaugaagcuuaucuaacauacguaguuucucuguaagaccuguugaagccuucucguucuuaggaacaugagauagcaguaagcuugggagccauuuuaaaccgugaaauugccaacacaaagcacaaaaauuggaaagacauggaacuaaauaagacugcaaaagagacaccuauuuugcaguaugagagcugaacaggaggcagugugucaccuugcuccaccucagcuggggaugugcaggucaggcaacuccaauuuuucaucccucugugcauguuugaaaaugaccaugaaagugccaucaguauagacuugggguuaaauuuucauaaguaggagaauuugcaaauacagaaucagugaaugaggauugacuauauauuuuuuuccuuuaagaacacaaaugcuaguauauaauacauagcauuuuguaucuuacucuauggacuuaacagugcaucuugaagauauuuuauacauacacagacauauuucauuugaguaaacuacgagcuucugcauucuauauuguucaggcuguauauaauccauuacaugggcguuuguguuuuuuuccagucuuuuauuacuuggauuacauugcacuggaaauguugcuagauacugucuucuguaaugguuguauauuauaccucucuaccaccauuacaagagggaauagauagcauucuuucauguagcagcauccauugcuaauuguacuggauaaugacuugaauucuauuuauucuuuaguacugaucuacucuguuggagaaaccaauaaggugcaagacuccacugaauagaaaagcaacaauuaaaaccauaaaggagucagucagugugugagaugcuugcauuccuucucucuguuuagcuguuucccaacccuuuuauuuguugcaugaucauaucucuuauccuuaucuucacuguggaauauagucaguguuucacaugaaggaauuuauuaauuucccuuuguaauuaaacuuucuauagaaaacaauguauuucaaaagugcacauugcaacaacauaugggcaacaugcauauuuuuaguauuuaauuguuacaauagccuagagaggauaauuucaguaaaucaaaaauaucugaagcuuaaccaccaugagacugguguugauggaagcuuguaaacuagcacgccuaugcaaauuauuuacugauacuguuuuuaaucccugacuucauuucaguaacaagagauagaccauagaccaauaaguaauauauuauuauaguuuguauauacauagcaugucugauagcgauuccugcuaaugaguaaagcaacacaggaagucaggggugggugggccaguggaaggaagauauaauuuugcagggauguucaggaaaacaauauugagcaaaggcuauaaaauagugagagugaucuaugccaguuuugaaauucaaggccaaggagagggccagugaaaaugcucuaccuguaaggagcuucuuugucaagggagacagggugucaggagcaacacugucauggaaagaucuccaagauacacuguuaaaaagacauccaauaguguuuguguguguguguguguguuuguguguguguguguguaaguuguaagcaaacccucauguguuguuuuuuagaaaacuuugauguuuaaguguuuuucuuuaggugccacuuuuccuaauguuaaaagaggucguaccaauccauaagaaaaauauagcucaauaauaacgacaugaauagaaaguucacaggaaaggaaauuuuuuuuagccauuucuuucaguagacaugugaaaaaaugccuaaauauacucauaacggaaaaaauaaaauagcaaugagauacacuuucaucuuuuagauugugagagguuaaaauuuuugagcagucaucugaguguuagagagaaaugugcuguugaaagugugaauuuuuguacauuuuggaauccuuuugcagggugacuuugcauucucuguaacuguuagaaacaccaacgucucauguguuaaugugcaaagaucucaaagauacaucauuguaaagugaaaaacaccaagaugcacgauaguuuuuaaaauaugauuuuuagaaaguauaugcauuuauugauacgugaauaugcauaaaaaucugaaguggaagagaguucauuaggaaagagaaggagacuuggcuuuuauuuuacaacucccuguguuacuugacuuuuaaaaaaaaaagaaaaacuguguacuuuauuucuauaguaaaaaauuaaaaccauacaaauuuaauugaaagauaacuucuuuuucuacuuuacaugauuaagcaaaguaacuuuugucaucaaguuauuaucauuguccucucauauauuguuaacuaauaguucucuuguacuauaaaucccaugacagauuuuugucugucuuguuccccuggguuugcccugguaucugggcacauggaaggcacuccauaaaaguguauugacuaaaugcauaaaggaaaaucuuuauuuaaauaaaguaucuaauauuccagcaugacacuaucuucaugcugucagguauauaauuauugucucaguuuuacagguaaaagagagaaaaaucuaugcaaaucacaauguaagucuagaagugauuaaaauugauaaaaagcaaagcaacuaugcaaaguaagagcugagauucagauuuugugagucaugacuauuuguuuaacuuaguaauccaauaucuuggccaggcacgguggcucaugccuguaaucccagcacuuugggaggccaaggcaggcggaucaccugaggucaggaguugaagacuagccuggccaacguggcgaaaccccaucucuacuaaaaauacagaaauuagccgggcauaguggcaugcgccuguagucccagcuacuugggagacugaggcaggagaaucccuugaacuugggaggugaagguugcagugagcugagauugugccauugcacuccagccugggcaacaagagcgaaauucugucucaaaaaaaaaaaaaaaaaaaauauauauauauauauauauauacacguguauauauguguguguauauauauguguguguguguauauauauacauauauauauagauguauauauauaucucucuccaauaucuuggcugccaauuagagaaugguuauuaaauuuuguccugguucuugacugaucgugcccucgggauacagaaaaauguuaaugaguguggaguuuuucuuccuaagaguuguguuccuucucaguaaaccuaguaugauuagaggaaauguguagguugaucucacaggugcuacaaaauaaagcacaugauguuuaguuaaaaauguuugugaucuucaaaaugggguuuauugaauuauagacugugcacacaaugguccacuagguuguucuuuacuguaguuaucuauuucuguggagauggaugaauauguagugauguggaaagaugaacuuuucauaauauaaagcagaauaggguuguauaguauguuuggauuuuuguuaauaacauguuaaaagugucaaauugccaacaagggcaagagcauaauauaaugauuuucugaaaccauguguuaaagcauaauuaacuaacuugacaaauacaguuucaauguacuauauccaugaacuuugguuuaucuuuguguuuauauauaaaguaauuggauauuuaaugauuauuuaaauguauuuaguuaauucuucuuguaccuagaaaaggauuugcccugucaaagacaaagugcugguccacuucuucaugaauauauauuuccuacuuuuaauaauuugcuugucaauauaaugagacuaacaaagugccauuuaggcuauuucaacauguguaguucccugagggcacauagcuuuacagcuuccauagcagauacuauaauuccuugagguaguuggcacucaguaaauguuuauugaguugaugauuuucuuaaggaaauaaaauauccaagaaauuuuuuuuuuuuuugagacggagccuugcucuuucacccaggcuggagugcaguggcgcuaucucagcucacugcaaccuccgccucccagguucaagcaauucuccugccucagccucaugaguagcugggacuacaggugcaugccaccacgugcagcuaauuuuugcauuuuuaguagagacgggguuucacuaucuuggccaggcuggucuugaacuccugaccucacuugauccaccugccucggccucccaaaaugcugggauuacaggcaugagucaccgcaccuggccuauccaagacauauuuuagaguauucagucacuucuuuucccucccucuaauuacuguguacuauuauuuggcauuuuaccagcucaaaguggaauaacuauuuuugcuucacauuguauguaccaaauuaauuucauauuaugcuucaguuucuccuacuuuuugcaauaaauuauagagggaacaaaugaaguuugugguuacuugacacuaggggcgaauaaaauguuugagccuuucuuuucccuccuccuucuucuuggccuugcuagaagaaccccaaaugggcagugacccagauggccauuuacuuuuggacuauccuccuuuucaaaucugccaaaaaugauuaaucagaaugaugauuagccaguuucuaucaguuguuacaaaucaauuaugugacuaaggaaacugcaucuuuuaccagccuuguuauggcuucuuuuaaccgcaaauauccaguuacugguuaccauaugaaagauuucuuugaggacuaauuuuguguuuucaguguggaugcuuuucaguuuuaugauauauuuuguuccaaggcagauacucguuaauccuauuuuacuuacuaagguaguauaaaacuaacugcuuaaagaaaugaauucaauccacuugucucuucuguccugaaaaagaagcaugugcuuuauuacaugggcccguuucuuuuucuguuuuuuugaggcagggucucgcucuguugcccaggcuggagugcaguggugcaauccuagcucacuggagccucagucuccugggcucaagugauccucccaccucagccuucugaguagucgagacugcagaugcuuggugccaugccuggcuaauuuuuuaauuuuuuguggagacggggucucucuagguucccuaggcuagucucgaacuccuaggcucaagugauccuccacccuugacuucugcugggauuauaggcaugagccacugugcccagccagaacccuuuuauuuguguuaauauuuaguaagauuuuagauggaggucaguccaauguggaaaugucuuggaaaagcccuuaccuuucauuaucuccucugcagcaauccuucagggagaaucacauccuaauucuaggucacuuguuaccuaauccucuuuuccugacacagcuucucacuccagaaaacauuuuaacuuccugaauauuaagauucuacuaaauguggcaggcucuguaacaaccaccaauccuuuacauuuucaagguggcucuggugcagccuccaguuuucuugucuuccccuucuuauuuucuauuccuuuauuugucucuugaauagguauuuaaagaaaggaaagcaggcauauuuggauaugugcccacuaaggcacuauuccugagagaaguuugcaaaaugucuuuuucaaaugccugugugcuuuauuauuccuauacugccuuguagcaacgcucauuauucagggcagugguucucaacaugagcugugcuucccguguuguaauugucugggaaccuuuuauaaucaccagugcugaggccuugacaucuguggaagugggggugggagguuaauaaaucucuccaggagaugugaugagaaccugugguuuaggaagauguuagauacgaggagguuguugaucugcccccaagcucucuagcaauucugauuauuuuaaauguaccugcaauauguagccauuguaucaugcauauugaacugucucggggucuagauauggauauaugaaccaggacgacuugggacucuuacugucuggaaagaauggcauuguguuagaggaaaaauaaguguuccaaaaaagcucaaucgcauagauaaauucugauauuugugauacaaauuguuaaacuuugauuuuguaaaauauucaauuuguaauacaaccuauuuaaguaucuuugauagauugaaaaauuauuuuuuucugacuauuguaaauaauaauuuuuuuugcuauagauuaggaguuuccuaugcucucagucucuagggcuaucccuucuguauuaguauaacuauaacuauauaauauguaauaaauaguaugugaccaaauguaggaagauuuuuaaagccaugaccauuaugauuugauucuuaaaaaacaaucauaauaauuuauaauugaaaaacuuuuaagaaguaaaaguuuuggucuaugugaguguggucaauagguacuucaaaauuaaauguucauagaaguuuaaaaaauauauuacuaguuaugccccaaauuugcuaaauauuuauugggcaauuauauauuaguauauaauagcaguauaugcuauguagauuguauaguacaauauauuguagcaagcauauauuaagugccuaacgugcuuaaaauauauugcucauuuaauucucaaauaaugcugcaagaaucagucacaggauugauaacugucaaaaaaguaaaaguuggacucagaucucucuuuguggaaagucccuguuuugaccucuagcacauuuuugaccuagcauuucuucuccaaguuaauuacaaauaagagauaggauccauaguuagugugacauuauagccugugauuaucuguuuuggugguuacacugccacuucccuuucauguagcaccaagccaucuucucaacucaguggggaugguguaagagaaaaguuagcagcugguaagaaauucgguuugggucugaugacagaaauagcucaaaaaauaacuuugcugagaggcaaucacauguucacaucaagaaauuaauaucacagccugggcaacacacaagagcuugucucuauuaauaauaaaaauaggccagguguggaggcucaugccuguaaucccagcucuuugggaggccaaggcaggaggaucacaugaggccaggaguucacgaccagccuggccaauauggugaaauccugccucuacuaaaaauacaaaaauuagucaggugugauggugcaugucuguaaucccagcugcucggaggcugaggcaggagaaucaccugaaccugggaggcggaggcugcagugagcugauagcgcaccacugcacuccagccugggagauacagugagacucuguaucaaaaaauaaaauaauaaauaaaauaaaauauuagcuggguguggugucacacaccuauagucccagcuacuugggaggcugaggugggaggaucacuugagccuagaaugugaaggcuguggugagccaugauugcgccauugcacaccacccugggugacagaguaagacuaucucagaaaaagaaaacaaaagaaaagaaauuaauauugauggacaaaaagccugguacuuuuaaaauuucuuaauuuuacuaaauaaaaguggaauugguaauuuuaauagacaaagucugugccuugguauaaaauuggggagaaaaaaacuuccuguuuccuugcaaaugaaguaaagaaugcuguuagggcaguggggacagcuaagccuuguaaagcugcuuacauugcauuagaaacuacaaaguaagaaauagcccauuauuccacuucuaguuauuucaggaaugacacuggagagcucuguggauccuacuuuaaaugaagaucuguuaguuuaaaucugcaaaaccacucuuaaaauuuuaaaaauuauaacaguuuuucauuucucuauauauguuggagcauaagguuucaaaagcuucaauuucagggugccaagaagaaaacuguuuuaagaaugggauuuacauaaaggguaaaaugugucaacagcuuaugaaucugaaaggagcauuuauuggcuauaauuuuuuuuacauggcauuuucagcugaucacccuuguuggauuuuaugucaauaaguacauuucucaucaucuguaacuguggcaauuuuuaauccuccacuauuaauuaucaauuaaguuuuagcccaccaucuauaaguagcauuuaaauuaucacacuauuaaaguuuaaaucacucaaaagagauaaguagguaguaauugcugucauuguauuuugaagauuaauauuuugagcaaaaaauuaaauuauguauaaggucucauaaguuauggaagcuaccuacuuucugcagaaugguauguguaccacaauuuuacuguaauuauaauucccuuuucacuauuauuauuaaaucuuaacagugauaccagaaaguuuucauaauguacauuuugguuauaauuguuucuucaucucugucaggguucugguuuccuacuuacaagcugacacagguugugcugccugaucaucauuaaaaugugaauuucuuauuuucaaaaccauacccaaaggcacaucaaaaagaagugguucgucaacuacugugucauuccugcucuucaauagaccaguguuuauacucacggaggggucacauagguuuggcauccuccuuuugagagacgaaggauugucuuugcuaauuugaaaaagcaaauuuugaaagaaugaaauguucauuuugaaauaagguuucuaggacagugcaguaaaaugcuuuccccuucuaaaauuuucugaaauauuuuuagccuucuaacauaagugcauguguacgcacacacucacauacacuauauauagcaaccugguugucacaauccucacuacuucuacgugugaucuguguaugugaaccagcagcaucacugcagagcuugccagagaugcagaaucucaggcaggccccaccccagacccacugaaucagaaugugcauuucaacaagauucccagguguuucauauguucaaauauauccacagugugagaagcucugguaucaggcaucacugccuggcagaaaggccgggcguggcacuaucuguauuuucacggaauaaauucucauucagugacugagagaacccuuuguucuuuuuaaaacaaaggugauccugagcugggugucagagagguaagauuugggaaaguaaagguuuuauaauucuaauaggaugacaauagcagcuauauauauaaugccaggaaauaauacaggagacucuaccgugauagauggguuuuuuccucaaucauuuugucucugaucguguauuuaguuaauucucugcaaagagaaguguccauaauaggacuugauaugacauaagguaugcccucuugauagucuuuaaggaaacuuuauuauaggguaacccaaccaauauuaaguuuuaaagauauuuugggggggcauaugggagggccaagagccaaaucaauagcagucagcuauuuagaaugaaucuucucaugaauauuuaucuuacuguuacucuguauuaaacucccuuuuauuuuacaucuaggauuucuacccaguuuagaacuuagagaugccaauauuuucagauaaggacuuuuuaguuguugaaugcuauaacuuguguaauauuaauauucacugacugaugauuaaauguacccuguacaauccauuaucuaaguuaaucuucacagcaguccuaggcaacaacggacuuuuaaaaucuccuuuuuacugacgaggaaacucagaaaccaagagauuaaguaauucaccaaacauuguacagcuaguaagugggagaagcagguguuaagucuaggaucucucauucaaaaguccaucucuuauuuaugauacaagauugccuuuuagacuucuuuauggcccacaaaugcugucucuuaaugggcaggcaugucaaaucucaacaucauuauuggccuuuugguaaauaauuacauauauagaagucuucugacacacccaagcaucuaucccauaggucaaacccaaauacugaucuuauuggcaacucauuaauauaacaaugguacaaauugaacaucccuaaucugaaaaucugaaaucagaaaugcuucaacuccgaaacuuuuugagugcuaacaugacaccaaaaguggaaaauuccacaccagaccucaaguuguagguccagacaaaacuuuguuuaaugcauaaaauuauuaaaauuauuauauaaaauuaccuuuaggcuauguuuauaagguguauaugaaacaaucaauuuuguguuuagacuugggucucaucccuaagauaucucauuauguauauauaaauauuccaaaauccaaaaaaaaaaaaaucugaaaucugaaacacuucugguuggucccaagcauuuuggauaaaagauacucaaccuguauuaaaaaauauugaaaucuuuagucauguagaauuuaugcaauuaaaaggugcugaaauucaguuaagaauuucaaaguuaaaguuuauauuuuaaauuuuuuuuuuuuuuucagacggagucuuccucugucucucaggcuggagugcaguggcacgaucuuggcucacugcaaccuccgccucccagguucaagcaguuuuccugccucagccuccugcguagcugggauuacaggcaugugccaccacgucuggcuaauuuuuguauuuuuaguagagacagaguuucaccauguuggccaggcuggucucaaacuccugaccucaggugauccguccaccucggcuucccaaagugcugggacuacaggccugagccaccgugcccggcccuaaaacuguauuuuuauuuuaaaauaugaauaucuauuaucacuaaguaauaaaauuaaagcuuggaaaugaaaggaucauacaaugcaagaguaucuaaagucauuuaaauaaugucaagaauaauguuuuaauuauucugcucuuagaauuuuaagcauuuuuaguuuuaaaaauaaaaauggaguauuuuugacaauauuuugcuuaacauucccuaauugcugagaaaucaucuguuucagaaauuagccauugacagauaaugaguuugagauucccuuuugccagaaaaaauuguaguaacauacaauaauauggaaauugccaguauguuuggguauuuauuagauugagaacuauuucaaacacaucuagaucaaucuguaagcaaagaauccaaaacuugugaguuuauuucuugucgccugucuguuuaagucugacaguuuaggcaaggagaaugucuuaugaauuugaguauaaugaauuuguggagggguuuuacugaaugcauuuucaggauuauuuugaaaauacaugaaguagacugaacacgguggcucacaccuguaauuccagcacuuugggaggccgaagcagaaggauugcuugaguucaggaguucaggaccagccugggccacauagugagacggugucucuaugaaaaacuaaaacuaaaacuaaaaauaaaaugcaugaaguaaaugcagaaaaaaaaagaaacaguuuccauucaaauuucuacuuuucaaaucugaaacacauaacuguucacucucacuacaugauguacuuguuuuaaggggaagaaaaauucaagauuuaagaaggcauuuauuuacgcucucaaaaaucuauaggauacagucuuugaaaaugaauacauuuauuaauuauuuuuggggugcuuacaacauguuuuucuauguuggucuuuucuaaguggagauuuuucuauguaggcagauaaauaccaguauuaggaagagauauauauuuauacucauggaguacaagugcaguuuugucacaugaauauacugcauuguggugaagucaggccuucauugcauccaucaguggagcaacacacuucguacccaccaagcaaccugccaucaucuaucaccccaugccuccaagucuucauuguccaucauuucacacucugcuucuucuguacaaauuauuuagcuuccacuugugagaacaugugguauuugucugugucugaauuguuucacuuaagauaauggccuccgguucuauacauguugcugaaaaagacaugaucucaaucuuuuuaugacugaguaguauucauuguguacacauaacacauuuucuuuauucgguccuccacugauggacacuuaagucgauuccauauguuugauauugugaacagagcugugauaaacauaaaagggcagguaucuuuuugauauaaugauuucauuuccuuuggguguauacccagcagugggauugcuggaucaaagguuagucguauuuuuaguucucgaagaaaucuccauaguuuuccauacagguuguacuaauugauuugcauucccgucaacaauacagaagagcugggugcgguggcucacaccuguaaucccagcacuuucggaagccaagauggguggaucucuugagcccaggaguucaagaccagccucagcaacauggugaaaccuugucucuacuaaaaauacaacaaauuagcugggcauaguggcuugugccuguaaucccagcuacuugggaggccaaggcaggagaaucgcuugagccugggagauugaccuugcagugagcugugaugguagcacugcacuccagccugggcaacagagcgagacucugucucaaaauaaaacagaacaaaaaguauauaagcguucacuuuccucugcauccuuaccaacaucuguuauuuuuuuguccuuuuuaaaaaaauuauuuuaaauuuuuguggguacacaguaaguguauauauuuaugggguacaugagauguuuugauacaggcaugcaguguauaauaaucacuucauggaaaaugguguauccauccccucaagcauuuauccuuuguguuacaaacaguccaauuauacucuuaguuauuuuucaauguaaaauuaaauuauugacuaugcuuacccuguugugcuaucaaauacuaggucuuauucauuccuucuauuuuuuuacguaugugcccauuaaccauuccuaccucccccccucccccgcacaacccccuucugggccucugguaaccaucuuucuacucucuaucuccaugaguucaacuguuuagauuguacaaauaagugggaacagagaagaugcagcguuugucuuucugugccuggcuuauuucacuuagcauaaugaccuccaguuccauccauguuguacauguauuuuuuguccuuuaauaauagccauucugauugguauaagaugauguuucacugugguuuuaauuugaauuuuucugaugacuagugauuuugaacauuuuuucauaugcuucuuggcuauuuguuugucuuuugaaaaaugucuguuccuacccuaaacccacuuguuaaugggaugauuauuuggcuuuuuuuuuuuuuuuuuuuugagaccgaguuuugcucuuguugcccagguuggacugcaauggcacaaucucggcucacugcaaccucugccuccugggcggauucuccugccucagccucccagauagcugggauuacaggcaugcgccaccacacccagcuaauuuuuuguauuuaguagagaugggguuucaccauguuggccaggcuggccuggaacuccugaccucaggugauccacccaccucggccugccaaagugcugggauuacaggcgugagccaccaugccuggccuuuuuggcgugcacguguguguguguguguguguguguguguguguguguguccugcucugucaccugggcugcagugcaguggcucagucacugcucacugcagccucaacuucccaggcucaaaugauccucguaccucagccucucaaguaucugggaauacaggcacacaccaccauacccaguugauuuuuguauuuuuuuguagagaugggguuucaccauguuacccaggcauuugaggguuuuugguuaaguuguuugaguuccuuguaaauucuggauguuaguucccugcaggcuguaucauuugcaaauauuuucucccauuccaaaggcugucuguucacucuguuaauuauuucucuugcugugcagaagcuuuuuaguuuagucccauuugucuauauuuguuuuuguugccugugcuuugagaucuuagucaagaauucuuugccuagaccaguaucuagaagaagaguuuucucuagguuuucuucuaguauuuucauaguuucaggucuuccuuuuuucuuuuuuuuuuuuuuuuuuacuuuuaauugcauuuauuuuuuugcugaauuaauccugugccauaaguuuuuguuucuucaguuucuuuugggauaucuuuuucuguauccaaccuccucuucugcuuuaggaacaauuuguuccuuuucaguaaggaucuucucaguguggcagggagagcuccuguaugaacucuggaagucugguggugcaucuuggaugcuuuguucaccuggauauguuuaaugaccagagaaucuacacccaaauccuuaaguucagcauuacucugcuuuuuuuuuucuuugagacagagucucagucuguugcucaggcuggagugcaguggcaugaucucagcucacugcaaccuccaccucccagguucaagcaauucuccugccucagccuccugaguagcugagauuacaggugcccaccaggaugcccagcuaaguuuuguauuuuuaguagaaaagggguuuucucagguuggccaggcuggucuugaauuccugaccucaagugauccacccgccucggccucccaaagugcugggauuacaggcgugagccaccgcgcccagccauuacucugcauuuuuaagcauguacaguaaaaauucaauagucuuuuugggccacugacuuugucuaguuccacuguuuggccagggcacaccugacaacucuaucauuguaauguuugaauuguacauacuguuuuuguaaagugacaucuuucucccauuccacuagguguagcuuaaaaauaaaaaagugacauuuuucagauacuuaguggcuuuuuguauaugcauaccuuugauggucugggcaguuuaugaaagugaacacaaagauuugagccucuugauuugcaugauuuuuucuggguuaagccagaucaccucaggcugcauagaggaagagguuuuacuucagcucuuaaauccauuuccaaguaauuuuuguacaugguauccaaaauuuuuguacauaggaguccaguuucacaguccaauuuucccagcaccauuuauugaagauuauccuuuccucaguguauguucuuguugacuuugccaaaaaucaguuggcuguaaguauguggcuuucuggguucucuauucuguccauugaucaaugugucuguuuuuaacagcaguaccaugcuguuuugauuacuauagcccuguaguguaauuugcaguaaggaaaugcuccagcuuuguucuuuuugcugcuauugcuuuagcuauuuggauucuuuuuugguuccauaugaacuuuagaauaguuuuuuuccaauuuugugaaaaaugauguugauauuuuaauagggauuguguugaagcuauagauugcuuugggcaguauggucauuuugaugguauuaauuauagucuuaggaagauucuuuaacaggaaaagagcagcuacuuaaaaauguuuuaacaaaccaugcaaggaaauuugaugcauuugccaagccuuuuguuuggcacucuuuucuucauuauuucuuaacaucacaauauuucuaggagugacauauuuuguuaucggugguuucuuuguuuuguguuuuuuuuuuuuagacagucucugacuaaggaaggagugagguauuaucuccacuuuacagaugaggaaaacaggcaaacccugcaaggucauagagcugaaaagugguccagguagaauucaaacccacaucuguucuauucuucaugcuucauucugucuguaguaauugucuuuuucuguuucaucuuuguacugcuuuaucacauaguuguggauagacaguucgccucuuugguagaacaucugaagccuuuacuaugggaacugcucaguuugggaauggccuuugugauguagcuuccagguaauuuccggaguagggggcugcugggcaggaucccuucugccuggauaucauguauauuuguguuucuuaccuuauggaguggggguuggggaagaguggcugggaaacagugcauaacccuggcuccagaaggcuggcuaggguuuguuuuccuucuucauuccugccagcccuguuagcuaggggcuggguugucuguccacccuuacugguuccagucaccuugcacagcuucuuucucacucucucucucucucugcccuauacuucuguuugccuugucugcuccucugaucagaccaucccuuuccaccuugagccaaccugaauuccuccuccagcuggucugugugcucuuauauuguauccugcuggauaccagccuuaucagacucugaugaggauguuaacaugcuucugugagcuuaagccaaaaaggagaguacaaaucagaccagaaaaagagaggugauugacuacaauagaagagaaagguuucaacaguggauggauucugacagcuaaaauuccaucuuuugaagugcuggaauuuccaucuuaacaacuuauuucuuggcaaacauccucuucacagugauuacagcuguuccauucagaauuauuucaguucuucaaagcaaggagagucuguuuaaagaguugcuuacaaauuguauuuuuauuggugauggucacuccuguauagcacccaaggaggagacacuaacugcauccauuauggcuuaugaugccgucugucagaucauuucugcagguuagguaccaguguaaaguuggaaagaguagugcugcaauugacaacugagguaggaccucaggagucaucuguacucugaugggcucaucagcuuacuaaugacuauucacauucuguuagggaaaaauuauuuauauaaaauguucauauucaucaucaaaaaaugaaaaaaggagcuaagcaaauaugauuuuaaugccagcauaguauuacauuaugugaauauacuguaagcauggggucguuuaucgauuuauaguggaagauagccuuuccagguucuaaaauauucauagcuacucccuauggcucuccauuucuuguaaaaguaccaagauaaggauucuugauuggaauggaauccaaaugcagguaacugccuaguuuuguggauuauuucagagguaauggaaacuaacagacugaauaacacuaguaucuagcuagugggucaaagagaaugccccuguaugacagauuugguauuuuugcaaugaaauuacuaugucaauucccuggcuuuuauuuuucucaagaccccucaucuuuuuuuuuuuuuuuuuuuuugagauggaguuucgcucuuguugcccaggcuggagugcaauggcgcaaucucggcucaccacaaccuucgccucccagguucaaguguuucuccugccucagccucccgaguagcugggauuacagacauugccacuaugccuggcuaauuuuguauuuuuaguagagauggaguuucucuauguuggucaggcuggucuugaacuccagaccucaggugauccacccgccucagccucccaaagugcugggauuacaggcgugagccacugcgcccggccugccccucuucuuauauuauuaaaguaacuuacuuuauauuccuuuuguuacuguuuuugugauggaaaacuaacuuucuaaugcaguguugcucaagcuuuaaugugcauccaaauugccuggggaauccuguuaaguguagguuccuuuuuaggaggucuguauguagaaacacagauucuuauucuuagauaaugcugacugauggugcugguuaucaucacccuuugaauagcucauuguccuaagaaauauaagauaagaaauauaauaagaaauguauuucuuaggauggguuauucuauacaaaacuaacauuuuucuucugaaaaucagcaugaaaucagaacaugaaauuuucugaccuuauucucagaugcaggagcgccauugaaaaaagauugaacuaaugaaguaauuggaugauaaauauuauacaucuaauaucucaaacgauuuuuuuuaccguuaaaaaucauaugguaaagauaaguuaaaaaaaaaagcacuacagucuaauuugugugaaaaucucacuucuauuuauuugagcugaucuugaugaaauaugccacuacuagcaacgucaaaugagguuuguuuuguuuuguuuugcuuuuuaaugaugugucuuuggcauauccuggaaucaggaguuugauguuucucacacaauuuucuaagaaauuauaagucaacauguauuauguuccagcccacaguuccuuccugguagagagguaggcuauuagcuucuaacugguagauuuaaggaucuguggaaguaagcaaagggccauuccuuacgugcugagggacgggagaggggaauugcaugggggcuaaucaacaagucaacaaucauuuuagaagauuuagcacuggcauaauuaauaacuucuugagaagguaaaaccacaauuuaaagaugaguuauauugaaggauugguauguuauaggacugugauaacuagaaaaaauggcagcauagccaacaaaacucccagccaaaggauacucagugauaaaagaaggaauuaacuagaaguugaagucaguaauuauguuguuuaccuguucaguguaagugaggaaauggcaugaucuaccugaaggaggaaggacccauuugauuauccagagagcaagaguucauucuuacuauuggagacuucaacuuccugguuauuccauuaagucauucauuuaacuguuuuuucaaaaauuccuuaggcaaacuaaaugaguagacugauuacauuaaauggcaguaauuccacacaguuuagacagggauagaugagauugucugcaauguuuauaaauuauuuuuagaaagggagugagauuaacccuguugauuccuguuaaauagguaaggcaaauuuccuuuaauccuuggacguuacuaaaaauuaguaagggguggccgggugcgguggcuuaugccuguaaucccagcacuuuaggaggccaaggcggauggaucaugaggucaggagaucgagaccauccuugcuaacacgguaaaacauuagccuggugugguggcgggcaccuguagucccagcuacuugggaggcugaggcaggagaauggugugaucccaggagguggagcuugcagugagccgagaucacaccacugcacuccagccugggugacacagcgagacuccgucucaaaaaaaaaaaaaaaaaaaaaaguuaguaaggggugggauaucaaggaugaaguuccuuggacugcaaagaucccagaaacaaaugauauuugguagagcagagcugaagguagaagaugaguguggcagccagacaucagaccacuaauaugucuuggugaguauauauguauauauuguauuaguauauauauaguauuguauuguauuaguauauauauauauauauauacuaauuguauuguguuaguguauauauauaugguauuguauuguauuaguacauuguauuaguauauauacauauauacuguauauauauacuaauacaauacuauauauauaaauacaauacaauacaauuaguauauauaugcuaauacaauacaauauauauacuaauacuauauauauacacuauauauauauacuaauacaauacaauacaauauuaaugcuguaggaucaaauacuucugcaugaucucagugauucucaagguuaggaucgccccuccccaguggguuuuucuccaucaucuguagugcugccuuaggucuuccacccuccuggucccuagaucuccugauacacccccuuucugaguguguggucccagggaacuacuguuucaguugcauuuuucaggugcauuguagguauccuucagauguauggggccaaagguuagaguuaccuaggcagcuuuuauauaccaaugcuccagccgggcacgguggcuuaugccuguaaucccagcacuuuaggaggccaaggcagguggaucaccugagguugggaguuugagaccagccugaccaacauggagaaaccaugucucuacuaaaaauacaaaauuagcugggugugguggcucaugccuguagucccagcuacuugggaggcugaagcaggagaaucacuugaacccgggaggcagagguugcggugagcugagaucgugccauugcacuccagccugggcaacaagaacgaaacuccaucucaaaaaaaacaaaaaaaaccaauucaauacuugaaucagaacaacuaccacagagauaguuuagccccagcuugagaagugucauuucucaacaaucccguaagcugccgugauugugaggccuccccagccacguggaacugugaguccagugaaccucuuucuuuuguaaauugcccagucuuggguaugucuuuaucagcaacaugaaaacggacuaauacaguaauaaaagaauaugcacaauauuauuuagauuuugcuaaacuuuuagguauuugaggaccuuaauauuauauauauaauaauaauauauauucauuuaaaaaaugacccuugguugcaauuaacaaauagucauugaagucacuugggcaauaaggacaagcuuaauaucauuuagacuuugcuaaaacuuugaguaucuguugauaacuuuaagaauucauaaaaaguauuaucucuugguuacaauugagaagugcuuagaauugaaggcagaaaaccauuuuaaaaaauuaaaaagaagcaugguggcaugacgcuuguagucccagcuacucaggaggcuaaaacagugagcugugauugcaccacugcacuucagccugggcgacagaguaagaccccaucucaaaauaauaauaauaauaaugauaacaaaaauacaauuuaauuaaaaagaacuagggccugagagucaacauccauucuuuuuuagcagagcaggggauagaaacugcuagggaucugacacugagcacaaaguuuaggaaguaagcagcaggaagcaccaaucaaucauugcaguugcagaaauaaaccauguccacaggcuuccccuagcuuuaucaucuuguggaaagaaaaguaaaagaaaagagacccaacuuuuucaccuacugugaaacacaaagucaaguuugggggcuuauauagaaaaguacuagcccugccuaucuccaaaguggcaugggcaguaaaggacuguaaagccagcggcaaccugagaagcaugucagccagucccagcuaaggcagccagggauuagggaagucauagauaaucaccacaugguaggaucaguagggaauaccaaacagaccagugacacagccauccgucccugauggugcuuaaugacuaguguaagggguagguucuguaagguguccugccagggaggggauuagauaggacaagcgcaccuuaaacacuagagauuacaaaauaauuuacaaccaagugggaaaauuugagauucuuugcuagcaagauccaguaaugguagacauuauuucaguuauguuagagggugguaccugucgaaugagagguuggcugaaguggacuugggaaaggggaggcagggguagguuaaaugccagcaaaaaaaaucuuagauaaacaaagcugacuuuugcuuaaaaacuguuaaaacacuguugaugagaagaggaagucagcuauauagcaauucucuccuuugcuuccaaaauacgucugaaaaaagacaaaaaauggagauauauauuagagaaaaaguccaggucuagcagaacaagaggaauuuuuugugugugcauuguuauucucuaaaauuauauauguaagcaaaaagaaaaaaucuuuaacagggaaaacuacgauagaaauaaaauaaacuuaaauaagagaaggaaaguuacugaggucacugugauuaucuacaugugucuuuuuaucgcugaaaaguaaaauauugacagacuggagccccaaggggauggaaauguauccaauucuuacucaaauaaaaauguauugagcucaguuccagagaacauucuuggauuugauguuuuuagcucccuaaguuaaaacagcugaaauuucuucuuauuaggcuuucauagaagaaaaacguuuucauuuuguuguuuauuuuuuaauuaaaaauauacauauacccacaaacaugcuaaucccccauaauaccacuuuuuucuuaaaauuaaaaagaaaugaaaguugccacaaucuucaacccugcaagauaagaacuuuuaauaucccuuuaaaacuuuuuucuauaccagagacacauaucuauaucuauccacugauguaucuauaucaauaccuaaaauuauauauaauaauuuuacuucaugcagaucuucauugaaaagauagaauacuguguccuuggcuuagguacuauggguguaaugauauuuuuauauguuuaaucuguaaucauuuuuggauuaccacacaguuauucagguuguggcugauggaaaccacaggagucugaggacacacuuaagagcugcgugggacucaccccugccccccaccccacauccacacaucuuaucacacaagugaccauugcucagcuccuuacauacaccaaacucuaguguucaggcuuuccaguaugcacuuucuuuuccuuugaauguucuuccuucugcucuucucaaggcuggcuauuucucauuuuuugugaucucaauuuauucccaugucuuuagggaggcauucucauucuccaucuaaaagagcuccccuccaccugcuaacaccgucucuuugaugcucuaauuuuccuucaaaacacaucguaguguguuacuauuaauuuguugauuaguguguaucucucugcuuuucaaugaaacaagcucugugaggcucauuuguacccauuuuguucaguacuguguauccaguaccuagcguaggaucuggcagauaagaaauacccaguaggauuuguggaauuaaugagguguauagaacuuuauuagcacaaauccacagacauauauuacuagcuugcuuuacaaccacaaggccaugaagaaagagguugcuauuucagugguguuuauuagacauauuuacaaguuaaaaguuaaaagugaauccuuagugaaauaguuaaaucaguaauaaauuauagagcauguuguauuaggucacugcucuuuagaaaccuaagcaauaacguggaagaacugcucuaugcauuucuguaaugacuuuagcagaagcuguggguggaagaaagaauuggacucacuuugaacccagaguuccucuuuauuagccaguuauaagcaaguccuuuuuugagccccaguuuucuugucuguaaaaggcaauaaguuugucugaagaaugauguaggugcuacaugagauacaguuaagcucugcccuaaucauguaaaugaaugugcacaguucuguuguuuugaaauuaaagugggagcccaugaagcuagauggcuggaguuccguagccaauuguguuauuucuaaaaguuuguuauggccucagaguguguuguugaggaauuuauguaauguuagugacuuguaaagagccauccacauuuaugguccuaucauuacuauuauuguuauaugcuuaaaaaaauccacauucuauuaauaaauaagauaaaucugauaagacugagcauuagcuuuuuaccuuuugaauucagauagauuuaguggaagcauaaacuuaacugacauggauaauaagaucuauaguaaagucaaaacagcuuaucaaaucuugaaugaaacuaaucuugaaaaggggcuacugaaaauggccccuucaccaggcaguaggaagugaguuugucccauuucugauugacuuugaccucugcuuuccaacuuugccccaaagaaaguuagucacgacuuugccccaaagaaaguaagucacgaugaugaacuucuuaggcggaagcagccauaaaguggaagaucacuaaaggcaaccagcuaguuacuuaaguuuccacucagcugggcuagauuuaauccaggcucagagucagagaaucacggaauucuaaugcuggaaggaacuaaaauuuccuuuuuuaacuacaaagucugauuuaaagcuuucuaaguuucuaauuuaaaguuuuccagguuucuaaggaaaccaaagaaacuaguuuuauuauauuucuugaccuauuugauaucagauuauaaaauuucugaagguaccauuuuuccugccaagcuuugauauauguuugguaguauuaccauggcacccuuggccuucuaaccaacaaggaagaaagagaguaauucugcauuuauaugagugucacagcucuuuaacagacaaucccagaagacaucuagauauuccugugauaaaacuuucuuuuugggccucuauuucuccacuuccaccuuucucacucuuccccuacuucuguguuauaggauauggguggacauaguaugguuauugauuagaugcuaauuuuguuaguuuugccugaaacagcagcuuuacaaauuaacauuugaggaccugaaacacaaaggugauaggaaacucagaaaaccauggcucaccuugcaccaguuauuuagaauguaaaauaauguucacugugaucauugggugcagcugguauaaucaggggcagcuggcagauccuacagacuauucugaguaaauaaagaaaaucuucauagccaaugggaacacuacaucucaaguuguuaguuuguaaggaagugcugauugcuccuaauauaggugauuguaucugucagucaagugaacauguaaucgguccuagcuuugguuacaggaggacauauuuucuuuauuacuacuuacacauuucgaguuuuaaauaaggcguucaauauagagugaacauuuuauuauagacaaacccauaguuguaggaauucuacucagaagaacuaucagcacagccuuuaaacacuuuauaauugagcuuaaaucugaagcuugaaguauuauguuuaugugccuauuccuaaugcuggguguuuuccgacucaagggcaaacauuugagucacucaugauaugucaaaaagugaaauaggaauuugagaaaauuugucuagaaaucugagaccaaaauaacacaagaaauuucaaacaucuagaauccuaacaagugcagcucaguuuaugaacaugcagucuuugugaucaaugcuuuaagaagcccaucauaagauaccuucaauauuagcccagacuuaauuauuaacauccuaaucacauauccaaguuaagaaacaaaaauucauuuuucuacuagacucacacacacucaacauccaaugaaucugaggaaguucuugagauguuaaggaagguagagaucaguuccuuccaagccuuacauuaaauugugaucagucuucucucuucuagaauuuuuuauuuugacccuuuguucaucuugaaggaucuucucugaacaccaaguugucuguggugccuggcacuggaucagaccauugcugauaauaggaggauuacuucauuauuccccuaggcagccuuaauuguggucaguuacuacaagaggagacagaagggaaagagagacagugcuugcuugcaguucgucugcugauuggcuucuuacccacuaaggucuuuaccugucccuugaacuuaccuauuuaaacaauuuuagugucugacuuuuuucccuaggcuacuacccugcuacccuguaaguguuccuauugagcuucauuucauguguuucugaccuuuucucguauuugccaacuaaauuauaauuuuugccuucuaaguugcugacuuuggcuuugaagucauacagaagccaguuugaacugagaccucacuccauuucuuacaaguuaugcaaacuuacgcaaguuauuuaacacaguaugugcugcauuucuuuaucugcaaaugggggaugguacacauaccuagugaaguuagugugaagaggaaaggagaaaucagcaucaaguucuuagugcaguuucugaaaagucucaagaaacacuggacucugguacaggcuuacuaaaucacauucauuagguaccuucagauuauuuuaaaugacuuccuuguuagccuuaaggugauucucuuaucgucaaccaguuauacauccacauaauaaaggaagaauauccuagguucuauuuuauacgucuguuagugauauacauaaaaggaaaguacucacauuuuuagccuggaauauaaggcccuucauaguuccucuuccaccuuauguccuacaucaucacuuuuuuuucuggagacagggccuuguucugguacacaggcuggagugcagugguaugaucacaacuuacugcagcuuugaacuccugggcucaaucuucccaccccagccuccugaguagcugagacuacaagccugcauaaccagcccagcuaauuuuaaaauuuuuuguagagaugaggucuugcaauguuguccaggcuggucucgaauuccuggccucaagugauccuccuaccucaacucccaaagugcugggauuacagacaugagcuaccacacccaguucacaucaucccuuuuaaacacuguaaacacaucugccaaaugucuucauucucugcacaaacauucucuaaccuuuauuucauguuguuccuucauucuguaauguuuuauuucccgaucuccacuuuucucuauccugccacaauacauguccccccagaggccuuguguucuuacagccugaaaugaucccacuaucagcugacuuagcauaauuuuuaaaaaucauuuucucaugacugaucacauucuuccaugugucauagugacuccugaggguaagaaguguuuuaauacuucuaucccucccaaaccaugcuuaaauuggugccuggcaacuuguagggcucagugauggaguaucgaaggaaggaccauauccuggggaucagaaacagacaucaauuaugcagucaaauauguucucucgucacuucaagcauuuauguucauauauuucuacuccacuaauagaggucuucccugagcaccacaccuaaugaagccuugucauuccugggccauuugcuuuguuuuauuuuuguacacaacacuauaacauuguaauguauccucagaguuauuuguuaauuucugucuccugcuagaauguaggcuucaugagcacaaguucaccuuuuuaaugccgguaagccuuauaaguauuuguugaacgaaugaauggauacaugaaauaaucacaggaucuacugcguuaaagcguuauggauauuauuauucuacuuuucuaaacguauguaaacaggcuucugguaauugucauuuuggauguuuagauguuacauuuuuagagaagcuuuaaguaauagacauuuaaucagugccugccuaaguaacuaugaggugaguuguuucuauaaauguuagucaggucuuagaaauacucuaguuuaauuuggugaauuuaacuuuuucuuucauaucuuaauuuucuucuuuggacacccagagagauuauauugggaaauaaugacuuccuuuuagccuaggacuuugcucuccaaacagacuugggacuuaaaugaaggguuaagcaagaugagaaggugcaugccuuuucuucccuuuuucccuguccucucaggcucccuugacaccugugacaaccccgccuccgcaagccucaucuucccaaagccugucaccuuaccucuucccauuugcccaagugcagugucaguguuaaguaagccauaguucacagcuuuuauuaauacacaguguaacauuuguaaggaaaugcaacaugcuuucgcuaugcuuucacaguaggaugaggcuguccuugagguuugagguuuauuugccuaacaccuggcaugcaggaacuucaguaaauauuuguuggagaaaugaaugauccauucacagacucauuaggcccugauugugucuguggguuacaauagaacacucuucuuaucaguccuuaucugacuugauuugcucugugacacuuaacuuccucucuuuucucuaccccugacccaugacacuccuuaauuuucuucuuuccucuugaaugugucuucuuaaucuucuuugcuucucuuccaccuucucuguaagugaugaugcuccccgcccuucccauuagguucuguauugaccuucgauauuccccuuggaugaucucauucguguccaugacuucaaccaccaccacccagacauggaugacuuccaaauagauaucuuuagcccugauauuucuaugucccacacccuguagauuucuuuccaucucugggaguaaguccuauauugcuauuaacuaucucuacuaguaaacacuaaaaugccacuucuuuuuuuuuuuaaagacagucuugcuguacugccuaggcuggagugcagugguuugaucucagcucacugcaaccuccacauccuggguucaagugaucuuccugccucagccucccaaguagcugggauuacagccacacacgaccacacucagcuaauuuuuuuuuguauuuuuugaauuuuuguauuuuuggggguuucaccauguuggccaggcuggucuugaacuccugaccucaagugaucugucuaccucggccucccaaagugcuggguuuacaggcaugagccaacgcaccuagccucuaaaaggccacuucuucuugacuccccaucaaacuaacacugaccacccacaaaucaucccuuacccucucuuuugccucucuccccauauuaaaucagcugccaagaccucucuguucuaucucuucuguugaauuuauuucaauaaauauauggaauaauuacuguauuuuggguuaccaucuuucagagccauccaucucucugcuucuaccaccuuaagcaucuucucuugaggaaaacugcaguuaccuggccacugucucuaucagguuacucauaccccucccaucugcccuucacauugccacugccaagcgggcuuucuacaaauuuaaucucagcacgcuccuccucccuuacuuaaaacccuucauggcuuccuguauuuucaggauaaaguucaaacuagccccauucgagcauaaaagucauucaagauacaagcuuaucuuaauucuccacccucauuucugacuccuguagcccaggaguccagguccuucaaccugcaccccaccccacugagugguuguguccagcuuuccuccugcagaagcaccucuucccccauucuuuucuggccauucuggcaugccuuaaaaacuggccauuucagcaagagaauuucuguccuucucuuuauuuuuuuccccuauccucuucauaccauucugaauauuuagagugcauuauagauuuuuguuuacuugucuaucucacuagaugaugagcaauuugagguuugugucaccagcaucuagaacugucuagaccaguguuucuuaaagugagguccccagguccuccuggcaaugacagaaucauuugguuguuguuaauauucauacuugggcccuccucacccccacaggaccuagaggauuggaguuuuuguuuuuuuucuuuaguuuuuaaaauuuuuuucuuguuuuaguuucuccacuuugcaagagaaauuuuugauuuuuuaaacuaggugauguuuaugaauauuauagauauugaguaaauguuuuugaauaaacaaguaaaccagcuggagcccucguucauguuuuugaguucacauacgcuguauuaacuuggauuuguuacugauaauucuaaaaauaccccugucuauaaaagaggcaguuuaguuuucuagagaagacugccuauuugucauaauaugaacuugaggauuuggagauucuauggccaauuuugaucaauauaaacagauaauuugaauaguucagauuaaaaaaauaauccacacaacucuggauuucagcaucccaaacucuucuagcccuucuggugacucaugaaaggugucccaccucucuguaacucaguuucugucaguguaaauuagaaucauacugugaagcaacagggauuagaacaucaacgcaacagauauuuccuagguacuucauuauuuucaguucaauguccaaggugcagaccuuacauguaguacagucaaugauaauuuagaaagcuuccuuaccuguaaaaaauucucuuauauucaaauaaacuagugcagccagagcuuuuauauaggagugggaguuagagugaaguaucuaaugaucuuuauauguguuaaacuuacauguuuccuugaaagaaauguguacuuaccuauguuuguaugcauuuaaaugccuaaauacagacccaugcacagauauaaauuuucugucuuugauauccuaaaaugacugauggucaugugcauaaaagcuagucugagaacccuggagccugccagacagguugagcuucugaguaagcacuguagcuauugcagugcucagcccacacgauauguuuugcuuaaagggaacuauccaauccuuggccggauggaugaugguggacacuuugguuuaauacugcuuauuacugugucacuuuaauuugccuaaaauuguucacagaacguuguccuuauauguuucugggaguuacuuuuccuugggcuacuguguugguuuugcuuuagcauccuugguucagucauuuuuaguacuuggucauucaagcuuaauuaaaugagaauaauuacggccagaaugcccaggaaguauaggacagcuuuuuguuuuuguuuccccgcugucuuaugguacugacagagcucccacagaucaggcagcucaacagaggagggaggcuauacaaaugucacuuuaaauauauuuacauuuuagaggaauuggcuugcuaguucuaguccauguuaauaaaucaccacagaaucccacauacuguuaguagcaacagaacuuagugccuuacauucagagaaguuuuaauugaaauuuagaguauuaagauuguguuggguggccaggcgcgguggcucaugccuauaaucucagcacuuugggaggccgaggugggcgggucacgaggucaagaaaucaagaccauccuggccaacauggugaaaccccaucucuacuaaaaauacaaaaauuagcugggcaugguggcgcaugacuguagacccagcuacucaggaggcugaggcaggagaacugcuugaacccgggaggcagaggcugcagugagucaagauccauuacugcacuccagccuggugacagagcaacacucugucucaccaaaaaaaaaaaaaaaaaaaaaaauuggauuggauuggaaauaauggaaaaaaucaacaaauagaaucuuaaucauguaugggaauugccuuguuucacucaacagacgucuagagcacacaaucuagagcugacaaggcagcuggaugaugcuaucaggaaacuaagcugauuucaucuuuuacuucauugucuuucucaugugggcugccccacggcuauaagaugguugcugccacgcuucagguuugugacuaggaagaaaagagaagagcaaaggaauaaaacuccaaagggacaugcagacaagucuguauguuuuaaaaaccuuucccagaagccccaccuggcaacuccuguuuucauaaucauugccauagcuucacugcagacuaaucucugaaaaagagcaaggcaaaugaguaucauggaugggcauucagucauauugccauacuuagccucacaauugauccaguccagugaagcuaggguuccaaucaaagaacgucuugugggguguaucacuuacuauaacaucuauccugguguuaaggcaucucuugagagacucaaggacuuuuuaggaggugacagaugacacuagggaacacccuguuucucagcugguaagaagagaaagcaauccaguguagaugugucucacuugagaaauauauaaaacaauaacagaaauauauaaaacaauaacaauuauuugauucuuaaaaauaauuauuaauuuuucuuaaauaggaaagcuccccaaauguuuucaaaauacaauuuaguuuuuugaaaaaaagauuuauacauaauuuuucuggacuaaaucugcuacauaaagcaagauaagccuguccuuuugaaaaguuugccuuugaguacugaauguguagguuggugcaaaaguaauggcaaaaccacaauaacuuuugcacccaccuaaaaucuuaguagcucaguuaccuacuuaucuauccucaucaguccagccuuucuuguaucuuccaaaacauguuccaagugagcugagaaguuuccuuuacaaguucugucuuguugguuggaaauauggaugacuguuuucucagucuugaaacugacauuguugcauguugguagcugacacauggugggaggagcauaauuuuauaucuaagaacaugauaagcaccgaaacaaaugaggaaauguuagaucuugcuguugccccuacgcucacagauaagugucugagugaaacuguuugcagaaggcacucgauggacuucauacacccauauguguaaaacauuuaacgaguugcucugaaaugaugcuccaguugggaggguacagaugcaggaacuuccuguaaccgcacugcccaugacgccugccuuauccucaccuacaaggccugcuguugucuaaaaccugugccauucccaccagacuuacucaagcuccagcuuucauuucaucagugagugaucuuuauauaucacaaauccaagcacgugacuucauucauuuaaaaccuucauuggcuacccauuacucuuaagaugaaaaagaaacgucuuagcauggccuauaagaguccucaugaucuugcuuccacuuaacuucuugcaccuucaucucaacacucucccacuuacucuguaauugaaggucaagugcucuaaauuucuuagaguuguuugaaugugcuuucucucucaugccucuggcucuuugcccauacuguucccucucacuuucuuugccaggcuuauacucguccugucugaauaugucuccagaaagccuucucugacccaacaagaugggguuaucgugccuccuguguguuuccuaauuucacuuuuuacuuuuuuuuuuuuuuugagacaggaucucucuguguagcccaggccagucuugaacuccugggcuccagugauccuccugccuuggccucccaaagugcugggauuacagguguaagccacugugcccagccuguuuccuuauuuuuaguccccugcuuuucugauuacuugucuguuuucccccaaaacaugucugggugcaaggagugugucuguuuuguuaacuauucucaaugcuuaggacauaguuagcccuuaauaaauauuuacugaauagcuguaugcaagaaugaaugaaucaaaagucuccuuauucucagcccagauaaauucuucuuggucaugauagauaauucagcaaaauuuuguaccauaaaccaaaaggcuuugaaaaguuuuauuaaauaaauauauuugaucucugucauuaaacuaccauccucaaagccuggaaaacuaucuuucaccuggaaaacuaacucauaacuuaugaagaaaaauaaauguuauccauuaguuucaguuuuacauuuaaaaaaggauaaggaauuuuagauuaauguuuuucuuaggcucucccauagaggagaagcuuuaggagcuuagugagacauaggcuuaccuucuuuucuuuuuuuuuuuuuuuuuuugagacggaaucucgcucugucacccaggcuggaaugcaauggcacgaucucggcucacugcaaccucugccucccggguucaagugauucuccugccucaguuuccugccuagcuggguuuacaggugugcaccaccacacccaacuaauuuuuguauuuuuaguagagacaggguuucaccauguuggucaggcuggucucgaacuccugaccuugugauccaaccaucucggccucccaaagugcugggauuacaggcgugagccacugcaccuggccaggcuuuucuuagagccaugguauuguggcaacaacgguacauauauccugugucucuuaguguagaguaggagagauggucuacuacuuuuccuuuuccucucuuuucaaagucuuugcuuuuuuuaaugcauugauuuuuuuuuuguaauuacaguauuagccagaaguauuuuauuuuuuguaggauacaauuaauuuugauaugcauguuaucaaagugauguuaucuuugagauaggaaaucaaagaguccugagggauucuggaagagaguggcugaagauagguagcuaaaucaucaugauaaaagcaugaaauaguggaucaagcucaaauuuaaaaaucuucuaagacuuuuacuucagugcacacuuuaugguuacucuucuggauucagaaagucugggaggaggaaaucugucuuugcaagcaucucauagguucuguuggagguggucagugaaccauuuugagaaacacauaagauuagcugguaaaaaugcuuaguucaaaaaugugaguguguguacauaggguuguuagaugacuagcaccuucaaauccucuuaaauuuguuacauaacaccagagaguguauuagaaguuuggaggaaacuggcaucaaauuuuucacuaccauccauauguauacuuccuugggaggccucccaaaagucaaugaggggcaaaauugaguuacugauuugucauuaaugggaauuccaagcuuugccccucucccuuguuuuacucugcuccacucaggccaagauuugaggguugggugcagcgacucaugccuguaaucucagcacuuugggaggccgaggcaggugggucagccuugaguccaggaguucaagacuacccugggcaacauggcaaaaccucaucucuacaaaaaauacaaaaauuaucugggcauggcgguacaugccuguaguccuagcuacuugggaggcugagguaggacaauuguuugagccugggauguagagguugcagugagccaagaucaaaccauugcacuccagccugggcaacagagugagauccugucucacaaaaaaaagauuggacaguuuuuguuuuuaaccaucacuggggccaaaucaguuucucucaaucucuaauucuugcucccaaucuuuuucucccuucucucacucugauuaaaauugacauauuguuuuauuuuuuauuauaaaaguaauaaaaacauucuuuuuauaacccacaugaaugcaaguacaaaauaaaaaucacccauaaaccaaaucucuauuuuuuuuuuuuugagauggagucucgcucugucgcccaggcuagagugcaguggugccaucuuggcucacuucaaccuccaccucccagguucaagcgauucuuuugccucagccuccugaguagcugggacuacaggcguaugccaccaugccuggcuaauuuuuuuuauuuuuuuuuuaagagagaugggguuucacuauguugaccaggcuggucucaaacuccugaccucaggugaucugcccaccucagccucccaaagugcugggauuacaggcaugagccaccaugccuggccuaaaucccuaucuuucuaauagaguaaagaaaauuacuuuuuauuaauuuauaaagaaaauuaaauuuuauccaucccuuuccuuauguauauugacauggucuuggucuuucauucauagagccacugaguucuauaaagauacgaagauacucuggaaacacguagggaaauguagaaagacuuuuuaaaaaaguguuuauguuuuuaaagaaacaacaauaucuuaucuuugaaacauuuauguuuuuacuuaaugaugguuuccuaaaauugagaucagcuuauagguauauaauguuauuacucagcuaaaaauuuaaaacuucaucucaacucacugaagcauuggagucaaaggcuuuauuuuuuaaaaaauggaaauggguaguuguuagaguauauuuuuaaaauaaaaauuacucaaugacuuuuuauuuuaguuuaaaaguaauauuuauucauuucauuugccuucuuuucaaaaguucugauuuccacaauaccauuagguuuuacuucucuauauguucauuuagagaaacauauauuaaaaagucacuugugccuuguccuucacugcugacucaugaugaaaauugaaagccuauuuuuuguccuugucagaaaucauuauacuuuuuugcaacuuggaccuaaaaacaguuggccagugaagcagaauuaaugugcuuguagaaaaaucugucuaguugagaguaauccuggcaguuucuucaagaacuagccuuugcuuauauauauucagguuuggguuugcaagaggaaauccugaaagaacaauaaacacauucuuuuuuuuuuuuuuaaguuccaggauacaugugcagaauguacagguuuguuacauagguaaacaugugccauggugguuugcugcaccuuucaacccaucaccuagguauuaagccccacgugcauuagcuauuuguccugauggucucccuccccuaacucccuguaccacaggccccaguguguguuguucccuuccucguguccauguguucucauuguucaguuccuacuuaugaguaagaacaugcagaguuugguuuucuguuccuguguuaguuugcugaggaugauggcuuccaacuucauccaugucccugcaaaggacaugaucucauuccuuuuuauggcugcauaguguuccaugguguauauauaccacauuuucuuuguccaguccaucauuagugggcauuuggguugguuucauguuuugcuauugugaauagugcugcaguaaacauacguaugcaauaagcaaacauucauuauaauagaauaauuuguaauccuuuggguauauacccaguagugggauugcugggucaaaugguauuucugguuaaacacauucuuuaugaagaaagauuaaauaaauucuucucuagagucaagcuacuuuaaaccuguuuuaauucaagacuuuaccgugguaccuucuaaucugucuacagacugucuaauuuaacucacaagaggcaguagcagaaacugggauuucuugguaacuaagauuuauaguuaccuuuuaaagaagauuuuaguuauugauaaaaacaaacaaaccuucuuuaccauagucuagauccuuucaugcucauuuuuuccugaaugauauuuaugacuaugcaaacuuagcuggauuuaccugaaaaguuacugaaaggagaauuauugcccagauacacauuuauagauacaugcucaaaugacaucucaauauguugaauuuuccaaagacaaaaucaguagaaucugguaaauuuuaccuuugaagauaguucuugccuuggcuauucccugccuuauacauuuccucccagaauggcucauucccauacuuccuuccagucuuggcucacauccaccuucccagugugccacccuguuuaacacugugcucugucccucacucuccaucccauuuuccaccugcaccaacuugcuuuuuuucuuuccauaauauuuguaauuuucuaacauacuauauaauuuacuuauuuucuuauuuauugucuuucuccaggcuuguaaccuccauccacgaggacgggguuuuuugucuguuugguucacugauguauucccggagccuagaacucugcuuagcacacaguuggcacucaauuaauacuugcugaaugaauaauuuaaaucauuucaagauuuaaacuaccuaucuuaauuuguaguauucuuucugcuacuaagggaaaagagcuauaagaaaauacaauuuuuacuguuuagauuuaaaauaaagugaguuugaagcagaguuucacagaucacuugagcaucaguuauucuauuuagucuucaauaauguauuuucccuguuaaaaguauguccaaaacacaagauuuaaaaaaucaaauaaaccauuuauuaauucauauguugaggaaagacguaaaguccugggcauacaaaguugaguaagauacaaucuguacccuucaggauuucaaaggaaagacagauauguuagcuuguguguaaaauacaaacagacaagugcuacaguagguaagaaaaagacauauagaaagcacaguggugaugaaggaagggauaggcaacuugaccuagaagcagucagggaguaucuucacagugaucauaaaaaaugacaagguugcaugggaagggcauucaacguacugagaacagcaugugcgaaggaaagugggacaaaggggcgugaugucuuuggagaaugacaguauaguuguagcacagggugucacaggggaaaguuaugacaugauuccagaggaguagggagaggugaaaccauuugaaccaugucaaagcauuuuggggccgggugcagugccucacaccuguaaucccagcacucugggaggccaagguggguggauugcuugagcucaggaguuugagaccaggcugggcaacauggugaagcuucaucucuacaaaaacacacaaaaauuagccagguguggugacaagcaccuguagucccagcuacuugggaggaaggcuugagaccaggaggcagagguugcagugagcugagauugugccacugcauuccagccugcacaacacagccagacuguguuucaaaacagaaaccacaaaaaaagaaaagcauuuuggacaucuuagagaugaugccaaaucuguuaaaauuccuacagucuguagagccuagaaucuaccauauaauauuaaugccauucauauuuaaauaaacaagauaguuggcuaauagugaagauuauaugcuacauaaagaucuugacuucauauaauuuaauguuuacauuuccuuuuauauagucuugcacacuuguguccucaacaguuuuucuauaucagauuuaaggauuuugaagcaaagggccauuguccuuuuggacagcuggaaauacagaauaagucagucuaagugggaaaacacaaagacaaaacaacgguguaguaugccuaagcucuuacaguauguucugccauuaagcagucaaggguauacggcugccaguauauagcaaaguaggcaaacacuagauggaaaaggaguagucagcuucaagcauguagugacuuuggaaagucuggagaccuuuucuuacagauuucucuggagaccuuuucuuacagauuucucucuauguccaaaaauuaagccuuaugaaugugaccuaaagaaaggaauguucuauuggagacaaagugaauugcaaguguaagugauuuauauuuuuaacuggcagaaauagugauggggugugagagugagaagggaugauaaaaacuacuacuuuuuuuuugagacagagucucgaucugucgcccaggcuggagugcaguggcgcaaucucggcucacugcaaccuccgccuccuggguucacgccauucuccugccucagccucccgaguagcugggacuacaggcgucugccaccacgccuggcuaauuuuuuuguauuuuuaguagagacgggguuucaccguguuagccaagaugguaaaaacuacuacuguuaagaaccaacugggauuucuugguaacuaagauuuauaguuaccuuuuaaagaagauuuuaguuauugauaaaaacaaacaaaccuucuuuaccauagucuagaucuuuucaugcucauuuuuuccugaaugauauuuaugacuaugcaaacuuagcugaauuuaccugaaaaguuacugaaaggagaauuauugcccagauacacauuuauagauacaugcucaaaugacaucucaauauguugaauuuuccaaagacaaaaucaguagaaucugguaaauuuuaccuuugaagauaguucuugacuuggcuauucccugccuuacgcauuuccucccagaauggcucauucccauacuuccuuccagucuuggcuuacauccacccauuacaggcucaggccuguaaucucagcacuuugggaggccgagguagguggaucaccugaggucaggaguucgagaccagccuggccaacguggcgaagcccugucucuacuaaaaauacgaaaauuagccaggcgugguggcaggcgccuguaaucccagcuacuugggaggcuaagccaggagaaucgcuugaacccgggaggcagagguugcagugagccaaaaucgcuccacagcacuccagccagggggauagagcgagacucuguuucaaaaaaaaaaaaaaaaaaaagaaaagaaaaaaaagaaaagaaccagcugagaaguguaacauuccugguauacaauguagugguugagaaguguaacauuccugguauacaauguagcgguggaaucucaagugcucagaacaccuccaucaguaccuagaauauaguaagugcaguuuuuaaaaaguaauuacuauuuugaucaaauugaaacacauuuuaauuucguggccuggaacaaugcauaguaguaguuugaagucaggacccaacuguuuguguauaauggugcaucaaguucccauaggagagcuaugugaagagcugcaacccauggauauucaguaauacuuuuuaacuauuguuaucacacucagacaucuagaauuccucaaauugaucaaaaaaggccuuagacucaagaaguaucuugaguaaauacuugccaaaucuuuuuuuuuuuuuacuuuuuuauuuuuuauuuuuugguaggaaaccuuucuguguaaacauagcuaaauauuguuacucucaaaucuuggugcuuaguaaaucagucuugacaaacaagcaaaguagaaaaaagacaagaaaagcaaaggcucagguuuacuauccagagcgauugcuaccuauccacauggugugugcaugccagcauaagcaaucugaagaacacauuuccccauaaugcauucucaaagggcaugcuuugggaauaggggaagacacauuaaccuucugacuuucaaaggaauguugagucacauacacacucuucucucccuaagcauuuuuccuuccuuuugaaacucugaagaaaaggaugcuguaggcauugugauuuugagaaucucuuuucugggaauccaugcuugaucaaucccagccauaccauagucacaugcagcaauucaccugacaugcaaagaaaggagaaauuauucuugugucucacaaccuggcaguaaagagaaacuuguaagaauaaaguucccuuucacuuuaugaagaaaugggagcuauggacuuaauuuucuuguuuucugagggaucuugagauuuuuuuucauuaagauuuuccccaaaaggucuuucuuucucucuuuuuuuggcuuugaaucugugaaggggcaaagagaaaaaagaaagugaaagucugugggaaaugauguaaaaagauauauagauaaaagucuucuaagcuauauagagauaaaggacuccuaaaccagcuccggacacugucugaccaguuuuacucugcuucccgcuguagaaacugaugacaggcacaagcaggagcgcagcuuccuguugaacugguuuagcuuugugcacaauccuuagaggagaauuagugccuugcaacauguuaauuaggggagcaaaggccugugaguagcuaauaaagaugauuaauauuuuguuagaagauuuagaaaacagugcaauugauuuuguccaucucaauugauauacuuuaucaugugauaccaccuuuuuuuuucuuucuuucuuuugagauggagacgcacucugucaccaggcuagagugcauuggugcaaucucagcucacugcaaccucuacauacuggguucaagugauucaccugccuuggccucccaaagugcugggauuucaggcaugacccacugcacucagccaauaccaccuauuuuauuacaauuccaauacuucugaaaauagagcuauugcuacucucaauuuuuauuaauuuuaauuaauuaauuuguuugaaauuuccuuuguggcccaggcuggagggcaguggcaugaucacagcuuacugcaaccuccgccaccucccaagcuaaagccauucaccuaccucugccucucgaguagcugggacuacagaugccuaccaccaugcguggcuaauuuuuacuguagagaagggguuuggccauguugcccaggcuggucucaaacuccugagcucaagcaaucugcccaccacauccuuucaaaguguugggguuacagacaugagccauugcaucuggccuacucucaauuuuuuaaaguguaugucauagaaaacuuuggugauaucaaauuuucggacuuugaauaugggaguauccccauguucauuguagcauuauucacagcagccaacauauggaaucaaccuaggugcccguaaacagaucaauggauaaagaaauugugauauaauggaauuuuauuucgcauuaaaaaagagauucuaucauuugugacuacauggauaaaccuggaagauauuauccuaagccaggcauaaaaagaaauguuauugugugauuucauuuauaugugaaaucuaaaaaaguugaaaauguagaaacagaguagaauagugguaacauugucccauacugggugaaguuaauauugguuaucauggaauuaucuauaaaagugguuaauaaagagaugacugcaguaacuaaaauucuacuucaagaagaauuugaauucuguguggaguuagggggguggugucuuggcaguuaccaugaagucugguucuauucauuuaagaucacuggccaggcgcaguggcucacaccuguaaucccagcacuuugggaggccgaggcggguggaucacuugaggucaggaguuugagaucagccuggccaaaauggugaaaaccuguguccaccaaaaauacaaaacuagccgggcauggugguguguuccuguagucccugcuacuugggaggcugaggcaggagaaucacuugaacccaggaggcggagguugcagugagccgagaucucaccacugcacuccagccugggcgauagagugagaguuugucucaaaaagaaaaaaaaaaaaaaaagauuauuccuuuuucuccucucuggggagauauauauauauauauauauauuuuuuuuuuuuuuuuuuuuuuugagacagagucucacucuguugcccaggcuggagcgcaguggugcaaucucggcucacuguaagcuccgccucccggguucacgccauucuccugccucagccucccaaguagcugggacuacaggcgcccgccaccacgcccggcuaauuuuuuuauuuuuaguagagaugggguuucaccuuguuagccaggauguucucgaucuccugaccucgugauccacccauuuuaaaugcaguucuagaugaccuucauucaggagaggcacugaagcagaugaauaauuguaagaauucaaucuaccagccuucaggaugcagcuggacauggcccaucguagucagaagugaaccuaauucuagaacagugaagagaguaauauacugacucacugguuguuauuuuguuuucccuuuuaaaucgaacugcucacuugaaacaagaagcuugcuuuauuuacucugugcuugaaaucaauuugaagcaauucagccugagugugucugaggcauaagugguaucaccccaaucagugaacguacuuuugaagcaguuuugccuacacccucuugaguuuuccaauuucucuuuucuuaauuucugucuccauauuucucuuguucaggauccucaaccuuagcacuauuggcauuuuugggggcuggauaauuuuugguugcagagggcugucuuguggcauccagggccucuacacaccaccugccaguagccaacugccuuccaguuguaaagaccaaaaaugucuuaagauauuucaaaauauccucugaagggcaaaaucaucacccucugugagaacccaugguggaggccaaaagagaagagguccacagauugaauucuggggauccucaguuuguggauugaggagaugaagggaaagcagcaaaggaaaaugaaaaaagaacagauggugaaguuggagaagaagcaagagaaaacagaaaggaaggaagugaaggaagcauugcaggaaagaaggaguugccaucugugucaaaugcugcugcuagcaggccaucuggguggaagacugauacuugaccauugcugcauagaaaccuaucuuuauagacauaagcccaaaaagagaggaaggauaaaacaacugcauugccacaaacaggaaaacauacuuaaaguagccuguaguacguauuuuaagauugggauuaagagaaugguuacaaaccaaguaaccuuuguuguugcaaaggaguguugagagauggcaauuuaggacuguggacagucagaauaaaucgaauacauauuaguaauuuuaguaaauuguauauuauacuagaaauucugaacauagguaccugguucauuguaaaggauacaguaagucaugugcuacuaagaguucagaugcugauauuugugagucacauguuaaugaguugcuuaaagacaaucuccauaagaguguugcucucgcccuuuggauucuaaaaugcuuucuugaguagaggggaagaaccuggcuuuggggauggcaaaccaggaauagacaugaaacaugugcaucuguaggggucuccuauguguuuuaguagaagaauggcuuuagaucuuacgauuuaguuuaauccacaugguaaacagaauaacagucccucaaaaaugugcccaucuucugugaauauguuacuuuauauagcaaaggacauguugcggaugcaauuagguugaggaauuugagauggugagauuauuccagaauaucuuugggcaggggacaucuaaucacauggguuguuaaaauggaagccucuaggcuguggcccuggauuaucuggugggcccauuauauucacaggguucuuaacagggaguuggggggaucagagucagauaaggugacgugaccauggaaacagcuuggugugaugcauuuugaagauggagaaggaggcagccaugagccaaggaaugucaaguggacucuagauguuggaaaaggcaaggaaauggauucugccauagagccuucagaagaaaugcaacccuggugacucuuugauuuuagccccguaagacucauuucagauucuaacuuccagaacuguaagauaauacauuuguuuuguuagaagccauucaguuugugagaauuuguuguagcuguccccauuaucggaguucucaaagcuauugucugcaaacuuuauccucuuaugucacugaaugagaguucagauuuugaaggagcaguaugaaagccccagucaaaauguugccauauuauuauuauuucuggaaguuuuuuuuuguagagacagguucucaccauauuacccaggcuggccuuggauuccuggccuuaagccgucuucccaccuuggccucccgaaaugcugggauuacaggcaugagccaucaugcuuggcccuauauuauuauuuuuaagaacaagaugaaauucagaguucuuucuuggguaaucgggugauaaucucauaaguaaaaacaauguuuaagucauuuucacucauuacuaaaaauauauuucuucugauuacugccaguuuuuucucaagcuuaauuucuuauguacauuugauuuugcugacaaaaucaauuuauaaacuaaccaugagaucaucgucacugcugagauauuuucucuaauccagaaauaguauuugggguauauuuucucauugcuuccccaguuucuuuucaaaauuuauauugagggaaucauuagugacaggaguauauuuauuuauccaauaguuaacgugaaaacaugccauguuuuccccuucauuuuauuuucuagcuuuuggaauuuucagcugucuaugaggugauuuggggaaaugaaaacccuauauaaauauuaagguagugguaaccuacaacagaaauggauucuccuuugauauaaaugucaguccuugaguacagagaaagugcucauaaacauggauauguuuaugcuuguuuauauaauugugcaagcuguuauuuuucuugguuuugauuuaaaucuaggaaaauuuucaguuugaauuggacuuaaucuuauaaaccugaaauccgguuuucaaugcauugugaauaauugucuccuuuugacaguguuuuuucacuucuaguuuuagccuccagcucugauaggucuauuaguuauaagacguccuaggcuucuuuaggauaaagacaaucaggaaacagguuuuuauauucaacucuaaguguagccuguuaguuugaaaggguguuggucauccauaggggaaggaugaguggcuucagcauuugggucaguuuuuaaagaagcccagcuguaccauaugaucaggaacuaaugaccuccaaguuccagucauuauuucuacauuuaguagaaauuagaggaccaucagccaggaaguuuuuagccaggaauuccuaagcugaaaaguuuagacuagaugucuaaggucuguuccaaucuugagauucuauaugucuagggucauuaggccacuggacuggaaaagaagaucuaaaaaaaagaaaaaaaaaugccuacagcuuugacugacauagcccauaauuguauuuguguaacuucaagcccaauaaaauuuuauauuuaggaaaauagaugacuaaugcuucauuuauauuauagaauagauuuuuaaggcuauaggagauaaaguuuagcuuggugacaggagagucacucaacuacucuuauuuaauaggaggcauuucagaauuauaguacaguuuuuauauuaccauuauuguuacacuuuuuuucguuuucaagggauggagucuuguuauguugcucaggcuggauucgaugucucgagcucaagggcuucucccaccucagccuccugaguagcugggacuacaggugcaugccaucaugccuggcucaucauuauuauauuuugaaauaauuuaacaagugagcauugccucauuggaaauuaauaugcuaccuuucucguagaaugaagaguauuucuucaagaaaauuagugcaaugaaauugaauugcugcuggaaccaccuucugaauucuauuucuacaugcugccucucuuauucagaaauuacuguuuuaaauggccacaagaguuuuguuuuacuaucacuagaucguuaccuggaaauucucaccugcaacaaucaauacucucaaacaaaacagaaacuagaaauuauuuuuucaucauagagaucauuuuuaguuuguuuucagaugggcaugggagauuugucuaaauaagaccaaugacuuuuuguuuuguuuuuggcuuuuuuaaagacagggucucacucugucgcccaggcuggagugcauggggcaaucaugcucacugcagccgcaaccuccuaggcucaguccucccacccuaguuucucaaguagcuaggacuacaggcaugcaccacuacagcagacuaauuuuuaauuuuuuuguagagauggagggggucucaguauguugaccaggcuggucucgaacuccugggacaaguaauauucccgccuugcccucccaaagcauugggauuacaggcaugagccaccaugcccagucacugauauguuuucugccagguuuugacuugggggugauggcaagcuuuccucuuuuuuuuuuuuuuuuugagacggagucuugcuuugucgcccaggcuggagugcaguggcacaauccuggcucgcugcagccuaugccucccagguucacgccauucuccugccucagccuccucaguagcugggauuacaggcgccugccaccacgccuggcuaauuuuuuuuguauuuuuuuaguagagacgggguuucaccguguuagccaggauggucuccauccccugaccucgugaucugccugccucagccucccgaagugcugggauuacaggcgugagccacugugcccugccggcaagcuuuacucuaaggagauaaaaaauugaauggauuuuaauucuuuuguuuuuauuuucguuucugagauggagucuugcucuguugcccaggcuggaaugcaauggugugaucuuggcucacugcaaccucugccucccagguucaagagauucuccugccuuaggcuccugaauagcugggauuacaagcauguaccaccacacccagcuaaguuuuuguuuuuuuaguagagaggggguuucaccauguuguccaggcuggucuugaacuccugaucucaagugauccaccccccucagccucccgaaguguugggauuacaggcaugagccaccacacucagcccggauuuuaauucuuuguuugauuuugcuaacuagagcagcaaggacagucuacagucuuugguucuaacuucaaaacugauuuuuucugaucaguuuuauuaagccauaucuacugaaacaaaaaguauucuuguaccucucuaagaugcaacgcuuuaggauugaaacugacaauucucugagcugcaaacaucaacucuacugaaauaaugcugugauuagccuagcgguuugcuaucuuuuacuaugaacaggagaauauucauuccuaaaggugaucccaucugaugauuccugugaagagccgcaguucacacacacacuucagugcauugaucgagagaucaggaauucaacuuuugccacaucugcccucagggauagaaauaaugcauaccaaguuucucugugaacaucuuuuuaaauucugucuuccuucccagcucagacuuucaguacccuucaugacuucauccagcaguucucuauccauuuuucugggggcacaaguuauuacuuccccaucucucacccaugggacaugaugggguaugugugauuuagucuauuguuuauuuaagaagaaaaagaagaaaagaaaauuaagccauacauuucaguccuguacuuuaauuaguaguaacaaauuacugggcacaugccucacaacuuacugcaaacuugaggugcagauacagccugaacucugcugcaguuuucagaaugucacacaacccaacuuuagcccgcaucuccaaacaggcuuucuaccauacccaacccacagcaucugguaugacagacucccgguuuagcucacaccuaacuccauugccuauugcuacuugcccuuugcccauccauccaaaaccuucaggguccacucuuaaaucuuccacagcauuuucucaugacaauagucuccuuccuuagcucuuuauaaaacauuaucuguaacacacauuugcuacugacccccuauauaaccauguguuaccauguaaauuuuucuuucuagcuagauuagcagaggcagaauuuacucucacauaaggauccuuuuuucauucaaugucuuacuaaccauacugcaaaggaauacaaugaguuuauuaaauuucuuggccauggcuuaaaccuaacagaagaaaaaaaaaaacugaaagguuuauugaauuuugaauggauggguggaugucaacauuuucaucagcuacugaaaaaaaaaaaggaauucuaaggaaacaaagggaauugauaaccugccgauuuaaguauuaaagagucuuuuuagaugugcaguuuuuucguuuuaacauuuugagaguauuuucucccccaaaaucuuauguccaguuguaauacaaaaacggaaugcaccaagauuuuuuaaaaggugacaaggggggaaaaagauaaguuuacagauguauacaaggaauuucuguguccaaucugcuucuaagagggguauacuuuccuggaaagggaugugcagccauguuauugaaucucauggacuaaauguaacucuacuuugcuuauggccuacuucaaggauagaaaaacuaaaaacuaguucucacaccuuuuuuaaaaaaauagaugaggagaaccugugaucucuaaauuaguaucuggagggggaagcaaaaagguaaagugcuuacaacucaaagaagcuuggaaaucacaccuuaguugguauccuuggucauacacaacagcuuggaauaagaauaaggaaccuuuaccuuaguuauggcuuugucuugcaauuguaaagccacuuuucauuuguaucaauuacgggcauauuuucaugauuauucacaaaauuguuugucagaauuucugggcauaugguuaauuuacuuacgaauaaaaccuccuggccaggugugguggcuuacaucuguaaucccagcacuuugggaggcugaggcaggaggauugcuucaguccaggaguuggggaccagucuggccagcauacugggaucccauuucugcaaaaaaauuaaaagaaucaggcgcaccuguagugccagcuacccaggaggcugaagugggaagaucgcuugagcccuggaggcugaggcugcagugagccaugaucacaccacuacgcuccagccuagaugacagaaugagaccuuggcucaaaaaaaaaaaaaaaaaaaaaaaaucugcggaaaaauuuccauuuuuuuuaacguaaaaaaaaugccuauaugaagucuugcagaauccuuaagaauguggcagaauuaagcccuggauaggacuucaagaaaccucaggaucccucucaagaaaaucuuauuuucuuaucaaauuauaaccaccauagacauacauuaaaugucauauuggcaaaaaguaguguuauuuccucuagucucugggucccuacuuuauuuguaucccuaaaaucacuuucagaaccauaaguuguuuccugacuugagucagcaacugaacugcaagaggacucuuaaaagaggaggggggugcaccaguuggcauucugucucagcgucagacucuucaccuuagaacaugaaaacuuucucugcacuagguagauagguaucagcugaacugggcggugcccuuuucauuuuuuccccucacugcuuuuuacuuucccaucuccuuguaccucacauguguacaguagccauaaugaaggccauguagauacgacaugaaagagccaggagggagcucaggccagcuucccaagcuauucauuagcaauuauccuauguugaaauacuacccacauaaacauuucuucauuagcaaauaaacuaguuugacucuugggguauagaaaucuugacgugaaugcuaacgagacucaagcuaagcacugguuucagugaaaucccacgaguuuaaaaaaacauguauuucaauuuaugcauacuuuuucagaaauguuaauggguaaagcaagaaauaccaaucauaagugagaacuugcucagcuacucugguaagaaucaaaaaagcauguccuaggaaugcuuuggaacaagauaguaugauagagaaauucagauuucuaaggauagauccacuauucauuuuuauuaauuauggaauaauuuccauuguucaucuugaugacagaaauagaaggguaaaaaggauaaauauaagcuugacagaauuaaagcacaucaguauuucauuuggguugucuuuauuugguuggucaccugguaaucauaacuccugaaucaccacacugaaaaguacuuauuaaguaccuauaauuauggguugugcuauaugaugcacauuuaaaauuuauuaaacaagaagaguccaugcuaucucaaaaugacugauuaucuaauaauaaaacaguauaguguuaccauuauacccaaguauggaggccugccaguauacaaaguauuaccacagaaccauuaggaaagcaaucuauccacauuaaaaacuaagugggcuaguggcaaaccauuauucaucuugaauauaauugaacuuuaccggagagaugccagaaaggaaaggcaauuuuaauucauuuaaauuguccuguucauuaaagaaaaucuuaccuucuucuaagcaauauggaaaacaaauaguacauucaaccauaaaugacaacucaguuaaagagguaauuauuaaugcuuaggcaacuuccacuuauagcagaugcuuagguuuaauuccaaacuaaccccaaggauuugaauuucacuacaguaaaagauuucugugcaugcaaugaaaaacuuacuuugaucacagcacucaaaccgauucccauuaacuaccugugacccugauauagcuuauacaauuauuuuguguuuaccuaccugcuugaccacagccaugacaauguuggauagucuugaccaguguagcaugaagcugugugacugugagugacuauugucaucgguucccuauucucuuuucugucgaaggaggaaauugggcuccaccucuaagguuccuugcuugcaauuaucaaguucuaugauucuguacugacugacuucauugccuuagcuguugaauugcuuuguaaagagagcucuuguggaaaagugaauggcccuugcugggaagugagcagugcauuaggauuaauucucauuuuagaaguuaggaaauuggagaaaaaauacauagggaagauuuuuuguucuuuucuugguucuugaggcauuacuuuucccuuuauggcuagaaugauaggauuguaugaagauauucauuuaacuugguuuaugauugcaaguaauacaguuaauacaaccauaaucagaaucucaauuauguugaauggguaagauaaauaaugguaauuuuaaggaaaugucuuccaugguauauguauaauuaauuucuguucucaaagaagcaaagaggguuuggaugaaagcuucccaggcucagaaaauaugacaguagaaacaugaagaugggaaauucuucuucaucuuuucacaguuacacaauguucuacacauuaugcaaugauuauguaauucaacaggacagcuuaaggaauuuuuacagcuuauaagauaacacuucaaguaccccuuuuucuucugaaaguuuaccacaagaacaggaaaaucuagggcuacuuuaccucuaagccuguuuauuuaugaaauaaagauaauacuuuaccugcaccaugaggauuaaaugguaaagcuuuuuggcauuaugucuacccauaggaaucacucuauaaaucauaaugugauuauugucacuuauuaccuuuauaaauuagaaaaaaaguauauacuuuuucagauuacuaucaccuacauuaacuugguagaacuuuauuuuucuuuagucuuugcuuauaugugcauaaacagaaacagugauugugacucuuaaguaauuuaauuccaugcccuuguaauuuccagaggagaaauaaagcaauauauaauuuauggccaaaaguacuuucuuccugaaauguccaauaguuaaaguuuccacaaaauuguuucacugaaguauagaaauaaucaaugucuuucugggggaagaaaauguaucauaauauuuuucugaauauuugacucuuuaguuauuaauguauuacggggaaaguacaacuuucuguuaguguuugcugccuguuuacuguacacagaugccugauuauuuuccccaucagaaaauuugauaggacaagaccacguucauucaacagauauuuauuaagcaccuacuguguuccaggucuugugggcccaagagaagagucuguaaaccucagugaaagugauuuauucaacauuuacuuauggguugauuucuggaaucauugcuuuauuuggugguauucacuaaguaggucacuugcauucauuuacauaggaaagcugcuuguguaaauagcaaggucccuuaugagucagcauuacaugucagcauaaagggagaaaacacgaagcauuuuacaaauaauacucuuuaggugaacacauuuugcuuuugauauuauguuuuguaacuuauuucucaacccuuuccuuauugaucuaauugaauagggaagacccauuuuaagagaaacauugcuuucucaggaaacaugcucaacuguuuuaaauuauuuauaagguuucuguugcuuucagucgaaucauaguucuauuauagaaguuuguggauuuuugcuuuugaauuuaucuuuuggcauuaucaguacuguugucagaggcauuuguaccagagugacuuuaucuugaauaggggcuaaguaaaaugaggcugagaccuacugggcugcauucccaggagguaaggaauucuuagucacaggaugacauaggagguuggcacaagauacgggucacaaagacccugcugauaaaacaggauauaguuaagaagcuggccaaaacccacccaaaccaagaugguaacacaagugaccucugaucauccucacugcuuauuauaugcuaauuauaaugcauuagcaugcuaaaagacacucccaccaacaccaugacaguucacaaaugccaugguacaguauacagucuaaaaagggaaggaacccucaguucuguuccuggggaaauccccgccccuuuccccggagcacucaugaauaaucuaccccucguuuagcauguaauuaaaaaacccauaaaaguagccagccagcaguccucagggcugccuauggaauaaccauucuuuuauucuuuugccuuuugagauggagucucaaaaaucucagcucauugcaaccucugccuucugguuucaagcaauucugccucagccucccaaguagcuaagauuacaggugcccaccaccaugccuggcuaaauuuuguauuuuuaacagagagggaguuuuaccauguuggccagucuggucucaaacuccuggccuaaagugauccacccaccucugccucccaaagugcugggauaacaggugugagccaccacacccacccaagauaaaauuuuaaauggcuaucuuguuccaagacacaaccuugucaccaaauaguuccaauaaaaacacuucuuuuuaaaauucauguauguaucuaaauuggcucaacaaacucuaaagaauaaaauuauuucucucagugaaaagacuacuuuuuguacuucaaugcuauguuguugaaauuucaguccuagagccuacaaaggaaauauaucuauccugacaugauacuuaauauguugguuaaacuacuggaagaccugauuugucaagggagauuucaacagaacacuaguuugccguguagacuagacucccucuucagugaagcaggaauauucucaagaauauuuuuucagugcuuacaaagaggagaacugguacaaaauuugguguuuccuaaugacuaaaaauaucuuaaagauuuuguuugcuuguuugcaggaagaaaucuuuccuguuuucugcucuguaugcugccuuuauauucgguggucggcaccuaaugaauaaacgagcaaaguuugaacugaggaagccauuagugcucuggucucugacccuugcagucuucagguagguuuuuuucauuuuucuaauaaaacguauccauuuuaucacuugcugaaagaaugcaaugauugagcauuugauuuuaaaucugauauuuuugauuauugaauaugaugaggacauaaaauaaagucauguucagaaagaaagccuucacugccaccauuugccaugauguauucaaccuuauauauuuugagaggugucaggccaucucuuguccuguccaaauuggucaugcaguaaucugauugaucuguuaggaugagaagcaguacagcaauucauuauuguuauuggcuaaauauagaugaaagguuaaaugggaaggcacacaaguaaccuguugaagucuauuggagaacaggguucaaauacccugggugugcuguuccuaacacuuaaucaaaagaugacacuuagacauagaccagacacuggacaucugugucaguauugcuagaccagagaaugcuuuugcucugcaucuucaaaagcacccuccacccucauuccccgaacugacuugcagacauguguuuauguagccagcucuggcuuuguaaaugugaaagaacucaacacagagacugucaggacaaggccuguucucucagggcaucugucagcuggugugcagacucauuccuccagaagcuuucaggagcauuuccagucuuguauuauuuugugaucuaggcaaucacaagacuaauuagcacccagcugguguccaagcaagugccaggauuuaccuagagugcuaacaaaggcaccuguucuauuuguguuuugcuugucaaaaccagcaaguucauaacuaggcuuggggaggaacgggagcggaguaaauguagauauacuaugaaacacaaaacuauuaauuuucauauuuauaaauauucauuuguauuuuuucauauauuaacuguucuaagcagaaauggauguuaucauuaaagcuucauuaguuacuuaaagcuuauuaaaaaugacugaggaagaguauuuccauuaaacucuuaugaucuguguuuuuccauaauguuggaucccuccaucuaaaacacccacuuacucaccacuacugaauauacuuuuuauuucagugcaauuucuaaagcccuagguuugaaguacucaugauuuggaucugucacuaaaaucuccuuccaguucaaucuguaucagaucaugauucucuauaauauaaagaaggcuuuucauuuuuauuuacauuuaagguugacagaguaugccucaccugaaguauuuugauauuuguggggaauuuaucucuauccuaaugaagccuuucaccauuuuacugauuuuucaauauucccugcaccuuuaucuuuuguuauuuuaaauuuuaacacuuguaagcggagaaaaaaaguacaaugacuccccugcaaccccuaccuugguuaaacaauugucaacacuuggcugauuuuacuucguuuaaucuugcucaccuuguuucucauccccaaauuauuuggaacuauuaauaauagaggcugaaauaauucuuauugaaaucauaccauggcuaaagguuaaguacucuuuaaaagcaaacacaguauuaugaucucaccuaaauuaauaauuuguucuuauuaaauuucaaauuucuucaguugucucauaaaugauuccuguuuuacaguuuaagaaccuagaucaaaaugagaucuuuacacuuccauuaacugauaucuuuuggcuuauagauuuccucuuuuuccuuaugauucauccuuugaagaaaccagauaguuuaccccauagagcuuccucuggccuggauuuugcuugauugcauuuuucuguaccuucuauuucuuauaaguuguaguuagaucuagaagguuuauuacauucagguguaauauuugaagaggcuuucuauaagaagaaacuugccuuuaucaacuauucgguuaucuugaaguauauacaguuauuauagcaaagauuaggauaaaugcuugauucuuugucuauauucaucagguuuuuuuuuuaaguuaguuagcauguaaacaauaagauuuguuuucuuaagaaucauuauaaacuuauggauauguacuuuuucauaugccagugauuuugagauaugauuuugauguguuuuaaguccauugcuauuccuuuugauggugauaguuugauuuuuuuuucuuuaauuacaagauaccaggccaggcauguuguauauuucuuguccagaacuggaaucagccauuucuccaaagagccuguauuaguucguuuucaugcugcugauaaaagacauacccgaaacugggaagaaaaagagguuuaauuggacuuacaguuccacauggcuggggaaccucagaaucauggcgggagguauaaggcacuucuuacaugguagaggcaagagaaaaaugaggaagaagcaaaaguggaaaccccugauaagcccaucagaucucauaagacuuauucacuaucaugagaauagcacgggaaagaccagccccuaugauucgauuaccgccccuccccacccccuacccgccccccgucccccaucccucccacaacacgugggaauucugggagauacaauucaaguugagauuuugguggggacccagcugaaccauaucagagcccuaauuccuaugguggagagaagauaauauuuagaaaccacugucuggguacuaaaggugguuguuggugcugaguaaguucuuauauuuaagucuuuaaaaaagccagaaguggaaauuuacuuauugagguaaaauauacauauauaaucuaucaucuuuacuuuuuuuuuuuuggagacaagauuucacucugucacccaggcuggaaugcaguggcacaaucacggcucccuacagccucaaccucuccagccucaagugauccuacuaacuuagccucccauguagcugggacuaugggcauguaccaccacggccagcuaguuucuauauuuguuuugguagagauggaguuucacuauguugcccuagcuagucacaaacaaucuuuaccauucuuaugacuuaacuuuuauuucuccuuccucucgggucaaaaauccaaauucccaguguuggccaguaacuccccauuuacuuuauccugcaaugcacaugcagaagucaguggugauacuuuaucuuuuuuagacugacaaauuauuguguucucuuucauuuaaaauucuguuauuuuacuuucuucagagccauguuuuguauaaaauuuaaaaauccagaacuauauagaaaaauccaagcaucugcagucuaagguuuuaaaaaguggaucuuaauuuuuuuaagccagaauuugggaaacauugauaauggaaugcuaugcuucuguguuuggaagaacauauugagauuucucuaugcuuaaagaaugcuagucaacaaugcauggaaguaaaaaggcuaacuacacaaugauacuuuuaauauaaaaauauuuauagagauacuagaagaaaauaaacucaauuuuuuacuuuuuggggggcaaaagcagagaagaugucuuauuuauuaaauuccuaugauuuauuagaaaauaagaccagccugggcaacaugacaaaaccccaucucuacaaaaaguacaaaaauuagccaggcauggugucacgcaccuguagucccagcuaccugggaggcugaggugggagggucaccugagccaggggaggcugaggcugcauugagccauuuuagcaccacugcacucaaaccuggguagcagagugagacccugucucaaaaaauaaaugaacgaaugaauaaauggauaaauaaaaaauuucagcauuuguacagguugguugguguggacuggcaauuuagaagaaaaaaaauuugugauguguuauucagaacaaaugaagcaaauauaaucauguggacaacucucaauuuugcauauuggccauuuauuauuguuuguguuuuucugcauuuaacacauuuccuaaaauauacguacacauguucauaucuaaucuccuacacaauucuguagaauuucaagugaguaguugcuuuuuuuuuuugaaauccaaauauuucaugaaugaaguugauauaaaacauucaucaaaaauaugcucuucuggccaggcgugguggcucacaccuguaaucccagcacuuugggaggcugaggugggcagaucaccugaggucaggaguccgagacuagccuggccaacguggugaaacucugucucuacuaaaauuacaaaaauuagccaggcaugguggcacaugccuguaauccuagcuacucgggaggcugaggcaggauaaucguuugaacccuggagguggagguugcagugagcugagauugugccacugcacuccagccuggacuacagagcaagacugucucaaaaacaaacaaacaaacaaaaaacugcuuuucacaaacaguuguuuuaaugaguauuaagaaauuuucuauuuuggucauaaaugaaaacuucauuauuauaaaggauauauuuuuguagaaaguuuugaguggcucuuacacuauaauucaugcauuuucaacuauugucuaaugacaaaaauauagaaauucuuugcucaggagauaguuccucuauuagauggucugcaaugaggugauggcccaagggccuaucgcccacuccaucuccccguccuuugccaccauagcguaaucaauuuagaaaaugaaggaaagagaaagaaccaaacauuucagaagaaguaaauuuuucuuuuggaaaaucaccaaaaagaggaauuuuuguguauuucacugcuuaggaauaauuucuuuucccucaaguccucaagguugccuguuagcucuuaacuguagccagggacccaguuaugcuuaauuuccagaugccauacacuguucacucaugaacugagacaacauuaugggaauuaaaucauaucugcagcauacuuaaaaaaaaacaaacaaaagaaaccucuucaaaccagucuauuucaaaaagugaugggguuuuaauauuguuugcaagaauugccugcaguuuuucucuuuauuuuugggggcugacugaagcagccuucauggagacagaagucuucauucaggugguaauuuauugaaaccuaucauaagcuuugcuagaguaaacaaaauauggccaguugaguuuuccuuaggccuauaauggaucauuucauuugaggaagauuucucuggguuucccugaaaaucucuccccacgauuccuccaggcucccuuuuucagaaccaaaucaccagguccuggugucaauuaaucuuuauaaauauggccaguaugauggcauagugaccaacuuccaccuacaucccaccuaacccaaggacaggcauuucuguauuugauaagauaauuuuauguggcauuuauccauggguguuugaacauuuccuuaggguaaaugcugagaacaauucugguuaugugaaucaguaagacuuuuagaugagauugcuccugguggcaaagaaguuagauuuggcuaaguuauccaacuuugauauggcaacagagcaucagauacuucaaggugccuauccccuguucuucacagacacuccugagucauucaaucauguugcuaugacaugucagcuggguuacuacaguugauuugaaaaaguuuuccauccuucuagauuggguccaggugugugugcuucugauucaaggagccucuaccaguuaccugucuggcaguguuuucuuuucaucagcagcauaaggaguuccaagaagccaucuuugagguucuugaccuaacacagaucaaagcaggaugucuaguuaguguacauuauaaaaagauaauuugguguuaaaaauuuauaggugcaaauaucacacuugcuucaccuuugcuuacuccuuuuccuggugauuacucuggccucaauuguuuuugcuugauuugcacaaauccagauguucuacacuuuauaguuugacuucuugccuauuaaccaccaguuuuuccuguugaaccucauuguaauuuccuggcuauauuuucauuuuguuauuaaauuucuucucuggcuuaaguaugaaauauauucaagauuaguagaaaauuauucucuuuuuuucuuuugugggauucuuaugaacaaagugcuuaaauauagcacaggaaacuuucagaaaagucuuaacagugcaagcaguagaugaaugguauuuaaucaaaucauuugagaucuguuucccacugauaucauaaacaaauuuaguguuuaauaucugaagaauuauuggcaauuaccuuauuucuaaagccaacaaguauauaauaaaacuaacugaagcuguucaagugaaaaaaacaugacaguucuuaaccuauauggaaggaaugaggacaugaaugaccuauaaaaugaugguacaaugaaaaugacaaauuuuagaacaaugaaaucaguuuguacauaagaccgucauaagugucuuaguuuuuuuccuaugguugccaaaauugcccaucuuaauccacaaaaacaaugaugaugacaaugauuguacugauacuauuuauauaaaauaaauggauccauaagcuuuaagugucauaggacaaaagcuccuacuuuaugaaaaacgcauuauaaaugucagauuuuuaaauguaacaccaaaagggcagaaguaacaagcaaaauuggaaagcauaaugcugaguaauaaaaaagcaagcugggaaauaauccuggaaguguaaaaucauuuaugaaaauuuuaaaaacucguuaauacuacauuuaugaauauauauguaguaaaaguauuaaaauaugcacgaaaaccucaggauaguaauuaucucuguuuaggggaagggaaggagagaaauacgaccagagagaguccaaagggggcuucaauuccuuuuguaacauuucauuacauguaguaacauguuacaacauguuauuacaaaauggucaaaccagggaaaaauagcuuugauaaaaaguauggcuauaaaaaagcaaaguugaaugcaauuaaugacauuugguuuguuaaaagaaagagcaacaauuguagccaugauauaagauucaggucauacugguggugcauaaguaaagcaaguuuauaucaaaacacaaauguuguacuuuauugguccucauucucuaccuaucccacccaauaaugaucgguuuauaguuagaaugaagaauagcuuuuguuucccccuuuuuuuugacgguaucccucaguuaaguguguauauuuugcuggaaggaugauuugggggacuuuucuuuucuguccguguucaacucuugaagaaucuaucacgguuaauguuucuaacuuguagacagauacgaugcaggucagauauugugcauuuaauuauuuguuuuaucaaaaccuguuuuuguuuuaucuuuagccuacucgaaaauguaaaaugucacauuuucuauaccaauacuucguaacucccuuagccuccuauuuuggugucauuuuaucaaagaaccauagaaauugcugacuccaaugccuugcuucuaaugccauauuuguaaauuacagcuucuccuauucuucuaaaaguaaaauuaauggauauauaggaaauccuuuuuuuuuuuuucugaaggcagaguauaagacaguuuucuuuggagaaucagauuuuucuuaaaacuaaauugcuggagcaauuauguuuuauaauaaacauaauaauauaauaauuuauugagacauaaaauaacugagacuaggaauaacacacaccuagauaacaucuccagcacacugacuguuugaaaggucaggucacaaaaugacaccaaaacauauuuuguuucccucugcaccaagagaaaagugaagcacccacacuguauuauuauuuaaaagcccaacaaauguucaaggcaaaaaucuuaauaaaauaguaaaguuaaaaaagcccauugccacaggaaaaauaauccuuccauuuacuuagcacugccggaguuggcuucuuuccuugaugaaggacacccugcuaacauuuuuacaacuggagauaacaaugucuagucugaaagguagugggguagaggauuucuuaagcuuuuuuuuuuuuuuuuuggagauggagucucgcucugucacccaggcugaaguacaguggcacgaucuuggcucacugcaaccuccaccucccugauucaagcaauucucugccucagccuccugaguagcugggauuacaggcacccgccaccacgcuuggcuaauuuuuguauuuuuaguagaggcaggguuucgccaucuuggccaggcuggucuugaacuccugaccuggugauccauccaccucggccucccaaagugcugagauuacaggggugagccacugcgcccagccauguuaagcauuuugaguuguauuugaaucccuuucaaucugagagcugcaggauaccccuguucaguuauccuguucaguuuuguuauuauccuguucaguuuuguuauuaauaccaauuuuguuggucuguuaaccuauacacacauucacauaacugccuaacaaauugcagcuauuuauuauauuaauaucaauuuuguuauucugaugaccuauacaugcaguaacauaacuaccuaacaaauugcagcuacaggauaaagaaaauucuuucuguaccugcacaugguauauauacacacaaaucccguuacccuuuauacacucuucuuccugcucaccaggaauuuuuucuaucccccugacaucagagacagcucaaguaaaauacugcuucaacugggaccugacaucagaaauuccaaugucaacccagacuagcucagauccccacccacccccuugaauaaaaccuccaugcuucauuaaccaugccaggagcaucaugaguagguaauaguggaguuauaugacauaagcuacuucauuaacauucucuuuguuuucuagaugucuaaaacugcauccuuugccagagcucagucuuuccagucucaaaucaaaauaaagugacccuaacugaauucuugaccccuuuugagaaaccacgagcuauaauaaaaauaagaaauugacaacuuucuaucuuuuaaaaguaagauggaauuuuuaacugggguccaugcaacuuggucugcucaggacagucuuuaguuuuaugcacguugucucaguguaauuauuaauagcuccuucuucacucucaaaaaugucccaauuuggaugauaaauaaaacaguuauucuauuuauaacccacugagaaauuguguuggcucaauaaaaaagaaaaaggaagaacaccauggauuauuugacaauuaacugcuaacaaauucuuauuuuuaggauugaccucuugacuaaaacuugcucugccugucugugauauuuccaaacguuugacacaucaucacucagauuuaaaauauccaaacugguucuccuuuugauauuccuuuauucauugaaguuuaucacaauuuuccuaaugaacaucuuuaagucauucuaaguuauguaugcaaaucuccuuuacccagucaccaaguuguaucaauucucagaaucucuuagguagcugacuacaccuguuccacccuggacccuccaauuauggucuuugucaguucacaucuucaguuuugcaaccacuaguugcuguccuucaaauguuuccucuacccaaggauauucuacauagcauauuguuucccuguuuaaaccuuaauuaaaacucuuuugcuuauacauuaaaaccucaaucucaccauaaaaauguacaaucuugccuugacucaccuuuuaccacugcccuaugcaaacuuuucuauccaagccaacaugguauaucgaaucuuuuccugcaaaacagacacaccuugcccauuccuaauuucaugccuuuuuuuuuuuuuuuuuuaaagacaguuucgcccuuucacccaggcuggaaugcaguggugcgaucuaggcucacugcaaccucuuucuccuggguucaagugauucucaugccucagccucccaaauagcugggauuacaggcgugugccaccacgcccagcuaauuuuuguauuuuuaguggagaugggguuuugccauguuggccaggcuggucucgaacugcugaccucaggugaucugcccaccucaaucucccaaagugcugggauuacaggugugagccaccacagccaggccuaauuucaugucuuugaacacgcugcacuuacucuuucuccauucuuccucuauuuguuuuucuguaaaucuuaguuauugcuuagacuuaacuuaaaauuccuucucuauaauggcuuaucugaucauuucagcccauaucucagcuccacugaacuugcugguaguucauuuaaccagacuauauauugccuuaacugauguacuucuugguagacuaugaauuucuuggggcaagaauugugucuugcuguccuuggaacaccaagugcauacauaguuguugaauuaaugaauacaaaucucacaccugccaguuuugcagucauaugugauuaucauuuccagucacuucacuuuuucacucuguauuucuugcaucaacugcccuagacaugcccuaguccagucuucauugcauuccgucagucuuuaccugugaacaugcauacaugcaucaagaaaucaaagacugauguuauguagugucaggagccugcaauggccuacaaagcccuacacagccuggcccuuaguuuuugaccucuucucuucccucuccucagccacucuugccuccuugcuguuccucaaacauggucacaaggccucugccucagggcccuuguauuugcucuucccuugcccagaacacuccucacccagguauucuuuuuuaauuauauauauguauauauaauuauauauuauaauuacauauauuuuauauguaauauauauuauguuauauauauuauauauauauauauauauauauauauauauauauauauuucuuuuuaaguaaaauagaaacagagucucacuguguuguccaggcuggucugaaacuacugggcucaaggauccuccugccucagucucccaaagugcugggauuacaggugugagccacugcaucuggcccauccagauuuuuuuuuuuuuuugagauggaguuuagcucuauugcccaggcuggagugcaguggcacaaucuuggcucgcugcagccuccaccuccuggguucaagcaauucuccugccucagccucccaaguagcuggaacuacagacgcaugccaccgcaccuggcuaauuuuguguuuuugguagagacgggcuuuugccaugucggccaggcuggucucaaacuccugaccucaguaaucugccugccuuggcuucccaaaaugcugggauuacagacgugagccaccauaccagccccacccagauauucuaauggcuuguuccucaccuccuuuagaauuuugcucacauuuggccuugaugagaccuucccuagccuccauuauccaaaaucacaauauucccauccaugcuuguaauugccuuuucuuauuuuucccuuuaacgccugucauauuccagcccacuguauguauuacuucugugguucauuaucugucucgucccacugcacucuauguuccaugagggcagugauuuuugucugucugauuuccugcuguguuucuagugccuaaguaggugcucuuuaaaaaaguaauaagggaaaugaagagacuuacuagcaacugucuacauuuauuuucaaagguggaaauaggaaaauuuuccagcuuuucucuugaauucaagaacuaccuggaauuucaccuauuuccaagaaaauaacagugagugauauaugcaaauaugacaaagaacugcaaguuuauguauaggcaaaggguggcuucucauucucacaggaacuaugguugacuugauaaccuuauaugacuugaauugcuuauguacaauuagaaaaucuguccaguggucacuuuuugauuaaguaauuuuccuuucuauuuauaaaagauaggauucucugcaucaaaacugaaaaccacaaaaucacauacauagacuuuuuaucccaguucucacagauauuuacuguuaauauuuuggugccucauaauuuaauguuaaacuugagauucuuuuaucauaauuuuaauucucuguaaugcaguuaauacauuugaguguggacaaaaauaugacuucuguaauaucuuugcauuacaggugcuauaacaacuugaaacagcugacauguaagauucuuuaaaucguuuuaccaaaaugggauaguauuuaaauagcuggaauaccauagcucuuuugaaacuugguugaaauauaaaaugagcauucuagaagagauugcguguuaguuuaggauguaauauacuuagauguaaguauaauaacaccugcaggcauuuguuaaggauuguuuugaauuaagacauaguuagggauuacaguuuguauaaacuucauguuaucucauaaauccuccacagauccuuguuuggcaggguuugggaugugugcacguguguguguguguguguacuacaagauuucgaacuaaaaauugaauccuuaaaaaauucuucagacuuaaggaaugaacuuuuaaugaaauugccuaauugcauaaucuggaaugcuucaaaugaugcugacguccauaaauaaaauacuguagccacacuuauagauuagcugaaggaaacauuaaagagaauaacauggaaaaauacuagacuuuucuucucuggucguucucauuagugagcagagaauuaacugaaacauugcgagaugaguauuccuuccccugauaguccacauguccuuaaaguguggauaugaguggaggaugguagagaagagugguauuaguguucauuaaagagaaauuggucacccgccguaugguuauaugcuguuguuagagcaaugaaaaucauuuuccuacauauaaaugcuuuucccauaugaaacuucuuacaggccucuuaugaccucggccuugaaagcauugacaguucuuuccugaaagcugucaauuuuuauucuccauguuuuaaucaaagcucuaaauaguaacugucaucuguuuuugaugauacuaggguauugacagaugucccagaucugacuugauuuugcauaugacauagggagcucuuguuucuuccuugaaaccggcaacucuuguuagccagagcuacuaguaaauggacuaauuucacugguugcuagcacuccuugaaacucguuuccuagcauguguuucaaaaauuuguuaagugagaauuggugcugacuguuugaucccuucuuguuaucacuuauaacuaaauuguuaugcuggcuggaggcugugcaagcaauccucacuguauucauuguuauccuagaucauucuuacaguuuccagagcccugggauuuagaaucaaaucuauguaauuaaaaugauugauugauccggggcauaauacuucauuccuugcacauugcaauuuccuaacaacuuuauaaagcaacgauuuucuuuugcuccuuucauuugacuacuaaugguacaauaguagacagagggguggcuuuuuguauuuuuuguucugagauguggaugagcaccauugacuuagcaauggauaugcggggugauuaauguagcugguauuuguguuaacccggaacuggagcagaaauuuucaaugcaguuuaauagaauugcuuaugaauugaagaaauuaugaaucauuaguuauucagcauucucuuaugcagggggcagggaugugguuucucugaaggcguucagcuuuaaguuggaguuuaugcuagcuuaaugcagauagauagguagguaaaaagcaaagcaggaaaaagaaacuaacuuuccaggacaagggcacagagcucaggagaggauaguggagaagaaaaucuaauuucugccuuuaaaaggaauauaguuaaaacucuaguacuuuuccaguugugaacagacagccuaccucuagagauuucaguuuaacuccucaaacugauuuuugccaccuuauacauguuuacugagaccaaacccaucuuccaucaaccuuggagugaaggaaucacucugggguguguucuaaucuaauugacaccucuagaauagguguguaauuuucuguucuccuuaaggacauggauccuuaaauugauagaguagaacuagguuaaaguuugaagucauuaaaaguaaaagcaaacaaacaucuucugccucauguauuuauuaaguuggcuaugucuguuucucuccauuugccgaaccugugaauauuguauugauccucuuucugccauaccuuuauaauaccuucuguauuucuuccuaugcauucacacauaagguaaaauuacaaauaaaauugaaucugaauuucuaaaguaugaaagucaaacucucggccaggagugguggcucacgccuguaauccuagcacuuugggaggccgaggcggguggaucgcaaagucaggagauugagaccauccuggccaacauggcgaaaccccaucucugcuaaagauacaaaaauuagccgggcaugguggugcacaccuguaaucccagcuacuugggaggcugaggcaggggaauugcuugaacccagguggcggagguuucagugagcugagaucaugccacugcacuccagccuggcgacagagcgagacuccgucucaugaaaaaaaaaaaaaaaaaaaagaaagucaaacuuuccuguaaguuccuggaaggccuaccucuuguggcccuaaugaggaggagcccugucacucuuguguuccugcaugcccagguccagcaccaagugugagucacaucucaagucagucaaugacuggauuucuuuacauauacaaugcuauugaggauggcauaaauugcaucuuuuaaggguuaugguugacaaaaauaugaauagagggugccuacuuuuauuucuguguuaauguauagaagguuuacauguagauaaaugguaaaugauuaguuaucaaucuugcugcucaaaaggaacccacagaaaaaaagucacccuucuccauacacagucuaaacacccaccucaacacaagauuuagcuguuuuaugaggaauuagugagaaaaagauuugagagaauuuuauguuucgguauaaugcuaacacuaacaauagacaucauucauuggugccuggcacuguauuaagcucuuaauauauugucuuaucuaacuuucaagacugccuugagguauguacuuuauuuucauuuuacaaaugagaaaaccuaggcucagagagguuuaagaaaccucagaauagaaucccaggaauaaacccuaaagccugcuguguaauacaaagaaaauugcuccaacacaguuaucugcugaagagguaugugcccucuggauaccuaaguaacuauucugcucauccucuccuuccuccucuuucuuuuccuuccccaccuccaucaucaccauuguggcugugauuaugcagcccugaggucuuuccguuggagcacugccucucuuaaauaggugacuugcuaucuugaggcaacaaugagcugcuuugacaagaagaaaaguuggcccaucuacccauaagcucucauugggcaaggaucucauauauuucauagacaauguuagccaacuaguguccugaucuucugccugcaucucaaaaauagcaugcuaucucuuaggagugaauuucaauuaucaggaaauccagaaguuugacauuguuccacauuuucugaaacugcccauggaaaucaauuccaggcuuauaagcugucuguauguacagucaucccucaguauacauaggggauugggucuagaaccacccaggauacuaaaauuugcacagacucaagccugcagucagcccugaggaaccuacauauaugaaaagucagcccuuuguauugguggguuucacauccuaggaauaccauguuugguugaacaaaauuugaguacaagugggcccgagugguucaaaccuauguuguuugaaggccaacuguaguuauauuaagcugaaugcacguuuuuauacacuaccgucuccacacuuguucaugaagagaagacagagcuucuauuucauuauuaauuuugccuauuuaagcauuuuauccuaaaauaaauguaugcucaucacuugaaauagcugucggaguaacauuugcuggaaagagaaagaaaguaaauaacacaaaguuaaaaagacauggguagaucugauuuuuggaggaccaagaaauuuguugcaaaagaucuagcucacuucuagucccuacaaugaaacacgagugcaguaguuucccuuacccacgauuuuacuuucugugguuucaguuaccggugguaacuguaauggaaaauuccagaaacaaacaauuuauacaguuuuaaguugugcaccauucugacuagcaugaugaaauacugcaucacaccacuccgucccucucaggacaugaauccuuccuuuaucaagcagauucacaccugugagucacuuaguagcccuguuggugaucagacugucuuugugucacagugcuuguguucaagugacucuuauuuuacuuaauaugaccugcaagugcaauagugaugcuggcuacuuggauaugccaaagagaagccagaaagugcuuuaagagaaaaggugaaagguuucaacuuaguaaggaaaaaaauacuauauguuaagguugccaagaucuauggugaaaacaaaucuucuauacaugaaauuuucgagaaggaaacagaaauccaugcuaguuuugcuguugcaccuccagcugcaagacuuacggccacagugcuuauuaaaauggaaaagccauuaaaucuguggguggaagacaugaacagaaaugugucccaauugguggguuucaggcauccuccaggggucuuggaauguguccccguuggguaagaggaguguacuguaugcccaaggaauuccucauguuuucacuugggguuaucugcacccagcccuuugauagaauuaguguuuauucucauuuucacucccggaaaauguauaagcuacaauacucuaauuagcgcucugugcuuggcuuuggugagaacacacucugugugugcacaguucaccaaaaccuuugggaaugacugaagggccuggaaguuuccaaacugagggucaaggucaccuuggcuuugcuauccauuauuucuuguuucuuuuacaggaaaaauccuuugauguucuauaaauucuaaauacauuugcaauuuaaaacacucuucaaaaauguaguaaaaccacguauuuguaaccuucacgaaggccggaaucugaaaaaagaaaagacagagccaaauugacucuaauuguuaaggacaaaaugaaccaucuuuugacuagacaaagcuaccagaaaucucuuugauuggaaguauuuugugcugaaaaccaacuagaaaauaggagguuuuuuuuuuuuuuacaauuuuauuuuagguaacaggagcuauuuaaaaaaaauuacuccuucauuccaccagaaguuuuaaauguuucuugaucuaaaaauguagaugugguuuaaguaauuguaugaacaagguaagggccagugucucuacugugacauuaaugacaggugcaaacuaaaaaacucauuccaguauuuuugcagaaugaggaguggugucagagacagcugggcuuggaaaccuucuggaagucuuuuauuguuuccuguauuggaucaaguccaaaagugagaauaauuacccuuuagagcugccaaguuuucaggcaauucagaugacucuagucuuguaguaggaaaaaaaugugagucaggguacaagaauagugauugaauuuuauaaaaaguauuucuaaagcaguaauuuccucagaagugacuuguuagcuuugacuaaucgaaugcaaaguagagaagcgucugaucaaaauuacagaaaaugagaaagaaaauuagacucaucuacuucuagacggccuaauaauacagaguugaggguuucaaucaggcucccuuggugacuuuuagguaauucaucaaauccuugugggggcggugucugaggaggcugugaaaaagagagacaggaagaaccucucaauauugaauaggaaauuuauauuguucuaaaaacuucauaucucccaaauuuguaagaacacccugguuuaaaauaaacaggcucccccucuugagaauagagaaacagugacagguguuucccuaaauuuccaaaccuaacaacccauuuagacagccuauaucaggugcuuuacucauccucacaacagaccugcaaaggaaauacuauuauaggacggucacauucaaggauaagauccuugaauauuucaaaauaaucaaauaacucagaacuuuccuaauuccggaucaguuuucccauaggaauaaaugucgcauagggagguauuuucagaaccuauaaaucuauaucuaauguuguguuuuaaaacaauuuuaaacacaaugaauggauacauacuaacuuuuugucgugucuaacuuuuguuucuucucucaaaaguucuuggcucuaacaauuuuuucauuuuuaccacuaacacuaccacuuaaugaaccccugggaagcauggucauaauuaaccaauaguggucauuaaaauaacagcacaggagucaucaaaaucacacuuaggaacuucugagggagagugguuuagaagcuaaugaccaaaaauauuucuauuuccuacuaacacacuacucucauguggcaauauuauaaauguacgaaacaaguuggaacacuagcuuugaaacugugauuucugaguauaauuuagauguaagagauucacaugccuucaaauuuaacauauaaaguacauccuccuuaauauuguauauagugguauuuccaaaugucaugauucagaugcacauaaaaugcaaccacaucccuauuuugggaugaaagaagugaugcuugggugauuaagaaauuuaccuaugggcacauaccugguuccagaaucaggauuaauuggucugacuuaaaaugccaugcugcuuacauaacugagacaggucaaaaaguuaaagaggacuaaauccagaaagacuucauuaguggcuucgauuagauaggaauaugauuuuaugagcaucugagggagggaaacacuuugcuguagaguuucucaaacugugaccugugggucauuugcaucaagacaucuggaauguuuguuaaaaaucuccauuucugguuucuuccccaaagcuauaaaauuagagccaguaaucucagcacucuugggauuacuuugggaggccaagguggguggaucgcaacauggcgaaaccccaucucuacaaaaaguacaaaauauuuagcugggcaugguggagcaugccuguagucccagcuacucaggaggcugaggugggagaauucacuugaaacuggaagguugaggcugcagugagccaagaucacaccacugcacuccagacaaagugagguccuguuuccaaaaaaaguagagccucugguggugaaguuuggaaaucugcauuuuuaacaaucuccauguuuuacuguaauuaaaguuucaauauaguauuaggaggcuuauaugccccuuuagauaccacccaaugcccccucaccagaguccagggacucuuacaguaacuguccccauugaacaacuaaaggcuuuugggacguguucaguagaugagaaguucaauacaugcuguguuucuccagacagguaucacacugugauucuggucaacuauggcacacuuacucuuuacucaugcauuucuuaauugugccucugaccuuucaccagcuauuuuuuccagcacuguggacuauuaacuggaugcuugcaccugagauagcaguguucugguaaccucucacuugaggaaguuguuaucucaguuggcuuccuguuuggccucaugccauccaugcagagccaugagaggcaaagcagcccagaagcagccucucaucccucuccugugacuuccuaggagaagaauauuccagugguuaugauuuccccuccccacaucccuccaacgcaugcacauacauugccuaaccucuugcuuucauaucaguuugcauuuucuuucuuugaugucccaucuuaaacucaacauggucugaaaggaguuuuauaaaaauguucuuagccagcccugccaacacucuaccacaacuuaaucaauacacaaauaagugaauaauuaaaucaauuucuuuccuucucauugucuagugucauuauccacccuguugcucaggccaauagccuuagucuucuuuucuuccuugcuauuaauauaucacagcauacgccgggcacgguggcucacaccuguaaucccagcacuuugggaagccaagaugggcagaacaugaggucaagaguucgagaccagcgugaccaacauggugaaaccccaucucuacuaaacacacaaaaauuagccaggugugguggcacgcaccuguagccccagcuacucaggaggcugaggcaggaaaauugcuugaacucgggagguggagguugcagugagccgagaucacgccacuguacuccagucugggcgacagagcaagacuccaucucaaaaaaaaaaaaaaaaaaaaaaaauauauauauauauauauauauauaucuguguguguguguguguguguguguguguguaaguguauauaauguauacacauauaugauauauauguguauacauuauaguguauauuguuauauaucauauaugauauaugcgauauaucauauaugauauaugugauauaucauguaugucauauaucauauaucauauaugcgauauauaucauauaucauauaugcgguauauaucauauaucauauaugugauauauaucaaauuuauauauguuauauguuauauaucauauauaaguuauauauguuauauaucacauauaagcuauauguuauauauaucauauauguuauauauaucauauaaguuauauguuauauauaucauauaaguuauauguuauauauaucauauauaucacauauauguuauauauaucauauauaucauuaucacauauauguuauauauaucauauauaucauauauauguuauauaucauauauagcauauauauguuauauaucauauauagcauguguuauauaccauauauggcauauguuauauaccauauauggcauauguuauauaucguauauggcauauguuauaucauauauaucauauauaacauguuauauauaucucuauauauauuaucucucucucuauguguauauauauauuaucuauauauaucacagcauccaucacagcaucucagggagucuaagcagcuauacugccaaaauagauccuauguuugucugcuucucuuaugcccauuguuaccacauacuaaccaccaccaucaucaucuuuggaaaugcgggacacaauauauuuuuaagugccugacuacuuuuauaauaauaugaauauuuuaacauuuauauuaauguaguaauuacuacaguccuuucaccacacagcagccuguauuauuaaaaauacaaaucaugucauuaccugcuuaaaaccuaccaaugcuuguacagugcaguuagaauaaaaugaauuguauaauuauuacuaucucugugucaggauccucaaaggcccuauaagcuguaguccaugcccaccuguuaaaccaugucucucuuuaguccccaucaccgccagccucugggcucguaccaagcgugcccagcugauuagugcuuagugauuuaucccucuaccugguauguucuucucuaggucuuggccagccuggccccuuuucauugaucaguuaucagaucacauguccccgcuucugagaggacuucuuucaugucagaagacgaccuucuugcccucaucccuaguccauuaucacuuuaccugguuuuguuauccuguggcacuuacuaccugaaauuaguaagcuauuuuuaauguauucaucagucucccucacuagaauauggguuuugugaaaauugauuugucuuuuucuuaaucacuugauaugaagaaccuaguauguagucggcauagaaaaaguuugcuuuuuuuuuaagugaauaaacccagagagaaacaaccuaauuaaaucagaauucccuaaaaggauaccuguguucucuuguuuugcucauguugggcacuagauucuugucuccaucuucaguuaacauucacuaguucugauacuuacaaguaauaaugucuuaauuugagauuucuauggagcuguuaaaagcguuuguggauaauuguugaguccauauucucuaaugaaaacacacauggccuaucauacacagucaugcgucccuugacagggaugcgcugugagaaaagcacccugagaaguauguugcuaggugauuuuuuauuuauuuuuuuauuauacuuugaguuuuaggguacaugugcacaaugugcagguuuguuacauauguauacaugugccauguuggugugcugcacccauuaacucaucauuuaacauuagguauaucuccuaaugcuaccccuccucccuacccccaccccacaacaggcccuggugugugauguuccccuuccuguguccauguguucucauuguucaauucccaccuaugagugagaacaugugguguuugguuuuuuguccuugcgauaguuugcugagaaugaugguuuccagcuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauaugugugcaugugucuguauaguagcaugauuuauaauccuuuggguauauacccaguaaugggauagcugggucaaaugguauuucuaguucuagaucccugaggaaucgccacacugacuuccacgaugguugaacuaguuuacagucccaccaacaguguaaaaguguuccuauuucuccacauccucuccagcaccuguugcuuccugacuuuuuaaugauugccauucuaacuggugugagacgguaucucauugugguuuugauuugcauuucucugauggccagugaugaugagcauuuuuucaugugucuuuuggcugcauaaaugucuucuuuucagaagugucuguucauauccuucacccacuuuuugauggggcuguuuguuuuuuucuuguaaauuuguuugaguucuuuguagauucuggguauuaacccuuugucagaugaguagauugcaaaaauuuucucccauuuuguagguugccuguucacucugaugguaguuucuuuugcugugcagaagcucuuuaguuuaauuagaucccauuugucaauuuuggcuuuuguugcccuugcuuuuaguguuucagacaugaaguccuugcccaugccuauguccugaaugguauugccuagguuuucuucuaugguuuuuaugguuuuaggucuaacauuuaagucuuuaauccaucuugaauuaauuuuuguauaagguguaaggaagggauccaguuucagcuuuauacauaugacuagccaguuuucccagcaccauuuauuaaauagggaauccuuuccccauuucuuguuuuugucagguuugucaaauaucagaugguuguagauauguggcauuauuucugagggcuccauucuguuccauuggucuauaucucuguuuugguaccaguaccaugcuguuuugguuucuguagccuuguaguauaguuugaaguuagguagugugaugccuccagcuuuguucuuuuggcuuaggauugacuuggcaaugcaggcucuuuuuugguuccauaugaacuuuaaagugguuuuuuccaauucugugaagaaaaucauugguagcuugauggggauggcauugaauuuauaaauuaccuugggcaguauggccauuuucacgauauugauucuuccuacccaugagcauggaauguucuuccauuugucuguauccucuuuuauuucauugagcagugguuuguaguucuccuugaagagguccuucacaucccuuguaaguuggauuccuagguauuuuauccucuuugaagcaauugugaaugggaguucacucaugauuuggcucucuguuagucuguuguugguguauaagaaugccugugauuuuugcacauugauuuuguauccugagacuuugcugaaguugccuaucagcuuaaggagauuuugggcugagaugaugggguuuucuagauauacaaucaugucaucugcaaacagggacaauuugacuuccucuuuuccuaauugaauacccuuuauuuccuucuccugccugauuacccuggccagaacuuccaacacuauguugaauaggaguggugagagagggcaucccugucuugugccaguuuucaaagggaaugcuuacaguuuuugcccauucaguaugauauuggcuguggguuugucacggauagcuguuauuauucugagauacaucccaucaauaccuaaucuauugagaguuuuuagcaugaagcgcuguugaauuuugucaaaggccuuuucugcaucuauugagauaaucaugugguuuuugucauugguuuuguuuauagccuggauuacguuuacugauuugcguaugcugaaccagccuugcaucccagggaugaagcccacuugaucaugguguuuaagcuuuuugaugcgcugcuggauuugguuugccaguauuuuauugaggauuuuugcaucaauguucaucagggauauuggucuaaaauucucuuuuuuuguuuuguuucugccaggcuuugguaucaggaugaugcuggccucauaaaaugaguuaggaaggauucccucucuuucuauugauuguaauaguuucagaagcaaugguaccagcuccuccuuguaccucugguagaauucggcugugaauccaucugguccuggacuuuuuuugguugguaagcuauuaauuauugccucaauuucagagccuauuuuuggucuauucagagauucaacuuccuccugguuuagucuugggaggguguaugugucgaggaauuuauccauuucuucuagauuuucuaguuuauuuguguggagguguuuauagcauucucugaugguaguuuguauuucugugggaucgguggugauauccccuuuaucauuuuuuauugcaucuauuugauucuucucucuuuucuucuuuauuagucuugcuaguggucggucaauuuuguugaucuuuucaaaaaaccagcuccuggauucauugauuuuuuuugaaggguuuuuugugucucuguuuccuucaguucugcucugaucuuaguuauuucuugccuucugcuaguuuuugacuguguuugcucuugcuucucuaguucuuuuaauugugauguuagggugucaauuagaucuuuucugcuuucucuugugggcauuuagugcuguaaauuucccucuacacacugcuuugaauaugucccagagauucugguauguucugucuuuguucucguugguuucaaagaacaucuuuauuucugcuuucauuucguuauguacccaguagucauucaggagcagguuguucaguuuucauguaguugagcgguuuugagugaguuucuuaauccugaguucuaguuugauugcaccguggucugagagacaguuuguuauaauuucuguucuuuuccauuugcugaggagagcuuuacuuccaacuaugcagucaauuuuguaaugggugugguguggugcugaaaagaauguauauucuguugauuugggguggagaauucuguagaugucuauuagguccacuuggugcagagccgaguucaauuccuggauauccuuguuaacuuucugucuuguugaucugucuaauguugacaguaggguguuaaagucucccauuauuauugugugggagucuaagucucuuuguaggucucuaaggacuugcuuuaugaaucugggugcuccuguauugagugcauauauauuuaggauaguuaucucuucuuguugaauugaucccuuuaccauuauguaauggccuucuuugucucuuuugaucuuuguuggcuuaaagucuguuuuaucagagacuaggauugcaaccucugccuuuuuuuguuuuccauuugcuugguagaucuuccuccaucccuuuauuuugagccuaugugugucucugcacaugagauggguuuccugaauauagcacacugaugggucuugacuccuuauccaauuugccagucugugucuuuaauuuggagcauuuagcccauuuacauuuaagguuaauaugguuaugugugaauuugaucuugucauuaugauguuagcugguuauuuugcucauuaguugaugcaguuucuuccuagccucaauggucuuuacaauuuggcauguuuuugcaguggcugguacugguuguuccuuuccauguuuagugcuuccuucaggagcucuuuuagggcaggccugauggugacaaaaucucucagcauuugcuugucuguaaaguauuuuauuucuccuucacuuaugaagcuuaguuuggcuggauaugaaauucuggguugaaaauucuuuucuuuaagaauguugaauauuggcccccacucucuucuggcuuguagaguuucugccaagaggucagcuguuagucucaugggcuucccuucguggauaacccaaccuuucucucuggcugcccuuaacauuuuuuccuucaugucaacuuuggugaaucugacaauuaugugucuuggaguugcucuucuugaggaguaucuuuguggcguucucuguauuuccugaauaugaauguuguccugccuugcuagauuugggaaguucuccuggauaauauccugcagaguguuuuccaacuugguuccauucucccugucacuuucagguacaccaaucagauguagauuuggucuuuucacauagucccguauuucuuggaggcuuuguucauuucuuuuuauucuuuuuucucuaaaguucucuucuugcuuuauuucauccauuugaucuucuaucucugauaccguuucuuccaguugaucaaauuggcuacugaggcuugugcauucaucacguaguucucaugccuugguuuucagcuccaucagguccuuuaaggacuucucugcauuaguuauucuaguuagccuuucgucuaauuuuuuuucaagguuuuuaacuucuuugccauggguucgaacuuccuccuuuagcucggaguaguuugaucgucugaagccuucuuaucucaacucgucaaagucauuguccguccagcuuuguuccauugcuggugaggaguugcguuccuuugggggaggagaggugcucugauuuuuagaguuuccaguuuuucugcucuguuuuuuccccgucuuugugguuuuaucuaccuuuggucuuugacgauggugacauacagauggaguuuugguguggauguccuuucuguuuguuaguuuuccuucuaacagucaggacccacagcugcaggucuguuggaguuugcuggagguccacuccagacccuguuugccuggguaucagcaguggaggcugcagaacagcggauauuggugaccagcaaauauugcugccugaucauuccucuggaaguuuuaucucagaggagcacccggcugugugaggugucagucugucccuacuggggggugccuccuaguuaggcuacucgggggucagggacccacuugaggagacagucuguccauucucagaucuccagcugcgugcugggagaaccacuacucucuucaaagcugucagacagggacauuuaagucugcagaggauucugcugccuuuuguuuggcuaugcccugcccccagagguggagucuacagaggcaggcaggccuccuugagcugcgguuggcuccacccaguucgagcuuccuggcuggcugcuuuguuuaccuacucaagccucagcaauggcaggcgccccucucccagccucgcugcggccuugcaguuugaucucagacugcugugcuagcaaugagcgaggcucugugggcguaggacccuccgagccagucacgggauauaaucuccuagugugccguuugcuaagaccauuggaaaagcacaguauuagggugggagugacccgauuuuccaggugcugucugucaccccuuucuuugacuaggaaagggaguucccugaccccuugagcuuccugggugagguuaugccucgcccugcuucggcucacacucggugcgcugcacccacugucuugcacccacuuuccaacacuccccagugagaugaacccgguuccucaguuggaaaugcagaaaucacccaucuucugcauugcucacacugggagcuguagacuggagcuguucuuauuugaccuucuuggcuccaccucgcuaggugacuuuauccuuguguacuuccacaaaccuagaggguauauauuuuuauuuacauauuuuuuucauauggaaaagcaaguguccuaggaccauuacugaauaugaaucauuucuccuacuugaucugcacugccaaaagcaagugccacaaagcaguuuucucuguguguucuauuauuauauaggaccaccauuguauaugugauuugugcuugacuaaaacaucaccauggaauguauaacuguacaguuauauacaguaaauuguagagaauaguucugguuucagcugcaccgucucaugcuucauauaauuuugucugaagaacacuugcacuaauguuuaucucuuuucuucagcacuuaucacuaauacuuuuauuuuuaccuauaaaaagauucaauuuauagauucaaguacugagucauuaucaagcaauuucuucacaucugucugucaggaugcuagcugugacugugugaaaauggaguucgguuuuucucaucagcuugcuauuacccacugugugccauaauacuacaaugcaacaucacuaugccuauucaaguuuuggucaaauuguuucaggguaucaacucuucauuguuggaaacuuugauguguuucaggaaguuauuuuagcauuuucaucaaaagcacaugucaccuacauuuggacuuuuuuuugucccaacauuuuacaagucauuaacuugaaaauccauuuaauugguauauggaagugauucuuuaaggaauaggaguuuagaguuagagacauuuaaggccaucuuccagggaucuuuuugugcugcugugguggugguggugaaaaauggauaacaagauuuauccucuuaaccauuuuauguguauaguucaguaguguuacauauauucauuguugugcaaccaauuuuuagaacuuuuucaucuuauaaaacugaaacuguacccauuaagugaaaacuccucauuucugccucccccuaacccaacaaccaccauucuaguuucuguaucuaugaauuugacugcuuuagauaccucauaagcagaaucauacaguauuugucuuuuugugacuggcuuaugucacuuagcauaauguccuccagguucuuccacuuuguaguauaugucauaaucuucuuuucaaggcuuaguaauauuucauuguauauauaccacauuuuuuuuauccauucauccauugauacauuuagguugcuuucaucuguugccaauugugaauaaugcugcuguuuugagcauguguguacaaggaacuccucuaaauccuuuuucuaauucuuuugaauacacacccagaagugaaauugcugaaucauguggcaauucuauuucuuuuuaagaaacugccauacuguuuucaauagccauagagccauuuuauauucccuccaacagugcacauggguuccaauuuuuccacauccuaacaguaauuauuuuucauuuuuuugauaguagccauccuaaugacugugacgugauaccucauuauuuucauuuucuaaugaucagugagguugagcaucuuuucauaugcuuuugauucauuauuuguguauuaucucuggaguaacaucuauuuaccuuuguugcucauuuuuuaauagaguuauuuguuauuaaguuguaauuguucuuuacauauucuggaucacaguuccagcuccaggagaugaaggaacagggcacacuugaggaugcaauggagugccaaggccaguuacgggaaggagagccagcgcagggcuuacccacuuccuugaugccucugcucaagugucgucauauuauugaguucuuccugccuauaaguuuuaaaaaauguuuauuauguaauaaaacagcacacuguacucccacccagcacuccacacacuccuuaucaccaucuggcguacuauaauauauauuuccugacauacuaucuauugcccucauuuaagauauaagcuccaacaaaugugauuccuaucagaguuuacugcuauguccccaguaccuaaugucuuauccacaucauuucuaaaguucuccaggucuuaaaauuucaggucccuccuuccuuaccugaaauaaugccuggcacauauaaaauguucaggaaauauugcuugaauaaauaauuaaaaucucaugacccuccccuggcugaaauuacagucagcccuccauaucuauagguucugcaucugcagauucaaccaagcuugguuuggaggaaaaaaaauaaagacaacaauacaaauuacuuuaaaauacuguauaacaacuauuuacauugcauguacauuguguuauuauaaguaauccuggagauguuuuaaaguauaugggaagauggacacagguuaugugcaaauaccaagccauuucauaucagagacuugagcauccucagauuuugguauccuggggaguuccugggacaagucucccugauauugaggaauuacuauauuuagaaccugggcugucugcaauucuguugguugaaaauuuauguaauaccccaggaaggacaaaggaguuucagccauucccugcucccauugcauuugucuucuccuaauaucuaauugaggaauuaugggauuuuguuuugcagagaaggaggagacaaaucuguauuuuguaaccuaaaguuuggaagggccauggacuaugggaaaagaauagaacaagaauaaggaauaagccagaaagugagagagauaaaccaauuaucuuccagcgguggucuuuuuauuuccccucucacacuucagauggaaaccggcuuuuccuucagaagacaggaaagcccuaaagcaucaagggcuccauccucucugcuggacuggcugugaggucaggggcagcgguggaaggaauuuuccuuguuccucaaugcuuacauuucauagugaagggagaaaaauacguucuccuuggaggaaauguagagacuuccuggggaguucagcuaugaggccauuaggaaaauucaguagucugggaaucugugaagcaagaaauaccacagacuuuuugaaaccuuuauuaugaaacccugcuuaauaaucauaaaugucauagcucacaaauacccacugaguuugcguuauucauuggugcuuaagggcccaagguuauuccacaggcacaacccacuuucagacuuuuuccccaaagacacuuaagauaauuugugagaacacacuuaaugauauuuuauguuuuuccuacccugagguuaaaaaaaaaaaugccucugugaaaagagugagcucugcuccugggacaguacugguagaaugccaagccaggcagcaguccagugugugcccgcuaucagcccuaugagcuuggcggcacgugugguauggagaugauaaagguauacauagauuucucauuuugaaaauuaccagaauuguaucauuacauucuagcagauugaccuuaaaaaaauuguaaggaugaaaugcacggaaaucaguagaauagguacgagaguuuaagcauguuccuaacucuuccagauucacaaaccacagaguuaauuuuucuucuuaaaucaguuguauacacauauauaaaaauuagcuuaucuguguaugauucucauuuucaaaaucauuucgugauuaaauuggggccaggacuucuuguugccuuauuucacaggacucuggaaggcuuugauuagggcuuugaaguacaauagggugacaacuuucaggcugccuuugaggaacaggaaguuccugaaauggagaugagaggaccccagagaaggccauuuggagauucucaaaugucugagcaaccaugccagcaucuuggagacuucaagagcugcugaacuggccacaggucagagauaaaagugcucccaggguuuuucacugggauuucucuugaagaagcagaugaacucggcaacauagucacugccaacuguugccaguguggcacauuuggaggguggcccaucugggcaccauguauaagaccuugcaacuaaagagccuacuagugaguuucaccuggcagauaaauucccaugauuucuagaaauacuaguacaaaggauuuuuuuugagacggagucucucucugucaccaggcuggaguacauuggugcgaucuuggcucacugcaaccucugacucccuaguucaagcuauucuccugccucagccucccaaguaccugggauuacaggcaugugccaccauacccagcuaauuuuuguauuuuuaguagagacagcguuucgccguguuggccaggauggucucgaucucuugaccucaugauccacacgccucggccucccaaagugcugggauuacaggugugagccacugcgccuggccaaaggauuuuuacaggugccacuuaauuuuuuuauuuaaagcuggcagacucaauguucugagagugugcuggucagcugcuaggaguuaggugcuccagcaaguugacggcugucagucaacaggcuucagcugauaucugucucacugaucucacgcugguggauugauuucauuugugaacuacuguauuucucauacaaaggauccaggugaggaggaggcuggcuccgcccuucucacguuaugaaguuaucagccaaagaguucaccagauauugcaggcccugaaaucuuuuggaaaauccuccugaaacuucccuggaggucuguauaucccuguauuuaaaauauauuuaucaacgaaagaugugauuuagaaaggaguaucuuuucauaccaucucuuuucaguggugguauuugagcaaucuuuuaaaacacaaaaccccuugcuccagugcucuggaguggugcuuagacgccuggcauccuucugagcaggcaguggaucuuggccaaguuccgggagggagcgguggaggaaacuguggagggaaggcugggcgggagagggggagccagccauggaggaauccccccugcugguucugaaacugaagcuuugucccccugccugaaaagaaggugauuugcccucacuguaguggcauaucgugaccagacacuucacaguucacacuuucaaaugaccuaaguuccagagcauacacauacuugcuccaguaaaaauaacuaaacauggaaagaaaaaaacaaagcucuuuucagugaggaguaagguauagcacagggccuaucaccugagugcuuacaaguaugugugaaaugacuucauuacauuuaccuucuuugguaugcuuugugcuaauaauaauucaguuacuguggacaacuaugaacaucuuuggaaaaaagaacaaugugaucuuuaaaagauuguaaagauggaauggaucuuuagguuaaugaacccaaaggaaggaacugggcauauggaagagccggagcuuaugacucugcuaccucccuuccuugcaguucacaguuuagagcuggaaucauaaggaguauuuccaguccccucauuuuaaggauguggaauacugagggucaaaaugacuuuuuucccucccugguuuuuaguuaguuggguugggggaagacucuauacagauaauguuauauaucaugguucaagugcucucccaaugaaauuugcauuaauuaucuuuauucgucccuucuuacauugcuacaaagagcuaccugaggcugauuaauuuauaaaaaaaaagagguuuaauugacucaacaguuccgcaggcuguacaggaagcauggcuggggaggccucaggaaacuuacaaucaugguggaggcgacuggggaagcaggcauaucuuacuggccgaagaaagaggaagagagccaagggugaggugcuacacacuuuaaacaaccagaucucgugaggacucacucacuaucacaagaacggcaagggggaaguccaccccuccaaucaccucccagcaggccccuccuccaacacuggggauuacaguucaacgugagauuuuuucccccaggaaaaauguuugguuuccucaugagaacgugaaaccuaccuaggacugugagauggaguuaauggagcacugcuauuaucguugcacuggaauugucacuguccuaauaauuugauaaugcccugaaagagauuaauaguuuucucaaaggaacaaaguuuucuguagaaacaagaugacuaaccacuuuugugauccuggugaguuuuuuggcuucaacauuaaucuuuacugugaauacauguauuccaguuucuuuuugguucauauaagcaucauuuuaauuuucugcucugcuuaauugaggucacuauugguagaacuuuguucuuuguuccuauuagaaaaguccagaaaccagcacacuguucuuuccauuuguaguugaaaucaguauucauuuggcauggcugagccuccacaggaaugcguuguggcaucucuuccauaguugagugaagaagaaaaggcaagggaagaaagcauacccaccaguaauuaauuuuguagaauuuaguacaccucuuuagguuuaaaauuccaggagaaggguucucaucuaggacaccagggauguacagaaaggcaccguucuuuaucagcugccuaagcagugucauccccaggcucauggagugggguuguagagggagaacaggccagaaggcaucuugcacgguggggucuccaaaggugucccuaauccacagcuggggagcuaggacccacaggggcucccaagucaagauucugagccaguuguuaugagaugacuccuagguguuagaauugccuuagugcuuccaggugauugucauuuccagccaggcagagaaacacuauccuaaaugaaagcccagugaguuuucaggaucagcuaucagguaaaaggcacugagcuguagacagaagauucugcuacuuaguaacugugagaccuugggccaguccucugcccucucugugccuguuucuuugucuauaaaacagggauaauggugccccaugagguguagggagaaucaaauuccauaaucuaggggcucaaucaaguucuguaaaugugaaauaccauggcagcauccagugcagugcucgcacagagucaaguacuggucagccagcauugaagccuugcauuguuuagucugggagaugggcuggagcaagcaguaacugccuuucucucuggccuugauggggucgaggcuauuaguagugccaaggagaugaagucuuuauaucucaaagaaaaaaaaaaagguagcuuaagugacauaaauccugcuuguuuuuacaaaauagugugugauaucuucaucagaaucucaaaauguuauaaauucuauaaccagguguucuguuucuuuugggaaaugcuaguugacauccauuaugguaccaagugucccuauuauuauuauuauuauuauuauuauuauuauuauuauuuggagacagagucuugcucugucacccaggcuggagugcaguggcgcaaucuuggcucucugcaaccucugccucccagguuccagccucagccuccugaguagcugggacuacaggcgcugccaccacgcccagcuaauuuuuguguuuuuaguagagacagguuucgccauguuagccaagccagucucaaacuccugagcuuaggcaauccuccugccugggucuuccaaaguguugggauuacaggcgugagccauggaccccagccuauuacuuauaaucucuccaccccuccucacgccucacucugccaggugguuuuuaucagguuaguuucuaaaacuuggccccccacauuucuuugcugugccagguaacuggagcaagugugcucuuuuccaguugcacacuccagaugcaaggauagugcugagcaguauccaacaugucagaccucugaaaagcaagggaguuauuaucuaagaaacguucagacccuuaaagccaucuuuuuuauguuuaaaaagcuuagguuuacaaguuaagacaauaagcggguacuucugaaagugaaucgaagccaacugauccuaucaaacauuuaaucagaacaucuguuugcgaugaaguuuucugacuuaucagggggauugguggugaguugagacagcagccguagagugcacucucaucucauguuuaucgggggaucauauuguccacgaagauagcuucucugugcuccaagacuuuccucacuuacuguuucuuccaugaagucuucagcacagacaggcuucgcacugcaacauguagcauuuucucagucuaggaguucaagauuaucaucauaugauacuauuagucauuuuuagguaccauuuuagauacagaaugcuguggaaguuacuucgugccugaaggccuaaauguuauuucuccaaaaaggccuuaucucuguccucugucuuccuuauccuagucuaaauuaaguuuagcuuuuaugucuaauacuuuucuuucuuauguauuuuaguuuuaauuuauuuauuacuguccuuuuuucaguuauugauugucugauuccccacuagacuaaaagcuccagcuagcaugucagaucucagaggagagcucugugaaaggcguuaaugucuaaguaacauucagacuuuuaagguaucauuuuuuuaaauuaaaaaaacacaaggauuauuugacaccagauaucaacuuaaaauaugugaaagacauaaauauuagaaaugaggauuuaaaguugguuuucuaauagcuucugaaagaaagugguauguugauuaaugaaauucuaacaugguaauaaucacauagacgcauaaccuuuaaaaaaauguacacaaauuggaucauaccauagauauuguccugcuccuuauguuuuucacuuaaucgugcaucuugauguucuuuuaugucagcaccugaugcagagaucguugguacauuucauggcuguauuguguucauuguaauuuauuuaccgauuuucaugucagaggacauuucuuggcacuucuccuuucugcuaccgugugaagaaggacauguuugcuucuucuuccaccgugauuguaagucuccugaggcuuccccagcccuguggaacugcaagucaauaaaaacucuuuccuuuacaaauuacccagucucaggcaguuuuuuauggcagugugagaacggacuaaugcauguuccaacaguggaauuacuaggucaaaauauguguauuuuuuauuaugauaaugugauauguaauuuuugccucagguuucuugauccacaagguguuggggagauuuucagauuuucuaauggagguaucugauuuaagauuucaagcaagauaaaugacucaaaccuagaaaugaucacagaguaaucaaaggaaaagugaaguuauacacucugaaguguuaaguaguagaggaagaaaacuaucagaaaaauuacaaccuaugccccgauuuaacugcuuagacauuuauuagacaaaaaaagaaaaucuacacuuuggcuuauuauauuauugaaaaauacauuuuuagcuaaggcuaaccacuagaccaauuaaaguagacauugucuauuaaagaugccuguucucaaugagaacacauggacgcagggagggaaacaucacacacuguggccuggcaggggguggggggcaauggggagggagagcauuaggacaaauaccuaaugugugcagggcuuaaaaccuagaugaugcguugaugggugcagcaaaccaccauggcacauguauaccuauguagcaaaccugcacguucugcacauguaucccagaacuuaaauaaaauaaaaauaaagaugcuuguucucaaguguggaaaggguuuagaguuugaggugcauguuguuuguagagacaugauauugacauggagaugccauaauucuuuuuuuuuuuuuuuuuuuuuuuuuuguugagacagagucucugucgcccaggcuggagugcaguggugcaaucucggcuuacugcaggcucccccuccugcguucacgugauucuccugucucagccucccgaguagcugggaccacaggcgccugucaccacgcccggcuaauuuuuuuuuguauuuuuaguagagacgggguuucaccguguuagccaggaugaucucgaucuccugaccucgugauccgcccaucucggccucccaaagugcugggauuacaggcaugagccaccgugccuggccugagaugccauaauucugcaucacaggcacuguaauccuauaucaucccccaaaucuagaggcauuacaguggguuugagauuaauuuguuuuaaccuguucuggcaucacuggauauucuuccuacucuggaaacugucagagucuaagaccaacagcaguucagguuuuguuaucaggaaaaucagugaccucuccuauguuaauaaagaguugcugcuguuggaucaccuguugcuguuuuuugacaacuccuuucccacucccaccccccuuugauuguaggauagaaguaugauaaaacauuuuaauugccuaauacugggaaaguaauuguaccuuugguuauugaguuaguaggguggagauugguuggugguuagcauuucagaauuaaaagauccuugagaaacuaugguuugauuccaaaaaaacuuacauuuaagacgaagaucaauaagggaacaauguaaaaauuuuuuuuuaaaucaacuauugauguucaugugaaaauaaaguauugaugauuuauacccaaggcucuuuuuccccccagggcagaauucuggaauucuuaacauuacugagcuauuccauuuugacuuacagauggaaauaaaaguggaagguuaaaauauagaguuauucagucuuuuuccaaguagguaaauggucagacgucauggucaaagccuaggaaguuuuguuguuguugcuguuguugucguuuugagaaagggucucacucugucacccaggcuggagugcaguggcacaauuauggcuuauugcaggcucgacauccugcacucaagcgauccuuucaccucagccucccaaauagcugggacuacaggugugcaccacuuugcccagcuaauuuucgcauuuguagaaaugggguuuuaccauauugcccaggcuggcuucaaacuguugggcuuaagugagccacccacuucagccuuccaaagugcuaggauuacagccaugagccauugugcccagcccagcccaaagccugguuuuaaagaagauuagcuauaucucuuauacaucuuuaaaaaggaccccaauacauacaccuacacaagaaaaaauaaaaccugaaaacaagaacuugcuuucuaaacuuuuauucuaaaaauuccaacaucuguuuauguaaauauccaaaggaaacucccaaccauauacacauacauacccuucagcucuucagugccacuguuucuauuguuuuuguuauacauauauauuuauuuucauguuuguugucuccugcaauaggcuguagaaacugcccccuccccaaccucccucaugaguacuguaauaucugacacuugguguguguuaaguacguguugauuuaauacaugaaacagucuuuucuccccgagugcuaaugccaguuugucauccaagggcugauuagagauuaguguuauaugucaacgucaugcuagaaauucacuaggaaagccucacaagcuaguaccauugugauugcaucaauuguggccaggcaccuauugaaaguagauuuuuaaacauuaucaaucgaggccaggugcaguagcucacgucuauaaucccagcacuuugggaggcuguggcaggaggguugcuugagcccaggaguucaagaccagccugggcaagaugaugagaccccauuuucauuaaaaaaaaaauuucuaauaugugcuugauuaaaaauaguuaaauaggcacaguggcucugccuauaauccuagcuacuugggaagcugaggcaggaggaucacuugaguccaggaguucaaggcuguugugagcugugauugcgccacugcacuccagccugugcaacagaacaagaucuuaucacuuaaaaaaaauaaaaaagagucaaauagugcagaaauguacacaguacaaaauagaaguuacccucccccacccacaaaguauuacaguuaauuguauaauggauauucuuggcccccuccugacaucccauggcaaauagcuagugaucaggaaacaggcuccuuguggauuaggaauccagugcaggaguuugagaagaaagcaccuuagcuaaucaggauggugauccccaccuccucaucgccuugcugcauugugucugauguugcagagggagcagaaacguauacugcucccuccacagagcucucugcuauuccacugauuucauuuggcuuugacaaaaaugauauguaugguauauuucuuuuucuuucuuucuuucuuuuuuuuuuuuuuuugagacagaguuucacucuuguugcccaggcuggagugcaauggcgcgaucucagcucacuacaaccuccacuucccagguucaagcaauucuccugccucacccucccaaguagcuaggauuacaggcguguaccaccguaccuggcuaauuuuuguauuuuuaguagagaugggguuucaccguguuggccaggcuggucucgaaauccugaccucaggugauccacccuccucggcaucccaaagugcugggauuacaggcaugagccaccgugcccagccuguaugguauauuucuuuuuuucuuuuauuuucuuuuuuuuuuuuaaaguaugaccauagagcugggaaaaggcaugugacguaguaaucaucugccuucauucaacacagugguccagacccucagccucuuugaggcucuagauuuagaauaaucuauaucaucugaaggaaagauacauuucacuugaaacagaagcuuuucuauaccaacagccucuccuucaagcccuucuauggaaagugcucauuucacauccugucguaaacuugcuaguugucacuuguggaaaguuggugcaugguuaccuuuuguggagaugagagucaggaucaggaacugggggacugagcccaccagguguggacugccuaggcugucccuccuugaccccacgcucuggccaacuucgacugcuccaaaagagcaaccccacugcaggagaugucccuccuuggggucgccacaccaggagcaggccuccggaaaccugagaaguacuucgagaaugacagccauccucggcuccuagagacucacuuguccaagaaaaauaucuauauaaauaaaaauucucauagcaauaggaauaaugugaacaaucaauguggcaaauugaacuagcuguaaaucaguuuccuuaacuuugaauuaggguuaauuaaccuuaaccucucuuaccugacaaaauaagaucagcgaggaaggugauuuucaacauugaggguuagccgaaguaaaucagcaauaauaguaauacaaauagugauagaguaagaagaguaauauaaugaaaacuguuucguugagcaccuguguaucagaggcuugaugcuagcuaaauaccuuacuuauauugcuucaaaaaauucauacgaugaauuugcauguuagauauuauucucauuucagaggaaaaaauacuucaguaacuuggcuaauuauaaaacuguuaguaauaagugauuggacugugauuggagccuauuguacaaaggguucgauuugcaacucuaaucuauugacaguggcauagaguggccgagaacuuaaaugugugguccagggauggccagaaagacugcugagauugauuagcagcaucugcugugagccuaaguaaggacuagggguagcagaacagcagcauauuugccugcugcaucacgcugccucucaagcuaauguaacuuggggaggaaggaaagccucuucaccuuaaaguguauuuuguuaaagugucacgaugugacacuguugugauaaaaaccaccugguuccaaagcgugcagaggaugaaaugugcgaggggcagagcuaguggcuccccacaaauaacaauuaucccauuggcccccacagugcuccccagcaguagcacugucacaucccaacaaugcgccuuugcccacagacacaugggcccaauggcuggcacugacgguuucccugaaaagugcuacuguccucuguucugaguuagccuuauuguucagagcuuagggaaugaggcacauguccagauaugggacaauaauaugugcuauacacuugcugucagcaauauuauaggucaccaugauaucaaaaccuucaacucuacagugcucugaacugaccuccccauacccuagcccucaaacuugugaauaccuauuugccccuaauucaaauaccacuuccucugaagucuucuaggacuaccacucacuagccagaguuagcuuaaugauuuuuuuucacuccaucaucuaaaaccaugccaauaaauauuugaccacugaaagaauaaaugaacuugugugaauaccuuagaaauugggaauaaauuacaaugauuuuuugagacccaaaaggaugaaaggauagcaaccauuucaagcauacauucuuuggaucuacucugaucaugugggaauuacauagucuaacagcaaguagaguaagaggaaggguuuugggcuauaccccagcacuuugggaggccgaggcagguggaucacgaggucaggaguuugagaccggccuggccaacauagugaaaccccaucucuacuaaaaacacaaaaaauuagccuggcaugguggugcaugccuguagucccagcuacuugggaggcugaggaaggagagucacuugaacccaggaggcggagguugcagugagcugagaucaugccacuguacuccagccuggcugagagagcgagauucugucucaaaaaaaaaaaaaaaaaaaaaaaaagccaucauuuggugagggaaagacaguacacaaaaaaaauucagauaagacagaaaaaucucuauuacuugaugcuacuaaugaaaucaacccuucauccccaaauuaggacagauaauggacuauaaagacuuaggucauuccacggggaggagacauuuccuuaagauaagaaaguaaaaagccaguuuuguuaugaacaggggagaaaugcaaagguccugaggcagaaaacugaaagugucugaaaguucuggagugauuggcucacagugaacaagaagagaauggcaggaggugagaguggagaauggggagagagaggcagugcagagaggccuugucgguccugauaaaggaguugagguuuuuauuccaagugcagagaaaaaccacugaaggauuaaacaggaucuauaucuguaaaaugacaguaauccucugcaggacaauuucauacaguggaaagaguaacaccauuugauggagucuuuauaccuuuagagaagcuacuuacaaagacccaacuuaauagacaauugccaggaauuaaacuucauuauuuugauacuguagaaaguugaccuuuaguucuaguuggcagaugcgugcuuucuggacagguuagccuaguggaaugauuuauucuagagcaacucuaagauauuuuaaguaaaaaacagugccucugaggagaaaagaaggcuccauuucccaauucaacaguuguucauucauugaucucucagcugacuucuagaguaagaugcugcccuuuugggcagaaaaggcuaggcagguccaucuuccccacauggucagccagcucuccuuucagucccgggcaugguucacacacucugggacauacacuuaaggggcucacuucguaauaguggcugcuuguuccuauugccaagugcuuucccauggcagguuguguuucuugagccuaauguguuccagaacuuccuauuuccuuaccaguucucugauuuaaagaaauuguuuauuuuuucuucacuuuuucaacaaucucacuuuuucaacagucuuuauugagcaccugugccuauguggagauuaaacacauugcggggcauugaagaacaguguuggggugguauuagcacaacacugguucuagggagcucagggagugagcacuuaucucugccugagugggcuuccuggaggaggugacagagcuaagcuuuugaaggagucucauucugacaucucugagaaagauggaucagacaguagaaagugauuuggagacugcuggagaaauccaaggagggcacaaaaagccugggcuggcaaggcgaguccagagguagaggaaaaguuugccuaaagagguaaacagguuuucaggaaauagagccaguagaacuuggagaaugauugggcacagggcaaauuugagauaauuccaagaguuugcagccacacccaucugcucuccaaggaauaguucccaagcugaaacucaaaggucaccagcauucuucaugagauccugcucugaaucuguuacccuuuuucaugaccucuuuuuggaacagugaugaagaggaagugguaucauauaugguuucagaauaaagcccuugagucauuguauuagcucuuguuuacagaacauuuuaagaugcuuucaaggaaauacaaauaauaugauucuuaugccuauuuccugccaguggccaaccagucuucuaaguaugguugaugugagaagugaaacuauuuuccuaaaugcuguuucuuuucucuuuucauuaugaaguauauucggugcucuucgaacuggugcuuauaugguguacauuuugaugaccaaaggccugaagcagucaguuugugaccaggguuuuuacaauggaccugucagcaaauucugggcuuaugcauuugugcuaagcaaagcacccgaacuaggugaguaucuucuuccauuuccucucccucucuuuguagcaacauauccacaguauuuauuuagugagcaaagaaacauuuugaagguccuauuuuguugguugcaagaaaguuacaaugaaugaauuugaguucuugccugacuucuacuuuuuauuguucgcucccucuuuccuuuuaaauaauuuuacauugugcauauuaagaguagauaguuuauacugaacaugcugauuuucgagcucuacuaaaaauauaccuccacggacuuauaaaauguacagagaccccuuuaaaaggcccacugagcugagcuaauauuaaaacaugggggaagaaaagagcaacacagcuauuuccaagucccauaucugagcauacuuucaucuguagaguuaggauucagauuaggaauuaagcuuuucauuuggggacccuccuguucucauuaacaaaugcugaggguuggucucuggugguguuugauuuuaaucaucaagacuggccuuagggaaggggaauguaauuuaccuuccagaaaguaauagaaaauacaggcuguauuuguagauuucuauaauuuuucccucaacccuugaauggucuugaauguaaguguggcacagguuaccagaaauaguaaagucaaggaguuaaugugggcacaguuuuccaggaagaugucuuuauuuacacagaaagagaucuaguggugacaauaagcucugaguacauccaugaguaaugcuagcaaacugguacagauuguacagguacaaacugguaaggcaaaccuggucaccucugggguucuggguuuuuuuucaccugcaauuaagaauuauacauauuuaguucaaaagauaucaauugcaauuuuugccauuguuuucaauggcaaaaccgcaguuaacuuuugcaccaaccuaauauguauuguccccucuccuguuucuccuaaaaagggaguuugguguuguacuuuccuuacaaaccaccugcaauauaagcuaugagcagucuucuguaaggugccccuuguucacgccccguguccauucagauagaaugggaacugucugauuugugugggccggcaacccagccaccuuccacuggaagccagaaaccugcuguuuauaaguagaugacaauugguuugagcuacugucuucccaggucaaaaacaagggaagaacaacagaagaaaauuuuuccugaaaaccuuuccuaagaggggcagagguacaaagauaguccaaaauaacuagauaacuaccgcgugcaugugcaugccugcaccgcucccccccuccaacagacacacaaacgccuacacacacggaucauaugaaaacggucucaggguaaaaugcauuaguguggauucauucauucauucauucagugcauuuauguuaagcacuggcugaaauagaauggcaacuuuaucuaaaaggaauuuuacaauacagauuuuaugaaccaggccccaggagguauugguaccacuagguaugaagucauaggcuagagaagugguuuucacccuggauuuacagacaaugccugcaaaaucugaagagguauuucugggaauuuuaaaauuauaugagaauauuuuaauuugcuuugauucauagaguuucugaaucagagcacuuguucucaaacugggguugaucugagagugugagcauguauucuuuacucuugggguuuugugauuuuuuuuuuuuuuuuuuuuucccugagacagagucuuacucuguugccgaggcuggagugcaguggcgcgaucucggcucacugcaaccuccgugucccggguucaaacaauucucgugccucagccuuccgaguagcugggauuacaggugugugccacuacacccggcuaauuuuuguauuuuuaguagagacgggguuucaccauguuggccaggcuggacuugaacuccugaccucagguaaucagcccgccucggccucccaaagugcuaguauuauaggcaugagccacugugcccggcuguggcuuuuuuucuuuaaaauaaaauuacacguuauuaaagucugaauuauuuuaguugagaaauauaucccucuuuuaugcuauuuaauaaccuuauuaauccccuaucuuuuuugacaaaggccugacuacaacuacauaaauguaguaaaugcaugaaacgugauuuccccugaaugcuaccccugaacacuucaacaguuucuaccuuuuacuacuucccccucaauuuuuuuuuuaauaagaaauaaucaugccaguaggaugcaaguaggagacuagacuauggcuggagacuggacuuccgaccuuuaagccucagaucacaaaaaagcagccucaguguuuucuucuagaaacgccuuuucccugcaaggacuaauuguguuguguucugaguuauauacagcuguauuugagguacuugagaacaaacauaguccuuucuaccuuuuggaggaauaauuuauugaaaugccaccucaagcuaucuguagugauuaauuuccuuuaaagacauaaucagaccuaugcucucuguccuccugacuuuuaggauuccuagagaagaccuauuaguguagcacccagagguauucauauuuucaucuucuaucuugguuguguugaugcugaugauguuaauaucaccugucuuaauuuaauccaggcccaaauguccauuccccucagccucauagcggacauuguaauugaauacaguguucccucuugagccccaaaggagccauaauccagucuccuauuugcagucaacaggaguggugugcugcuggcaugauaaucccuuucccuggaaagggcucauucaucacaauaauuuguaguaguccuuuguggauuauccaauaaucgaugcaguuaaaauaugagauugaaguguuggaaaaaauaauauucuaaucuugacauaguucuuuaaugaggcuaauuaguaacacaaauucuucauacaguuucaaacccuuuauagagauaauuuucauguucugaauacuuuuuuuuuuuaacauuuuaaaauaugggauauuguucuucaaauacucuggagcuccucugacaauggccauucagagguaaaccgcugacucaaaacagguccaaaaucagugcaagugucuccaagacaagcagaucuaggucuuuauguagucaacauguuugccuggaugacuuuuuuuucccaugcauuuuggagguuaaauuucuuuccaguuuuugcaguuggaaaaucuugucgcuacuauuuaauuaagagagauuuacccguuuggauuauuuagaacuuuucuuauuuuuaggucucaaauuuuaccuuucaauauucuaagauucuggacucuuuaugagcaccaaaaggaaaagaucuagugagaaaaaaacaguucuuccauguauaguacugaaacuguauccccccccccagcucccacaaacucaaacucuuguuuuaaauugcaguaaaauauacauauuauucagauuguugagcaaccauuacuccaucaacuuccagaacuuuugcaucuucuccaacugaaaugcuacucauuccacacuaacucccccuucacuaaacucuuaauaaauagcaagaagaccuuucuguuucagcagaaaaccgugagcucauuucagugaauuaugggguuguaggccacuagaacaagugagaggaaaagagccacuaaccugcuuugugugccaaaucucugagcaccuacuauuuggauuauauuaaaacccgcugagauuuuguuuuguuaaaacuuggaaauaucugcucugagcccagguccuugcucaguugagcaugucauuguuuuugaagcucugacucagcagcacucuagcuagcucugggaagagggacucagcuguaugugacaaaccacacacacagaguagccucucugugucucuugguggccaagaacacccuggggauuuccaaaugcuuguugcuuuuccugcagcugcaaagguguaguuaagaagggacacuuggguauaaggaacaacaugcccugccugaaagcugucucuugaaugaaaauaguuggaccaaagguuagagaaaucaugauacagagaacaugagccaggagguagcuaaaaugacaggacugaaacguucgagagucuaaagucccauugcuuguacuuggccaauguccuucccguuaugccaacaggacauuugaacaagaaagauugacugaccaacucaaauacacagucccucugauaguuaacauuucugggucacucuauagcuucuggaaagccugaaauuaccaugacuuggcaugacucuggcucaugacaaauuaaaugugacauuaugugguuuccccagaggaaaaauaauuuguaccugccagaguggccugacugaugcaucucagcugccauauccaagaccgugagaggacuugguuagcucuucuagagccccaccaguuucccccugccugagggaaacuaccacucuuugggucagcagucugggggauaguaacccugauaggguguugaauggugcuacugaucagcuccagagccauugcugggagaugaucaauuucauucccgcacccaccaucgugcauauguguucuggaaaaaacuccuaagcaaauuuaaauuaauuuuguucuugagauuucgggacauguuuuccccuccuccuacccuccacuccacuccccucccuaaaguaacuagaaacacccaguguaucucaguuaaaccugagauauacccucaccuccagacaggagaaacacaaagccauucuuaacuccagaauuguaccuuccacuuuccaucccacacuagcccauucuaauaugguuuuucuuaaucauucuuuagacaauaaaauuuuaauauaaaagugaugauaggguuaaacuaaagaguuaggaugaaaugcauauuacuuugacaaauuuauuauaauguguuuggaauuguauagggguuuauauuuuaguuaaugcuaagagacucaugaaagcaucuauucaauuaugaaugacuaaacuuguuuuaaacauacaguaucuuggacaucuaccuucuuuacacuaugaaccaagguagcuggaauugauugugucugcguuauuguccacagagggauuggaggaacagaguaguacuuauacagaaacgguggaucucugacagauacaaaaauagcacaguuuaacacugaaaaguagaucccgggucuccugacaccaguuuugucccuuaaguauauguaugaggguuaccaucaucauccaucauuaucagucugccugacacuuauagacaccauaaaaaucuggcaucuugcaagagagaagaugacuucaacaaaaauuugacaguagguucagaaauauaacaacugacaacuuuccuauuuauuuaauuaauuuauuuauuuuuugagauggagucuugcccuguugcccaggccuagagugcaauggcaugaucuuggcucacugcaaccuccgccuccccagguucaagugauucuccugccucagccuccugaguagcugggauuacaggugccugccacaaugcccagcuaauuuuuuuuuuuugagauggagucucacucugucgcccaggcuggaguauaguggcacaaucucggcucacugcaaacuccaccucccggguucaugccauucuccugccucagccuccagaguagcugggaccacaggcacccaccaccacaccuggauauuuuuuuaauuuuauaguagagaugggguuucaccguguuagccaggauggucuugaucuccugaccuugugaucugcccaccucgggcucccaaagugcuggaauuacaggugugagccaccgugccagccuaauuuuuguauuuuuaguagagaugggguuucgccauguuggccaggcuggucucgaacuccugaccucaggugauccccccgccuuggccucccaaagugcugggaugacaggugugagucaccacacccggccaacuuucuuuuucuauuguaaacaaauaugaaauaauaguguuuaacaguuuaguaggaaaauaaaccaauagcucuccuaaugcauggaauggggcaccaccuguaucuuuccagccacugccauuagaaccuuagaagucuuuccccauaguccagcauucuuugaccuugcugagugcaagcguuuuaggccaucugugaaguacaugagggauaagguaggaauaaguacuaguuuuucuuuguuuuguuuuguuuuguugcgcuuaauuaaauuucagaagaagaagaagaaccagggccggguucucagggcgguggcucacgccuauagucccagcacuuuaggaggccgaggcugguggauagcuugagcucaggaguucaagaccucaucucuacuaaaaaaguuuuuuuaaauuagcugggcaugguggcacaugccugcagucucagcuauuccuuaggcugcagugggaggaucacuugagcccaggagaucaaguuuucagugagcugcgauggcacguaggugacagggcaagacccugucucaaaaacaaacaaaaaauuaaaagaaccuucuagcuuuuguuuuuuacacaaaaagaagccagguuugaguucaccaaaggucaugaaggaugucgauuuuucccaugucucauaaccauagagauaggaaggagaaagacgcauucaccugcauuagccuguuucugucacacauccuagcguaacuucccuuauuuucuuacucgcuaauguaauuggguauauuuuucacugggcuugcucuucauccaauuuuacauaaauguucuacagucuauuuucagagcccugaaacuuuucagugaagcauugcagauacauagcaucuacccaccucagcauaauucuagcuuucauaauauaaauucccugccucagaagcuauggucuuuuccuucaaagggauauuguuagacaaaauuuugauagauccuggaaaucuuuucaguuaauucuguaaaaugaaaacuguuauuuucaauugcuccucacuugauucacugguauaaaauauuccuauuacccuugucagcaaauguguauagaagaggauuuuugucccccuuuuucugucuuuuguuuagguuuuacuuuucucacugccauuuggcaaggcuguguaauuuagggagcucacaaagauauauguuugagggguaccuuuuaucauguaccaaagaaaaauuaugguuuuacuacucuagagaagccuuagaacauuuugcugggcacuugacuuccagucuguuuccuuugauugauaaaugaucuaagacaagucaccaguccccuccaggugguauuuccuaaaauguauaguugaguugggaguuggcaacauaguuguuaaugucccuuccagaucaaugauggauaagauuuugugugaaauaccuugaaagaaacauuugcugcuugccuccugugugugaagagagccaugcugauuauccuacuuaauccucaggugauuccaugcuacucuuuuaaauuaucaccauuuauauagaugaggaaacuagaaauagugaggauaacuaacuuguccagggucacagagcuaguaaguaccaguucaggguucuaauccagucuauguaacucuccaguccuagcucaggaugucuacccucuuacaaaacuguaagucaucguuacugguggucaaggaucucacguaccuucuuccucuuugucuuccaggagauacaauauucauuauucugaggaagcagaagcugaucuuccugcacugguaucaccacaucacugugcuccuguacucuugguacuccuacaaagacaugguugccgggggagguugguucaugacuaugaacuauggcgugcacgccgugauguacucuuacuaugccuugcgggcggcagguuuccgagucucccggaaguuugccauguucaucaccuugucccagaucacucagaugcugaugggcugugugguuaacuaccuggucuucugcuggaugcagcaugaccagugucacucucacuuucagaacaucuucugguccucacucauguaccucagcuaccuugugcucuucugccauuucuucuuugaggccuacaucggcaaaaugaggaaaacaacgaaagcugaauaguguuggaacugaggaggaagccauagcucagggucaucaagaaaaauaauagacaaaagaaaauggcacaaggaaucacacguggugcagcuaaaacaaaacaaaacaugagcaaacacaaaacccaaggcagcuuagggauaauuagguugauuuaacccaguaaguuuaugauccuuuuagggugaggacucacugagugcaccuccaucuccaagcacugcugcuggaagaccccauucccucuuuaucuaucaacucuaggacaagggagaacaaaagcaagccagaagcagaggagacuaaucaaaggcaaacaaaggcuauuaacacauaggaaaaaauguauuuacuaagugucacauuucucuaagaugaaagauuuuuacucuagaaacugugcgagcacaacacacacaauccuuucuaacuuuauggacacuaaacuggagccaauagaaaagacaaaaaugaaagagacacaggguguauaucuagaacgauaaugcuuuugcagaaacuaaagccuuuuuaagaaaugccagcugcuguagaccccaugagaaaagaugucuuaaucauccuuaugaaaacagauguaaacaacuauauuucaacuaacuucaucuucacugcauagccucaggcuagugaguuugccaaaaccaaagggggugaauacuuccccaagauucuuccugggaggauggaaacagugcagcccaggucccaugggggcagcuccaucccagagcauuucugauaguugaacuguaauuucuacucuuaagugagauaugaagcauuauccuuuuguucaguugccccgggcuuuugaacagaagaguaaauacagaauugaaaaagauaaacacucaaccaaacaaugugaaaacggguucuguaguauuuguaaaaaggcccggcccaggaccacugugagcuggaaaagggagaaaggcagugggaaaagaggugagccgaagaucaauucgacagacagaugguguguaugccccucccuguuugacuucacacacacucauaacuuuccaaaugaaaccccacaguauagcgcauauuuucgauauuuuugugaauuccaaaaggaaaucacagggcuguucgaaauauugggggaacacuguguuucugcaucaucugcauuugcuccccaagcaauguagagguguuuaaagggcccucugcuggcugaguggcaauacuacaacaaacuucaaggcaaguuuggcugaaaacaguugacaacaaagggcccccauacacuuaucccucaaauuuuaagugauaugaaauacuugucaugucuuuggccaaaucagaagauauucauccugcuucaagucagcuucagaaauguuuuaaaagggacuuuagcucuggaacucaaaaucaauuuauuaagagccauauucuuuaaaaaaaaaaagcuggauaauauucucuguaauauuucaguccuuuacaagccaaauacaugugucaauguuucuaguauuucaaagaagcaauuauguaaaguuguucaaugugacauaauaguauuauaauugguuaaguagcuuaaugauuaggcaaacuagaugaaaagauuaggggcuuccacacugcauagauuacacgcacauagccacgcauacacacacagacacacagaugugggguacacugaacuucaaagcccaaaugaauagaaacacauuuucuggcuagcagaaaaaaacaaaacaaaacuguuguuucucuuucuugcuuugagaguguacaguaaaagggauuuuuucgaauuauuuuuauauuauuuuagcuuuaauugugcugucguucaugaaacagagcugcucugcuuuucugucagagauggcaagggcuuuuucagcaucucguuuauguguggaauuuaaaaagaauaaaguuuuauuccauucugugugaaugguuugagcagugaacaaagaauccaugcaaaccaagucaugacuggaagaaauggggagugggggacagugcaggggaggaaagcuguuacaucuauguuaaaugauugugagcagucuauaaugucuugauguugguucauaggugagacacaacugauggaggaauguauuauaaauuaugcaaaaucugacaugagcugaaaagacagguccuuuuauaagagcuaauagaugcuuaggaugcaaauguuauuuugagcuucgcaaauacaugauaccgugcaauaagccuuuuuuccuuaua

SEQ ID NO: 191335 - RNA, 149543 nt, Homo sapiens
uauaaggaaaaaaggcuuauugcacgguaucauguauuugcgaagcucaaaauaacauuugcauccuaagcaucuauuagcucuuauaaaaggaccugucuuuucagcucaugucagauuuugcauaauuuauaauacauuccuccaucaguugugucucaccuaugaaccaacaucaagacauuauagacugcucacaaucauuuaacauagauguaacagcuuuccuccccugcacugucccccacuccccauuucuuccagucaugacuugguuugcauggauucuuuguucacugcucaaaccauucacacagaauggaauaaaacuuuauucuuuuuaaauuccacacauaaacgagaugcugaaaaagcccuugccaucucugacagaaaagcagagcagcucuguuucaugaacgacagcacaauuaaagcuaaaauaauauaaaaauaauucgaaaaaaucccuuuuacuguacacucucaaagcaagaaagagaaacaacaguuuuguuuuguuuuuuucugcuagccagaaaauguguuucuauucauuugggcuuugaaguucaguguaccccacaucugugugucuguguguguaugcguggcuaugugcguguaaucuaugcaguguggaagccccuaaucuuuucaucuaguuugccuaaucauuaagcuacuuaaccaauuauaauacuauuaugucacauugaacaacuuuacauaauugcuucuuugaaauacuagaaacauugacacauguauuuggcuuguaaaggacugaaauauuacagagaauauuauccagcuuuuuuuuuuuaaagaauauggcucuuaauaaauugauuuugaguuccagagcuaaagucccuuuuaaaacauuucugaagcugacuugaagcaggaugaauaucuucugauuuggccaaagacaugacaaguauuucauaucacuuaaaauuugagggauaaguguaugggggcccuuuguugucaacuguuuucagccaaacuugccuugaaguuuguuguaguauugccacucagccagcagagggcccuuuaaacaccucuacauugcuuggggagcaaaugcagaugaugcagaaacacaguguucccccaauauuucgaacagcccugugauuuccuuuuggaauucacaaaaauaucgaaaauaugcgcuauacugugggguuucauuuggaaaguuaugagugugugugaagucaaacagggaggggcauacacaccaucugucugucgaauugaucuucggcucaccucuuuucccacugccuuucucccuuuuccagcucacagugguccugggccgggccuuuuuacaaauacuacagaacccguuuucacauuguuugguugaguguuuaucuuuuucaauucuguauuuacucuucuguucaaaagcccggggcaacugaacaaaaggauaaugcuucauaucucacuuaagaguagaaauuacaguucaacuaucagaaaugcucugggauggagcugcccccaugggaccugggcugcacuguuuccauccucccaggaagaaucuuggggaaguauucacccccuuugguuuuggcaaacucacuagccugaggcuaugcagugaagaugaaguuaguugaaauauaguuguuuacaucuguuuucauaaggaugauuaagacaucuuuucucauggggucuacagcagcuggcauuucuuaaaaaggcuuuaguuucugcaaaagcauuaucguucuagauauacacccugugucucuuucauuuuugucuuuucuauuggcuccaguuuaguguccauaaaguuagaaaggauuguguguguugugcucgcacaguuucuagaguaaaaaucuuucaucuuagagaaaugugacacuuaguaaauacauuuuuuccuauguguuaauagccuuuguuugccuuugauuagucuccucugcuucuggcuugcuuuuguucucccuuguccuagaguugauagauaaagagggaauggggucuuccagcagcagugcuuggagauggaggugcacucagugaguccucacccuaaaaggaucauaaacuuacuggguuaaaucaaccuaauuaucccuaagcugccuuggguuuuguguuugcucauguuuuguuuuguuuuagcugcaccacgugugauuccuugugccauuuucuuuugucuauuauuuuucuugaugacccugagcuauggcuuccuccucaguuccaacacuauucagcuuucguuguuuuccucauuuugccgauguaggccucaaagaagaaauggcagaagagcacaagguagcugagguacaugagugaggaccagaagauguucugaaagugagagugacacuggucaugcugcauccagcagaagaccagguaguuaaccacacagcccaucagcaucugagugaucugggacaaggugaugaacauggcaaacuuccgggagacucggaaaccugccgcccgcaaggcauaguaagaguacaucacggcgugcacgccauaguucauagucaugaaccaaccucccccggcaaccaugucuuuguaggaguaccaagaguacaggagcacagugauguggugauaccagugcaggaagaucagcuucugcuuccucagaauaaugaauauuguaucuccuggaagacaaagaggaagaagguacgugagauccuugaccaccaguaacgaugacuuacaguuuuguaagaggguagacauccugagcuaggacuggagaguuacauagacuggauuagaacccugaacugguacuuacuagcucugugacccuggacaaguuaguuauccucacuauuucuaguuuccucaucuauauaaauggugauaauuuaaaagaguagcauggaaucaccugaggauuaaguaggauaaucagcauggcucucuucacacacaggaggcaagcagcaaauguuucuuucaagguauuucacacaaaaucuuauccaucauugaucuggaagggacauuaacaacuauguugccaacucccaacucaacuauacauuuuaggaaauaccaccuggaggggacuggugacuugucuuagaucauuuaucaaucaaaggaaacagacuggaagucaagugcccagcaaaauguucuaaggcuucucuagaguaguaaaaccauaauuuuucuuugguacaugauaaaagguaccccucaaacauauaucuuugugagcucccuaaauuacacagccuugccaaauggcagugagaaaaguaaaaccuaaacaaaagacagaaaaagggggacaaaaauccucuucuauacacauuugcugacaaggguaauaggaauauuuuauaccagugaaucaagugaggagcaauugaaaauaacaguuuucauuuuacagaauuaacugaaaagauuuccaggaucuaucaaaauuuugucuaacaauaucccuuugaaggaaaagaccauagcuucugaggcagggaauuuauauuaugaaagcuagaauuaugcugagguggguagaugcuauguaucugcaaugcuucacugaaaaguuucagggcucugaaaauagacuguagaacauuuauguaaaauuggaugaagagcaagcccagugaaaaauauacccaauuacauuagcgaguaagaaaauaagggaaguuacgcuaggaugugugacagaaacaggcuaaugcaggugaaugcgucuuucuccuuccuaucucuaugguuaugagacaugggaaaaaucgacauccuucaugaccuuuggugaacucaaaccuggcuucuuuuuguguaaaaaacaaaagcuagaagguucuuuuaauuuuuuguuuguuuuugagacagggucuugcccugucaccuacgugccaucgcagcucacugaaaacuugaucuccugggcucaagugauccucccacugcagccuaaggaauagcugagacugcaggcaugugccaccaugcccagcuaauuuaaaaaaacuuuuuuaguagagaugaggucuugaacuccugagcucaagcuauccaccagccucggccuccuaaagugcugggacuauaggcgugagccaccgcccugagaacccggcccugguucuucuucuucuucugaaauuuaauuaagcgcaacaaaacaaaacaaaacaaagaaaaacuaguacuuauuccuaccuuaucccucauguacuucacagauggccuaaaacgcuugcacucagcaaggucaaagaaugcuggacuauggggaaagacuucuaagguucuaauggcaguggcuggaaagauacagguggugccccauuccaugcauuaggagagcuauugguuuauuuuccuacuaaacuguuaaacacuauuauuucauauuuguuuacaauagaaaaagaaaguuggccggguguggugacucacaccugucaucccagcacuuugggaggccaaggcggggggaucaccugaggucaggaguucgagaccagccuggccaacauggcgaaaccccaucucuacuaaaaauacaaaaauuaggcuggcacgguggcucacaccuguaauuccagcacuuugggagcccgaggugggcagaucacaaggucaggagaucaagaccauccuggcuaacacggugaaaccccaucucuacuauaaaauuaaaaaaauauccaggugugguggugggugccuguggucccagcuacucuggaggcugaggcaggagaauggcaugaacccgggagguggaguuugcagugagccgagauugugccacuauacuccagccugggcgacagagugagacuccaucucaaaaaaaaaaaauuagcugggcauuguggcaggcaccuguaaucccagcuacucaggaggcugaggcaggagaaucacuugaaccuggggaggcggagguugcagugagccaagaucaugccauugcacucuaggccugggcaacagggcaagacuccaucucaaaaaauaaauaaauuaauuaaauaaauaggaaaguugucaguuguuauauuucugaaccuacugucaaauuuuuguugaagucaucuucucucuugcaagaugccagauuuuuauggugucuauaagugucaggcagacugauaaugauggaugaugaugguaacccucauacauauacuuaagggacaaaacuggugucaggagacccgggaucuacuuuucaguguuaaacugugcuauuuuuguaucugucagagauccaccguuucuguauaaguacuacucuguuccuccaaucccucuguggacaauaacgcagacacaaucaauuccagcuaccuugguucauaguguaaagaagguagauguccaagauacuguauguuuaaaacaaguuuagucauucauaauugaauagaugcuuucaugagucucuuagcauuaacuaaaauauaaaccccuauacaauuccaaacacauuauaauaaauuugucaaaguaauaugcauuucauccuaacucuuuaguuuaacccuaucaucacuuuuauauuaaaauuuuauugucuaaagaaugauuaagaaaaaccauauuagaaugggcuagugugggauggaaaguggaagguacaauucuggaguuaagaauggcuuuguguuucuccugucuggaggugaggguauaucucagguuuaacugagauacacuggguguuucuaguuacuuuagggaggggaguggaguggaggguaggaggaggggaaaacaugucccgaaaucucaagaacaaaauuaauuuaaauuugcuuaggaguuuuuuccagaacacauaugcacgauggugggugcgggaaugaaauugaucaucucccagcaauggcucuggagcugaucaguagcaccauucaacacccuaucaggguuacuaucccccagacugcugacccaaagagugguaguuucccucaggcagggggaaacugguggggcucuagaagagcuaaccaaguccucucacggucuuggauauggcagcugagaugcaucagucaggccacucuggcagguacaaauuauuuuuccucuggggaaaccacauaaugucacauuuaauuugucaugagccagagucaugccaagucaugguaauuucaggcuuuccagaagcuauagagugacccagaaauguuaacuaucagagggacuguguauuugaguuggucagucaaucuuucuuguucaaauguccuguuggcauaacgggaaggacauuggccaaguacaagcaaugggacuuuagacucucgaacguuucaguccugucauuuuagcuaccuccuggcucauguucucuguaucaugauuucucuaaccuuugguccaacuauuuucauucaagagacagcuuucaggcagggcauguuguuccuuauacccaagugucccuucuuaacuacaccuuugcagcugcaggaaaagcaacaagcauuuggaaauccccaggguguucuuggccaccaagagacacagagaggcuacucugugugugugguuugucacauacagcugagucccucuucccagagcuagcuagagugcugcugagucagagcuucaaaaacaaugacaugcucaacugagcaaggaccugggcucagagcagauauuuccaaguuuuaacaaaacaaaaucucagcggguuuuaauauaauccaaauaguaggugcucagagauuuggcacacaaagcagguuaguggcucuuuuccucucacuuguucuaguggccuacaaccccauaauucacugaaaugagcucacgguuuucugcugaaacagaaaggucuucuugcuauuuauuaagaguuuagugaagggggaguuaguguggaaugaguagcauuucaguuggagaagaugcaaaaguucuggaaguugauggaguaaugguugcucaacaaucugaauaauauguauauuuuacugcaauuuaaaacaagaguuugaguuugugggagcuggggggggggauacaguuucaguacuauacauggaagaacuguuuuuuucucacuagaucuuuuccuuuuggugcucauaaagaguccagaaucuuagaauauugaaagguaaaauuugagaccuaaaaauaagaaaaguucuaaauaauccaaacggguaaaucucucuuaauuaaauaguagcgacaagauuuuccaacugcaaaaacuggaaagaaauuuaaccuccaaaaugcaugggaaaaaaaagucauccaggcaaacauguugacuacauaaagaccuagaucugcuugucuuggagacacuugcacugauuuuggaccuguuuugagucagcgguuuaccucugaauggccauugucagaggagcuccagaguauuugaagaacaauaucccauauuuuaaaauguuaaaaaaaaaaaguauucagaacaugaaaauuaucucuauaaaggguuugaaacuguaugaagaauuuguguuacuaauuagccucauuaaagaacuaugucaagauuagaauauuauuuuuuccaacacuucaaucucauauuuuaacugcaucgauuauuggauaauccacaaaggacuacuacaaauuauugugaugaaugagcccuuuccagggaaagggauuaucaugccagcagcacaccacuccuguugacugcaaauaggagacuggauuauggcuccuuuggggcucaagagggaacacuguauucaauuacaauguccgcuaugaggcugaggggaauggacauuugggccuggauuaaauuaagacaggugauauuaacaucaucagcaucaacacaaccaagauagaagaugaaaauaugaauaccucugggugcuacacuaauaggucuucucuaggaauccuaaaagucaggaggacagagagcauaggucugauuaugucuuuaaaggaaauuaaucacuacagauagcuugagguggcauuucaauaaauuauuccuccaaaagguagaaaggacuauguuuguucucaaguaccucaaauacagcuguauauaacucagaacacaacacaauuaguccuugcagggaaaaggcguuucuagaagaaaacacugaggcugcuuuuuugugaucugaggcuuaaaggucggaaguccagucuccagccauagucuagucuccuacuugcauccuacuggcaugauuauuucuuauuaaaaaaaaaauugagggggaaguaguaaaagguagaaacuguugaaguguucagggguagcauucaggggaaaucacguuucaugcauuuacuacauuuauguaguuguagucaggccuuugucaaaaaagauaggggauuaauaagguuauuaaauagcauaaaagagggauauauuucucaacuaaaauaauucagacuuuaauaacguguaauuuuauuuuaaagaaaaaaagccacagccgggcacaguggcucaugccuauaauacuagcacuuugggaggccgaggcgggcugauuaccugaggucaggaguucaaguccagccuggccaacauggugaaaccccgucucuacuaaaaauacaaaaauuagccggguguaguggcacacaccuguaaucccagcuacucggaaggcugaggcacgagaauuguuugaacccgggacacggagguugcagugagccgagaucgcgccacugcacuccagccucggcaacagaguaagacucugucucagggaaaaaaaaaaaaaaaaaaaaaucacaaaaccccaagaguaaagaauacaugcucacacucucagaucaaccccaguuugagaacaagugcucugauucagaaacucuaugaaucaaagcaaauuaaaauauucucauauaauuuuaaaauucccagaaauaccucuucagauuuugcaggcauugucuguaaauccagggugaaaaccacuucucuagccuaugacuucauaccuagugguaccaauaccuccuggggccugguucauaaaaucuguauuguaaaauuccuuuuagauaaaguugccauucuauuucagccagugcuuaacauaaaugcacugaaugaaugaaugaaugaauccacacuaaugcauuuuacccugagaccguuuucauaugauccguguguguaggcguuugugugucuguuggagggggggagcggugcaggcaugcacaugcacgcgguaguuaucuaguuauuuuggacuaucuuuguaccucugccccucuuaggaaagguuuucaggaaaaauuuucuucuguuguucuucccuuguuuuugaccugggaagacaguagcucaaaccaauugucaucuacuuauaaacagcagguuucuggcuuccaguggaagguggcuggguugccggcccacacaaaucagacaguucccauucuaucugaauggacacggggcgugaacaaggggcaccuuacagaagacugcucauagcuuauauugcaggugguuuguaaggaaaguacaacaccaaacucccuuuuuaggagaaacaggagaggggacaauacauauuagguuggugcaaaaguuaacugcgguuuugccauugaaaacaauggcaaaaauugcaauugauaucuuuugaacuaaauauguauaauucuuaauugcaggugaaaaaaaacccagaaccccagaggugaccagguuugccuuaccaguuuguaccuguacaaucuguaccaguuugcuagcauuacucauggauguacucagagcuuauugucaccacuagaucucuuucuguguaaauaaagacaucuuccuggaaaacugugcccacauuaacuccuugacuuuacuauuucugguaaccugugccacacuuacauucaagaccauucaaggguugagggaaaaauuauagaaaucuacaaauacagccuguauuuucuauuacuuucuggaagguaaauuacauuccccuucccuaaggccagucuugaugauuaaaaucaaacaccaccagagaccaacccucagcauuuguuaaugagaacaggaggguccccaaaugaaaagcuuaauuccuaaucugaauccuaacucuacagaugaaaguaugcucagauaugggacuuggaaauagcuguguugcucuuuucuucccccauguuuuaauauuagcucagcucagugggccuuuuaaaggggucucuguacauuuuauaaguccguggagguauauuuuuaguagagcucgaaaaucagcauguucaguauaaacuaucuacucuuaauaugcacaauguaaaauuauuuaaaaggaaagagggagcgaacaauaaaaaguagaagucaggcaagaacucaaauucauucauuguaacuuucuugcaaccaacaaaauaggaccuucaaaauguuucuuugcucacuaaauaaauacuguggauauguugcuacaaagagagggagaggaaauggaagaagauacucaccuaguucgggugcuuugcuuagcacaaaugcauaagcccagaauuugcugacagguccauuguaaaaacccuggucacaaacugacugcuucaggccuuuggucaucaaaauguacaccauauaagcaccaguucgaagagcaccgaauauacuucauaaugaaaagagaaaagaaacagcauuuaggaaaauaguuucacuucucacaucaaccauacuuagaagacugguuggccacuggcaggaaauaggcauaagaaucauauuauuuguauuuccuugaaagcaucuuaaaauguucuguaaacaagagcuaauacaaugacucaagggcuuuauucugaaaccauauaugauaccacuuccucuucaucacuguuccaaaaagaggucaugaaaaaggguaacagauucagagcaggaucucaugaagaaugcuggugaccuuugaguuucagcuugggaacuauuccuuggagagcagauggguguggcugcaaacucuuggaauuaucucaaauuugcccugugcccaaucauucuccaaguucuacuggcucuauuuccugaaaaccuguuuaccucuuuaggcaaacuuuuccucuaccucuggacucgccuugccagcccaggcuuuuugugcccuccuuggauuucuccagcagucuccaaaucacuuucuacugucugauccaucuuucucagagaugucagaaugagacuccuucaaaagcuuagcucugucaccuccuccaggaagcccacucaggcagagauaagugcucacucccugagcucccuagaaccaguguugugcuaauaccaccccaacacuguucuucaaugccccgcaauguguuuaaucuccacauaggcacaggugcucaauaaagacuguugaaaaagugagauuguugaaaaagugaagaaaaaauaaacaauuucuuuaaaucagagaacugguaaggaaauaggaaguucuggaacacauuaggcucaagaaacacaaccugccaugggaaagcacuuggcaauaggaacaagcagccacuauuacgaagugagccccuuaaguguaugucccagagugugugaaccaugcccgggacugaaaggagagcuggcugaccauguggggaagauggaccugccuagccuuuucugcccaaaagggcagcaucuuacucuagaagucagcugagagaucaaugaaugaacaacuguugaauugggaaauggagccuucuuuucuccucagaggcacuguuuuuuacuuaaaauaucuuagaguugcucuagaauaaaucauuccacuaggcuaaccuguccagaaagcacgcaucugccaacuagaacuaaaggucaacuuucuacaguaucaaaauaaugaaguuuaauuccuggcaauugucuauuaaguugggucuuuguaaguagcuucucuaaagguauaaagacuccaucaaaugguguuacucuuuccacuguaugaaauuguccugcagaggauuacugucauuuuacagauauagauccuguuuaauccuucagugguuuuucucugcacuuggaauaaaaaccucaacuccuuuaucaggaccgacaaggccucucugcacugccucucucuccccauucuccacucucaccuccugccauucucuucuuguucacugugagccaaucacuccagaacuuucagacacuuucaguuuucugccucaggaccuuugcauuucuccccuguucauaacaaaacuggcuuuuuacuuucuuaucuuaaggaaaugucuccuccccguggaaugaccuaagucuuuauaguccauuaucuguccuaauuuggggaugaaggguugauuucauuaguagcaucaaguaauagagauuuuucugucuuaucugaauuuuuuuuguguacugucuuucccucaccaaaugauggcuuuuuuuuuuuuuuuuuuuuuuuuugagacagaaucucgcucucucagccaggcuggaguacaguggcaugaucucagcucacugcaaccuccgccuccuggguucaagugacucuccuuccucagccucccaaguagcugggacuacaggcaugcaccaccaugccaggcuaauuuuuuguguuuuuaguagagaugggguuucacuauguuggccaggccggucucaaacuccugaccucgugauccaccugccucggccucccaaagugcugggguauagcccaaaacccuuccucuuacucuacuugcuguuagacuauguaauucccacaugaucagaguagauccaaagaauguaugcuugaaaugguugcuauccuuucauccuuuugggucucaaaaaaucauuguaauuuauucccaauuucuaagguauucacacaaguucauuuauucuuucaguggucaaauauuuauuggcaugguuuuagaugauggagugaaaaaaaaucauuaagcuaacucuggcuagugagugguaguccuagaagacuucagaggaagugguauuugaauuaggggcaaauagguauucacaaguuugagggcuaggguauggggaggucaguucagagcacuguagaguugaagguuuugauaucauggugaccuauaauauugcugacagcaaguguauagcacauauuauugucccauaucuggacaugugccucauucccuaagcucugaacaauaaggcuaacucagaacagaggacaguagcacuuuucagggaaaccgucagugccagccauugggcccaugugucugugggcaaaggcgcauuguugggaugugacagugcuacugcuggggagcacugugggggccaaugggauaauuguuauuuguggggagccacuagcucugccccucgcacauuucauccucugcacgcuuuggaaccaggugguuuuuaucacaacagugucacaucgugacacuuuaacaaaauacacuuuaaggugaagaggcuuuccuuccuccccaaguuacauuagcuugagaggcagcgugaugcagcaggcaaauaugcugcuguucugcuaccccuaguccuuacuuaggcucacagcagaugcugcuaaucaaucucagcagucuuucuggccaucccuggaccacacauuuaaguucucggccacucuaugccacugucaauagauuagaguugcaaaucgaacccuuuguacaauaggcuccaaucacaguccaaucacuuauuacuaacaguuuuauaauuagccaaguuacugaaguauuuuuuccucugaaaugagaauaauaucuaacaugcaaauucaucguaugaauuuuuugaagcaauauaaguaagguauuuagcuagcaucaagccucugauacacaggugcucaacgaaacaguuuucauuauauuacucuucuuacucuaucacuauuuguauuacuauuauugcugauuuacuucggcuaacccucaauguugaaaaucaccuuccucgcugaucuuauuuugucagguaagagagguuaagguuaauuaacccuaauucaaaguuaaggaaacugauuuacagcuaguucaauuugccacauugauuguucacauuauuccuauugcuaugagaauuuuuauuuauauagauauuuuucuuggacaagugagucucuaggagccgaggauggcugucauucucgaaguacuucucagguuuccggaggccugcuccugguguggcgaccccaaggagggacaucuccugcagugggguugcucuuuuggagcagucgaaguuggccagagcguggggucaaggagggacagccuaggcaguccacaccuggugggcucagucccccaguuccugauccugacucucaucuccacaaaagguaaccaugcaccaacuuuccacaagugacaacuagcaaguuuacgacaggaugugaaaugagcacuuuccauagaagggcuugaaggagaggcuguugguauagaaaagcuucuguuucaagugaaauguaucuuuccuucagaugauauagauuauucuaaaucuagagccucaaagaggcugagggucuggaccacuguguugaaugaaggcagaugauuacuacgucacaugccuuuucccagcucuauggucauacuuuaaaaaaaaaaaagaaaauaaaagaaaaaaagaaauauaccauacaggcugggcacgguggcucaugccuguaaucccagcacuuugggaugccgaggaggguggaucaccugaggucaggauuucgagaccagccuggccaacacggugaaaccccaucucuacuaaaaauacaaaaauuagccagguacggugguacacgccuguaauccuagcuacuugggagggugaggcaggagaauugcuugaaccugggaaguggagguuguagugagcugagaucgcgccauugcacuccagccugggcaacaagagugaaacucugucucaaaaaaaaaaaaaaaagaaagaaagaaagaaaaagaaauauaccauacauaucauuuuugucaaagccaaaugaaaucaguggaauagcagagagcucuguggagggagcaguauacguuucugcucccucugcaacaucagacacaaugcagcaaggcgaugaggagguggggaucaccauccugauuagcuaaggugcuuucuucucaaacuccugcacuggauuccuaauccacaaggagccuguuuccugaucacuagcuauuugccaugggaugucaggagggggccaagaauauccauuauacaauuaacuguaauacuuugugggugggggaggguaacuucuauuuuguacuguguacauuucugcacuauuugacucuuuuuuauuuuuuuuaagugauaagaucuuguucuguugcacaggcuggagugcaguggcgcaaucacagcucacaacagccuugaacuccuggacucaagugauccuccugccucagcuucccaaguagcuaggauuauaggcagagccacugugccuauuuaacuauuuuuaaucaagcacauauuagaaauuuuuuuuuuaaugaaaauggggucucaucaucuugcccaggcuggucuugaacuccugggcucaagcaacccuccugccacagccucccaaagugcugggauuauagacgugagcuacugcaccuggccucgauugauaauguuuaaaaaucuacuuucaauaggugccuggccacaauugaugcaaucacaaugguacuagcuugugaggcuuuccuagugaauuucuagcaugacguugacauauaacacuaaucucuaaucagcccuuggaugacaaacuggcauuagcacucggggagaaaagacuguuucauguauuaaaucaacacguacuuaacacacaccaagugucagauauuacaguacucaugagggagguuggggagggggcaguuucuacagccuauugcaggagacaacaaacaugaaaauaaauauauauguauaacaaaaacaauagaaacaguggcacugaagagcugaaggguauguauguguauaugguugggaguuuccuuuggauauuuacauaaacagauguuggaauuuuuagaauaaaaguuuagaaagcaaguucuuguuuucagguuuuauuuuuucuuguguagguguauguauugggguccuuuuuaaagauguauaagagauauagcuaaucuucuuuaaaaccaggcuuugggcugggcugggcacaauggcucauggcuguaauccuagcacuuuggaaggcugaaguggguggcucacuuaagcccaacaguuugaagccagccugggcaauaugguaaaaccccauuucuacaaaugcgaaaauuagcugggcaaaguggugcacaccuguagucccagcuauuugggaggcugaggugaaaggaucgcuugagugcaggaugucgagccugcaauaagccauaauugugccacugcacuccagccugggugacagagugagacccuuucucaaaacgacaacaacagcaacaacaacaaaacuuccuaggcuuugaccaugacgucugaccauuuaccuacuuggaaaaagacugaauaacucuauauuuuaaccuuccacuuuuauuuccaucuguaagucaaaauggaauagcucaguaauguuaagaauuccagaauucugcccuggggggaaaaagagccuuggguauaaaucaucaauacuuuauuuucacaugaacaucaauaguugauuuaaaaaaaaauuuuuacauuguucccuuauugaucuucgucuuaaauguaaguuuuuuuggaaucaaaccauaguuucucaaggaucuuuuaauucugaaaugcuaaccaccaaccaaucuccacccuacuaacucaauaaccaaagguacaauuacuuucccaguauuaggcaauuaaaauguuuuaucauacuucuauccuacaaucaaaggggggugggagugggaaaggaguugucaaaaaacagcaacaggugauccaacagcagcaacucuuuauuaacauaggagaggucacugauuuuccugauaacaaaaccugaacugcuguuggucuuagacucugacaguuuccagaguaggaagaauauccagugaugccagaacagguuaaaacaaauuaaucucaaacccacuguaaugccucuagauuugggggaugauauaggauuacagugccugugaugcagaauuauggcaucucaggccaggcacgguggcucaugccuguaaucccagcacuuugggaggccgagaugggcggaucacgaggucaggagaucgagaucauccuggcuaacacggugaaaccccgucucuacuaaaaauacaaaaaaaaauuagccgggcguggugacaggcgccuguggucccagcuacucgggaggcugagacaggagaaucacgugaacgcaggagggggagccugcaguaagccgagauugcaccacugcacuccagccugggcgacagagacucugucucaacaaaaaaaaaaaaaaaaaaaaaaaaaagaauuauggcaucuccaugucaauaucaugucucuacaaacaacaugcaccucaaacucuaaacccuuuccacacuugagaacaagcaucuuuauuuuuauuuuauuuaaguucugggauacaugugcagaacgugcagguuugcuacauagguauacaugugccauggugguuugcugcacccaucaacgcaucaucuagguuuuaagcccugcacacauuagguauuuguccuaaugcucucccuccccauugccccccacccccugccaggccacagugugugauguuucccucccugcguccauguguucucauugagaacaggcaucuuuaauagacaaugucuacuuuaauuggucuagugguuagccuuagcuaaaaauguauuuuucaauaauauaauaagccaaaguguagauuuucuuuuuuugucuaauaaaugucuaagcaguuaaaucggggcauagguuguaauuuuucugauaguuuucuuccucuacuacuuaacacuucagaguguauaacuucacuuuuccuuugauuacucugugaucauuucuagguuugagucauuuaucuugcuugaaaucuuaaaucagauaccuccauuagaaaaucugaaaaucuccccaacaccuuguggaucaagaaaccugaggcaaaaauuacauaucacauuaucauaauaaaaaauacacauauuuugaccuaguaauuccacuguuggaacaugcauuaguccguucucacacugccauaaaaaacugccugagacuggguaauuuguaaaggaaagaguuuuuauugacuugcaguuccacagggcuggggaagccucaggagacuuacaaucacgguggaagaagaagcaaacauguccuucuucacacgguagcagaaaggagaagugccaagaaauguccucugacaugaaaaucgguaaauaaauuacaaugaacacaauacagccaugaaauguaccaacgaucucugcaucaggugcugacauaaaagaacaucaagaugcacgauuaagugaaaaacauaaggagcaggacaauaucuaugguaugauccaauuuguguacauuuuuuuaaagguuaugcgucuaugugauuauuaccauguuagaauuucauuaaucaacauaccacuuucuuucagaagcuauuagaaaaccaacuuuaaauccucauuucuaauauuuaugucuuucacauauuuuaaguugauaucuggugucaaauaauccuuguguuuuuuuaauuuaaaaaaaugauaccuuaaaagucugaauguuacuuagacauuaacgccuuucacagagcucuccucugagaucugacaugcuagcuggagcuuuuagucuaguggggaaucagacaaucaauaacugaaaaaaggacaguaauaaauaaauuaaaacuaaaauacauaagaaagaaaaguauuagacauaaaagcuaaacuuaauuuagacuaggauaaggaagacagaggacagagauaaggccuuuuuggagaaauaacauuuaggccuucaggcacgaaguaacuuccacagcauucuguaucuaaaaugguaccuaaaaaugacuaauaguaucauaugaugauaaucuugaacuccuagacugagaaaaugcuacauguugcagugcgaagccugucugugcugaagacuucauggaagaaacaguaagugaggaaagucuuggagcacagagaagcuaucuucguggacaauaugaucccccgauaaacaugagaugagagugcacucuacggcugcugucucaacucaccaccaaucccccugauaagucagaaaacuucaucgcaaacagauguucugauuaaauguuugauaggaucaguuggcuucgauucacuuucagaaguacccgcuuauugucuuaacuuguaaaccuaagcuuuuuaaacauaaaaaagauggcuuuaagggucugaacguuucuuagauaauaacucccuugcuuuucagaggucugacauguuggauacugcucagcacuauccuugcaucuggagugugcaacuggaaaagagcacacuugcuccaguuaccuggcacagcaaagaaauguggggggccaaguuuuagaaacuaaccugauaaaaaccaccuggcagagugaggcgugaggagggguggagagauuauaaguaauaggcugggguccauggcucacgccuguaaucccaacacuuuggaagacccaggcaggaggauugccuaagcucaggaguuugagacuggcuuggcuaacauggcgaaaccugucucuacuaaaaacacaaaaauuagcugggcgugguggcagcgccuguagucccagcuacucaggaggcugaggcuggaaccugggaggcagagguugcagagagccaagauugcgccacugcacuccagccugggugacagagcaagacucugucuccaaauaauaauaauaauaauaauaauaauaauaauaauaauagggacacuugguaccauaauggaugucaacuagcauuucccaaaagaaacagaacaccugguuauagaauuuauaacauuuugagauucugaugaagauaucacacacuauuuuguaaaaacaagcaggauuuaugucacuuaagcuaccuuuuuuuuuuucuuugagauauaaagacuucaucuccuuggcacuacuaauagccucgaccccaucaaggccagagagaaaggcaguuacugcuugcuccagcccaucucccagacuaaacaaugcaaggcuucaaugcuggcugaccaguacuugacucugugcgagcacugcacuggaugcugccaugguauuucacauuuacagaacuugauugagccccuagauuauggaauuugauucucccuacaccucauggggcaccauuaucccuguuuuauagacaaagaaacaggcacagagagggcagaggacuggcccaaggucucacaguuacuaaguagcagaaucuucugucuacagcucagugccuuuuaccugauagcugauccugaaaacucacugggcuuucauuuaggauaguguuucucugccuggcuggaaaugacaaucaccuggaagcacuaaggcaauucuaacaccuaggagucaucucauaacaacuggcucagaaucuugacuugggagccccuguggguccuagcuccccagcuguggauuagggacaccuuuggagaccccaccgugcaagaugccuucuggccuguucucccucuacaaccccacuccaugagccuggggaugacacugcuuaggcagcugauaaagaacggugccuuucuguacaucccugguguccuagaugagaacccuucuccuggaauuuuaaaccuaaagagguguacuaaauucuacaaaauuaauuacugguggguaugcuuucuucccuugccuuuucuucuucacucaacuauggaagagaugccacaacgcauuccuguggaggcucagccaugccaaaugaauacugauuucaacuacaaauggaaagaacagugugcugguuucuggacuuuucuaauaggaacaaagaacaaaguucuaccaauagugaccucaauuaagcagagcagaaaauuaaaaugaugcuuauaugaaccaaaaagaaacuggaauacauguauucacaguaaagauuaauguugaagccaaaaaacucaccaggaucacaaaagugguuagucaucuuguuucuacagaaaacuuuguuccuuugagaaaacuauuaaucucuuucagggcauuaucaaauuauuaggacagugacaauuccagugcaacgauaauagcagugcuccauuaacuccaucucacaguccuagguagguuucacguucucaugaggaaaccaaacauuuuuccugggggaaaaaaucucacguugaacuguaauccccaguguuggaggaggggccugcugggaggugauuggagggguggacuucccccuugccguucuugugauagugagugaguccucacgagaucugguuguuuaaaguguguagcaccucacccuuggcucucuuccucuuucuucggccaguaagauaugccugcuuccccagucgccuccaccaugauuguaaguuuccugaggccuccccagccaugcuuccuguacagccugcggaacuguugagucaauuaaaccucuuuuuuuuuauaaauuaaucagccucagguagcucuuuguagcaauguaagaagggacgaauaaagauaauuaaugcaaauuucauugggagagcacuugaaccaugauauauaacauuaucuguauagagucuucccccaacccaacuaacuaaaaaccagggagggaaaaaagucauuuugacccucaguauuccacauccuuaaaaugaggggacuggaaauacuccuuaugauuccagcucuaaacugugaacugcaaggaagggagguagcagagucauaagcuccggcucuuccauaugcccaguuccuuccuuuggguucauuaaccuaaagauccauuccaucuuuacaaucuuuuaaagaucacauuguucuuuuuuccaaagauguucauaguuguccacaguaacugaauuauuauuagcacaaagcauaccaaagaagguaaauguaaugaagucauuucacacauacuuguaagcacucaggugauaggcccugugcuauaccuuacuccucacugaaaagagcuuuguuuuuuucuuuccauguuuaguuauuuuuacuggagcaaguauguguaugcucuggaacuuaggucauuugaaagugugaacugugaagugucuggucacgauaugccacuacagugagggcaaaucaccuucuuuucaggcagggggacaaagcuucaguuucagaaccagcaggggggauuccuccauggcuggcucccccucucccgcccagccuucccuccacaguuuccuccaccgcucccucccggaacuuggccaagauccacugccugcucagaaggaugccaggcgucuaagcaccacuccagagcacuggagcaagggguuuuguguuuuaaaagauugcucaaauaccaccacugaaaagagaugguaugaaaagauacuccuuucuaaaucacaucuuucguugauaaauauauuuuaaauacagggauauacagaccuccagggaaguuucaggaggauuuuccaaaagauuucagggccugcaauaucuggugaacucuuuggcugauaacuucauaacgugagaagggcggagccagccuccuccucaccuggauccuuuguaugagaaauacaguaguucacaaaugaaaucaauccaccagcgugagaucagugagacagauaucagcugaagccuguugacugacagccgucaacuugcuggagcaccuaacuccuagcagcugaccagcacacucucagaacauugagucugccagcuuuaaauaaaaaaauuaaguggcaccuguaaaaauccuuuggccaggcgcaguggcucacaccuguaaucccagcacuuugggaggccgaggcguguggaucaugaggucaagagaucgagaccauccuggccaacacggcgaaacgcugucucuacuaaaaauacaaaaauuagcuggguaugguggcacaugccuguaaucccagguacuugggaggcugaggcaggagaauagcuugaacuagggagucagagguugcagugagccaagaucgcaccaauguacuccagccuggugacagagagagacuccgucucaaaaaaaauccuuuguacuaguauuucuagaaaucaugggaauuuaucugccaggugaaacucacuaguaggcucuuuaguugcaaggucuuauacauggugcccagaugggccacccuccaaaugugccacacuggcaacaguuggcagugacuauguugccgaguucaucugcuucuucaagagaaaucccagugaaaaacccugggagcacuuuuaucucugaccuguggccaguucagcagcucuugaagucuccaagaugcuggcaugguugcucagacauuugagaaucuccaaauggccuucucugggguccucucaucuccauuucaggaacuuccuguuccucaaaggcagccugaaaguugucacccuauuguacuucaaagcccuaaucaaagccuuccagaguccugugaaauaaggcaacaagaaguccuggccccaauuuaaucacgaaaugauuuugaaaaugagaaucauacacagauaagcuaauuuuuauauauguguauacaacugauuuaagaagaaaaauuaacucugugguuugugaaucuggaagaguuaggaacaugcuuaaacucucguaccuauucuacugauuuccgugcauuucauccuuacaauuuuuuuaaggucaaucugcuagaauguaaugauacaauucugguaauuuucaaaaugagaaaucuauguauaccuuuaucaucuccauaccacacgugccgccaagcucauagggcugauagcgggcacacacuggacugcugccuggcuuggcauucuaccaguacugucccaggagcagagcucacucuuuucacagaggcauuuuuuuuuuuaaccucaggguaggaaaaacauaaaauaucauuaaguguguucucacaaauuaucuuaagugucuuuggggaaaaagucugaaaguggguugugccuguggaauaaccuugggcccuuaagcaccaaugaauaacgcaaacucaguggguauuugugagcuaugacauuuaugauuauuaagcaggguuucauaauaaagguuucaaaaagucugugguauuucuugcuucacagauucccagacuacugaauuuuccuaauggccucauagcugaacuccccaggaagucucuacauuuccuccaaggagaacguauuuuucucccuucacuaugaaauguaagcauugaggaacaaggaaaauuccuuccaccgcugccccugaccucacagccaguccagcagagaggauggagcccuugaugcuuuagggcuuuccugucuucugaaggaaaagccgguuuccaucugaagugugagaggggaaauaaaaagaccaccgcuggaagauaauugguuuaucucucucacuuucuggcuuauuccuuauucuuguucuauucuuuucccauaguccauggcccuuccaaacuuuagguuacaaaauacagauuugucuccuccuucucugcaaaacaaaaucccauaauuccucaauuagauauuaggagaagacaaaugcaaugggagcagggaauggcugaaacuccuuuguccuuccugggguauuacauaaauuuucaaccaacagaauugcagacagcccagguucuaaauauaguaauuccucaauaucagggagacuugucccaggaacuccccaggauaccaaaaucugaggaugcucaagucucugauaugaaauggcuugguauuugcacauaaccuguguccaucuucccauauacuuuaaaacaucuccaggauuacuuauaauaacacaauguacaugcaauguaaauaguuguuauacaguauuuuaaaguaauuuguauuguugucuuuauuuuuuuuccuccaaaccaagcuugguugaaucugcagaugcagaaccuauagauauggagggcugacuguaauuucagccaggggagggucaugagauuuuaauuauuuauucaagcaauauuuccugaacauuuuauaugugccaggcauuauuucagguaaggaaggagggaccugaaauuuuaagaccuggagaacuuuagaaaugauguggauaagacauuagguacuggggacauagcaguaaacucugauaggaaucacauuuguuggagcuuauaucuuaaaugagggcaauagauaguaugucaggaaauauauauuauaguacgccagauggugauaaggaguguguggagugcugggugggaguacagugugcuguuuuauuacauaauaaacauuuuuuaaaacuuauaggcaggaagaacucaauaauaugacgacacuugagcagaggcaucaaggaaguggguaagcccugcgcuggcucuccuucccguaacuggccuuggcacuccauugcauccucaagugugcccuguuccuucaucuccuggagcuggaacugugauccagaauauguaaagaacaauuacaacuuaauaacaaauaacucuauuaaaaaaugagcaacaaagguaaauagauguuacuccagagauaauacacaaauaaugaaucaaaagcauaugaaaagaugcucaaccucacugaucauuagaaaaugaaaauaaugagguaucacgucacagucauuaggauggcuacuaucaaaaaaaugaaaaauaauuacuguuaggauguggaaaaauuggaacccaugugcacuguuggagggaauauaaaauggcucuauggcuauugaaaacaguauggcaguuucuuaaaaagaaauagaauugccacaugauucagcaauuucacuucuggguguguauucaaaagaauuagaaaaaggauuuagaggaguuccuuguacacacaugcucaaaacagcagcauuauucacaauuggcaacagaugaaagcaaccuaaauguaucaauggaugaauggauaaaaaaaaugugguauauauacaaugaaauauuacuaagccuugaaaagaagauuaugacauauacuacaaaguggaagaaccuggaggacauuaugcuaagugacauaagccagucacaaaaagacaaauacuguaugauucugcuuaugagguaucuaaagcagucaaauucauagauacagaaacuagaauggugguuguuggguuagggggaggcagaaaugaggaguuuucacuuaauggguacaguuucaguuuuauaagaugaaaaaguucuaaaaauugguugcacaacaaugaauauauguaacacuacugaacuauacacauaaaaugguuaagaggauaaaucuuguuauccauuuuucaccaccaccaccacagcagcacaaaaagaucccuggaagauggccuuaaaugucucuaacucuaaacuccuauuccuuaaagaaucacuuccauauaccaauuaaauggauuuucaaguuaaugacuuguaaaauguugggacaaaaaaaaguccaaauguaggugacaugugcuuuugaugaaaaugcuaaaauaacuuccugaaacacaucaaaguuuccaacaaugaagaguugauacccugaaacaauuugaccaaaacuugaauaggcauagugauguugcauuguaguauuauggcacacaguggguaauagcaagcugaugagaaaaaccgaacuccauuuucacacagucacagcuagcauccugacagacagaugugaagaaauugcuugauaaugacucaguacuugaaucuauaaauugaaucuuuuuauagguaaaaauaaaaguauuagugauaagugcugaagaaaagagauaaacauuagugcaaguguucuucagacaaaauuauaugaagcaugagacggugcagcugaaaccagaacuauucucuacaauuuacuguauauaacuguacaguuauacauuccauggugauguuuuagucaagcacaaaucacauauacaauggugguccuauauaauaauagaacacacagagaaaacugcuuuguggcacuugcuuuuggcagugcagaucaaguaggagaaaugauucauauucaguaaugguccuaggacacuugcuuuuccauaugaaaaaaauauguaaauaaaaauauauacccucuagguuuguggaaguacacaaggauaaagucaccuagcgagguggagccaagaaggucaaauaagaacagcuccagucuacagcucccagugugagcaaugcagaagaugggugauuucugcauuuccaacugaggaaccggguucaucucacuggggaguguuggaaagugggugcaagacagugggugcagcgcaccgagugugagccgaagcagggcgaggcauaaccucacccaggaagcucaaggggucagggaacucccuuuccuagucaaagaaaggggugacagacagcaccuggaaaaucgggucacucccacccuaauacugugcuuuuccaauggucuuagcaaacggcacacuaggagauuauaucccgugacuggcucggaggguccuacgcccacagagccucgcucauugcuagcacagcagucugagaucaaacugcaaggccgcagcgaggcugggagaggggcgccugccauugcugaggcuugaguagguaaacaaagcagccagccaggaagcucgaacuggguggagccaaccgcagcucaaggaggccugccugccucuguagacuccaccucugggggcagggcauagccaaacaaaaggcagcagaauccucugcagacuuaaaugucccugucugacagcuuugaagagaguagugguucucccagcacgcagcuggagaucugagaauggacagacugucuccucaagugggucccugacccccgaguagccuaacuaggaggcaccccccaguagggacagacugacaccucacacagccgggugcuccucugagauaaaacuuccagaggaaugaucaggcagcaauauuugcuggucaccaauauccgcuguucugcagccuccacugcugauacccaggcaaacagggucuggaguggaccuccagcaaacuccaacagaccugcagcuguggguccugacuguuagaaggaaaacuaacaaacagaaaggacauccacaccaaaacuccaucuguaugucaccaucgucaaagaccaaagguagauaaaaccacaaagacggggaaaaaacagagcagaaaaacuggaaacucuaaaaaucagagcaccucuccucccccaaaggaacgcaacuccucaccagcaauggaacaaagcuggacggacaaugacuuugacgaguugagauaagaaggcuucagacgaucaaacuacuccgagcuaaaggaggaaguucgaacccauggcaaagaaguuaaaaaccuugaaaaaaaauuagacgaaaggcuaacuagaauaacuaaugcagagaaguccuuaaaggaccugauggagcugaaaaccaaggcaugagaacuacgugaugaaugcacaagccucaguagccaauuugaucaacuggaagaaacgguaucagagauagaagaucaaauggaugaaauaaagcaagaagagaacuuuagagaaaaaagaauaaaaagaaaugaacaaagccuccaagaaauacgggacuaugugaaaagaccaaaucuacaucugauugguguaccugaaagugacagggagaauggaaccaaguuggaaaacacucugcaggauauuauccaggagaacuucccaaaucuagcaaggcaggacaacauucauauucaggaaauacagagaacgccacaaagauacuccucaagaagagcaacuccaagacacauaauugucagauucaccaaaguugacaugaaggaaaaaauguuaagggcagccagagagaaagguuggguuauccacgaagggaagcccaugagacuaacagcugaccucuuggcagaaacucuacaagccagaagagagugggggccaauauucaacauucuuaaagaaaagaauuuucaacccagaauuucauauccagccaaacuaagcuucauaagugaaggagaaauaaaauacuuuacagacaagcaaaugcugagagauuuugucaccaucaggccugcccuaaaagagcuccugaaggaagcacuaaacauggaaaggaacaaccaguaccagccacugcaaaaacaugccaaauuguaaagaccauugaggcuaggaagaaacugcaucaacuaaugagcaaaauaaccagcuaacaucauaaugacaagaucaaauucacacauaaccauauuaaccuuaaauguaaaugggcuaaaugcuccaaauuaaagacacagacuggcaaauuggauaaggagucaagacccaucagugugcuauauucaggaaacccaucucaugugcagagacacacauaggcucaaaauaaagggauggaggaagaucuaccaagcaaauggaaaacaaaaaaaggcagagguugcaauccuagucucugauaaaacagacuuuaagccaacaaagaucaaaagagacaaagaaggccauuacauaaugguaaagggaucaauucaacaagaagagauaacuauccuaaauauauaugcacucaauacaggagcacccagauucauaaagcaaguccuuagagaccuacaaagagacuuagacucccacacaauaauaaugggagacuuuaacacccuacugucaacauuagacagaucaacaagacagaaaguuaacaaggauauccaggaauugaacucggcucugcaccaaguggaccuaauagacaucuacagaauucuccaccccaaaucaacagaauauacauucuuuucagcaccacaccacacccauuacaaaauugacugcauaguuggaaguaaagcucuccucagcaaauggaaaagaacagaaauuauaacaaacugucucucagaccacggugcaaucaaacuagaacucaggauuaagaaacucacucaaaaccgcucaacuacaugaaaacugaacaaccugcuccugaaugacuacuggguacauaacgaaaugaaagcagaaauaaagauguucuuugaaaccaacgagaacaaagacagaacauaccagaaucucugggacauauucaaagcaguguguagagggaaauuuacagcacuaaaugcccacaagagaaagcagaaaagaucuaauugacacccuaacaucacaauuaaaagaacuagagaagcaagagcaaacacagucaaaaacuagcagaaggcaagaaauaacuaagaucagagcagaacugaaggaaacagagacacaaaaaacccuucaaaaaaaaucaaugaauccaggagcugguuuuuugaaaagaucaacaaaauugaccgaccacuagcaagacuaauaaagaagaaaagagagaagaaucaaauagaugcaauaaaaaaugauaaaggggauaucaccaccgaucccacagaaauacaaacuaccaucagagaaugcuauaaacaccuccacacaaauaaacuagaaaaucuagaagaaauggauaaauuccucgacacauacacccucccaagacuaaaccaggaggaaguugaaucucugaauagaccaaaaauaggcucugaaauugaggcaauaauuaauagcuuaccaaccaaaaaaaguccaggaccagauggauucacagccgaauucuaccagagguacaaggaggagcugguaccauugcuucugaaacuauuacaaucaauagaaagagagggaauccuuccuaacucauuuuaugaggccagcaucauccugauaccaaagccuggcagaaacaaaacaaaaaaagagaauuuuagaccaauaucccugaugaacauugaugcaaaaauccucaauaaaauacuggcaaaccaaauccagcagcgcaucaaaaagcuuaaacaccaugaucaagugggcuucaucccugggaugcaaggcugguucagcauacgcaaaucaguaaacguaauccaggcuauaaacaaaaccaaugacaaaaaccacaugauuaucucaauagaugcagaaaaggccuuugacaaaauucaacagcgcuucaugcuaaaaacucucaauagauuagguauugaugggauguaucucagaauaauaacagcuauccgugacaaacccacagccaauaucauacugaaugggcaaaaacuguaagcauucccuuugaaaacuggcacaagacagggaugcccucucucaccacuccuauucaacauaguguuggaaguucuggccaggguaaucaggcaggagaaggaaauaaaggguauucaauuaggaaaagaggaagucaaauugucccuguuugcagaugacaugauuguauaucuagaaaaccccaucaucucagcccaaaaucuccuuaagcugauaggcaacuucagcaaagucucaggauacaaaaucaaugugcaaaaaucacaggcauucuuauacaccaacaacagacuaacagagagccaaaucaugagugaacucccauucacaauugcuucaaagaggauaaaauaccuaggaauccaacuuacaagggaugugaaggaccucuucaaggagaacuacaaaccacugcucaaugaaauaaaagaggauacagacaaauggaagaacauuccaugcucauggguaggaagaaucaauaucgugaaaauggccauacugcccaagguaauuuauaaauucaaugccauccccaucaagcuaccaaugauuuucuucacagaauuggaaaaaaccacuuuaaaguucauauggaaccaaaaaagagccugcauugccaagucaauccuaagccaaaagaacaaagcuggaggcaucacacuaccuaacuucaaacuauacuacaaggcuacagaaaccaaaacagcaugguacugguaccaaaacagagauauagaccaauggaacagaauggagcccucagaaauaaugccacauaucuacaaccaucugauauuugacaaaccugacaaaaacaagaaauggggaaaggauucccuauuuaauaaauggugcugggaaaacuggcuagucauauguauaaagcugaaacuggaucccuuccuuacaccuuauacaaaaauuaauucaagauggauuaaagacuuaaauguuagaccuaaaaccauaaaaaccauagaagaaaaccuaggcaauaccauucaggacauaggcaugggcaaggacuucaugucugaaacacuaaaagcaagggcaacaaaagccaaaauugacaaaugggaucuaauuaaacuaaagagcuucugcacagcaaaagaaacuaccaucagagugaacaggcaaccuacaaaaugggagaaaauuuuugcaaucuacucaucugacaaaggguuaauacccagaaucuacaaagaacucaaacaaauuuacaagaaaaaaacaaacagccccaucaaaaagugggugaaggauaugaacagacacuucugaaaagaagacauuuaugcagccaaaagacacaugaaaaaaugcucaucaucacuggccaucagagaaaugcaaaucaaaaccacaaugagauaccgucucacaccaguuagaauggcaaucauuaaaaagucaggaagcaacaggugcuggagaggauguggagaaauaggaacacuuuuacacuguuggugggacuguaaacuaguucaaccaucguggaagucaguguggcgauuccucagggaucuagaacuagaaauaccauuugacccagcuaucccauuacuggguauauacccaaaggauuauaaaucaugcuacuauacagacacaugcacacauauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaagcuggaaaccaucauucucagcaaacuaucgcaaggacaaaaaaccaaacaccacauguucucacucauaggugggaauugaacaaugagaacacauggacacaggaaggggaacaucacacaccagggccuguugugggguggggguagggaggagggguagcauuaggagauauaccuaauguuaaaugaugaguuaaugggugcagcacaccaacauggcacauguauacauauguaacaaaccugcacauugugcacauguacccuaaaacucaaaguauaauaaaaaaauaaauaaaaaaucaccuagcaacauacuucucagggugcuuuucucacagcgcaucccugucaagggacgcaugacuguguaugauaggccauguguguuuucauuagagaauauggacucaacaauuauccacaaacgcuuuuaacagcuccauagaaaucucaaauuaagacauuauuacuuguaaguaucagaacuagugaauguuaacugaagauggagacaagaaucuagugcccaacaugagcaaaacaagagaacacagguauccuuuuagggaauucugauuuaauuagguuguuucucucuggguuuauucacuuaaaaaaaaagcaaacuuuuucuaugccgacuacauacuagguucuucauaucaagugauuaagaaaaagacaaaucaauuuucacaaaacccauauucuagugagggagacugaugaauacauuaaaaauagcuuacuaauuucagguaguaagugccacaggauaacaaaaccagguaaagugauaauggacuagggaugagggcaagaaggucgucuucugacaugaaagaaguccucucagaagcggggacaugugaucugauaacugaucaaugaaaaggggccaggcuggccaagaccuagagaagaacauaccagguagagggauaaaucacuaagcacuaaucagcugggcacgcuugguacgagcccagaggcuggcggugauggggacuaaagagagacaugguuuaacaggugggcauggacuacagcuuauagggccuuugaggauccugacacagagauaguaauaauuauacaauucauuuuauucuaacugcacuguacaagcauugguagguuuuaagcagguaaugacaugauuuguauuuuuaauaauacaggcugcuguguggugaaaggacuguaguaauuacuacauuaauauaaauguuaaaauauucauauuauuauaaaaguagucaggcacuuaaaaauauauugugucccgcauuuccaaagaugaugaugguggugguuaguaugugguaacaaugggcauaagagaagcagacaaacauaggaucuauuuuggcaguauagcugcuuagacucccugagaugcugugauggaugcugugauauauauagauaauauauauauacacauagagagagagauaauauauauagagauauauauaacauguuauauaugauauauaugauauaacauaugccauauacgauauauaacauaugccauauaugguauauaacauaugccauauaugguauauaacacaugcuauauaugauauauaacauauauaugcuauauaugauauauaacauauauaugauauauaugauauauauaacauauaugugauaaugauauauaugauauauauaacauauaugugauauauaugauauauauaacauauaacuuauaugauauauauaacauauaacuuauaugauauauauaacauauaugauauauauaacauauagcuuauaugugauauauaacauauauaacuuauauaugauauauaacauauaacauauauaaauuugauauauaucacauauaugauauaugauauauaccgcauauaugauauaugauauauaucgcauauaugauauaugauauaugacauacaugauauaucacauauaucauauaugauauaucgcauauaucauauaugauauauaacaauauacacuauaauguauacacauauauaucauauauguguauacauuauauacacuuacacacacacacacacacacacacacacacagauauauauauauauauauauauauauuuuuuuuuuuuuuuuuuuuuuuugagauggagucuugcucugucgcccagacuggaguacaguggcgugaucucggcucacugcaaccuccaccucccgaguucaagcaauuuuccugccucagccuccugaguagcuggggcuacaggugcgugccaccacaccuggcuaauuuuuguguguuuaguagagaugggguuucaccauguuggucacgcuggucucgaacucuugaccucauguucugcccaucuuggcuucccaaagugcugggauuacaggugugagccaccgugcccggcguaugcugugauauauuaauagcaaggaagaaaagaagacuaaggcuauuggccugagcaacaggguggauaaugacacuagacaaugagaaggaaagaaauugauuuaauuauucacuuauuuguguauugauuaaguugugguagaguguuggcagggcuggcuaagaacauuuuuauaaaacuccuuucagaccauguugaguuuaagaugggacaucaaagaaagaaaaugcaaacugauaugaaagcaagagguuaggcaauguaugugcaugcguuggagggauguggggaggggaaaucauaaccacuggaauauucuucuccuaggaagucacaggagagggaugagaggcugcuucugggcugcuuugccucucauggcucugcauggauggcaugaggccaaacaggaagccaacugagauaacaacuuccucaagugagagguuaccagaacacugcuaucucaggugcaagcauccaguuaauaguccacagugcuggaaaaaauagcuggugaaaggucagaggcacaauuaagaaaugcaugaguaaagaguaagugugccauaguugaccagaaucacagugugauaccugucuggagaaacacagcauguauugaacuucucaucuacugaacacgucccaaaagccuuuaguuguucaauggggacaguuacuguaagagucccuggacucuggugagggggcauugggugguaucuaaaggggcauauaagccuccuaauacuauauugaaacuuuaauuacaguaaaacauggagauuguuaaaaaugcagauuuccaaacuucaccaccagaggcucuacuuuuuuuggaaacaggaccucacuuugucuggagugcaguggugugaucuuggcucacugcagccucaaccuuccaguuucaagugaauucucccaccucagccuccugaguagcugggacuacaggcaugcuccaccaugcccagcuaaauauuuuguacuuuuuguagagaugggguuucgccauguugcgauccacccaccuuggccucccaaaguaaucccaagagugcugagauuacuggcucuaauuuuauagcuuuggggaagaaaccagaaauggagauuuuuaacaaacauuccagaugucuugaugcaaaugacccacaggucacaguuugagaaacucuacagcaaaguguuucccucccucagaugcucauaaaaucauauuccuaucuaaucgaagccacuaaugaagucuuucuggauuuaguccucuuuaacuuuuugaccugucucaguuauguaagcagcauggcauuuuaagucagaccaauuaauccugauucuggaaccagguaugugcccauagguaaauuucuuaaucacccaagcaucacuucuuucaucccaaaauagggaugugguugcauuuuaugugcaucugaaucaugacauuuggaaauaccacuauauacaauauuaaggaggauguacuuuauauguuaaauuugaaggcaugugaaucucuuacaucuaaauuauacucagaaaucacaguuucaaagcuaguguuccaacuuguuucguacauuuauaauauugccacaugagaguaguguguuaguaggaaauagaaauauuuuuggucauuagcuucuaaaccacucucccucagaaguuccuaagugugauuuugaugacuccugugcuguuauuuuaaugaccacuauugguuaauuaugaccaugcuucccagggguucauuaagugguaguguuagugguaaaaaugaaaaaauuguuagagccaagaacuuuugagagaagaaacaaaaguuagacacgacaaaaaguuaguauguauccauucauuguguuuaaaauuguuuuaaaacacaacauuagauauagauuuauagguucugaaaauaccucccuaugcgacauuuauuccuaugggaaaacugauccggaauuaggaaaguucugaguuauuugauuauuuugaaauauucaaggaucuuauccuugaaugugaccguccuauaauaguauuuccuuugcaggucuguugugaggaugaguaaagcaccugauauaggcugucuaaauggguuguuagguuuggaaauuuagggaaacaccugucacuguuucucuauucucaagagggggagccuguuuauuuuaaaccaggguguucuuacaaauuugggagauaugaaguuuuuagaacaauauaaauuuccuauucaauauugagagguucuuccugucucucuuuuucacagccuccucagacaccgcccccacaaggauuugaugaauuaccuaaaagucaccaagggagccugauugaaacccucaacucuguauuauuaggccgucuagaaguagaugagucuaauuuucuuucucauuuucuguaauuuugaucagacgcuucucuacuuugcauucgauuagucaaagcuaacaagucacuucugaggaaauuacugcuuuagaaauacuuuuuauaaaauucaaucacuauucuuguacccugacucacauuuuuuuccuacuacaagacuagagucaucugaauugccugaaaacuuggcagcucuaaaggguaauuauucucacuuuuggacuugauccaauacaggaaacaauaaaagacuuccagaagguuuccaagcccagcugucucugacaccacuccucauucugcaaaaauacuggaaugaguuuuuuaguuugcaccugucauuaaugucacaguagagacacuggcccuuaccuuguucauacaauuacuuaaaccacaucuacauuuuuagaucaagaaacauuuaaaacuucugguggaaugaaggaguaauuuuuuuuaaauagcuccuguuaccuaaaauaaaauuguaaaaaaaaaaaaaaccuccuauuuucuaguugguuuucagcacaaaauacuuccaaucaaagagauuucugguagcuuugucuagucaaaagaugguucauuuuguccuuaacaauuagagucaauuuggcucugucuuuucuuuuuucagauuccggccuucgugaagguuacaaauacgugguuuuacuacauuuuugaagaguguuuuaaauugcaaauguauuuagaauuuauagaacaucaaaggauuuuuccuguaaaagaaacaagaaauaauggauagcaaagccaaggugaccuugacccucaguuuggaaacuuccaggcccuucagucauucccaaagguuuuggugaacugugcacacacagaguguguucucaccaaagccaagcacagagcgcuaauuagaguauuguagcuuauacauuuuccgggagugaaaaugagaauaaacacuaauucuaucaaagggcugggugcagauaaccccaagugaaaacaugaggaauuccuugggcauacaguacacuccucuuacccaacggggacacauuccaagaccccuggaggaugccugaaacccaccaauugggacacauuucuguucaugucuuccacccacagauuuaauggcuuuuccauuuuaauaagcacuguggccguaagucuugcagcuggaggugcaacagcaaaacuagcauggauuucuguuuccuucucgaaaauuucauguauagaagauuuguuuucaccauagaucuuggcaaccuuaacauauaguauuuuuuuccuuacuaaguugaaaccuuucaccuuuucucuuaaagcacuuucuggcuucucuuuggcauauccaaguagccagcaucacuauugcacuugcaggucauauuaaguaaaauaagagucacuugaacacaagcacugugacacaaagacagucugaucaccaacagggcuacuaagugacucacaggugugaaucugcuugauaaaggaaggauucauguccugagagggacggaguggugugaugcaguauuucaucaugcuagucagaauggugcacaacuuaaaacuguauaaauuguuuguuucuggaauuuuccauuacaguuaccaccgguaacugaaaccacagaaaguaaaaucguggguaagggaaacuacugcacucguguuucauuguagggacuagaagugagcuagaucuuuugcaacaaauuucuugguccuccaaaaaucagaucuacccaugucuuuuuaacuuuguguuauuuacuuucuuucucuuuccagcaaauguuacuccgacagcuauuucaagugaugagcauacauuuauuuuaggauaaaaugcuuaaauaggcaaaauuaauaaugaaauagaagcucugucuucucuucaugaacaaguguggagacgguaguguauaaaaacgugcauucagcuuaauauaacuacaguuggccuucaaacaacauagguuugaaccacucgggcccacuuguacucaaauuuuguucaaccaaacaugguauuccuaggaugugaaacccaccaauacaaagggcugacuuuucauauauguagguuccucagggcugacugcaggcuugagucugugcaaauuuuaguauccugggugguucuagacccaauccccuauguauacugagggaugacuguacauacagacagcuuauaagccuggaauugauuuccaugggcaguuucagaaaauguggaacaaugucaaacuucuggauuuccugauaauugaaauucacuccuaagagauagcaugcuauuuuugagaugcaggcagaagaucaggacacuaguuggcuaacauugucuaugaaauauaugagauccuugcccaaugagagcuuauggguagaugggccaacuuuucuucuugucaaagcagcucauuguugccucaagauagcaagucaccuauuuaagagaggcagugcuccaacggaaagaccucagggcugcauaaucacagccacaauggugaugauggagguggggaaggaaaagaaagaggaggaaggagaggaugagcagaauaguuacuuagguauccagagggcacauaccucuucagcagauaacuguguuggagcaauuuucuuuguauuacacagcaggcuuuaggguuuauuccugggauucuauucugagguuucuuaaaccucucugagccuagguuuucucauuuguaaaaugaaaauaaaguacauaccucaaggcagucuugaaaguuagauaagacaauauauuaagagcuuaauacagugccaggcaccaaugaaugaugucuauuguuaguguuagcauuauaccgaaacauaaaauucucucaaaucuuuuucucacuaauuccucauaaaacagcuaaaucuuguguugagguggguguuuagacuguguauggagaagggugacuuuuuuucuguggguuccuuuugagcagcaagauugauaacuaaucauuuaccauuuaucuacauguaaaccuucuauacauuaacacagaaauaaaaguaggcacccucuauucauauuuuugucaaccauaacccuuaaaagaugcaauuuaugccauccucaauagcauuguauauguaaagaaauccagucauugacugacuugagaugugacucacacuuggugcuggaccugggcaugcaggaacacaagagugacagggcuccuccucauuagggccacaagagguaggccuuccaggaacuuacaggaaaguuugacuuucuuuuuuuuuuuuuuuuuuuucaugagacggagucucgcucugucgccaggcuggagugcaguggcaugaucucagcucacugaaaccuccgccaccuggguucaagcaauuccccugccucagccucccaaguagcugggauuacaggugugcaccaccaugcccggcuaauuuuuguaucuuuagcagagaugggguuucgccauguuggccaggauggucucaaucuccugacuuugcgauccacccgccucggccucccaaagugcuaggauuacaggcgugagccaccacuccuggccgagaguuugacuuucauacuuuagaaauucagauucaauuuuauuuguaauuuuaccuuaugugugaaugcauaggaagaaauacagaagguauuauaaagguauggcagaaagaggaucaauacaauauucacagguucggcaaauggagagaaacagacauagccaacuuaauaaauacaugaggcagaagauguuuguuugcuuuuacuuuuaaugacuucaaacuuuaaccuaguucuacucuaucaauuuaaggauccauguccuuaaggagaacagaaaauuacacaccuauucuagaggugucaauuagauuagaacacaccccagagugauuccuucacuccaagguugauggaagauggguuuggucucaguaaacauguauaagguggcaaaaaucaguuugaggaguuaaacugaaaucucuagagguaggcugucuguucacaacuggaaaaguacuagaguuuuaacuauauuccuuuuaaaggcagaaauuagauuuucuucuccacuauccucuccugagcucugugcccuuguccuggaaaguuaguuucuuuuuccugcuuugcuuuuuaccuaccuaucuaucugcauuaagcuagcauaaacuccaacuuaaagcugaacgccuucagagaaaccacaucccugcccccugcauaagagaaugcugaauaacuaaugauucauaauuucuucaauucauaagcaauucuauuaaacugcauugaaaauuucugcuccaguuccggguuaacacaaauaccagcuacauuaaucaccccgcauauccauugcuaagucaauggugcucauccacaucucagaacaaaaaauacaaaaagccaccccucugucuacuauuguaccauuaguagucaaaugaaaggagcaaaagaaaaucguugcuuuauaaaguuguuaggaaauugcaaugugcaaggaaugaaguauuaugccccggaucaaucaaucauuuuaauuacauagauuugauucuaaaucccagggcucuggaaacuguaagaaugaucuaggauaacaaugaauacagugaggauugcuugcacagccuccagccagcauaacaauuuaguuauaagugauaacaagaagggaucaaacagucagcaccaauucucacuuaacaaauuuuugaaacacaugcuaggaaacgaguuucaaggagugcuagcaaccagugaaauuaguccauuuacuaguagcucuggcuaacaagaguugccgguuucaaggaagaaacaagagcucccuaugucauaugcaaaaucaagucagaucugggacaucugucaauacccuaguaucaucaaaaacagaugacaguuacuauuuagagcuuugauuaaaacauggagaauaaaaauugacagcuuucaggaaagaacugucaaugcuuucaaggccgaggucauaagaggccuguaagaaguuucauaugggaaaagcauuuauauguaggaaaaugauuuucauugcucuaacaacagcauauaaccauacggcgggugaccaauuucucuuuaaugaacacuaauaccacucuucucuaccauccuccacucauauccacacuuuaaggacauguggacuaucaggggaaggaauacucaucucgcaauguuucaguuaauucucugcucacuaaugagaacgaccagagaagaaaagucuaguauuuuuccauguuauucucuuuaauguuuccuucagcuaaucuauaaguguggcuacaguauuuuauuuauggacgucagcaucauuugaagcauuccagauuaugcaauuaggcaauuucauuaaaaguucauuccuuaagucugaagaauuuuuuaaggauucaauuuuuaguucgaaaucuuguaguacacacacacacacacacgugcacacaucccaaacccugccaaacaaggaucuguggaggauuuaugagauaacaugaaguuuauacaaacuguaaucccuaacuaugucuuaauucaaaacaauccuuaacaaaugccugcagguguuauuauacuuacaucuaaguauauuacauccuaaacuaacacgcaaucucuucuagaaugcucauuuuauauuucaaccaaguuucaaaagagcuaugguauuccagcuauuuaaauacuaucccauuuugguaaaacgauuuaaagaaucuuacaugucagcuguuucaaguuguuauagcaccuguaaugcaaagauauuacagaagucauauuuuuguccacacucaaauguauuaacugcauuacagagaauuaaaauuaugauaaaagaaucucaaguuuaacauuaaauuaugaggcaccaaaauauuaacaguaaauaucugugagaacugggauaaaaagucuauguaugugauuuugugguuuucaguuuugaugcagagaauccuaucuuuuauaaauagaaaggaaaauuacuuaaucaaaaagugaccacuggacagauuuucuaauuguacauaagcaauucaagucauauaagguuaucaagucaaccauaguuccugugagaaugagaagccacccuuugccuauacauaaacuugcaguucuuugucauauuugcauauaucacucacuguuauuuucuuggaaauaggugaaauuccagguaguucuugaauucaagagaaaagcuggaaaauuuuccuauuuccaccuuugaaaauaaauguagacaguugcuaguaagucucuucauuucccuuauuacuuuuuuaaagagcaccuacuuaggcacuagaaacacagcaggaaaucagacagacaaaaaucacugcccucauggaacauagagugcagugggacgagacagauaaugaaccacagaaguaauacauacagugggcuggaauaugacaggcguuaaagggaaaaauaagaaaaggcaauuacaagcauggaugggaauauugugauuuuggauaauggaggcuagggaaggucucaucaaggccaaaugugagcaaaauucuaaaggaggugaggaacaagccauuagaauaucuggguggggcugguaugguggcucacgucuguaaucccagcauuuugggaagccaaggcaggcagauuacugaggucaggaguuugagaccagccuggccgacauggcaaaagcccgucucuaccaaaaacacaaaauuagccaggugcgguggcaugcgucuguaguuccagcuacuugggaggcugaggcaggagaauugcuugaacccaggagguggaggcugcagcgagccaagauugugccacugcacuccagccugggcaauagagcuaaacuccaucucaaaaaaaaaaaaaaaucuggaugggccagaugcaguggcucacaccuguaaucccagcacuuugggagacugaggcaggaggauccuugagcccaguaguuucagaccagccuggacaacacagugagacucuguuucuauuuuacuuaaaaagaaauauauauauauauauauauauauauauauauauauauaauauauauaacauaauauauauuacauauaaaauauauguaauuauaauauauaauuauauauacauauauauaauuaaaaaagaauaccugggugaggaguguucugggcaagggaagagcaaauacaagggcccugaggcagaggccuugugaccauguuugaggaacagcaaggaggcaagaguggcugaggagagggaagagaagaggucaaaaacuaagggccaggcuguguagggcuuuguaggccauugcaggcuccugacacuacauaacaucagucuuugauuucuugaugcauguaugcauguucacagguaaagacugacggaaugcaaugaagacuggacuagggcaugucuagggcaguugaugcaagaaauacagagugaaaaagugaagugacuggaaaugauaaucacauaugacugcaaaacuggcaggugugagauuuguauucauuaauucaacaacuauguaugcacuugguguuccaaggacagcaagacacaauucuugccccaagaaauucauagucuaccaagaaguacaucaguuaaggcaauauauagucugguuaaaugaacuaccagcaaguucaguggagcugagauaugggcugaaaugaucagauaagccauuauagagaaggaauuuuaaguuaagucuaagcaauaacuaagauuuacagaaaaacaaauagaggaagaauggagaaagaguaagugcagcguguucaaagacaugaaauuaggccuggcugugguggcucacaccuguaaucccagcacuuugggagauugaggugggcagaucaccugaggucagcaguucgagaccagccuggccaacauggcaaaaccccaucuccacuaaaaauacaaaaauuagcugggcgugguggcacacgccuguaaucccagcuauuugggaggcugaggcaugagaaucacuugaacccaggagaaagagguugcagugagccuagaucgcaccacugcauuccagccugggugaaagggcgaaacugucuuuaaaaaaaaaaaaaaaaaaggcaugaaauuaggaaugggcaaggugugucuguuuugcaggaaaagauucgauauaccauguuggcuuggauagaaaaguuugcauagggcagugguaaaaggugagucaaggcaagauuguacauuuuuauggugagauugagguuuuaauguauaagcaaaagaguuuuaauuaagguuuaaacagggaaacaauaugcuauguagaauauccuuggguagaggaaacauuugaaggacagcaacuagugguugcaaaacugaagaugugaacugacaaagaccauaauuggaggguccaggguggaacagguguagucagcuaccuaagagauucugagaauugauacaacuuggugacuggguaaaggagauuugcauacauaacuuagaaugacuuaaagauguucauuaggaaaauugugauaaacuucaaugaauaaaggaauaucaaaaggagaaccaguuuggauauuuuaaaucugagugaugaugugucaaacguuuggaaauaucacagacaggcagagcaaguuuuagucaagaggucaauccuaaaaauaagaauuuguuagcaguuaauugucaaauaauccaugguguucuuccuuuuucuuuuuuauugagccaacacaauuucucaguggguuauaaauagaauaacuguuuuauuuaucauccaaauugggacauuuuugagagugaagaaggagcuauuaauaauuacacugagacaacgugcauaaaacuaaagacuguccugagcagaccaaguugcauggaccccaguuaaaaauuccaucuuacuuuuaaaagauagaaaguugucaauuucuuauuuuuauuauagcucgugguuucucaaaaggggucaagaauucaguuagggucacuuuauuuugauuugagacuggaaagacugagcucuggcaaaggaugcaguuuuagacaucuagaaaacaaagagaauguuaaugaaguagcuuaugucauauaacuccacuauuaccuacucaugaugcuccuggcaugguuaaugaagcauggagguuuuauucaaggggguggguggggaucugagcuagucuggguugacauuggaauuucugaugucaggucccaguugaagcaguauuuuacuugagcugucucugaugucagggggauagaaaaaauuccuggugagcaggaagaagaguguauaaaggguaacgggauuuguguguauauauaccaugugcagguacagaaagaauuuucuuuauccuguagcugcaauuuguuagguaguuauguuacugcauguauaggucaucagaauaacaaaauugauauuaauauaauaaauagcugcaauuuguuaggcaguuaugugaauguguguauagguuaacagaccaacaaaauugguauuaauaacaaaacugaacaggauaauaacaaaacugaacaggauaacugaacagggguauccugcagcucucagauugaaagggauucaaauacaacucaaaaugcuuaacauggcugggcgcaguggcucaccccuguaaucucagcacuuugggaggccgagguggauggaucaccaggucaggaguucaagaccagccuggccaagauggcgaaacccugccucuacuaaaaauacaaaaauuagccaagcgugguggcgggugccuguaaucccagcuacucaggaggcugaggcagagaauugcuugaaucagggagguggagguugcagugagccaagaucgugccacuguacuucagccugggugacagagcgagacuccaucuccaaaaaaaaaaaaaaaaagcuuaagaaauccucuaccccacuaccuuucagacuagacauuguuaucuccaguuguaaaaauguuagcaggguguccuucaucaaggaaagaagccaacuccggcagugcuaaguaaauggaaggauuauuuuuccuguggcaaugggcuuuuuuaacuuuacuauuuuauuaagauuuuugccuugaacauuuguugggcuuuuaaauaauaauacagugugggugcuucacuuuucucuuggugcagagggaaacaaaauauguuuuggugucauuuugugaccugaccuuucaaacagucagugugcuggagauguuaucuagguguguguuauuccuagucucaguuauuuuaugucucaauaaauuauuauauuauuauguuuauuauaaaacauaauugcuccagcaauuuaguuuuaagaaaaaucugauucuccaaagaaaacugucuuauacucugccuucagaaaaaaaaaaaaaggauuuccuauauauccauuaauuuuacuuuuagaagaauaggagaagcuguaauuuacaaauauggcauuagaagcaaggcauuggagucagcaauuucuaugguucuuugauaaaaugacaccaaaauaggaggcuaagggaguuacgaaguauugguauagaaaaugugacauuuuacauuuucgaguaggcuaaagauaaaacaaaaacagguuuugauaaaacaaauaauuaaaugcacaauaucugaccugcaucguaucugucuacaaguuagaaacauuaaccgugauagauucuucaagaguugaacacggacagaaaagaaaagucccccaaaucauccuuccagcaaaauauacacacuuaacugagggauaccgucaaaaaaaagggggaaacaaaagcuauucuucauucuaacuauaaaccgaucauuauugggugggauagguagagaaugaggaccaauaaaguacaacauuuguguuuugauauaaacuugcuuuacuuaugcaccaccaguaugaccugaaucuuauaucauggcuacaauuguugcucuuucuuuuaacaaaccaaaugucauuaauugcauucaacuuugcuuuuuuauagccauacuuuuuaucaaagcuauuuuucccugguuugaccauuuuguaauaacauguuguaacauguuacuacauguaaugaaauguuacaaaaggaauugaagcccccuuuggacucucucuggucguauuucucuccuucccuuccccuaaacagagauaauuacuauccugagguuuucgugcauauuuuaauacuuuuacuacauauauauucauaaauguaguauuaacgaguuuuuaaaauuuucauaaaugauuuuacacuuccaggauuauuucccagcuugcuuuuuuauuacucagcauuaugcuuuccaauuuugcuuguuacuucugcccuuuugguguuacauuuaaaaaucugacauuuauaaugcguuuuucauaaaguaggagcuuuuguccuaugacacuuaaagcuuauggauccauuuauuuuauauaaauaguaucaguacaaucauugucaucaucauuguuuuuguggauuaagaugggcaauuuuggcaaccauaggaaaaaaacuaagacacuuaugacggucuuauguacaaacugauuucauuguucuaaaauuugucauuuucauuguaccaucauuuuauaggucauucauguccucauuccuuccauauagguuaagaacugucauguuuuuuucacuugaacagcuucaguuaguuuuauuauauacuuguuggcuuuagaaauaagguaauugccaauaauucuucagauauuaaacacuaaauuuguuuaugauaucagugggaaacagaucucaaaugauuugauuaaauaccauucaucuacugcuugcacuguuaagacuuuucugaaaguuuccugugcuauauuuaagcacuuuguucauaagaaucccacaaaagaaaaaaagagaauaauuuucuacuaaucuugaauauauuucauacuuaagccagagaagaaauuuaauaacaaaaugaaaauauagccaggaaauuacaaugagguucaacaggaaaaacuggugguuaauaggcaagaagucaaacuauaaaguguagaacaucuggauuugugcaaaucaagcaaaaacaauugaggccagaguaaucaccaggaaaaggaguaagcaaaggugaagcaagugugauauuugcaccuauaaauuuuuaacaccaaauuaucuuuuuauaauguacacuaacuagacauccugcuuugaucuguguuaggucaagaaccucaaagauggcuucuuggaacuccuuaugcugcugaugaaaagaaaacacugccagacagguaacugguagaggcuccuugaaucagaagcacacacaccuggacccaaucuagaaggauggaaaacuuuuucaaaucaacuguaguaacccagcugacaugucauagcaacaugauugaaugacucaggagugucugugaagaacaggggauaggcaccuugaaguaucugaugcucuguugccauaucaaaguuggauaacuuagccaaaucuaacuucuuugccaccaggagcaaucucaucuaaaagucuuacugauucacauaaccagaauuguucucagcauuuacccuaaggaaauguucaaacacccauggauaaaugccacauaaaauuaucuuaucaaauacagaaaugccuguccuuggguuaggugggauguagguggaaguuggucacuaugccaucauacuggccauauuuauaaagauuaauugacaccaggaccuggugauuugguucugaaaaagggagccuggaggaaucguggggagagauuuucagggaaacccagagaaaucuuccucaaaugaaaugauccauuauaggccuaaggaaaacucaacuggccauauuuuguuuacucuagcaaagcuuaugauagguuucaauaaauuaccaccugaaugaagacuucugucuccaugaaggcugcuucagucagcccccaaaaauaaagagaaaaacugcaggcaauucuugcaaacaauauuaaaaccccaucacuuuuugaaauagacugguuugaagagguuucuuuuguuuguuuuuuuuuaaguaugcugcagauaugauuuaauucccauaauguugucucaguucaugagugaacaguguauggcaucuggaaauuaagcauaacugggucccuggcuacaguuaagagcuaacaggcaaccuugaggacuugagggaaaagaaauuauuccuaagcagugaaauacacaaaaauuccucuuuuuggugauuuuccaaaagaaaaauuuacuucuucugaaauguuugguucuuucucuuuccuucauuuucuaaauugauuacgcuaugguggcaaaggacggggagauggagugggcgauaggcccuugggccaucaccucauugcagaccaucuaauagaggaacuaucuccugagcaaagaauuucuauauuuuugucauuagacaauaguugaaaaugcaugaauuauaguguaagagccacucaaaacuuucuacaaaaauauauccuuuauaauaaugaaguuuucauuuaugaccaaaauagaaaauuucuuaauacucauuaaaacaacuguuugugaaaagcaguuuuuuguuuguuuguuuguuuuugagacagucuugcucuguaguccaggcuggagugcaguggcacaaucucagcucacugcaaccuccaccuccaggguucaaacgauuauccugccucagccucccgaguagcuaggauuacaggcaugugccaccaugccuggcuaauuuuuguaauuuuaguagagacagaguuucaccacguuggccaggcuagucucggacuccugaccucaggugaucugcccaccucagccucccaaagugcugggauuacaggugugagccaccacgccuggccagaagagcauauuuuugaugaauguuuuauaucaacuucauucaugaaauauuuggauuucaaaaaaaaaaagcaacuacucacuugaaauucuacagaauuguguaggagauuagauaugaacauguguacguauauuuuaggaaauguguuaaaugcagaaaaacacaaacaauaauaaauggccaauaugcaaaauugagaguuguccacaugauuauauuugcuucauuuguucugaauaacacaucacaaauuuuuuuucuucuaaauugccaguccacaccaaccaaccuguacaaaugcugaaauuuuuuauuuauccauuuauucauucguucauuuauuuuuugagacagggucucacucugcuacccagguuugagugcaguggugcuaaaauggcucaaugcagccucagccuccccuggcucaggugacccucccaccucagccucccagguagcugggacuacaggugcgugacaccaugccuggcuaauuuuuguacuuuuuguagagaugggguuuugucauguugcccaggcuggucuuauuuucuaauaaaucauaggaauuuaauaaauaagacaucuucucugcuuuugccccccaaaaaguaaaaaauugaguuuauuuucuucuaguaucucuauaaauauuuuuauauuaaaaguaucauuguguaguuagccuuuuuacuuccaugcauuguugacuagcauucuuuaagcauagagaaaucucaauauguucuuccaaacacagaagcauagcauuccauuaucaauguuucccaaauucuggcuuaaaaaaauuaagauccacuuuuuaaaaccuuagacugcagaugcuuggauuuuucuauauaguucuggauuuuuaaauuuuauacaaaacauggcucugaagaaaguaaaauaacagaauuuuaaaugaaagagaacacaauaauuugucagucuaaaaaagauaaaguaucaccacugacuucugcaugugcauugcaggauaaaguaaauggggaguuacuggccaacacugggaauuuggauuuuugacccgagaggaaggagaaauaaaaguuaagucauaagaaugguaaagauuguuugugacuagcuagggcaacauagugaaacuccaucucuaccaaaacaaauauagaaacuagcuggccguggugguacaugcccauagucccagcuacaugggaggcuaaguuaguaggaucacuugaggcuggagagguugaggcuguagggagccgugauugugccacugcauuccagccugggugacagagugaaaucuugucuccaaaaaaaaaaaaguaaagaugauagauuauauauguauauuuuaccucaauaaguaaauuuccacuucuggcuuuuuuaaagacuuaaauauaagaacuuacucagcaccaacaaccaccuuuaguacccagacagugguuucuaaauauuaucuucucuccaccauaggaauuagggcucugauaugguucagcuggguccccaccaaaaucucaacuugaauuguaucucccagaauucccacguguugugggagggaugggggacggggggcggguaggggguggggaggggcgguaaucgaaucauaggggcuggucuuucccgugcuauucucaugauagugaauaagucuuaugagaucugaugggcuuaucagggguuuccacuuuugcuucuuccucauuuuucucuugccucuaccauguaagaagugccuuauaccucccgccaugauucugagguuccccagccauguggaacuguaaguccaauuaaaccucuuuuucuucccaguuucggguaugucuuuuaucagcagcaugaaaacgaacuaauacaggcucuuuggagaaauggcugauuccaguucuggacaagaaauauacaacaugccuggccugguaucuuguaauuaaagaaaaaaaaaucaaacuaucaccaucaaaaggaauagcaauggacuuaaaacacaucaaaaucauaucucaaaaucacuggcauaugaaaaaguacauauccauaaguuuauaaugauucuuaagaaaacaaaucuuauuguuuacaugcuaacuaacuuaaaaaaaaaaccugaugaauauagacaaagaaucaagcauuuauccuaaucuuugcuauaauaacuguauauacuucaagauaaccgaauaguugauaaaggcaaguuucuucuuauagaaagccucuucaaauauuacaccugaauguaauaaaccuucuagaucuaacuacaacuuauaagaaauagaagguacagaaaaaugcaaucaagcaaaauccaggccagaggaagcucuaugggguaaacuaucugguuucuucaaaggaugaaucauaaggaaaaagaggaaaucuauaagccaaaagauaucaguuaauggaaguguaaagaucucauuuugaucuagguucuuaaacuguaaaacaggaaucauuuaugagacaacugaagaaauuugaaauuuaauaagaacaaauuauuaauuuaggugagaucauaauacuguguuugcuuuuaaagaguacuuaaccuuuagccaugguaugauuucaauaagaauuauuucagccucuauuauuaauaguuccaaauaauuuggggaugagaaacaaggugagcaagauuaaacgaaguaaaaucagccaaguguugacaauuguuuaaccaagguagggguugcaggggagucauuguacuuuuuuucuccgcuuacaaguguuaaaauuuaaaauaacaaaagauaaaggugcagggaauauugaaaaaucaguaaaauggugaaaggcuucauuaggauagagauaaauuccccacaaauaucaaaauacuucaggugaggcauacucugucaaccuuaaauguaaauaaaaaugaaaagccuucuuuauauuauagagaaucaugaucugauacagauugaacuggaaggagauuuuagugacagauccaaaucaugaguacuucaaaccuagggcuuuagaaauugcacugaaauaaaaaguauauucaguaguggugaguaaguggguguuuuagauggagggauccaacauuauggaaaaacacagaucauaagaguuuaauggaaauacucuuccucagucauuuuuaauaagcuuuaaguaacuaaugaagcuuuaaugauaacauccauuucugcuuagaacaguuaauauaugaaaaaauacaaaugaauauuuauaaauaugaaaauuaauaguuuuguguuucauaguauaucuacauuuacuccgcucccguuccuccccaagccuaguuaugaacuugcugguuuugacaagcaaaacacaaauagaacaggugccuuuguuagcacucuagguaaauccuggcacuugcuuggacaccagcugggugcuaauuagucuugugauugccuagaucacaaaauaauacaagacuggaaaugcuccugaaagcuucuggaggaaugagucugcacaccagcugacagaugcccugagagaacaggccuuguccugacagucucuguguugaguucuuucacauuuacaaagccagagcuggcuacauaaacacaugucugcaagucaguucggggaaugaggguggagggugcuuuugaagaugcagagcaaaagcauucucuggucuagcaauacugacacagauguccagugucuggucuaugucuaagugucaucuuuugauuaaguguuaggaacagcacacccaggguauuugaacccuguucuccaauagacuucaacagguuacuugugugccuucccauuuaaccuuucaucuauauuuagccaauaacaauaaugaauugcuguacugcuucucauccuaacagaucaaucagauuacugcaugaccaauuuggacaggacaagagauggccugacaccucucaaaauauauaagguugaauacaucauggcaaaugguggcagugaaggcuuucuuucugaacaugacuuuauuuuauguccucaucauauucaauaaucaaaaauaucagauuuaaaaucaaaugcucaaucauugcauucuuucagcaagugauaaaauggauacguuuuauuagaaaaaugaaaaaaaccuaccugaagacugcaagggucagagaccagagcacuaauggcuuccucaguucaaacuuugcucguuuauucauuaggugccgaccaccgaauauaaaggcagcauacagagcagaaaacaggaaagauuucuuccugcaaacaagcaaacaaaaucuuuaagauauuuuuagucauuaggaaacaccaaauuuuguaccaguucuccucuuuguaagcacugaaaaaauauucuugagaauauuccugcuucacugaagagggagucuagucuacacggcaaacuaguguucuguugaaaucucccuugacaaaucaggucuuccaguaguuuaaccaacauauuaaguaucaugucaggauagauauauuuccuuuguaggcucuaggacugaaauuucaacaacauagcauugaaguacaaaaaguagucuuuucacugagagaaauaauuuuauucuuuagaguuuguugagccaauuuagauacauacaugaauuuuaaaaagaaguguuuuuauuggaacuauuuggugacaagguugugucuuggaacaagauagccauuuaaaauuuuaucuugggugggugugguggcucacaccuguuaucccagcacuuugggaggcagagguggguggaucacuuuaggccaggaguuugagaccagacuggccaacaugguaaaacucccucucuguuaaaaauacaaaauuuagccaggcaugguggugggcaccuguaaucuuagcuacuugggaggcugaggcagaauugcuugaaaccagaaggcagagguugcaaugagcugagauuuuugagacuccaucucaaaaggcaaaagaauaaaagaaugguuauuccauaggcagcccugaggacugcuggcuggcuacuuuuauggguuuuuuaauuacaugcuaaacgagggguagauuauucaugagugcuccggggaaaggggcggggauuuccccaggaacagaacugaggguuccuucccuuuuuagacuguauacuguaccauggcauuugugaacugucaugguguuggugggagugucuuuuagcaugcuaaugcauuauaauuagcauauaauaagcagugaggaugaucagaggucacuuguguuaccaucuugguuuggguggguuuuggccagcuucuuaacuauauccuguuuuaucagcagggucuuugugacccguaucuugugccaaccuccuaugucauccugugacuaagaauuccuuaccuccugggaaugcagcccaguaggucucagccucauuuuacuuagccccuauucaagauaaagucacucugguacaaaugccucugacaacaguacugauaaugccaaaagauaaauucaaaagcaaaaauccacaaacuucuauaauagaacuaugauucgacugaaagcaacagaaaccuuauaaauaauuuaaaacaguugagcauguuuccugagaaagcaauguuucucuuaaaaugggucuucccuauucaauuagaucaauaaggaaaggguugagaaauaaguuacaaaacauaauaucaaaagcaaaauguguucaccuaaagaguauuauuuguaaaaugcuucguguuuucucccuuuaugcugacauguaaugcugacucauaagggaccuugcuauuuacacaagcagcuuuccuauguaaaugaaugcaagugaccuacuuagugaauaccaccaaauaaagcaaugauuccagaaaucaacccauaaguaaauguugaauaaaucacuuucacugagguuuacagacucuucucuugggcccacaagaccuggaacacaguaggugcuuaauaaauaucuguugaaugaacguggucuuguccuaucaaauuuucugauggggaaaauaaucaggcaucuguguacaguaaacaggcagcaaacacuaacagaaaguuguacuuuccccguaauacauuaauaacuaaagagucaaauauucagaaaaauauuaugauacauuuucuucccccagaaagacauugauuauuucuauacuucagugaaacaauuuuguggaaacuuuaacuauuggacauuucaggaagaaaguacuuuuggccauaaauuauauauugcuuuauuucuccucuggaaauuacaagggcauggaauuaaauuacuuaagagucacaaucacuguuucuguuuaugcacauauaagcaaagacuaaagaaaaauaaaguucuaccaaguuaauguaggugauaguaaucugaaaaaguauauacuuuuuuucuaauuuauaaagguaauaagugacaauaaucacauuaugauuuauagagugauuccuauggguagacauaaugccaaaaagcuuuaccauuuaauccucauggugcagguaaaguauuaucuuuauuucauaaauaaacaggcuuagagguaaaguagcccuagauuuuccuguucuugugguaaacuuucagaagaaaaagggguacuugaaguguuaucuuauaagcuguaaaaauuccuuaagcuguccuguugaauuacauaaucauugcauaauguguagaacauuguguaacugugaaaagaugaagaagaauuucccaucuucauguuucuacugucauauuuucugagccugggaagcuuucauccaaacccucuuugcuucuuugagaacagaaauuaauuauacauauaccauggaagacauuuccuuaaaauuaccauuauuuaucuuacccauucaacauaauugagauucugauuaugguuguauuaacuguauuacuugcaaucauaaaccaaguuaaaugaauaucuucauacaauccuaucauucuagccauaaagggaaaaguaaugccucaagaaccaagaaaagaacaaaaaaucuucccuauguauuuuuucuccaauuuccuaacuucuaaaaugagaauuaauccuaaugcacugcucacuucccagcaagggccauucacuuuuccacaagagcucucuuuacaaagcaauucaacagcuaaggcaaugaagucagucaguacagaaucauagaacuugauaauugcaagcaaggaaccuuagagguggagcccaauuuccuccuucgacagaaaagagaauagggaaccgaugacaauagucacucacagucacacagcuucaugcuacacuggucaagacuauccaacauugucauggcuguggucaagcagguagguaaacacaaaauaauuguauaagcuauaucagggucacagguaguuaaugggaaucgguuugagugcugugaucaaaguaaguuuuucauugcaugcacagaaaucuuuuacuguagugaaauucaaauccuugggguuaguuuggaauuaaaccuaagcaucugcuauaaguggaaguugccuaagcauuaauaauuaccucuuuaacugaguugucauuuaugguugaauguacuauuuguuuuccauauugcuuagaagaagguaagauuuucuuuaaugaacaggacaauuuaaaugaauuaaaauugccuuuccuuucuggcaucucuccgguaaaguucaauuauauucaagaugaauaaugguuugccacuagcccacuuaguuuuuaauguggauagauugcuuuccuaaugguucugugguaauacuuuguauacuggcaggccuccauacuuggguauaaugguaacacuauacuguuuuauuauuagauaaucagucauuuugagauagcauggacucuucuuguuuaauaaauuuuaaaugugcaucauauagcacaacccauaauuauagguacuuaauaaguacuuuucaguguggugauucaggaguuaugauuaccaggugaccaaccaaauaaagacaacccaaaugaaauacugaugugcuuuaauucugucaagcuuauauuuauccuuuuuacccuucuauuucugucaucaagaugaacaauggaaauuauuccauaauuaauaaaaaugaauaguggaucuauccuuagaaaucugaauuucucuaucauacuaucuuguuccaaagcauuccuaggacaugcuuuuuugauucuuaccagaguagcugagcaaguucucacuuaugauugguauuucuugcuuuacccauuaacauuucugaaaaaguaugcauaaauugaaauacauguuuuuuuaaacucgugggauuucacugaaaccagugcuuagcuugagucucguuagcauucacgucaagauuucuauaccccaagagucaaacuaguuuauuugcuaaugaagaaauguuuauguggguaguauuucaacauaggauaauugcuaaugaauagcuugggaagcuggccugagcucccuccuggcucuuucaugucguaucuacauggccuucauuauggcuacuguacacaugugagguacaaggagaugggaaaguaaaaagcagugaggggaaaaaaugaaaagggcaccgcccaguucagcugauaccuaucuaccuagugcagagaaaguuuucauguucuaaggugaagagucugacgcugagacagaaugccaacuggugcaccccccuccucuuuuaagaguccucuugcaguucaguugcugacucaagucaggaaacaacuuaugguucugaaagugauuuuagggauacaaauaaaguagggacccagagacuagaggaaauaacacuacuuuuugccaauaugacauuuaauguaugucuauggugguuauaauuugauaagaaaauaagauuuucuugagagggauccugagguuucuugaaguccuauccagggcuuaauucugccacauucuuaaggauucugcaagacuucauauaggcauuuuuuuuacguuaaaaaaaauggaaauuuuuccgcagauuuuuuuuuuuuuuuuuuuuuuuugagccaaggucucauucugucaucuaggcuggagcguaguggugugaucauggcucacugcagccucagccuccagggcucaagcgaucuucccacuucagccuccuggguagcuggcacuacaggugcgccugauucuuuuaauuuuuuugcagaaaugggaucccaguaugcuggccagacugguccccaacuccuggacugaagcaauccuccugccucagccucccaaagugcugggauuacagauguaagccaccacaccuggccaggagguuuuauucguaaguaaauuaaccauaugcccagaaauucugacaaacaauuuugugaauaaucaugaaaauaugcccguaauugauacaaaugaaaaguggcuuuacaauugcaagacaaagccauaacuaagguaaagguuccuuauucuuauuccaagcuguuguguaugaccaaggauaccaacuaaggugugauuuccaagcuucuuugaguuguaagcacuuuaccuuuuugcuucccccuccagauacuaauuuagagaucacagguucuccucaucuauuuuuuuaaaaaaggugugagaacuaguuuuuaguuuuucuauccuugaaguaggccauaagcaaaguagaguuacauuuaguccaugagauucaauaacauggcugcacaucccuuuccaggaaaguauaccccucuuagaagcagauuggacacagaaauuccuuguauacaucuguaaacuuaucuuuuuccccccuugucaccuuuuaaaaaaucuuggugcauuccguuuuuguauuacaacuggacauaagauuuugggggagaaaauacucucaaaauguuaaaacgaaaaaacugcacaucuaaaaagacucuuuaauacuuaaaucggcagguuaucaauucccuuuguuuccuuagaauuccuuuuuuuuuuucaguagcugaugaaaauguugacauccacccauccauucaaaauucaauaaaccuuucaguuuuuuuuuuucuucuguuagguuuaagccauggccaagaaauuuaauaaacucauuguauuccuuugcaguaugguuaguaagacauugaaugaaaaaaggauccuuaugugagaguaaauucugccucugcuaaucuagcuagaaagaaaaauuuacaugguaacacaugguuauauagggggucaguagcaaauguguguuacagauaauguuuuauaaagagcuaaggaaggagacuauugucaugagaaaaugcuguggaagauuuaagaguggacccugaagguuuuggauggaugggcaaagggcaaguagcaauaggcaauggaguuaggugugagcuaaaccgggagucugucauaccagaugcuguggguuggguaugguagaaagccuguuuggagaugcgggcuaaaguuggguugugugacauucugaaaacugcagcagaguucaggcuguaucugcaccucaaguuugcaguaaguugugaggcaugugcccaguaauuuguuacuacuaauuaaaguacaggacugaaauguauggcuuaauuuucuuuucuucuuuuucuucuuaaauaaacaauagacuaaaucacacauaccccaucaugucccaugggugagagauggggaaguaauaacuugugcccccagaaaaauggauagagaacugcuggaugaagucaugaaggguacugaaagucugagcugggaaggaagacagaauuuaaaaagauguucacagagaaacuugguaugcauuauuucuaucccugagggcagauguggcaaaaguugaauuccugaucucucgaucaaugcacugaagugugugugugaacugcggcucuucacaggaaucaucagaugggaucaccuuuaggaaugaauauucuccuguucauaguaaaagauagcaaaccgcuaggcuaaucacagcauuauuucaguagaguugauguuugcagcucagagaauugucaguuucaauccuaaagcguugcaucuuagagagguacaagaauacuuuuuguuucaguagauauggcuuaauaaaacugaucagaaaaaaucaguuuugaaguuagaaccaaagacuguagacuguccuugcugcucuaguuagcaaaaucaaacaaagaauuaaaauccgggcugagugugguggcucaugccuguaaucccaacacuucgggaggcugagggggguggaucacuugagaucaggaguucaagaccagccuggacaacauggugaaacccccucucuacuaaaaaaacaaaaacuuagcuggguguggugguacaugcuuguaaucccagcuauucaggagccuaaggcaggagaaucucuugaaccugggaggcagagguugcagugagccaagaucacaccauugcauuccagccugggcaacagagcaagacuccaucucagaaacgaaaauaaaaacaaaagaauuaaaauccauucaauuuuuuaucuccuuagaguaaagcuugccggcagggcacaguggcucacgccuguaaucccagcacuucgggaggcugaggcaggcagaucacgaggucaggggauggagaccauccuggcuaacacggugaaaccccgucucuacuaaaaaaauacaaaaaaaauuagccaggcgugguggcaggcgccuguaaucccagcuacugaggaggcugaggcaggagaauggcgugaaccugggaggcauaggcugcagcgagccaggauugugccacugcacuccagccugggcgacaaagcaagacuccgucucaaaaaaaaaaaaaaaaagaggaaagcuugccaucacccccaagucaaaaccuggcagaaaacauaucagugacugggcaugguggcucaugccuguaaucccaaugcuuugggagggcaaggcgggaauauuacuugucccaggaguucgagaccagccuggucaacauacugagacccccuccaucucuacaaaaaaauuaaaaauuagucugcuguaguggugcaugccuguaguccuagcuacuugagaaacuagggugggaggacugagccuaggagguugcggcugcagugagcaugauugccccaugcacuccagccugggcgacagagugagacccugucuuuaaaaaagccaaaaacaaaacaaaaagucauuggucuuauuuagacaaaucucccaugcccaucugaaaacaaacuaaaaaugaucucuaugaugaaaaaauaauuucuaguuucuguuuuguuugagaguauugauuguugcaggugagaauuuccagguaacgaucuagugauaguaaaacaaaacucuuguggccauuuaaaacaguaauuucugaauaagagaggcagcauguagaaauagaauucagaaggugguuccagcagcaauucaauuucauugcacuaauuuucuugaagaaauacucuucauucuacgagaaagguagcauauuaauuuccaaugaggcaaugcucacuuguuaaauuauuucaaaauauaauaaugaugagccaggcaugauggcaugcaccuguagucccagcuacucaggaggcugaggugggagaagcccuugagcucgagacaucgaauccagccugagcaacauaacaagacuccaucccuugaaaacgaaaaaaaguguaacaauaaugguaauauaaaaacuguacuauaauucugaaaugccuccuauuaaauaagaguaguugagugacucuccugucaccaagcuaaacuuuaucuccuauagccuuaaaaaucuauucuauaauauaaaugaagcauuagucaucuauuuuccuaaauauaaaauuuuauugggcuugaaguuacacaaauacaauuaugggcuaugucagucaaagcuguaggcauuuuuuuuucuuuuuuuuagaucuucuuuuccaguccaguggccuaaugacccuagacauauagaaucucaagauuggaacagaccuuagacaucuagucuaaacuuuucagcuuaggaauuccuggcuaaaaacuuccuggcugaugguccucuaauuucuacuaaauguagaaauaaugacuggaacuuggaggucauuaguuccugaucauaugguacagcugggcuucuuuaaaaacugacccaaaugcugaagccacucauccuuccccuauggaugaccaacacccuuucaaacuaacaggcuacacuuagaguugaauauaaaaaccuguuuccugauugucuuuauccuaaagaagccuaggacgucuuauaacuaauagaccuaucagagcuggaggcuaaaacuagaagugaaaaaacacugucaaaaggagacaauuauucacaaugcauugaaaaccggauuucagguuuauaagauuaaguccaauucaaacugaaaauuuuccuagauuuaaaucaaaaccaagaaaaauaacagcuugcacaauuauauaaacaagcauaaacauauccauguuuaugagcacuuucucuguacucaaggacugacauuuauaucaaaggagaauccauuucuguuguagguuaccacuaccuuaauauuuauauaggguuuucauuuccccaaaucaccucauagacagcugaaaauuccaaaagcuagaaaauaaaaugaaggggaaaacauggcauguuuucacguuaacuauuggauaaauaaauauacuccugucacuaaugauucccucaauauaaauuuugaaaagaaacuggggaagcaaugagaaaauauaccccaaauacuauuucuggauuagagaaaauaucucagcagugacgaugaucucaugguuaguuuauaaauugauuuugucagcaaaaucaaauguacauaagaaauuaagcuugagaaaaaacuggcaguaaucagaagaaauauauuuuuaguaaugagugaaaaugacuuaaacauuguuuuuacuuaugagauuaucacccgauuacccaagaaagaacucugaauuucaucuuguucuuaaaaauaauaauauagggccaagcaugauggcucaugccuguaaucccagcauuucgggaggccaaggugggaagacggcuuaaggccaggaauccaaggccagccuggguaauauggugagaaccugucucuacaaaaaaaaacuuccagaaauaauaauaauauggcaacauuuugacuggggcuuucauacugcuccuucaaaaucugaacucucauucagugacauaagaggauaaaguuugcagacaauagcuuugagaacuccgauaauggggacagcuacaacaaauucucacaaacugaauggcuucuaacaaaacaaauguauuaucuuacaguucuggaaguuagaaucugaaaugagucuuacggggcuaaaaucaaagagucaccaggguugcauuucuucugaaggcucuauggcagaauccauuuccuugccuuuuccaacaucuagaguccacuugacauuccuuggcucauggcugccuccuucuccaucuucaaaaugcaucacaccaagcuguuuccauggucacgucaccuuaucugacucugauccccccaacucccuguuaagaacccugugaauauaaugggcccaccagauaauccagggccacagccuagaggcuuccauuuuaacaacccaugugauuagauguccccugcccaaagauauucuggaauaaucucaccaucucaaauuccucaaccuaauugcauccgcaacauguccuuugcuauauaaaguaacauauucacagaagaugggcacauuuuugagggacuguuauucuguuuaccauguggauuaaacuaaaucguaagaucuaaagccauucuucuacuaaaacacauaggagaccccuacagaugcacauguuucaugucuauuccugguuugccauccccaaagccagguucuuccccucuacucaagaaagcauuuuagaauccaaagggcgagagcaacacucuuauggagauugucuuuaagcaacucauuaacaugugacucacaaauaucagcaucugaacucuuaguagcacaugacuuacuguauccuuuacaaugaaccagguaccuauguucagaauuucuaguauaauauacaauuuacuaaaauuacuaauauguauucgauuuauucugacuguccacaguccuaaauugccaucucucaacacuccuuugcaacaacaaagguuacuugguuuguaaccauucucuuaaucccaaucuuaaaauacguacuacaggcuacuuuaaguauguuuuccuguuuguggcaaugcaguuguuuuauccuuccucucuuuuugggcuuaugucuauaaagauagguuucuaugcagcaauggucaaguaucagucuuccacccagauggccugcuagcagcagcauuugacacagauggcaacuccuucuuuccugcaaugcuuccuucacuuccuuccuuucuguuuucucuugcuucuucuccaacuucaccaucuguucuuuuuucauuuuccuuugcugcuuucccuucaucuccucaauccacaaacugaggauccccagaauucaaucuguggaccucuucucuuuuggccuccaccauggguucucacagagggugaugauuuugcccuucagaggauauuuugaaauaucuuaagacauuuuuggucuuuacaacuggaaggcaguuggcuacuggcaggugguguguagaggcccuggaugccacaagacagcccucugcaaccaaaaauuauccagcccccaaaaaugccaauagugcuaagguugaggauccugaacaagagaaauauggagacagaaauuaagaaaagagaaauuggaaaacucaagaggguguaggcaaaacugcuucaaaaguacguucacugauuggggugauaccacuuaugccucagacacacucaggcugaauugcuucaaauugauuucaagcacagaguaaauaaagcaagcuucuuguuucaagugagcaguucgauuuaaaagggaaaacaaaauaacaaccagugagucaguauauuacucucuucacuguucuagaauuagguucacuucugacuacgaugggccauguccagcugcauccugaaggcugguagauugaauucuuacaauuauucaucugcuucagugccucuccugaaugaaggucaucuagaacugcauuuaaaauggguggaucacgaggucaggagaucgagaacauccuggcuaacaaggugaaaccccaucucuacuaaaaauaaaaaaauuagccgggcgugguggcgggcgccuguagucccagcuacuugggaggcugaggcaggagaauggcgugaacccgggaggcggagcuuacagugagccgagauugcaccacugcgcuccagccugggcaacagagugagacucugucucaaaaaaaaaaaaaaaaaaaaaaauauauauauauauauauauaucuccccagagaggagaaaaaggaauaaucuuuuuuuuuuuuuuuucuuuuugagacaaacucucacucuaucgcccaggcuggagugcaguggugagaucucggcucacugcaaccuccgccuccuggguucaagugauucuccugccucagccucccaaguagcagggacuacaggaacacaccaccaugcccggcuaguuuuguauuuuugguggacacagguuuucaccauuuuggccaggcugaucucaaacuccugaccucaagugauccacccgccucggccucccaaagugcugggauuacaggugugagccacugcgccuggccagugaucuuaaaugaauagaaccagacuucaugguaacugccaagacaccaccccccuaacuccacacagaauucaaauucuucuugaaguagaauuuuaguuacugcagucaucucuuuauuaaccacuuuuauagauaauuccaugauaaccaauauuaacuucacccaguaugggacaauguuaccacuauucuacucuguuucuacauuuucaacuuuuuuagauuucacauauaaaugaaaucacacaauaacauuucuuuuuaugccuggcuuaggauaauaucuuccagguuuauccauguagucacaaaugauagaaucucuuuuuuaaugcgaaauaaaauuccauuauaucacaauuucuuuauccauugaucuguuuacgggcaccuagguugauuccauauguuggcugcugugaauaaugcuacaaugaacauggggauacucccauauucaaaguccgaaaauuugauaucaccaaaguuuucuaugacauacacuuuaaaaaauugagaguaggccagaugcaauggcucaugucuguaaccccaacacuuugaaaggauguggugggcagauugcuugagcucaggaguuugagaccagccugggcaacauggccaaaccccuucucuacaguaaaaauuagccacgcauggugguaggcaucuguagucccagcuacucgagaggcagagguaggugaauggcuuuagcuugggagguggcggagguugcaguaagcugugaucaugccacugcccuccagccugggccacaaaggaaauuucaaacaaauuaauuaauuaaaauuaauaaaaauugagaguagcaauagcucuauuuucagaaguauuggaauuguaauaaaauaggugguauuggcugagugcagugggucaugccugaaaucccagcacuuugggaggccaaggcaggugaaucacuugaacccaguauguagagguugcagugagcugagauugcaccaaugcacucuagccuggugacagagugcgucuccaucucaaaagaaagaaagaaaaaaaaaggugguaucacaugauaaaguauaucaauugagauggacaaaaucaauugcacuguuuucuaaaucuucuaacaaaauauuaaucaucuuuauuagcuacucacaggccuuugcuccccuaauuaacauguugcaaggcacuaauucuccucuaaggauugugcacaaagcuaaaccaguucaacaggaagcugcgcuccugcuugugccugucaucaguuucuacagcgggaagcagaguaaaacuggucagacaguguccggagcugguuuaggaguccuuuaucucuauauagcuuagaagacuuuuaucuauauaucuuuuuacaucauuucccacagacuuucacuuucuuuuuucucuuugccccuucacagauucaaagccaaaaaaagagagaaagaaagaccuuuuggggaaaaucuuaaugaaaaaaaaucucaagaucccucagaaaacaagaaaauuaaguccauagcucccauuucuucauaaagugaaagggaacuuuauucuuacaaguuucucuuuacugccagguugugagacacaagaauaauuucuccuuucuuugcaugucaggugaauugcugcaugugacuaugguauggcugggauugaucaagcauggauucccagaaaagagauucucaaaaucacaaugccuacagcauccuuuucuucagaguuucaaaaggaaggaaaaaugcuuagggagagaagaguguguaugugacucaacauuccuuugaaagucagaagguuaaugugucuuccccuauucccaaagcaugcccuuugagaaugcauuauggggaaauguguucuucagauugcuuaugcuggcaugcacacaccauguggauagguagcaaucgcucuggauaguaaaccugagccuuugcuuuucuugucuuuuuucuacuuugcuuguuugucaagacugauuuacuaagcaccaagauuugagaguaacaauauuuagcuauguuuacacagaaagguuuccuaccaaaaaauaaaaaauaaaaaaguaaaaaaaaaaaaagauuuggcaaguauuuacucaagauacuucuugagucuaaggccuuuuuugaucaauuugaggaauucuagaugucugagugugauaacaauaguuaaaaaguauuacugaauauccauggguugcagcucuucacauagcucuccuaugggaacuugaugcaccauuauacacaaacaguuggguccugacuucaaacuacuacuaugcauuguuccaggccacgaaauuaaaauguguuucaauuugaucaaaauaguaauuacuuuuuaaaaacugcacuuacuauauucuagguacugauggagguguucugagcacuugagauuccaccgcuacauuguauaccaggaauguuacacuucucaaccacuacauuguauaccaggaauguuacacuucucagcugguucuuuucuuuuuuuucuuuucuuuuuuuuuuuuuuuuuuuugaaacagagucucgcucuaucccccuggcuggagugcuguggagcgauuuuggcucacugcaaccucugccucccggguucaagcgauucuccuggcuuagccucccaaguagcugggauuacaggcgccugccaccacgccuggcuaauuuucguauuuuuaguagagacagggcuucgccacguuggccaggcuggucucgaacuccugaccucaggugauccaccuaccucggccucccaaagugcugagauuacaggccugagccuguaauggguggauguaagccaagacuggaaggaaguaugggaaugagccauucugggaggaaaugcguaaggcagggaauagccaagucaagaacuaucuucaaagguaaaauuuaccagauucuacugauuuugucuuuggaaaauucaacauauugagaugucauuugagcauguaucuauaaauguguaucugggcaauaauucuccuuucaguaacuuuucagguaaauucagcuaaguuugcauagucauaaauaucauucaggaaaaaaugagcaugaaaagaucuagacuaugguaaagaagguuuguuuguuuuuaucaauaacuaaaaucuucuuuaaaagguaacuauaaaucuuaguuaccaagaaaucccaguugguucuuaacaguaguaguuuuuaccaucuuggcuaacacggugaaaccccgucucuacuaaaaauacaaaaaaauuagccaggcgugguggcagacgccuguagucccagcuacucgggaggcugaggcaggagaauggcgugaacccaggaggcggagguugcagugagccgagauugcgccacugcacuccagccugggcgacagaucgagacucugucucaaaaaaaaaguaguaguuuuuaucaucccuucucacucucacaccccaucacuauuucugccaguuaaaaauauaaaucacuuacacuugcaauucacuuugucuccaauagaacauuccuuucuuuaggucacauucauaaggcuuaauuuuuggacauagagagaaaucuguaagaaaaggucuccagagaaaucuguaagaaaaggucuccagacuuuccaaagucacuacaugcuugaagcugacuacuccuuuuccaucuaguguuugccuacuuugcuauauacuggcagccguauacccuugacugcuuaauggcagaacauacuguaagagcuuaggcauacuacaccguuguuuugucuuuguguuuucccacuuagacugacuuauucuguauuuccagcuguccaaaaggacaauggcccuuugcuucaaaauccuuaaaucugauauagaaaaacuguugaggacacaagugugcaagacuauauaaaaggaaauguaaacauuaaauuauaugaagucaagaucuuuauguagcauauaaucuucacuauuagccaacuaucuuguuuauuuaaauaugaauggcauuaauauuauaugguagauucuaggcucuacagacuguaggaauuuuaacagauuuggcaucaucucuaagauguccaaaaugcuuuucuuuuuuugugguuucuguuuugaaacacagucuggcuguguugugcaggcuggaaugcaguggcacaaucucagcucacugcaaccucugccuccuggucucaagccuuccucccaaguagcugggacuacaggugcuugucaccacaccuggcuaauuuuuguguguuuuuguagagaugaagcuucaccauguugcccagccuggucucaaacuccugagcucaagcaauccacccaccuuggccucccagagugcugggauuacaggugugaggcacugcacccggccccaaaaugcuuugacaugguucaaaugguuucaccucucccuacuccucuggaaucaugucauaacuuuccccugugacacccugugcuacaacuauacugucauucuccaaagacaucacgccccuuugucccacuuuccuucgcacaugcuguucucaguacguugaaugcccuucccaugcaaccuugucauuuuuuaugaucacugugaagauacucccugacugcuucuaggucaaguugccuaucccuuccuucaucaccacugugcuuucuauaugucuuuuucuuaccuacuguagcacuugucuguuuguauuuuacacacaagcuaacauaucugucuuuccuuugaaauccugaaggguacagauuguaucuuacucaacuuuguaugcccaggacuuuacgucuuuccucaacauaugaauuaauaaaugguuuauuugauuuuuuaaaucuuguguuuuggacauacuuuuaacagggaaaauacauuauugaagacuaaauagaauaacugaugcucaagugaucugugaaacucugcuucaaacucacuuuauuuuaaaucuaaacaguaaaaauuguauuuucuuauagcucuuuucccuuaguagcagaaagaauacuacaaauuaagauagguaguuuaaaucuugaaaugauuuaaauuauucauucagcaaguauuaauugagugccaacugugugcuaagcagaguucuaggcuccgggaauacaucagugaaccaaacagacaaaaaaccccguccucguggauggagguuacaagccuggagaaagacaauaaauaagaaaauaaguaaauuauauaguauguuagaaaauuacaaauauuauggaaagaaaaaaagcaaguuggugcagguggaaaaugggauggagagugagggacagagcacaguguuaaacaggguggcacacugggaagguggaugugagccaagacuggaaggaaguaugggaaugagccauucugggaggaaauguauaaggcagggaauagccaaggcaagaacuaucuucaaagguaaaauuuaccagauucuacugauuuugucuuuggaaaauucaacauauugagaugucauuugagcauguaucuauaaauguguaucugggcaauaauucuccuuucaguaacuuuucagguaaauccagcuaaguuugcauagucauaaauaucauucaggaaaaaaugagcaugaaaggaucuagacuaugguaaagaagguuuguuuguuuuuaucaauaacuaaaaucuucuuuaaaagguaacuauaaaucuuaguuaccaagaaaucccaguuucugcuacugccucuugugaguuaaauuagacagucuguagacagauuagaagguaccacgguaaagucuugaauuaaaacagguuuaaaguagcuugacucuagagaagaauuuauuuaaucuuucuucauaaagaauguguuuaaccagaaauaccauuugacccagcaaucccacuacuggguauauacccaaaggauuacaaauuauucuauuauaaugaauguuugcuuauugcauacguauguuuacugcagcacuauucacaauagcaaaacaugaaaccaacccaaaugcccacuaaugauggacuggacaaagaaaaugugguauauauacaccauggaacacuaugcagccauaaaaaggaaugagaucauguccuuugcagggacauggaugaaguuggaagccaucauccucagcaaacuaacacaggaacagaaaaccaaacucugcauguucuuacucauaaguaggaacugaacaaugagaacacauggacacgaggaagggaacaacacacacuggggccugugguacagggaguuaggggagggagaccaucaggacaaauagcuaaugcacguggggcuuaauaccuaggugauggguugaaaggugcagcaaaccaccauggcacauguuuaccuauguaacaaaccuguacauucugcacauguauccuggaacuuaaaaaaaaaaaaaagaauguguuuauuguucuuucaggauuuccucuugcaaacccaaaccugaauauauauaagcaaaggcuaguucuugaagaaacugccaggauuacucucaacuagacagauuuuucuacaagcacauuaauucugcuucacuggccaacuguuuuuagguccaaguugcaaaaaaguauaaugauuucugacaaggacaaaaaauaggcuuucaauuuucaucaugagucagcagugaaggacaaggcacaagugacuuuuuaauauauguuucucuaaaugaacauauagagaaguaaaaccuaaugguauuguggaaaucagaacuuuugaaaagaaggcaaaugaaaugaauaaauauuacuuuuaaacuaaaauaaaaagucauugaguaauuuuuauuuuaaaaauauacucuaacaacuacccauuuccauuuuuuaaaaaauaaagccuuugacuccaaugcuucagugaguugagaugaaguuuuaaauuuuuagcugaguaauaacauuauauaccuauaagcugaucucaauuuuaggaaaccaucauuaaguaaaaacauaaauguuucaaagauaagauauuguuguuucuuuaaaaacauaaacacuuuuuuaaaaagucuuucuacauuucccuacguguuuccagaguaucuucguaucuuuauagaacucaguggcucuaugaaugaaagaccaagaccaugucaauauacauaaggaaagggauggauaaaauuuaauuuucuuuauaaauuaauaaaaaguaauuuucuuuacucuauuagaaagauagggauuuaggccaggcaugguggcucaugccuguaaucccagcacuuugggaggcugaggugggcagaucaccugaggucaggaguuugagaccagccuggucaacauagugaaaccccaucucucuuaaaaaaaaaauaaaaaaaauuagccaggcaugguggcauacgccuguagucccagcuacucaggaggcugaggcaaaagaaucgcuugaaccugggagguggagguugaagugagccaagauggcaccacugcacucuagccugggcgacagagcgagacuccaucucaaaaaaaaaaaaauagagauuugguuuaugggugauuuuuauuuuguacuugcauucauguggguuauaaaaagaauguuuuuauuacuuuuauaauaaaaaauaaaacaauaugucaauuuuaaucagagugagagaagggagaaaaagauugggagcaagaauuagagauugagagaaacugauuuggccccagugaugguuaaaaacaaaaacuguccaaucuuuuuuuugugagacaggaucucacucuguugcccaggcuggagugcaaugguuugaucuuggcucacugcaaccucuacaucccaggcucaaacaauuguccuaccucagccucccaaguagcuaggacuacaggcauguaccgccaugcccagauaauuuuuguauuuuuuguagagaugagguuuugccauguugcccaggguagucuugaacuccuggacucaaggcugacccaccugccucggccucccaaagugcugagauuacaggcaugagucgcugcacccaacccucaaaucuuggccugaguggagcagaguaaaacaagggagaggggcaaagcuuggaauucccauuaaugacaaaucaguaacucaauuuugccccucauugacuuuugggaggccucccaaggaaguauacauauggaugguagugaaaaauuugaugccaguuuccuccaaacuucuaauacacucucugguguuauguaacaaauuuaagaggauuugaaggugcuagucaucuaacaacccuauguacacacacucacauuuuugaacuaagcauuuuuaccagcuaaucuuauguguuucucaaaaugguucacugaccaccuccaacagaaccuaugagaugcuugcaaagacagauuuccuccucccagacuuucugaauccagaagaguaaccauaaagugugcacugaaguaaaagucuuagaagauuuuuaaauuugagcuugauccacuauuucaugcuuuuaucaugaugauuuagcuaccuaucuucagccacucucuuccagaaucccucaggacucuuugauuuccuaucucaaagauaacaucacuuugauaacaugcauaucaaaauuaauuguauccuacaaaaaauaaaauacuucuggcuaauacuguaauuacaaaaaaaaaaucaaugcauuaaaaaaagcaaagacuuugaaaagagaggaaaaggaaaaguaguagaccaucucuccuacucuacacuaagagacacaggauauauguaccguuguugccacaauaccauggcucuaagaaaagccuggccaggugcaguggcucacgccuguaaucccagcacuuugggaggccgagaugguuggaucacaaggucaggaguucgagaccagccugaccaacauggugaaacccugucucuacuaaaaauacaaaaauuaguugggugugguggugcacaccuguaaacccagcuaggcaggaaacugaggcaggagaaucacuugaacccgggaggcagagguugcagugagccgagaucgugccauugcauuccagccugggugacagagcgagauuccgucucaaaaaaaaaaaaaaaaaaagaaaagaagguaagccuaugucucacuaagcuccuaaagcuucuccucuaugggagagccuaagaaaaacauuaaucuaaaauuccuuauccuuuuuuaaauguaaaacugaaacuaauggauaacauuuauuuuucuucauaaguuaugaguuaguuuuccaggugaaagauaguuuuccaggcuuugaggaugguaguuuaaugacagagaucaaauauauuuauuuaauaaaacuuuucaaagccuuuugguuuaugguacaaaauuuugcugaauuaucuaucaugaccaagaagaauuuaucugggcugagaauaaggagacuuuugauucauucauucuugcauacagcuauucaguaaauauuuauuaagggcuaacuauguccuaagcauugagaauaguuaacaaaacagacacacuccuugcacccagacauguuuugggggaaaacagacaaguaaucagaaaagcaggggacuaaaaauaaggaaacaggcugggcacaguggcuuacaccuguaaucccagcacuuugggaggccaaggcaggaggaucacuggagcccaggaguucaagacuggccugggcuacacagagagauccugucucaaaaaaaaaaaaaaaguaaaaagugaaauuaggaaacacacaggaggcacgauaaccccaucuuguugggucagagaaggcuuucuggagacauauucagacaggacgaguauaagccuggcaaagaaagugagagggaacaguaugggcaaagagccagaggcaugagagagaaagcacauucaaacaacucuaagaaauuuagagcacuugaccuucaauuacagaguaagugggagaguguugagaugaaggugcaagaaguuaaguggaagcaagaucaugaggacucuuauaggccaugcuaagacguuucuuuuucaucuuaagaguaauggguagccaaugaagguuuuaaaugaaugaagucacgugcuuggauuugugauauauaaagaucacucacugaugaaaugaaagcuggagcuugaguaagucuggugggaauggcacagguuuuagacaacagcaggccuuguaggugaggauaaggcaggcgucaugggcagugcgguuacaggaaguuccugcaucuguacccucccaacuggagcaucauuucagagcaacucguuaaauguuuuacacauauggguguaugaaguccaucgagugccuucugcaaacaguuucacucagacacuuaucugugagcguaggggcaacagcaagaucuaacauuuccucauuuguuucggugcuuaucauguucuuagauauaaaauuaugcuccucccaccaugugucagcuaccaacaugcaacaaugucaguuucaagacugagaaaacagucauccauauuuccaaccaacaagacagaacuuguaaaggaaacuucucagcucacuuggaacauguuuuggaagauacaagaaaggcuggacugaugaggauagauaaguagguaacugagcuacuaagauuuuaggugggugcaaaaguuauugugguuuugccauuacuuuugcaccaaccuacacauucaguacucaaaggcaaacuuuucaaaaggacaggcuuaucuugcuuuauguagcagauuuaguccagaaaaauuauguauaaaucuuuuuuucaaaaaacuaaauuguauuuugaaaacauuuggggagcuuuccuauuuaagaaaaauuaauaauuauuuuuaagaaucaaauaauuguuauuguuuuauauauuucuguuauuguuuuauauauuucucaagugagacacaucuacacuggauugcuuucucuucuuaccagcugagaaacaggguguucccuagugucaucugucaccuccuaaaaaguccuugagucucucaagagaugccuuaacaccaggauagauguuauaguaagugauacaccccacaagacguucuuugauuggaacccuagcuucacuggacuggaucaauugugaggcuaaguauggcaauaugacugaaugcccauccaugauacucauuugccuugcucuuuuucagagauuagucugcagugaagcuauggcaaugauuaugaaaacaggaguugccagguggggcuucugggaaagguuuuuaaaacauacagacuugucugcaugucccuuuggaguuuuauuccuuugcucuucucuuuucuuccuagucacaaaccugaagcguggcagcaaccaucuuauagccguggggcagcccacaugagaaagacaaugaaguaaaagaugaaaucagcuuaguuuccugauagcaucauccagcugccuugucagcucuagauugugugcucuagacgucuguugagugaaacaaggcaauucccauacaugauuaagauucuauuuguugauuuuuuccauuauuuccaauccaauccaauuuuuuuuuuuuuuuuuuuuuuuggugagacagaguguugcucugucaccaggcuggagugcaguaauggaucuugacucacugcagccucugccucccggguucaagcaguucuccugccucagccuccugaguagcugggucuacagucaugcgccaccaugcccagcuaauuuuuguauuuuuaguagagaugggguuucaccauguuggccaggauggucuugauuucuugaccucgugacccgcccaccucggccucccaaagugcugagauuauaggcaugagccaccgcgccuggccacccaacacaaucuuaauacucuaaauuucaauuaaaacuucucugaauguaaggcacuaaguucuguugcuacuaacaguaugugggauucuguggugauuuauuaacauggacuagaacuagcaagccaauuccucuaaaauguaaauauauuuaaagugacauuuguauagccucccuccucuguugagcugccugaucugugggagcucugucaguaccauaagacagcggggaaacaaaaacaaaaagcuguccuauacuuccugggcauucuggccguaauuauucucauuuaauuaagcuugaaugaccaaguacuaaaaaugacugaaccaaggaugcuaaagcaaaaccaacacaguagcccaaggaaaaguaacucccagaaacauauaaggacaacguucugugaacaauuuuaggcaaauuaaagugacacaguaauaagcaguauuaaaccaaaguguccaccaucauccauccggccaaggauuggauaguucccuuuaagcaaaacauaucgugugggcugagcacugcaauagcuacagugcuuacucagaagcucaaccugucuggcaggcuccaggguucucagacuagcuuuuaugcacaugaccaucagucauuuuaggauaucaaagacagaaaauuuauaucugugcaugggucuguauuuaggcauuuaaaugcauacaaacauagguaaguacacauuucuuucaaggaaacauguaaguuuaacacauauaaagaucauuagauacuucacucuaacucccacuccuauauaaaagcucuggcugcacuaguuuauuugaauauaagagaauuuuuuacagguaaggaagcuuucuaaauuaucauugacuguacuacauguaaggucugcaccuuggacauugaacugaaaauaaugaaguaccuaggaaauaucuguugcguugauguucuaaucccuguugcuucacaguaugauucuaauuuacacugacagaaacugaguuacagagaggugggacaccuuucaugagucaccagaagggcuagaagaguuugggaugcugaaauccagaguuguguggauuauuuuuuuaaucugaacuauucaaauuaucuguuuauauugaucaaaauuggccauagaaucuccaaauccucaaguucauauuaugacaaauaggcagucuucucuagaaaacuaaacugccucuuuuauagacagggguauuuuuagaauuaucaguaacaaauccaaguuaauacagcguaugugaacucaaaaacaugaacgagggcuccagcugguuuacuuguuuauucaaaaacauuuacucaauaucuauaauauucauaaacaucaccuaguuuaaaaaaucaaaaauuucucuugcaaaguggagaaacuaaaacaagaaaaaaauuuuaaaaacuaaagaaaaaaaacaaaaacuccaauccucuagguccugugggggugaggagggcccaaguaugaauauuaacaacaaccaaaugauucugucauugccaggaggaccuggggaccucacuuuaagaaacacuggucuagacaguucuagaugcuggugacacaaaccucaaauugcucaucaucuagugagauagacaaguaaacaaaaaucuauaaugcacucuaaauauucagaaugguaugaagaggauaggggaaaaaaauaaagagaaggacagaaauucucuugcugaaauggccaguuuuuaaggcaugccagaauggccagaaaagaaugggggaagaggugcuucugcaggaggaaagcuggacacaaccacucagugggguggggugcagguugaaggaccuggacuccugggcuacaggagucagaaaugaggguggagaauuaagauaagcuuguaucuugaaugacuuuuaugcucgaauggggcuaguuugaacuuuauccugaaaauacaggaagccaugaaggguuuuaaguaagggaggaggagcgugcugagauuaaauuuguagaaagcccgcuuggcaguggcaaugugaagggcagaugggagggguaugaguaaccugauagagacaguggccagguaacugcaguuuuccucaagagaagaugcuuaaggugguagaagcagagagauggauggcucugaaagaugguaacccaaaauacaguaauuauuccauauauuuauugaaauaaauucaacagaagagauagaacagagaggucuuggcagcugauuuaauauggggagagaggcaaaagagaggguaagggaugauuuguggguggucaguguuaguuugauggggagucaagaagaaguggccuuuuagaggcuaggugcguuggcucaugccuguaaacccagcacuuugggaggccgagguagacagaucacuugaggucaggaguucaagaccagccuggccaacauggugaaacccccaaaaauacaaaaauucaaaaaauacaaaaaaaaauuagcugaguguggucguguguggcuguaaucccagcuacuugggaggcugaggcaggaagaucacuugaacccaggauguggagguugcagugagcugagaucaaaccacugcacuccagccuaggcaguacagcaagacugucuuuaaaaaaaaaaagaaguggcauuuuaguguuuacuaguagagauaguuaauagcaauauaggacuuacucccagagauggaaagaaaucuacagggugugggacauagaaauaucagggcuaaagauaucuauuuggaagucauccaugucugggugguggugguugaagucauggacacgaaugagaucauccaaggggaauaucgaaggucaauacagaaccuaaugggaagggcggggagcaucaucacuuacagagaagguggaagagaagcaaagaagauuaagaagacacauucaagaggaaagaagaaaauuaaggagugucaugggucagggguagagaaaagagaggaaguuaagugucacagagcaaaucaagucagauaaggacugauaagaagaguguucuauuguaacccacagacacaaucagggccuaaugagucugugaauggaucauucauuucuccaacaaauauuuacugaaguuccugcaugccagguguuaggcaaauaaaccucaaaccucaaggacagccucauccuacugugaaagcauagcgaaagcauguugcauuuccuuacaaauguuacacuguguauuaauaaaagcugugaacuauggcuuacuuaacacugacacugcacuugggcaaaugggaagagguaaggugacaggcuuugggaagaugaggcuugcggaggcgggguugucacaggugucaagggagccugagaggacagggaaaaagggaagaaaaggcaugcaccuucucaucuugcuuaacccuucauuuaagucccaagucuguuuggagagcaaaguccuaggcuaaaaggaagucauuauuucccaauauaaucucucuggguguccaaagaagaaaauuaagauaugaaagaaaaaguuaaauucaccaaauuaaacuagaguauuucuaagaccugacuaacauuuauagaaacaacucaccucauaguuacuuaggcaggcacugauuaaaugucuauuacuuaaagcuucucuaaaaauguaacaucuaaacauccaaaaugacaauuaccagaagccuguuuacauacguuuagaaaaguagaauaauaauauccauaacgcuuuaacgcaguagauccugugauuauuucauguauccauucauucguucaacaaauacuuauaaggcuuaccggcauuaaaaaggugaacuugugcucaugaagccuacauucuagcaggagacagaaauuaacaaauaacucugaggauacauuacaauguuauaguguuguguacaaaaauaaaacaaagcaaauggcccaggaaugacaaggcuucauuagguguggugcucagggaagaccucuauuaguggaguagaaauauaugaacauaaaugcuugaagugacgagagaacauauuugacugcauaauugaugucuguuucugauccccaggauaugguccuuccuucgauacuccaucacugagcccuacaaguugccaggcaccaauuuaagcaugguuugggagggauagaaguauuaaaacacuucuuacccucaggagucacuaugacacauggaagaaugugaucagucaugagaaaaugauuuuuaaaaauuaugcuaagucagcugauagugggaucauuucaggcuguaagaacacaaggccucuggggggacauguauuguggcaggauagagaaaaguggagaucgggaaauaaaacauuacagaaugaaggaacaacaugaaauaaagguuagagaauguuugugcagagaaugaagacauuuggcagauguguuuacaguguuuaaaagggaugaugugaacugggugugguagcucaugucuguaaucccagcacuuugggaguugagguaggaggaucacuugaggccaggaauucgagaccagccuggacaacauugcaagaccucaucucuacaaaaaauuuuaaaauuagcugggcugguuaugcaggcuuguagucucagcuacucaggaggcuggggugggaagauugagcccaggaguucaaagcugcaguaaguugugaucauaccacugcacuccagccuguguaccagaacaaggcccugucuccagaaaaaaaagugaugauguaggacauaagguggaagaggaacuaugaagggccuuauauuccaggcuaaaaaugugaguacuuuccuuuuauguauaucacuaacagacguauaaaauagaaccuaggauauucuuccuuuauuauguggauguauaacugguugacgauaagagaaucaccuuaaggcuaacaaggaagucauuuaaaauaaucugaagguaccuaaugaaugugauuuaguaagccuguaccagaguccaguguuucuugagacuuuucagaaacugcacuaagaacuugaugcugauuucuccuuuccucuucacacuaacuucacuagguauguguaccaucccccauuugcagauaaagaaaugcagcacauacuguguuaaauaacuugcguaaguuugcauaacuuguaagaaauggagugaggucucaguucaaacuggcuucuguaugacuucaaagccaaagucagcaacuuagaaggcaaaaauuauaauuuaguuggcaaauacgagaaaaggucagaaacacaugaaaugaagcucaauaggaacacuuacaggguagcaggguaguagccuagggaaaaaagucagacacuaaaauuguuuaaauagguaaguucaagggacagguaaagaccuuaguggguaagaagccaaucagcagacgaacugcaagcaagcacugucucucuuucccuucugucuccucuuguaguaacugaccacaauuaaggcugccuaggggaauaaugaaguaauccuccuauuaucagcaauggucugauccagugccaggcaccacagacaacuugguguucagagaagauccuucaagaugaacaaagggucaaaauaaaaaauucuagaagagagaagacugaucacaauuuaauguaaggcuuggaaggaacugaucucuaccuuccuuaacaucucaagaacuuccucagauucauuggauguugagugugugugagucuaguagaaaaaugaauuuuuguuucuuaacuuggauaugugauuaggauguuaauaauuaagucugggcuaauauugaagguaucuuaugaugggcuucuuaaagcauugaucacaaagacugcauguucauaaacugagcugcacuuguuaggauucuagauguuugaaauuucuuguguuauuuuggucucagauuucuagacaaauuuucucaaauuccuauuucacuuuuugacauaucaugagugacucaaauguuugcccuugagucggaaaacacccagcauuaggaauaggcacauaaacauaauacuucaagcuucagauuuaagcucaauuauaaaguguuuaaaggcugugcugauaguucuucugaguagaauuccuacaacuauggguuugucuauaauaaaauguucacucuauauugaacgccuuauuuaaaacucgaaauguguaaguaguaauaaagaaaauauguccuccuguaaccaaagcuaggaccgauuacauguucacuugacugacagauacaaucaccuauauuaggagcaaucagcacuuccuuacaaacuaacaacuugagauguaguguucccauuggcuaugaagauuuucuuuauuuacucagaauagucuguaggaucugccagcugccccugauuauaccagcugcacccaaugaucacagugaacauuauuuuacauucuaaauaacuggugcaaggugagccaugguuuucugaguuuccuaucaccuuuguguuucagguccucaaauguuaauuuguaaagcugcuguuucaggcaaaacuaacaaaauuagcaucuaaucaauaaccauacuauguccacccauauccuauaacacagaaguaggggaagagugagaaagguggaaguggagaaauagaggcccaaaaagaaaguuuuaucacaggaauaucuagaugucuucugggauugucuguuaaagagcugugacacucauauaaaugcagaauuacucucuuucuuccuuguugguuagaaggccaagggugccaugguaauacuaccaaacauauaucaaagcuuggcaggaaaaaugguaccuucagaaauuuuauaaucugauaucaaauaggucaagaaauauaauaaaacuaguuucuuugguuuccuuagaaaccuggaaaacuuuaaauuagaaacuuagaaagcuuuaaaucagacuuuguaguuaaaaaaggaaauuuuaguuccuuccagcauuagaauuccgugauucucugacucugagccuggauuaaaucuagcccagcugaguggaaacuuaaguaacuagcugguugccuuuagugaucuuccacuuuauggcugcuuccgccuaagaaguucaucaucgugacuuacuuucuuuggggcaaagucgugacuaacuuucuuuggggcaaaguuggaaagcagaggucaaagucaaucagaaaugggacaaacucacuuccuacugccuggugaaggggccauuuucaguagccccuuuucaagauuaguuucauucaagauuugauaagcuguuuugacuuuacuauagaucuuauuauccaugucaguuaaguuuaugcuuccacuaaaucuaucugaauucaaaagguaaaaagcuaaugcucagucuuaucagauuuaucuuauuuauuaauagaauguggauuuuuuuaagcauauaacaauaauaguaaugauaggaccauaaauguggauggcucuuuacaagucacuaacauuacauaaauuccucaacaacacacucugaggccauaacaaacuuuuagaaauaacacaauuggcuacggaacuccagccaucuagcuucaugggcucccacuuuaauuucaaaacaacagaacugugcacauucauuuacaugauuagggcagagcuuaacuguaucucauguagcaccuacaucauucuucagacaaacuuauugccuuuuacagacaagaaaacuggggcucaaaaaaggacuugcuuauaacuggcuaauaaagaggaacucuggguucaaagugaguccaauucuuucuuccacccacagcuucugcuaaagucauuacagaaaugcauagagcaguucuuccacguuauugcuuagguuucuaaagagcagugaccuaauacaacaugcucuauaauuuauuacugauuuaacuauuucacuaaggauucacuuuuaacuuuuaacuuguaaauaugucuaauaaacaccacugaaauagcaaccucuuucuucauggccuugugguuguaaagcaagcuaguaauauaugucuguggauuugugcuaauaaaguucuauacaccucauuaauuccacaaauccuacuggguauuucuuaucugccagauccuacgcuagguacuggauacacaguacugaacaaaauggguacaaaugagccucacagagcuuguuucauugaaaagcagagagauacacacuaaucaacaaauuaauaguaacacacuacgauguguuuugaaggaaaauuagagcaucaaagagacgguguuagcagguggaggggagcucuuuuagauggagaaugagaaugccucccuaaagacaugggaauaaauugagaucacaaaaaaugagaaauagccagccuugagaagagcagaaggaagaacauucaaaggaaaagaaagugcauacuggaaagccugaacacuagaguuugguguauguaaggagcugagcaauggucacuugugugauaagauguguggaugugggguggggggcaggggugagucccacgcagcucuuaaguguguccucagacuccugugguuuccaucagccacaaccugaauaacugugugguaauccaaaaaugauuacagauuaaacauauaaaaauaucauuacacccauaguaccuaagccaaggacacaguauucuaucuuuucaaugaagaucugcaugaaguaaaauuauuauauauaauuuuagguauugauauagauacaucaguggauagauauagauaugugucucugguauagaaaaaaguuuuaaagggauauuaaaaguucuuaucuugcaggguugaagauuguggcaacuuucauuucuuuuuaauuuuaagaaaaaagugguauuaugggggauuagcauguuuguggguauauguauauuuuuaauuaaaaaauaaacaacaaaaugaaaacguuuuucuucuaugaaagccuaauaagaagaaauuucagcuguuuuaacuuagggagcuaaaaacaucaaauccaagaauguucucuggaacugagcucaauacauuuuuauuugaguaagaauuggauacauuuccauccccuuggggcuccagucugucaauauuuuacuuuucagcgauaaaaagacacauguagauaaucacagugaccucaguaacuuuccuucucuuauuuaaguuuauuuuauuucuaucguaguuuucccuguuaaagauuuuuucuuuuugcuuacauauauaauuuuagagaauaacaaugcacacacaaaaaauuccucuuguucugcuagaccuggacuuuuucucuaauauauaucuccauuuuuugucuuuuuucagacguauuuuggaagcaaaggagagaauugcuauauagcugacuuccucuucucaucaacaguguuuuaacaguuuuuaagcaaaagucagcuuuguuuaucuaagauuuuuuuugcuggcauuuaaccuaccccugccuccccuuucccaaguccacuucagccaaccucucauucgacagguaccacccucuaacauaacugaaauaaugucuaccauuacuggaucuugcuagcaaagaaucucaaauuuucccacuugguuguaaauuauuuuguaaucucuaguguuuaaggugcgcuuguccuaucuaauccccucccuggcaggacaccuuacagaaccuaccccuuacacuagucauuaagcaccaucagggacggauggcugugucacuggucuguuugguauucccuacugauccuaccauguggugauuaucuaugacuucccuaaucccuggcugccuuagcugggacuggcugacaugcuucucagguugccgcuggcuuuacaguccuuuacugcccaugccacuuuggagauaggcagggcuaguacuuuucuauauaagcccccaaacuugacuuuguguuucacaguaggugaaaaaguugggucucuuuucuuuuacuuuucuuuccacaagaugauaaagcuaggggaagccuguggacaugguuuauuucugcaacugcaaugauugauuggugcuuccugcugcuuacuuccuaaacuuugugcucagugucagaucccuagcaguuucuauccccugcucugcuaaaaaagaauggauguugacucucaggcccuaguucuuuuuaauuaaauuguauuuuuguuaucauuauuauuauuauuauuuugagauggggucuuacucugucgcccaggcugaagugcaguggugcaaucacagcucacuguuuuagccuccugaguagcugggacuacaagcgucaugccaccaugcuucuuuuuaauuuuuuaaaaugguuuucugccuucaauucuaagcacuucucaauuguaaccaagagauaauacuuuuuaugaauucuuaaaguuaucaacagauacucaaaguuuuagcaaagucuaaaugauauuaagcuuguccuuauugcccaagugacuucaaugacuauuuguuaauugcaaccaagggucauuuuuuaaaugaauauauauuauuauuauauauauaauauuaagguccucaaauaccuaaaaguuuagcaaaaucuaaauaauauugugcauauucuuuuauuacuguauuaguccguuuucauguugcugauaaagacauacccaagacugggcaauuuacaaaagaaagagguucacuggacucacaguuccacguggcuggggaggccucacaaucacggcagcuuacgggauuguugagaaaugacacuucucaagcuggggcuaaacuaucucugugguaguuguucugauucaaguauugaauugguuuuuuuuguuuuuuuugagauggaguuucguucuuguugcccaggcuggagugcaauggcacgaucucagcucaccgcaaccucugccucccggguucaagugauucuccugcuucagccucccaaguagcugggacuacaggcaugagccaccacacccagcuaauuuuguauuuuuaguagagacaugguuucuccauguuggucaggcuggucucaaacucccaaccucaggugauccaccugccuuggccuccuaaagugcugggauuacaggcauaagccaccgugcccggcuggagcauugguauauaaaagcugccuagguaacucuaaccuuuggccccauacaucugaaggauaccuacaaugcaccugaaaaaugcaacugaaacaguaguucccugggaccacacacucagaaaggggguguaucaggagaucuagggaccaggaggguggaagaccuaaggcagcacuacagaugauggagaaaaacccacuggggaggggcgauccuaaccuugagaaucacugagaucaugcagaaguauuugauccuacagcauuaauauuguauuguauuguauuaguauauauauauaguguauauauauaguauuaguauauauauuguauuguauuagcauauauauacuaauuguauuguauuguauuuauauauauaguauuguauuaguauauauauacaguauauauguauauauacuaauacaauguacuaauacaauacaauaccauauauauauacacuaacacaauacaauuaguauauauauauauauauauacuaauacaauacaauacuauauauauacuaauacaauauauacauauauacucaccaagacauauuaguggucugaugucuggcugccacacucaucuucuaccuucagcucugcucuaccaaauaucauuuguuucugggaucuuugcaguccaaggaacuucauccuugauaucccaccccuuacuaacuuuuuuuuuuuuuuuuuuuuuugagacggagucucgcugugucacccaggcuggagugcaguggugugaucucggcucacugcaagcuccaccuccugggaucacaccauucuccugccucagccucccaaguagcugggacuacaggugcccgccaccacaccaggcuaauguuuuaccguguuagcaaggauggucucgaucuccugaccucaugauccauccgccuuggccuccuaaagugcugggauuacaggcauaagccaccgcacccggccaccccuuacuaauuuuuaguaacguccaaggauuaaaggaaauuugccuuaccuauuuaacaggaaucaacaggguuaaucucacucccuuucuaaaaauaauuuauaaacauugcagacaaucucaucuaucccugucuaaacuguguggaauuacugccauuuaauguaaucagucuacucauuuaguuugccuaaggaauuuuugaaaaaacaguuaaaugaaugacuuaauggaauaaccaggaaguugaagucuccaauaguaagaaugaacucuugcucucuggauaaucaaauggguccuuccuccuucagguagaucaugccauuuccucacuuacacugaacagguaaacaacauaauuacugacuucaacuucuaguuaauuccuucuuuuaucacugaguauccuuuggcugggaguuuuguuggcuaugcugccauuuuuucuaguuaucacaguccuauaacauaccaauccuucaauauaacucaucuuuaaauugugguuuuaccuucucaagaaguuauuaauuaugccagugcuaaaucuucuaaaaugauuguugacuuguugauuagcccccaugcaauuccccucucccgucccucagcacguaaggaauggcccuuugcuuacuuccacagauccuuaaaucuaccaguuagaagcuaauagccuaccucucuaccaggaaggaacugugggcuggaacauaauacauguugacuuauaauuucuuagaaaauugugugagaaacaucaaacuccugauuccaggauaugccaaagacacaucauuaaaaagcaaaacaaaacaaaacaaaccucauuugacguugcuaguaguggcauauuucaucaagaucagcucaaauaaauagaagugagauuuucacacaaauuagacuguagugcuuuuuuuuuuaacuuaucuuuaccauaugauuuuuaacgguaaaaaaaaucguuugagauauuagauguauaauauuuaucauccaauuacuucauuaguucaaucuuuuuucaauggcgcuccugcaucugagaauaaggucagaaaauuucauguucugauuucaugcugauuuucagaagaaaaauguuaguuuuguauagaauaacccauccuaagaaauacauuucuuauuauauuucuuaucuuauauuucuuaggacaaugagcuauucaaagggugaugauaaccagcaccaucagucagcauuaucuaagaauaagaaucuguguuucuacauacagaccuccuaaaaaggaaccuacacuuaacaggauuccccaggcaauuuggaugcacauuaaagcuugagcaacacugcauuagaaaguuaguuuuccaucacaaaaacaguaacaaaaggaauauaaaguaaguuacuuuaauaauauaagaagaggggcaggccgggcgcaguggcucacgccuguaaucccagcacuuugggaggcugaggcggguggaucaccugaggucuggaguucaagaccagccugaccaacauagagaaacuccaucucuacuaaaaauacaaaauuagccaggcauaguggcaaugucuguaaucccagcuacucgggaggcugaggcaggagaaacacuugaaccugggaggcgaagguuguggugagccgagauugcgccauugcacuccagccugggcaacaagagcgaaacuccaucucaaaaaaaaaaaaaaaaaaaaagaugaggggucuugagaaaaauaaaagccagggaauugacauaguaauuucauugcaaaaauaccaaaucugucauacaggggcauucucuuugacccacuagcuagauacuaguguuauucagucuguuaguuuccauuaccucugaaauaauccacaaaacuaggcaguuaccugcauuuggauuccauuccaaucaagaauccuuaucuugguacuuuuacaagaaauggagagccauagggaguagcuaugaauauuuuagaaccuggaaaggcuaucuuccacuauaaaucgauaaacgaccccaugcuuacaguauauucacauaauguaauacuaugcuggcauuaaaaucauauuugcuuagcuccuuuuuucauuuuuugaugaugaauaugaacauuuuauauaaauaauuuuucccuaacagaaugugaauagucauuaguaagcugaugagcccaucagaguacagaugacuccugagguccuaccucaguugucaauugcagcacuacucuuuccaacuuuacacugguaccuaaccugcagaaaugaucugacagacggcaucauaagccauaauggaugcaguuagugucuccuccuugggugcuauacaggagugaccaucaccaauaaaaauacaauuuguaagcaacucuuuaaacagacucuccuugcuuugaagaacugaaauaauucugaauggaacagcuguaaucacugugaagaggauguuugccaagaaauaaguuguuaagauggaaauuccagcacuucaaaagauggaauuuuagcugucagaauccauccacuguugaaaccuuucucuucuauuguagucaaucaccucucuuuuucuggucugauuuguacucuccuuuuuggcuuaagcucacagaagcauguuaacauccucaucagagucugauaaggcugguauccagcaggauacaauauaagagcacacagaccagcuggaggaggaauucagguuggcucaagguggaaagggauggucugaucagaggagcagacaaggcaaacagaaguauagggcagagagagagagagagugagaaagaagcugugcaaggugacuggaaccaguaaggguggacagacaacccagccccuagcuaacagggcuggcaggaaugaagaaggaaaacaaacccuagccagccuucuggagccaggguuaugcacuguuucccagccacucuuccccaacccccacuccauaagguaagaaacacaaauauacaugauauccaggcagaagggauccugcccagcagcccccuacuccggaaauuaccuggaagcuacaucacaaaggccauucccaaacugagcaguucccauaguaaaggcuucagauguucuaccaaagaggcgaacugucuauccacaacuaugugauaaagcaguacaaagaugaaacagaaaaagacaauuacuacagacagaaugaagcaugaagaauagaacagauguggguuugaauucuaccuggaccacuuuucagcucuaugaccuugcaggguuugccuguuuuccucaucuguaaaguggagauaauaccucacuccuuccuuagucagagacugucuaaaaaaaaaaaacacaaaacaaagaaaccaccgauaacaaaauaugucacuccuagaaauauugugauguuaagaaauaaugaagaaaagagugccaaacaaaaggcuuggcaaaugcaucaaauuuccuugcaugguuuguuaaaacauuuuuaaguagcugcucuuuuccuguuaaagaaucuuccuaagacuauaauuaauaccaucaaaaugaccauacugcccaaagcaaucuauagcuucaacacaaucccuauuaaaauaucaacaucauuuuucacaaaauuggaaaaaaacuauucuaaaguucauauggaaccaaaaaagaauccaaauagcuaaagcaauagcagcaaaaagaacaaagcuggagcauuuccuuacugcaaauuacacuacagggcuauaguaaucaaaacagcaugguacugcuguuaaaaacagacacauugaucaauggacagaauagagaacccagaaagccacauacuuacagccaacugauuuuuggcaaagucaacaagaacauacacugaggaaaggauaaucuucaauaaauggugcugggaaaauuggacugugaaacuggacuccuauguacaaaaauuuuggauaccauguacaaaaauuacuuggaaauggauuuaagagcugaaguaaaaccucuuccucuaugcagccugaggugaucuggcuuaacccagaaaaaaucaugcaaaucaagaggcucaaaucuuuguguucacuuucauaaacugcccagaccaucaaagguaugcauauacaaaaagccacuaaguaucugaaaaaugucacuuuuuuauuuuuaagcuacaccuaguggaaugggagaaagaugucacuuuacaaaaacaguauguacaauucaaacauuacaaugauagaguugucaggugugcccuggccaaacaguggaacuagacaaagucaguggcccaaaaagacuauugaauuuuuacuguacaugcuuaaaaaugcagaguaauggcugggcgcgguggcucacgccuguaaucccagcacuuugggaggccgaggcggguggaucacuugaggucaggaauucaagaccagccuggccaaccugagaaaaccccuuuucuacuaaaaauacaaaacuuagcugggcauccuggugggcaccuguaaucucagcuacucaggaggcugaggcaggagaauugcuugaaccugggagguggagguugcagugagcugagaucaugccacugcacuccagccugagcaacagacugagacucugucucaaagaaaaaaaaaagcagaguaaugcugaacuuaaggauuuggguguagauucucuggucauuaaacauauccaggugaacaaagcauccaagaugcaccaccagacuuccagaguucauacaggagcucucccugccacacugagaagauccuuacugaaaaggaacaaauuguuccuaaagcagaagaggagguuggauacagaaaaagauaucccaaaagaaacugaagaaacaaaaacuuauggcacaggauuaauucagcaaaaaaauaaaugcaauuaaaaguaaaaaaaaaaaaaaaaaagaaaaaaggaagaccugaaacuaugaaaauacuagaagaaaaccuagagaaaacucuucuucuagauacuggucuaggcaaagaauucuugacuaagaucucaaagcacaggcaacaaaaacaaauauagacaaaugggacuaaacuaaaaagcuucugcacagcaagagaaauaauuaacagagugaacagacagccuuuggaaugggagaaaauauuugcaaaugauacagccugcagggaacuaacauccagaauuuacaaggaacucaaacaacuuaaccaaaaacccucaaaugccuggguaacauggugaaaccccaucucuacaaaaaaauacaaaaaucaacuggguaugguggugugugccuguauucccagauacuugagaggcugagguacgaggaucauuugagccugggaaguugaggcugcagugagcagugacugagccacugcacugcagcccaggugacagagcaggacacacacacacacacacacacacacacacacacacacgugcacgccaaaaaggccaggcaugguggcucacgccuguaaucccagcacuuuggcaggccgagguggguggaucaccugaggucaggaguuccaggccagccuggccaacauggugaaaccccaucucuacuaaauacaaaaaauuagcugggugugguggcgcaugccuguaaucccagcuaucugggaggcugaggcaggagaauccgcccaggaggcagagguugcagugagccgagauugugccauugcaguccaaccugggcaacaagagcaaaacucggucucaaaaaaaaaaaaaaaaaaaagccaaauaaucaucccauuaacaaguggguuuaggguaggaacagacauuuuucaaaagacaaacaaauagccaagaagcauaugaaaaaauguucaaaaucacuagucaucagaaaaauucaaauuaaaaccacagugaaacaucaucuuauaccaaucagaauggcuauuauuaaaggacaaaaaauacauguacaacauggauggaacuggaggucauuaugcuaagugaaauaagccaggcacagaaagacaaacgcugcaucuucucuguucccacuuauuuguacaaucuaaacaguugaacucauggagauagagaguagaaagaugguuaccagaggcccagaaggggguugugcgggggagggggggagguaggaaugguuaaugggcacauacguaaaaaaauagaaggaaugaauaagaccuaguauuugauagcacaacaggguaagcauagucaauaauuuaauuuuacauugaaaaauaacuaagaguauaauuggacuguuuguaacacaaaggauaaaugcuugaggggauggauacaccauuuuccaugaagugauuauuauacacugcaugccuguaucaaaacaucucauguaccccauaaauauauacacuuacuguguacccacaaaaauuuaaaauaauuuuuuuaaaaaggacaaaaaaauaacagauguugguaaggaugcagaggaaagugaacgcuuauauacuuuuuguucuguuuuauuuugagacagagucucgcucuguugcccaggcuggagugcagugcuaccaucacagcucacugcaaggucaaucucccaggcucaagcgauucuccugccuuggccucccaaguagcugggauuacaggcacaagccacuaugcccagcuaauuuguuguauuuuuaguagagacaagguuucaccauguugcugaggcuggucuugaacuccugggcucaagagauccacccaucuuggcuuccgaaagugcugggauuacaggugugagccaccgcacccagcucuucuguauuguugacgggaaugcaaaucaauuaguacaaccuguauggaaaacuauggagauuucuucgagaacuaaaaauacgacuaaccuuugauccagcaaucccacugcuggguauacacccaaaggaaaugaaaucauuauaucaaaaagauaccugcccuuuuauguuuaucacagcucuguucacaauaucaaacauauggaaucgacuuaaguguccaucaguggaggaccgaauaaagaaaauguguuauguguacacaaugaauacuacucagucauaaaaagauugagaucaugucuuuuucagcaacauguauagaaccggaggccauuaucuuaagugaaacaauucagacacagacaaauaccacauguucucacaaguggaagcuaaauaauuuguacagaagaagcagagugugaaaugauggacaaugaagacuuggaggcauggggugauagaugauggcagguugcuugguggguacgaaguguguugcuccacugauggaugcaaugaaggccugacuucaccacaaugcaguauauucaugugacaaaacugcacuuguacuccaugaguauaaauauauaucucuuccuaauacugguauuuaucugccuacauagaaaaaucuccacuuagaaaagaccaacauagaaaaacauguuguaagcaccccaaaaauaauuaauaaauguauucauuuucaaagacuguauccuauagauuuuugagagcguaaauaaaugccuucuuaaaucuugaauuuuucuuccccuuaaaacaaguacaucauguagugagagugaacaguuauguguuucagauuugaaaaguagaaauuugaauggaaacuguuucuuuuuuuuucugcauuuacuucaugcauuuuauuuuuaguuuuaguuuuaguuuuucauagagacaccgucucacuauguggcccaggcugguccugaacuccugaacucaagcaauccuucugcuucggccucccaaagugcuggaauuacaggugugagccaccguguucagucuacuucauguauuuucaaaauaauccugaaaaugcauucaguaaaaccccuccacaaauucauuauacucaaauucauaagacauucuccuugccuaaacugucagacuuaaacagacaggcgacaagaaauaaacucacaaguuuuggauucuuugcuuacagauugaucuagauguguuugaaauaguucucaaucuaauaaauacccaaacauacuggcaauuuccauauuauuguauguuacuacaauuuuuucuggcaaaagggaaucucaaacucauuaucugucaauggcuaauuucugaaacagaugauuucucagcaauuagggaauguuaagcaaaauauugucaaaaauacuccauuuuuauuuuuaaaacuaaaaaugcuuaaaauucuaagagcagaauaauuaaaacauuauucuugacauuauuuaaaugacuuuagauacucuugcauuguaugauccuuucauuuccaagcuuuaauuuuauuacuuagugauaauagauauucauauuuuaaaauaaaaauacaguuuuagggccgggcacgguggcucaggccuguagucccagcacuuugggaagccgagguggacggaucaccugaggucaggaguuugagaccagccuggccaacauggugaaacucugucucuacuaaaaauacaaaaauuagccagacgugguggcacaugccuguaaucccagcuacgcaggaggcugaggcaggaaaacugcuugaaccugggaggcggagguugcagugagccaagaucgugccacugcacuccagccugagagacagaggaagacuccgucugaaaaaaaaaaaaaaauuuaaaauauaaacuuuaacuuugaaauucuuaacugaauuucagcaccuuuuaauugcauaaauucuacaugacuaaagauuucaauauuuuuuaauacagguugaguaucuuuuauccaaaaugcuugggaccaaccagaaguguuucagauuucagauuuuuuuuuuuuuggauuuuggaauauuuauauauacauaaugagauaucuuagggaugagacccaagucuaaacacaaaauugauuguuucauauacaccuuauaaacauagccuaaagguaauuuuauauaauaauuuuaauaauuuuaugcauuaaacaaaguuuugucuggaccuacaacuugaggucugguguggaauuuuccacuuuuggugucauguuagcacucaaaaaguuucggaguugaagcauuucugauuucagauuuucagauuagggauguucaauuuguaccauuguuauauuaaugaguugccaauaagaucaguauuuggguuugaccuaugggauagaugcuugggugugucagaagacuucuauauauguaauuauuuaccaaaaggccaauaaugauguugagauuugacaugccugcccauuaagagacagcauuugugggccauaaagaagucuaaaaggcaaucuuguaucauaaauaagagauggacuuuugaaugagagauccuagacuuaacaccugcuucucccacuuacuagcuguacaauguuuggugaauuacuuaaucucuugguuucugaguuuccucgucaguaaaaaggagauuuuaaaaguccguuguugccuaggacugcugugaagauuaacuuagauaauggauuguacaggguacauuuaaucaucagucagugaauauuaauauuacacaaguuauagcauucaacaacuaaaaaguccuuaucugaaaauauuggcaucucuaaguucuaaacuggguagaaauccuagauguaaaauaaaagggaguuuaauacagaguaacaguaagauaaauauucaugagaagauucauucuaaauagcugacugcuauugauuuggcucuuggcccucccauaugcccccccaaaauaucuuuaaaacuuaauauugguuggguuacccuauaauaaaguuuccuuaaagacuaucaagagggcauaccuuaugucauaucaaguccuauuauggacacuucucuuugcagagaauuaacuaaauacacgaucagagacaaaaugauugaggaaaaaacccaucuaucacgguagagucuccuguauuauuuccuggcauuauauauauagcugcuauugucauccuauuagaauuauaaaaccuuuacuuucccaaaucuuaccucucugacacccagcucaggaucaccuuuguuuuaaaaagaacaaaggguucucucagucacugaaugagaauuuauuccgugaaaauacagauagugccacgcccggccuuucugccaggcagugaugccugauaccagagcuucucacacuguggauauauuugaacauaugaaacaccugggaaucuuguugaaaugcacauucugauucagugggucugggguggggccugccugagauucugcaucucuggcaagcucugcagugaugcugcugguucacauacacagaucacacguagaaguagugaggauugugacaaccagguugcuauauauaguguaugugagugugugcguacacaugcacuuauguuagaaggcuaaaaauauuucagaaaauuuuagaaggggaaagcauuuuacugcacuguccuagaaaccuuauuucaaaaugaacauuucauucuuucaaaauuugcuuuuucaaauuagcaaagacaauccuucgucucucaaaaggaggaugccaaaccuaugugaccccuccgugaguauaaacacuggucuauugaagagcaggaaugacacaguaguugacgaaccacuucuuuuugaugugccuuuggguaugguuuugaaaauaagaaauucacauuuuaaugaugaucaggcagcacaaccugugucagcuuguaaguaggaaaccagaacccugacagagaugaagaaacaauuauaaccaaaauguacauuaugaaaacuuucugguaucacuguuaagauuuaauaauaauagugaaaagggaauuauaauuacaguaaaauugugguacacauaccauucugcagaaaguagguagcuuccauaacuuaugagaccuuauacauaauuuaauuuuuugcucaaaauauuaaucuucaaaauacaaugacagcaauuacuaccuacuuaucucuuuugagugauuuaaacuuuaauagugugauaauuuaaaugcuacuuauagauggugggcuaaaacuuaauugauaauuaauaguggaggauuaaaaauugccacaguuacagaugaugagaaauguacuuauugacauaaaauccaacaagggugaucagcugaaaaugccauguaaaaaaaauuauagccaauaaaugcuccuuucagauucauaagcuguugacacauuuuacccuuuauguaaaucccauucuuaaaacaguuuucuucuuggcacccugaaauugaagcuuuugaaaccuuaugcuccaacauauauagagaaaugaaaaacuguuauaauuuuuaaaauuuuaagagugguuuugcagauuuaaacuaacagaucuucauuuaaaguaggauccacagagcucuccagugucauuccugaaauaacuagaaguggaauaaugggcuauuucuuacuuuguaguuucuaaugcaauguaagcagcuuuacaaggcuuagcuguccccacugcccuaacagcauucuuuacuucauuugcaaggaaacaggaaguuuuuuucuccccaauuuuauaccaaggcacagacuuugucuauuaaaauuaccaauuccacuuuuauuuaguaaaauuaagaaauuuuaaaaguaccaggcuuuuuguccaucaauauuaauuucuuuucuuuuguuuucuuuuucugagauagucuuacucugucacccaggguggugugcaauggcgcaaucauggcucaccacagccuucacauucuaggcucaagugauccucccaccucagccucccaaguagcugggacuauaggugugugacaccacacccagcuaauauuuuauuuuauuuauuauuuuauuuuuugauacagagucucacuguaucucccaggcuggagugcaguggugcgcuaucagcucacugcagccuccgccucccagguucaggugauucuccugccucagccuccgagcagcugggauuacagacaugcaccaucacaccugacuaauuuuuguauuuuuaguagaggcaggauuucaccauauuggccaggcuggucgugaacuccuggccucaugugauccuccugccuuggccucccaaagagcugggauuacaggcaugagccuccacaccuggccuauuuuuauuauuaauagagacaagcucuuguguguugcccaggcugugauauuaauuucuugaugugaacaugugauugccucucagcaaaguuauuuuuugagcuauuucugucaucagacccaaaccgaauuucuuaccagcugcuaacuuuucucuuacaccauccccacugaguugagaagauggcuuggugcuacaugaaagggaaguggcaguguaaccaccaaaacagauaaucacaggcuauaaugucacacuaacuauggauccuaucucuuauuuguaauuaacuuggagaagaaaugcuaggucaaaaaugugcuagaggucaaaacagggacuuuccacaaagagagaucugaguccaacuuuuacuuuuuugacaguuaucaauccugugacugauucuugcagcauuauuugagaauuaaaugagcaauauauuuuaagcacguuaggcacuuaauauaugcuugcuacaauauauuguacuauacaaucuacauagcauauacugcuauuauauacuaauauauaauugcccaauaaauauuuagcaaauuuggggcauaacuaguaauauauuuuuuaaacuucuaugaacauuuaauuuugaaguaccuauugaccacacucacauagaccaaaacuuuuacuucuuaaaaguuuuucaauuauaaauuauuaugauuguuuuuuaagaaucaaaucauaauggucauggcuuuaaaaaucuuccuacauuuggucacauacuauuuauuacauauuauauaguuauaguuauacuaauacagaagggauagcccuagagacugagagcauaggaaacuccuaaucuauagcaaaaaaaauuauuauuuacaauagucagaaaaaaauaauuuuucaaucuaucaaagauacuuaaauagguuguauuacaaauugaauauuuuacaaaaucaaaguuuaacaauuuguaucacaaauaucagaauuuaucuaugcgauugagcuuuuuuggaacacuuauuuuuccucuaacacaaugccauucuuuccagacaguaagagucccaagucguccugguucauauauccauaucuagaccccgagacaguucaauaugcaugauacaauggcuacauauugcagguacauuuaaaauaaucagaauugcuagagagcuugggggcagaucaacaaccuccucguaucuaacaucuuccuaaaccacagguucucaucacaucuccuggagagauuuauuaaccucccacccccacuuccacagaugucaaggccucagcacuggugauuauaaaagguucccagacaauuacaacacgggaagcacagcucauguugagaaccacugcccugaauaaugagcguugcuacaaggcaguauaggaauaauaaagcacacaggcauuugaaaaagacauuuugcaaacuucucucaggaauagugccuuagugggcacauauccaaauaugccugcuuuccuuucuuuaaauaccuauucaagagacaaauaaaggaauagaaaauaagaaggggaagacaagaaaacuggaggcugcaccagagccaccuugaaaauguaaaggauuggugguuguuacagagccugccacauuuaguagaaucuuaauauucaggaaguuaaaauguuuucuggagugagaagcugugucaggaaaagaggauuagguaacaagugaccuagaauuaggaugugauucucccugaaggauugcugcagaggagauaaugaaagguaagggcuuuuccaagacauuuccacauuggacugaccuccaucuaaaaucuuacuaaauauuaacacaaauaaaaggguucuggcugggcacaguggcucaugccuauaaucccagcagaagucaaggguggaggaucacuugagccuaggaguucgagacuagccuagggaaccuagagagaccccgucuccacaaaaaauuaaaaaauuagccaggcauggcaccaagcaucugcagucucgacuacucagaaggcugaggugggaggaucacuugagcccaggagacugaggcuccagugagcuaggauugcaccacugcacuccagccugggcaacagagcgagacccugccucaaaaaaacagaaaaagaaacgggcccauguaauaaagcacaugcuucuuuuucaggacagaagagacaaguggauugaauucauuucuuuaagcaguuaguuuuauacuaccuuaguaaguaaaauaggauuaacgaguaucugccuuggaacaaaauauaucauaaaacugaaaagcauccacacugaaaacacaaaauuaguccucaaagaaaucuuucauaugguaaccaguaacuggauauuugcgguuaaaagaagccauaacaaggcugguaaaagaugcaguuuccuuagucacauaauugauuuguaacaacugauagaaacuggcuaaucaucauucugauuaaucauuuuuggcagauuugaaaaggaggauaguccaaaaguaaauggccaucugggucacugcccauuugggguucuucuagcaaggccaagaagaaggaggagggaaaagaaaggcucaaacauuuuauucgccccuagugucaaguaaccacaaacuucauuuguucccucuauaauuuauugcaaaaaguaggagaaacugaagcauaauaugaaauuaauuugguacauacaaugugaagcaaaaauaguuauuccacuuugagcugguaaaaugccaaauaauaguacacaguaauuagagggagggaaaagaagugacugaauacucuaaaauaugucuuggauaggccaggugcggugacucaugccuguaaucccagcauuuugggaggccgaggcagguggaucaagugaggucaggaguucaagaccagccuggccaagauagugaaaccccgucucuacuaaaaaugcaaaaauuagcugcacgugguggcaugcaccuguagucccagcuacucaugaggcugaggcaggagaauugcuugaaccugggaggcggagguugcagugagcugagauagcgccacugcacuccagccugggugaaagagcaaggcuccgucucaaaaaaaaaaaaaauuucuuggauauuuuauuuccuuaagaaaaucaucaacucaauaaacauuuacugagugccaacuaccucaaggaauuauaguaucugcuauggaagcuguaaagcuaugugcccucagggaacuacacauguugaaauagccuaaauggcacuuuguuagucucauuauauugacaagcaaauuauuaaaaguaggaaauauauauucaugaagaaguggaccagcacuuugucuuugacagggcaaauccuuuucuagguacaagaagaauuaacuaaauacauuuaaauaaucauuaaauauccaauuacuuuauauauaaacacaaagauaaaccaaaguucauggauauaguacauugaaacuguauuugucaaguuaguuaauuaugcuuuaacacaugguuucagaaaaucauuauauuaugcucuugcccuuguuggcaauuugacacuuuuaacauguuauuaacaaaaauccaaacauacuauacaacccuauucugcuuuauauuaugaaaaguucaucuuuccacaucacuacauauucauccaucuccacagaaauagauaacuacaguaaagaacaaccuaguggaccauugugugcacagucuauaauucaauaaaccccauuuugaagaucacaaacauuuuuaacuaaacaucaugugcuuuauuuuguagcaccugugagaucaaccuacacauuuccucuaaucauacuagguuuacugagaaggaacacaacucuuaggaagaaaaacuccacacucauuaacauuuuucuguaucccgagggcacgaucagucaagaaccaggacaaaauuuaauaaccauucucuaauuggcagccaagauauuggagagagauauauauauacaucuauauauauauguauauauauacacacacacacauauauauacacacacauauauacacguguauauauauauauauauauauauuuuuuuuuuuuuuuuuuuugagacagaauuucgcucuuguugcccaggcuggagugcaauggcacaaucucagcucacugcaaccuucaccucccaaguucaagggauucuccugccucagucucccaaguagcugggacuacaggcgcaugccacuaugcccggcuaauuucuguauuuuuaguagagaugggguuucgccacguuggccaggcuagucuucaacuccugaccucaggugauccgccugccuuggccucccaaagugcugggauuacaggcaugagccaccgugccuggccaagauauuggauuacuaaguuaaacaaauagucaugacucacaaaaucugaaucucagcucuuacuuugcauaguugcuuugcuuuuuaucaauuuuaaucacuucuagacuuacauugugauuugcauagauuuuucucucuuuuaccuguaaaacugagacaauaauuauauaccugacagcaugaagauagugucaugcuggaauauuagauacuuuauuuaaauaaagauuuuccuuuaugcauuuagucaauacacuuuuauggagugccuuccaugugcccagauaccagggcaaacccaggggaacaagacagacaaaaaucugucaugggauuuauaguacaagagaacuauuaguuaacaauauaugagaggacaaugauaauaacuugaugacaaaaguuacuuugcuuaaucauguaaaguagaaaaagaaguuaucuuucaauuaaauuuguaugguuuuaauuuuuuacuauagaaauaaaguacacaguuuuucuuuuuuuuuuaaaagucaaguaacacagggaguuguaaaauaaaagccaagucuccuucucuuuccuaaugaacucucuuccacuucagauuuuuaugcauauucacguaucaauaaaugcauauacuuucuaaaaaucauauuuuaaaaacuaucgugcaucuugguguuuuucacuuuacaaugauguaucuuugagaucuuugcacauuaacacaugagacguugguguuucuaacaguuacagagaaugcaaagucacccugcaaaaggauuccaaaauguacaaaaauucacacuuucaacagcacauuucucucuaacacucagaugacugcucaaaaauuuuaaccucucacaaucuaaaagaugaaaguguaucucauugcuauuuuauuuuuuccguuaugaguauauuuaggcauuuuuucacaugucuacugaaagaaauggcuaaaaaaaauuuccuuuccugugaacuuucuauucaugucguuauuauugagcuauauuuuucuuauggauugguacgaccucuuuuaacauuaggaaaaguggcaccuaaagaaaaacacuuaaacaucaaaguuuucuaaaaaacaacacaugaggguuugcuuacaacuuacacacacacacacacaaacacacacacacacacacaaacacuauuggaugucuuuuuaacaguguaucuuggagaucuuuccaugacaguguugcuccugacacccugucucccuugacaaagaagcuccuuacagguagagcauuuucacuggcccucuccuuggccuugaauuucaaaacuggcauagaucacucucacuauuuuauagccuuugcucaauauuguuuuccugaacaucccugcaaaauuauaucuuccuuccacuggcccacccaccccugacuuccuguguugcuuuacucauuagcaggaaucgcuaucagacaugcuauguauauacaaacuauaauaauauauuacuuauuggucuauggucuaucucuuguuacugaaaugaagucagggauuaaaaacaguaucaguaaauaauuugcauaggcgugcuaguuuacaagcuuccaucaacaccagucucauggugguuaagcuucagauauuuuugauuuacugaaauuauccucucuaggcuauuguaacaauuaaauacuaaaaauaugcauguugcccauauguuguugcaaugugcacuuuugaaauacauuguuuucuauagaaaguuuaauuacaaagggaaauuaauaaauuccuucaugugaaacacugacuauauuccacagugaagauaaggauaagagauaugaucaugcaacaaauaaaaggguugggaaacagcuaaacagagagaaggaaugcaagcaucucacacacugacugacuccuuuaugguuuuaauuguugcuuuucuauucaguggagucuugcaccuuauugguuucuccaacagaguagaucaguacuaaagaauaaauagaauucaagucauuauccaguacaauuagcaauggaugcugcuacaugaaagaaugcuaucuauucccucuuguaauggugguagagagguauaauauacaaccauuacagaagacaguaucuagcaacauuuccagugcaauguaauccaaguaauaaaagacuggaaaaaaacacaaacgcccauguaauggauuauauacagccugaacaauauagaaugcagaagcucguaguuuacucaaaugaaauaugucuguguauguauaaaauaucuucaagaugcacuguuaaguccauagaguaagauacaaaaugcuauguauuauauacuagcauuuguguucuuaaaggaaaaaaauauauagucaauccucauucacugauucuguauuugcaaauucuccuacuuaugaaaauuuaaccccaagucuauacugauggcacuuucauggucauuuucaaacaugcacagagggaugaaaaauuggaguugccugaccugcacauccccagcugagguggagcaaggugacacacugccuccuguucagcucucauacugcaaaauaggugucucuuuugcagucuuauuuaguuccaugucuuuccaauuuuugugcuuuguguuggcaauuucacgguuuaaaauggcucccaagcuuacugcuaucucauguuccuaagaacgagaaggcuucaacaggucuuacagagaaacuacguauguuagauaagcuucauucaggcaugaguuagugcuguuggcugugaguuccauguuaaggaaucaacaauauauguuaaauaagguauuuuaagcagaaacacacacaaaacuagguuauguguugaucagaaauauuguaaccaaaagcucucaggaaacuaacgcuguauuucccuaagugcaaggguuccauauucacaaguucaguguuugcggugacuuuacagaacauaucuaccuggaauaaugagaaucucauuauuuguaauugcuuuugugcacacaaaacaucucugaagagcacacuggcuauccgcagggaggagaauugugugguuggggaaagggauguaguccuuuauauaaaauacuuuuucacugcauacccuuguggaacauuuuaaauuuuauaccaugccuaguuuauaauuguuuuaaucuaaaguuaaaaaauaaacuaaaagaaugcuaacaguagaaaacugagcaaaugauugaaagauuacccauaguaaaauuaauuauaaagguaacagacaaccaaaauuuuuucuuaauuuuagucagacucaguaaaacuuuaauguagugauuucaagaggcugugcugaaccauuuugcugaauauagacaucuuguggguuguggguuuauuuuauuuuuugagacagggucucaauguguugcccaggcuggagugcaguggcgcaaucacagcucacuguagccuugagcucuucaggcucaggugauccucccaccucagccuucugaguuguugagacuacaggcacaugccacuaugccuaauuuuuuuucuauuuuuuggauacaggguuuugcuauguugcccaagcuagucuccaacuccuaggcucaugcaaucccacccaccucagccucccaaagugcugggauuacaggugugaacaacugugccaggccugaauauauagauauuuuggaugacuguuuuccccagaaaauuaaaguugccauuuuccuccugccucccuacaggagguuaaugaaugugcugaaguacgccaaauuuuaagguacacaaaugugauaugcaacauaauaaauuccacuguuuacugagcuucuacuacauacuaguuaauagacauuauuuaauuagauuuucacaacucugcaaagcaguuauugggacacucauugaugaagagaaaacugagucuucaggagugaacaauuuacuugaggucacccagauagucaguggugcagcugggguuugaacuaaauggucuguguccaagacuauguaggggaaaaucagucccugugaaugaagaaagacccaaucauuuagauaaaaauaguacagaaucacacugagaauauaugaacuccaaacuacaauucaaaugugcaaucaauaucugagguauucagacacaaaacagaaagcagaagccuacuugggugcgaagccauacacaguucaccugagggggcuuuguauuuguuguguccuaucuggaucucucuucuccuagaugggcccagggcuaacauggucuucucauuugcuacuaggucagaugccaauccuuuaguaaggcuuucccugacccccuagcuaaaacagcucccucuggccccaagucaccuccuaucacacuauuuucuuuauagcaguuagcaacaucuaauguuauuuugucuauauacuuguuuacauguuuaguguuuguguccuagugguaugaacggucucugagaacagcggccuugugccuggaacagagucuggcaaauacaggcuccucaauaaauauucaucaaacugagucacugaaauuuaacaguuauggacugaccgcauaguguagcagacugggaugaaggccaagucuuaucaucaaugaguauaaaaugcuagaagggugauauacaagucacaacugacuuuaauaugagaaaaucuaccacugccaaaugaaaagcaaaaauggaagaguuuaagauuaaaaguucaaaaccuuaaaagguuguaugaagguggcagcacugaguugggcuuucuaaguuucagaaauagagaaagaagagagauauuccagugguuuaauuugccagggucauaagauacuuauagagcaaugggagaacuaacuguaagaucgaauggugaguuaaggucaaggaaucuuccuuaucagguggguaaaucugagucauagugacaggcaauuugggagcaaugaaaaguucuuagcccugguugugacaugacauuucugaauguguaaugagaaguucaaaaauguuggcuaggaauucauuacucaguugaaagcaaaauaauacuaaaauaucugcugagagucaugccaguaaaagcuacuuuucauggagagccuagaaagugcuggacauuuuguaagccauugacacaccuuaacuaguuuaauuauuacuacagccuaauuugauuaucucaauuucacacuuagaaaugggggccuagggagguuaaugaaugugcucaaguucaccaagucauuaaguagcaaaggcagaauugaaacugugucugaauccacaggucccagaguuugauacacugcugcccugaugacaaguuaaggugagggaagaugaagccaaggccacccuaggaaaggaaaaaguaaaacgguuuguauagcaugaguauucugagcuaggcacuaaggaaacacuuugaccuaacucagcuuucauaagucugccacaagaugccaugaacauuugucacaagaaagcaagcacagccgggugagguggcucaugccuguaaucccagcacuuugggaagccaaggcagaaacaagcugaggcaacguggcgaaagcccaucucuacaaaaaauagaaaaauuagcccggugugguggcaugcaccuguagucccagcuacucaggaggaugaggugggaggaccgcuugagcccagggaggucaaggcuacaaugagccaugaucacgccacugcacuccagccugggugaaagugggacccugucucaaaaaaaaaaaaaaaaagaaaaaaaaaaaaacacucagguuggaaggcagguggguugguaggcugcucauuuauuucugaugaaagaauuucuuguuuuggggaauuucuuuuuuuugagacagagucucacucuguugcccagguuggagugcaguagcacaaucacagcucacuacaaccucugccccccaggcucaagcaauccucccaccucaaccucucgaggagcugggacuacacgugcaccccaccacacccaacuaagaaaggauuuccugaauguaaugugguauguggccuuucugugcauuuagucuuuaucaugccacccaaauugugguaaacauauaagcuuguagagcagguuugaucucuauucuucaaaaagaggacugguuucugacuagcuggacuagcaaaacagaccauuugcuagauaucuacaaacuauaagcaacccucuccauuauccucucacagaaaacaauaccagggcaccuguuuaguggaaccaugugcuauugccauucauaggccaaaauaguuaaguaucgacaauuuacaggaggcccuuccaccauuauguuccugauuuugugguuccuuccugucuagcagaccuacuccaacuccuuagccuggcuuccaagcuuccaaucgacccucacaacccaacuuuauuccucaaaccccacauaaaccuuagucaggccaggcugauucuccucucagcuacugcugcucaucaaauccuccauuuuaauagcacugcaagaaacaggagggaugagcucagguugucuagcucagagacacagcagccugcacuucagcuuuguucucuguagcacauguggcugugguaggcaggaaguagcauggucucaggagcugggcgguucuaaucucaucugaaucacacacagagaugaguuaaucacuucuuugagagucagcuuccucaacuauaaaauaacaauuaugaugcauuccugucagaacuaacaggaggauuuuuguaauaaaguauguggagcuggccagguaacaccugccuugcaaaaccaaacauuuacccaugcauuggagugaacccaaggcuaauuccccaaggacaauccuauauccucugccagaagaguuuagcacaucugggaagugggaaaagaggguggucuuuuccacguaagaaaaccaguuaggcuucucuacaucccuaacaaauuaucaacccacgauccugcuuucaauacaucugccuccucugucagugacagagccucagcacuccugggacagcuuaucaacaaaagcccagcucagagcugaucuggaggaaagauacugucagccuuccccuggguacuauaaaucccagccugcuaucaagugagauccuagagaaguugcucaaggcacauucauuucgccccuggacugcaguguucuuugacauuauaucccugauuuuccuucaaauguuguugucuuugggcuaggaccuugguuuguucuuaacuuacuugagcaauaaugagacaucaccuuucuuuucagauaacaagaauucucuuaaauucuuguguuucagccaggcgcgguggcucacgccuguaaucccagcacuuugggaggccaaggcagguggaucacgaggucaagagaucgagaccaucccggccaacaaccgugaaaccccaucucuacuaaaaauauaaaaauuaccuggguguggugguacgcgcccuguagucccagcuacuagaagggcuaaggcaggagaaucgcuugaacccgggaggagggguuguaaaugagccgagaucgcgccacugcacuccagccuggugacagugaaacuccgucucaaaaaaaagaaaaaauucuuguguuuccacuuuugcccuugcugccagaaggcaaugaacacugccuguuaaucucagcauggucagcccucaugguuagcauauaagacaucaugaguauucuggugcuaccaccaugaaaggaaacuccgucuuccuuuuucaucaacccaacuauuagcucucaaagucccugccuuuugcuggaguguuucuaaauuucuuagcacauagugauuuucuauacuauaguuacuauaauacuauauuccagcacuggaauauuuguucuuuuucuguagcauucuacuguauuuugcauguacaucugccuuccuaaacagacugugauccaaauaaguugaaauauauacagagggucugucugucugccaaugcuaggacauugccuucuauuucuuugucuucucaccugucuccugcaugucaggcacacucucaucauuuaguaaucaccagcugacuugacccaagaagaccaaacagucugaaugcacacaguagcugaagaucacaggguuucaguaucucuccacuggcaaaaauauuaggugcauugagacacacuucugguucucaggaauaaaaacuuuaucccaucuucaaaauguaaucgcuauuagaguauuuuuacaugcacaguaaaaggacuuguguuuuaguacauacagcguuaaguacuuaaccuuauacuaacuguaaauaugucucucucuguguguguuuacaaauuggccuuguuauuauacaugcuguuucauaagcagaguuuucugcaacaugugguauacauuuuuuuugucaagauauauucuucuauaauauaguuuuaaugguuacauaagaguuacuaaaggauguuuuuuugguugcagagaggggagugaagggggaacauuauaaauuuuauuuauuuucuugaggcagagucucacucuguugcccaggcuggagugcaguggugcaaugauccucagcuuccacaaguagcugggacuacagggugccugccaccaccucaguuauguauguauguauguauguauguauguauguauguauguauguauguauguauguuuguauguagagacagggucucccugugcugcucaggcuggucucaaacuccuggccucaagccauccucccacccuggccucccaaagugcugggauuacaggcgugagcugcugcacccaaccucucuuaugcuuuuggagagaaaaaauaaaacaccuaucuccaugauuagggcuauucuaacaguuuguacaaaacuuucugaggccuugagaggcagaaacauauccaggcaauuaaggaaguucuuucuuguauuuuugauauauaauuuuagauuaaaugcuuaauuccaauuggaagguauaguuagaaaacgucuacuacuuaagauuaauauuuuaguggaaauuuugucuuuguaucaauuuaugaacagagccaaaauuuaagugaacauaaaagagauucaaugaaaaaaaguuaaaacccuuugagaguaaaucauuuuuagguguauuuuuagcuuauugcaugagaauuauauggcuauaaaucauuagaguaagggucaaauucaggccagugugauggcucaugccuguaaucccagcacuuugggagucugaggugggcagauugcuggaagcccagaguucgagaccggcuugggcaacaaggcgaaaccccgucucuacuaaaaaaauaugcaaaaguuagcuaggcaugguguugcaugccuguaaucccagcuacuugggugacugaggcacaaaaaucacuugaacccaggaggcagaggcugcugugagccaagaucgugccauuguacuccagccugggcgacagagcaagacugucuaaaaaagaaaaaaaaaaaaagucaaauucaauggaugcaaucagaacuuuuucaaaaacugcucucacgugcuuucauugugcagagcucauuuaaacaaaaugagccccaccauaugcuuuucaaaauaucaccuuugaaaaugguuucuguaauuuucccaguaggugcugacgucauaagccaaagcaggagagacccagacucuguggacaggcaguguggaccuagacugccuggguuugaagccucacucugccaaucaccaggugucccaccuuuuccaaguuacuuaaccucaucuccaagacaugcccaaucacaaagccuacuucauaaaauggaggguuaauuaaauuaauguucaugaagccuuuaguggguacgugguaagcucaaugauuauuaguuaauaauauccuuauuaaacguccaguaagucuuuuuuaaauguuauuuucuuugagaaagggucucacucugucacccaggcugguuugcaauggcaccaucauggcuuacuguagccuagaccucuugggcucaagcaauucucccaucucagccucccaaguugcugggacugcagguguaugccaccacaccuggcuaauuuuuguauuuuugguagagacaggguccacccaccuuggccucccaaagugcuagaauuacaggugugagccacugcacccgaccccaacagaguuuugggguuuuuuguuuuguuuuuuuuuuuuugagacggagucucgcucugccacccagguuggagugcaguggugcgaucucggcucacugcaaucucuaccuccuggguucaagugauucuccugccuuagccucccuaguagcugggacuacaggugccuaacaccaugcccagcuaauuuuuguauuuuuaguagagaugggauuucaccauguuggccaggcuggcuggccuguaacuccugaccucaggugauccacacaccucagccucccaaagugcugggauuacaggcgugagccaccaugccuggccagcccaauagaagucuuuaaauaaguauuauucagaauuucuagaaaacacacuccaaucaucuuccauauuaaaacaauggugaaggauucacggugugugugugagcacacacagguguuuggaaauuauccacucuucuucccaguucucucuggauucucccuuaggaaacaaaaauuuuugaucuaauuuuaagaaaauuuuuauuuuuaugaauuuaugcuuauauucauuuuauauuuaguuuucuuuucuuucuuucuuuuuuuuuuuuuuugagauggaguuucccucuuguugcccaggcugagugcaauggugcgaucucagcucacugcaaccucugccucccagguucaagcgauucucuugcuucagccucccaaguagcugggacuaaaggcgugugacaccacaccuggcuaauuuuuguauuuuuaguagagauggggguuuaccauguuuuaccauguuggccagacuggccucgaacgccuaaccucaggugauccacccacuuuggccucccaaagugcuaggauuauaggcgugagccacugagcccagccuauauuuuguuuucuauauuuauuagauuuauaaauuuuuuaaaucuccagccuuaagaacaugcuuuaugauuuaaauuugaaaagacaaguucucuauaugaaaauaaaguucccuuaucagcauuuugugauauauuuacugcuaaguauagguugugugcugccauuauaaauuugaauuaugcaaaaaacaagauaaaggcuugaacuuugcauguuacuucuagaacagaauacagcugauccucauuacuaagaauucauacuuauuuagcauacucgcuaaaauuuauuuguaaccuccaaaucaauacucauaguacuuuuguagucauuuguggucaugcaaagagcagugaaaaaauuaaguugcccaaugugcacaucccuagcugaggcuaaaccaagugaugcucugcuucuuuuuuggacucucauucucuaaacaaauguccuuuuugcaguguacuugguccuaccuuucuuacauuuuugugcuuuuucaugauuucccuauuuaaauuggccucuagugcugacaugcugaggaguguucuuaaccacaagauuaugauuugccuuagaaaaacacguuagauuagcuuaguucaggcaugaguugauauugacugcaagcucaaugucaacaaaucaacaauauauuaaauaagaugugugauauuauauauacagguuucauccacagcuccuggcucgcaacucccacagcccuguuaaagucuuuuguuauaauguuggggcacuuuaggcccagaaaaaggccucaaaaaauggaaucucucucucucugaccuucccuugcccugguuuccccagcccaaggcagaacucuaaccuucccaggccuuucugauugaguccugagacccucaauucagaagggaucuugccccuuacccuggaggaaggaaugugacacacaggccaagaagaaucugaacagacaggccuugcuggguuucccgcucagucaaugaguauuagguuggccaggcgcuguggcucaugccuguaauccuagcacuuugggaggccaaggcaggcagaucaccggaggucaguuuaaacugagaccagccugaccaacauggugaaaccccaucucuacuaacaauacaaaauuagcuggguguggugguugaugccuguagucccagcuacuugggaggcugagccaggagaaucgcuugaaccugggaaucagagguugcagugagccaagaucgcgccauugcacuccagccugggcaacaagagugaaacuccaucucaaaaauaaauaaauaaauaaauaaauaaauaaauaaauaguauuagaucauaccuuuuuuguccaaucacauuucugcaugguugucaaucauaccuacacaaugaagucuccauaagaagcucaagauuggguuuggagaauuuccagauagcugagcaccuggagguuacuggaggguggugcacguagggaggacguggaagcuccaagcucuucucccauacauugcccuauguaucuuuucaucuguaucuugcauaauauccucuuuuuuuuuuuuuuuuuuuuuuuuuugguugagacagggucucucucuguguuguccaggcuggaguacaguagcacuaucuuggcucacugcagccucugccuccugugcucuuuccucccaccucagacucccaaguaacugggacuacaggugcaugccaccacacuuggcuuauuuuuuagcuuuuuguagagacaaggucucacuauauugcccaggcuggucucgaauuucugggcucaagcaauccuccagccuugguccccacggugcugagauuucaguugugagcuacugugcccagacuuauaacauccuuuauaauaaacuaauacauguguuucccugaguucucugagccugucuagcaaauuagugcaacccaaagucaugagaaucccaacuugaagccacucagaggucagaaauuccagagacccagacaugugacucuuggcuggggagagcagguagucuuggggauugggacuuuaaccugugggaucugucccuaucuccaagcagauagugucaaaauugaacuggaggacacccaguggaugucugcugcagaauuuacugcuugcuuggguaguggugugagaacagaggaaaaacaguuuugaguuuuuccacucacauacaaaagacgucuuuaacagaagcacacuuaaaagaaagucauguauugaucaauuguugaaaauguugugaccagacacuuguaggaacuuaauucuuauauuccaccugggagcaaugauucaguguuugcuaauucaguacccccagcaacuuuauaaagcauaacuacagcaaguaaugagaauugccuggaccuccugcaaaguacaaggauuagagguagauaguacuaauccaucccagguacauggauuaggcacugagaaagaagagccuucuaggauagcauccacacuugacacugguugcuuaguuaagugaauacccuucuucuuaagaaacgucuuuuugagaucugauuuuacuuaguuuaaaauauaugcuuacaaaaauaaauaacugcauuagcccaaaguacuuaaaaauucuugcugauguuuuuuacuguaaacucugcuaagagcuuuuaagucuuguuacagugaaacaauggacauauaccccuggaauauggagacuuuucauugagugucacaugcaggggaaaaaggaaaaccaacaauacucccuggaccucccaaaccuucuugucuucaaguccuaagcacaacaaagaaugcaaaaggagagacacacugcauaugccuauguggauucucauaugcuuauguuccagugacaccuucccauuugucuugugcuaaguaaacccacagguuuguguaauaaagacaaaaagcaugccauuuauugccauaauaguguacuauuucauccacugacuugaucugccuaucuguguauucaaauagcaccuaugaccugcuucuccgcccagacagaacaaauuauugggugugacuuagucaagcaugagaacaaacagagagaaauaugaacucaggcugucaaggcacagaaguaggcaguaaugggaagcaggugagaugugaucccagcagaccaauguguucucugagugcuagucccaggauggcaauaacuguuccaaguucuguuuaugucacuagugauacccacaaccagccauucucauccuagaacauccaggucucauacauucugaaagauucagacuaucaucuaaaauuguauuagaccugauaagaaugguuuccuuuaccugauauucuaguucugcaaaaggccaccuuuacuuugcccuguuauuaaacaguccaugucacucagccuauggcugcauuuugccaaaauuuccucaacuguaaaaaauuccuugaucaggucaagugacauggacuguuuaauaacagggcaaaguaaagguggccuuuugcagaacuagaaaucagguaaaggaaaauaauaauaauaauaauaauaauaauaauaauaaauuccucgaucaacugauugguccuacugcuagaugcucuggcaagaaauaagauaaaauagcauuaccuugggagcuaaaugauaagaacuuaugaauacaaagaaacaacaaugaggucuacuugauggaggagguugggaggagggagaggagcagaaaagaucacuuuuggguacuaggcuuaauaccugggugaugaaauaauauguacaacaaauccccaugacacauguuuaccuauguaacaaaccuucacauguacccucaagccuaaaauaaaaguuaaaaaaauaaaaauauaaaaaagcaagauaaauauucguuggauagaaaaaauagcaugacuuucaauguaaauuuuaaaaaagauuaacccacaaaaauuagaaauuuaaaaacuuuuuuuaaaaagaaagaaaaagauuuuaaaauaucaggauguaaagaaagacagucuuuuuuuuuuuuuuuuugagacagagucuuacucuguuguucaggcuggacugcaguggcguaaucucggcucacugcaaccuccaccuccgcaacucaagagauucuccugccucagccuccugaguaccugagauuacaggcccaucccaccauaugcccggcugauuuuuguauuuucaguagagaugggguuucaccauguuggccaggcuggucuugaacccccggccucaagugaucugccugccuuggccuccccaagugcugaaauuacaggugugagccacugcgccuggccuucaggcauuuuaaauauauauucucauaauaaugaaugcuuuuacuuuugaacauacauuuuuuaaaaaggucaaaugguaucucuuuuugccuguggcccuacugaaucagacuagacuuaccaaguuuucuauugaccuuagaauuccugaugugcuagguugacauuccuauaaugucaacacacguucacuaaaaugaauuugcuuuucugcuauaagaccuauuagucacagauggaaauucuacaacuauagaauacauguaaagcacaagaaauugucacacuauauaacaugaccuuuaccuacauuuuuacuuuugcuucaaaguuggcauauuuagauuuagaugcaccuaaaaccaucccaagaauauaaugcacuaaaugaacaaccuaauuauucuuauagagugcaauuaacucauaggauacuuguuaguauccuauguauuaacuaaucauuccuuucgcuucuucuuaaucuaauuuuacggaccaaauaaucuaagaauguguaaauuccauguauguuauaauuuguuuauacuauaaauauaauuuauaauuuaaaaaacuaaaaaaaaaaaucaaaucacuguugggcucauauacaaucaagacauaaguaucggccagucacaguggcucaugccuguaaucgcaauacuuugggaggcugaggcgggcagaucacuugaggcuaggaguuugagaccagccagccaacacggcgaaacacugucucuacaaaaaauacaaaaauuagccacgcgugguggugcacgcuuauaaucccagcuacacgggaggcugggacaugaaaaucgcuugaccccagagggagagguugcagugagccaacauugcgcuacugcacuccagccugggcaacagagcaagacucugucucaaaaaaaaaagacauaaauauaauguucucaccuauaaaauggagaugaaaaauccuauuuuauaggguugaaggagacuaugagauaaaguaaauguaguguguaaaauuuuaaauacugacauauguaaguaacaucaaugauaacaacauaacuaaaacauauacagcaucagugaaagcuuuacauauauuaacucauuuaaucaauauaacaacucuuaucagguuaguuuauuauuauuaaacuaugcuuuauagaagacuuuuacccucuccaagguuacaaagcugaacaaggaucagaacucaggcagucuagcccuagaguuacauuacaucuaucaucccucuuuaugauguuacuaucauaugauccaacagagacaguaacagcaaauaaagucuaagucaugccuucauaggaaggguaagugagaucuuuauuaugugcugaguaacugaugaugaaugauagauuccaguaucaauggucacagagcuuucucaauguggggucauguuuuaggaucucaugucauguaauguguaaaacuauucuuucuuaaucauuuguacuuguuuaaaucauuauucuuccacuuccauuaggaaguuuguaucuagagcucuccucauuggcauaguggugaguuaaaaaaaaaaaaaaagaacaagaaaguaucuagagcucuaucuucagagauuaaagaguaauuuacucaauaguuuacauuuaacaacaccaugaauaaaucaauguuucuaccuuauuuauuuauuuauuuauuuauuuuuugagauggagucucacucuguugcucacgcuggaaugcaguggcgugaucuuggcucacugcaaccuccaccucccagguucaagugauucuccugccucagccucucaaguagcugggacuacaggcacauaccaucacaccuggauaauuuuuguauuuuuaacagagaugggguuucaccauguuggcaggcugguuucaaacuccugacuuugugaucugcccaccuuggccucccaaagugcugagauuacaggcaugagccacugcgccuagccucaaaguuucuauuuuuuuagaagaaauuuccauuugugaagagucauguaaaaagucccaacaugauuuuuaccgcaaccugaaauuguuucuuucuucugagaguauacauuuuugugcuagcguggucaaagauaacuuauagccaacccaaucccccuccuuugccaacagauaaacuuuacccgauauuguguggagggcaaugugccuggcccuugagagacaaagugcaagacugguuuaagccucucaaggcgaucacucucuuugucauucuuugucauuauuuuugagauggaguuucauucuuguugcccaggcuggagugcaauggcacgaucucggcucacugcaaccugucucccagguucaagcgauucuccugccucagccucccgaguagcugggauuacaggcaugugccaccaugcccagcuaauuuuguauuuuuagaagagacaggguuucuccauguuggucagacuggucucgaacuccugaccucagguggucugccugccucggccucccaaagugcgagauuacaggcgugagccaccacgcccggccucuuugucauuuaagaguugguguaggaaagcaauccccauccucugucagugaaugguccaagagugaaacacaucaccaggccuggcugauggcaugaaauuauagcaauaauaagagcagaucuaggcauguuggcucaugcuuguaaucccagugauugagaggcuaaggcuggaggauuucuugaggauaagaguucaagaccaaccugggcaacauagcaugaccccaucucuacaaaaaauuuuagaauuugucaggugugguggcauguccuguaguucaaacuacuugggaggcuaagauaggaggaucauuuaagcccaggaauaugagacugcaauaagcuguaaucaugccacugcacgccagccuggcugacagagugaaacauuguuucuuaaaaaauaaauuaauaaauaauaauaauaauaauaaaauaagagcauauccuuuuauaaacuuacugagugcaaguuggcuuggaggcuuugccuugacaagaaagcaaauaaaaaggcucccaugccacugcuccuuucuuucugcuugagaugcuugugugggaagcuuggugauauggcagccaccuugugaccaugaagaaaaaacuauugacacauuaugaauggcaaaacggaaacucagauagaaccuaggucauugauaacauuauuaaaaccacuaaacaaccacugaggcuuccaaucaaaguuauuguuaugugaaauaauuaaaagucuucauguuuuaggcuacaguuaauuaaguucuguuacuugcaguugaaaacauccuaaaaguucccugauuggcauaaauguucuucacaccaaacugaugaguauuacccaaaaaugacauaauccaugaagaaaauaaucugaaacuuauugcauuuuguaccugacuggucaaacuuaaaacaauuguaauacuauuauucaguauauuuuguguuucucuaaagcuacuaguuuucuuugcccugucgucuaaaaaugauuaaaaaauaaugugcuaccuaaaaagagugagaugcaucuccucaagcuuuucaugugucagccagaacauuacauuaaagaaacaaauucucucauuuacaguuuggugcaggaaguauuuaacaacaugcagaaauauccauucuauauauuucuuaaaaguuaggcuacagaaaaauaugguaugaaaacuaugauaauauuuuuguaaaaaagaaaacgagccgugcacaguggcucacgacuauaauuccagcacuuggggaggccaaggugggcggaucuugaggucaggaguucgagaccagccuguccaauauggugaaaacccaucucuacuaaaaaaaaauuagccgagugugguggcgcacgccuauagucacuacuacuugggaggcugaggcagaagaaucgcuugaacuggggaggugaagguugcagugagcugagauggagccaagaucgugccacugcacgccagccugagugacagagagugagacuccaucuaaaaaaaaaaaaaggaaaaugggccagacgcgguggcucacaccuauagucccagcacuuugagaggccaagucaggacugcuuaagcucagaaacuugagagcaaccugggcaacauagugagaccucgucucuacaaauaaucaaaaaauuagucaggugugguggugcuugccuguagucucagcuacuugggagccugaggcuggagaaucacuugagccagaagacugaggcugcagcagccucggugacagagagagacucuguccuaaaacaaacaaacaaaaacauaaagauggauaaaaaguuuugaaagacuuacaccaaaauguuaguguauaucucagggugacauuuguuuucuucuuuucacuuguguuucuuaaauuuucuacaauguauuaaaguuaccugcuccaagccuauccacaagaagcagaaaacuacaacugauaauguuuaugcuuuuacaagugucucugcaaaaguauguauuuuuuuauuuaucaagaugaauccuaguaguucucuacguuagguaaaaucuuuaaaaaaaaaaagauuauauguauaccuucauaauucuaggccuccagauacauacaauuuaauugacgagacaaauaaaauacauguauguaaacuucagaaaauagggcaaaaauaggccagguauaguggcucaugccuguaaucccagcauuuaaggaggcugagguggauggaucaccugaggucaggaguucgagaccagccuggccaacauggugaaaccccaucucuacuaaaaauacaaaaaauuagcugggugugguggcacaugccuguaaucccagcuacucaggaggcugagacaggagaauugcuugaaaccgggaggcugagguugcagugagccgaaauuacgccacugcacuccagccugggcaacaagagcaaaauuccauuucaaaagaaaagggcaaaaauauuaaaucauuaaacccaaaugaaauaaagagaaaacaagaauauuuauuuucauuuucacaugaaaaaauacaauuuaagcuaauauuaaagacaacuagcaagcuauugauggucuggccuaaggucaaugaaaacuuaauuuauauaaugcuuuggaaaacuacuucauuccaaauguccuagauauugcauauaaacaagacauacggagcuguuauguuguaacuaccuagagaaaacaguuuaaaucuauuauagcacaucuagauaugauaaacuauaaacauaaaagaaccuauauucuuuccacugaguaaaauuuaauccugaagaaggacaaccauuagcaccuaauuuuaguuauuuucuguacuccaucaugaaaagguagaacaugucaucagcuucacacucccuauuccucaucccuccagcauugcuggggaaaaaggagucucuggacacugaaugcucuguggggaagaaauaucagccauaaaauguuuagucagaagacaaacucuuaggucucugaggaugagccuucuguuacuuauccaugguauaauucucaaaaacacgguagaguuuuuucuuuuaguauaugccacauaguuuucuauugugagugugcuuauuguauccauauaaugcaaguucacccccuaaaaaucucggguuugccugaauuaucugugugaaauaacacccacaaucuaagcccagauagcagauauaaugugcuaaucucgucucacucuaacagcagaacuaaaguuuagaauuaacauuugcuggauuuaaaaagaauaagccaaaucauuaagaaagcuuuauuuauuuacuuauauauguauguauguauuuauaggaacagggucucauuuuguugcccaggcuacuggaguggaguaguacaaucaugguuaacugcugccucaaacuccgggcucaagcaauccuccugcuucagccucccaaauaguugagacuacaagcagcuaucaaaccuggcuaauuauuauuuucucuuuuuauuuuuauuuuuuuaauaaagcaagaugaguucucaccauguugcccagguuggucucaaacuccuggaaucaagcaauucuccuggccucacggccucagccucccaaagugcugggauuacaggcaugagccaccacaccuggccuauacuuuguuuucuuauauccagaaauaauaauuuaaguggucuauagcuuaagaaugaaauuuugucuaaauuuagauaaaggauaggaacaaaaaauagccaagagcuguuuauagagauuuuuaaaaacuauauuccaaggccauguguggugguucacaucuguaaccccagcacuuugggaagccaaggcagaaagauuacuugagacccggaauucaagaccagcccaggccccauagcaagacucagucucuacaaauaauuuaagaauuuagcugggugugguaaugcaucccuguaauccuaccuacuagggaggcugaggcggaaggauugcuugagcuuaggcauucgagguuacagugagcuaugauugugccacuauccuccagcgugggagacagaguaagacccagucucaaaaaaaaaaaaauuaaauuaaauuaaggccgggcgcaguggcucacgccuguaaucccaacacucugagaggcugaggcggguggauugcucgacuccaggaguucaagaccaaccugggcaacacagugaaacccuaugucuacuaaaaauacaaaaaauuagcuaagugugguggugugcaccuguaauaccagauacucgggaggcugaggugggagaaucaccagagcccgggagguugaggcugcaguaaaccaagaucgcaccucugcacucuagccugagugacuagagugagacccugucuaaauaaauaaauaaauaaaguuaaaacuguauaugauuuugaaccagucuccucuaaccucuagggacauagacaauggagagaaaaagacugggauggaaagccaggucuucauagaucuaagccaacuuccuagauccuaguuaacuugaucaacuacaggguuaacuaagauguaaaacaaggaggagaggagagaaaauaaaauaaaauguaaaacaaaacaaaacaucuacuuucuguguacugaaagguaaccuucuccaucuuucuucucucagaaaggaagucuagaagacuagaaauggcccagaccaguaugaucugcuucacaaagcaguccuguggaaagcccugucacauugcucccaagcagaucacacauaccaggcucucuggauccacagagccuggccucuggacuagacagacuggccccuucuaaacuucguuucagagaguaucaaaaucuuucuagcuccucuuaaccagacacuaucuccuaggcauucugcaguacuacugaagauauuuguuaaccacguacuccagguacgugugcagcaucuguuuccaggugccacaaggucccugagccaauuauucuauucauuuuuuucucacucuagggacagguuuaugcuuaaccuuuugucuguauuagauuagaugacuuuugucccuggggaaccuuugucccauuagauacauuccugggcccacauguaaaaguuguaauucuaaaguuaaauuaauguuuuuuaucauccucccuugaaguaugauccuuuccuauuaaaaaaaucaaauuauguaauuuauuauugaagaaggagaaacaaguuuauugugacaucaacaauauggccccuccuccucagucuaagaaagcaaauucauuuggaguaagaaugggcaguucaauguccucacaaacugucuuuauguuuaauuguauugcuaauuuuaauguuuauuuuuaaaugaauuaguuuuuuuaagauuguuaccugauaccagguauuguacauacaucuuuguagaaugaaacuuaucuuaaaacauuaaguacauuauaguuaaugcaaagaaugugaaaauaagaccacauggauaaucacaccacccacauauacccagaauauaauaugaacagauuauagaaaacuggaacagggaggccgggcgcgguggcucaugcuuguaaucccagcacugugggaggccgagguggguggaucaccugaggucgguaguucgagaccagccugaccaacauggagaaacuccgucucuacuaaaaauacaaaauuagccaggcgugguggcccaugcuuguaaucccagcuaccugggaggcugaggcaggagaaucacuugaacccgggaggcggagguugcggugagccaagauugcgccauugcacuccagccugggcaacaagaacaaaacuccgucucaaaaaaaaaaaugaaaacuggaacagcagaaggauaaggaguaaacucugaccuuauuucucucuugcccaaauuccuagcuaaagggucuggggagucacaccauacaaaucauaaaaucucuccaaaccugaaucuggcauaacaucacaugacagauaaagaaggaaaucaaaauauuuuaccccgaggcuucuagaugacuuuauuuaaaaaacaaacaaacaaaaaaacacccaaaauauguuucuuugcuacuacgggcagucacguaugagacuuuaucuaccuaagaaccuuauguagaaccacaaccccuuaucuuaacccagacacucuuuucuacugauuccuggcuuuuagauaauaauuuaacucuuuuaacaaacugccaaucagaaaauauuugaacccagcuguaagcaacauccccucccuaauucaaguuguccugcuuuccgggcagaaccaauauauaccucacauguauugacugacgucuuaugucucccuaaaauguguaaaaccaagcuauaaaccagccaccuugugcacauguucucaggaccucuugagacuauaccucaggccauggucacucauauuuggcucagaauaaaucucuucaaauauuuuacagugcugugcucuuuucaucaacaaagauaaauaauaaccauuguuuuaccaccuuuacagaucuauuuuuuuuuuaccucuuuaguauguuuuucuuccagguuuuuuucuucuugugcauacaauuccacccuuccuucuacuuuagagaagucuuuuuuuaaaagucaucucagccaggcacgguggcucacagcuguaaucccagcaaucuggauugcuuugagcucaggagaccagccugggcaacguggggaaaucccaucucuacaaacaauacaaaaauuagccaugcguggugguguaugccuguggucccagcuauuuggaaggcugaagugggaggaucacuuuagacugggaggcagacguugcagugagcugagaucguaccacuguacuccagccuaggcaacagagugagacccugucucaaucaaucaaucaaucaauaaaauauaaaauaaaaaaaucaucucucucugauuggaauagauaguuugaguaucuagaaaaggacuaauaauccccaacaguuagcauggauucacugauaauuagucauguuaaaugccuauguuuucuucuuaaaaaugagaucagaugaagagaguaaaauauuuuuaagggacuggacaaucucccaugauucacuuaacgaaauacaaagcagugccagauaauauaaucagauacauuuaaaaguuaaugaacagccucguauguccaugcaugcauucauucaacuauucaaacacugaauaugccaaauucugugguaagcacugauuucagagaaaauauuuaucuauuuauaaaccaagugccagugaaccacaaauaaagagcaauagauauagauggguggagagaagaaggcuuuggaauucaaauuucaacuaaguaggcacuggacaagggcugcuucuagagguaacauuaagaagggaauuuggugccagauuuugaaugaccuuaaaacaacgggaaaccacugaagguuuuuaaccauugugaugacaagaucagaucagugacucagaaagacaaugggagguaggaaucuagaagacuaaaaguaguccuggggagcuaaaggaagucaguggcaagcacaaugaaccgagaaaaagggaacugacagccaacucacacaggaauugguuguaaauuacagguaggagaaaagggagaugaguacuuucaugcugagcuauguacuggucccacauagaugacaaagcagguaaagcagauuagcuaaggaagaguucagucuguaaaaucgaugguuugagaagacaaacccaaagaaugagagauggaaucaguuucauacagagcagugcuucucccuagggcaagugggaagguuuuucacaguaacacuugucuggaccccuccacagaucugcuaaaucugaaucccugagauaagccugugcauguguguacuggggaaaaauaaacccuauguaagucugauucaauaccuggguaaggaucauggacauggagcaagcuucuaaagcuuuuucuuacccuacacuuuucucuugucaguggacaaaggauuuagugauuacaaagagcuggcaaagaaccaaguacuaaccaaaguagugcaaucacacauaauaucagcaaucacaaaauacagguucaaaaaaaguauuuuuguuaauaugaaugcaagagcaguaauucaaaacuaaauacaacucaaggcaaccuuguauucacugauaacaguguccuuaaauuuuguagaaugucauguauguacaguaggagcuuugcaauguuccaaagcaaugaguugcagccguuuuagcagaauauguaauuagaaccccacuccuacccccacucaagagcaagucucuaguacagacuuacuguguugaauguacuaagugccaaauuuuagcaaguuuuaauaaaucucuuagagguuucuaguagguaauacuuaauuguucaaaccaaaagagggcuaauauuuuauuuuucuuaaguagcuagguggauuaccaguggacugcaaauaaaauuugagaaauggcuuagaaaagaaggccuagagagaacauaauauguacaaguaguauuaagacaaccaugcagaaauggaaauaaaagucagcuagagucacaauuaggaugacaggaggacugauggaggaaccugucuuucaggucaauauguagaagaaccuuuaaugaaaggauagaacuuucaagucaguauguagaaauaccuucaaucagccacuccauguauaauggacugaaaggggcuuccugagaaguccugaggucuuggauaaccaagagaagaauaagaaaaugauuuauuuaaggcugggcacgguggcucacaccuguaaucccagcacuuugggaggccgaggugggcggaucacaaggucaggaguucgagaccacccuggcuaacauggugaaacccuguaucuacuaaaaauagaaaaauuagccaggcaugguggcaggcaccuguagucucagcuacucaggaggcugaggcagaagaaucgcuugaacccgggaagcggagguugcagugggccaaaauugcaccacuguacuacagccugggcaacagagcgagacuccgucccaaaacaaaacaagacaaaacaaaaacaaaaacaaacagaaaaaaaauaaagugacuuaacaaguaggugacuauuccugcugaccaccaacccacacaaaaaugcuaucaucuauaaccuucucuacagucaagaaaacuuauuuugagacaucugauagccuacccaucucucuccuaccggcccccacacaacguaaaaauaaacaacacugagaagcagugugauagucuuucuuuuguccucuucugaucagacucucuacauucugaauguugggauguuucugauucaaaacaagcaguauggguuagugccagugauuauuuuaaauauaaguggaauggguucaggugcaauggcucuaaucccagcacuucaggaggcggaggucacuuaaggucaggaguucgagaccacccuggccaacaugguaaaacccugucucuacuaaaaauacaaaaaugagucgggcaugguggcacgugccuguaaguccagcuagucaggaagcuaaggugggagaaucacuugaacccaggagguggagguugcagugaguugagauuacaccacugcacuccagccuagguaacagaacgagacucugucucaaaaaaaaaaaaaaaaaaaauauauauauauauauauauauuuauauauauacacacacaaauauauacauauauacacauauauauauacauauauauggaauguuucaaaaaaaaaaacuaucaauugaauaaaaccguggaugucaauguuccgugauuucaaauucauuauguauuauucaauaaaguagguaaaccuaucuuaugaugucauguaauaguuauuauaauuagccaauccuuaucuucacucauuuuauauuuauucuauuacaauuuuaacauuucaauuuaugaugaaaauuuaaaaaugugugaggcagugcauaguuuuuuaaacuucuauuagaggcauaugaguaaaagagucugaaaaucacuccuuuuccuauggaaaacuccauaaaacaaauuucuucugauuaagcaccacaauuaagagguccuuugaccucuuaauugucccuuaauuuacauaguaucuauuguuucaguccuuucuggagccauuuuugacuggacaugaaguuuccaccucuucacaagaguuacuauguagcaaacaguaagcagagaaaaagcauauaaccuaacugcuuggacaaaugaaggcuucucaaguuagaccucagcaaaaugaaaaaaaaaaaaaaauugcuugggaggccgaggcaggcggaucaccugagaucaggaguuugagaccagugaaaccccgucucuacuaaaaauacaaaaaauuagccuggcaugguggcacgcauguguagucccaacuaauagggaggcugaggcaggaggaucacuugaacccaggaggcagagguugcagugagccaagaucacaccacugcacuccagccuggguaacaggaaugaaacuccaucuaaaaaaaaaaaaaaaaaauuguaaugugauaguacguaaaucuguucagugcagucccuggcacauaguagggaacccaggcugucacaguuuagguacugaauggucuaaggcauacuaaaaaaccuggaaacaaggcugaaggaaauggagcaaaauaacaguggcagccucuggaaaagaauuaaagguguuuccuuuccgacaucuuuauacuucuuaauguuuucauuucauuucuuuuccuguaacuauuucuuaccuuagaaucaggaaaagaauuuaaagcuacuaaaaugaaacaaaagguauucugugauucuucacauuguaggagcugaccuucaagaauagggauauccccaacccacauauuuuuauuuuacugucaacaguggguggcuauuuacaaguagcuacacuaaaaccugcugggaagaaagucuggcugcagaucagauggaaacacaaauucccagggucuagaaccaagcugagugcaagaaauuaauaucacagagcagacaguaaauauuucauaggccaaagcuuuauucuggccuuaaguauucaggauccacccagugaaaauuauuaacaaaagagacauuugugagaucauugacuaaaaccacagauaccugacacguuuccagugcagccaaguuuucaagugcauuguuuuucugauugaauauuauauuaauauucaaauaagaggaugauuggggccuugugacacaccccucaucaucacaccagccauccaagccuuauucaagccuggaacccaguuuuccuuuucugauuccuacaugcaaaucccaacuccccuuccugaguuguccaucgugcaaaagaucauaaaggguggcugcaaggguuuaacaguuaaaguacguaaaacauuggccaggcgcgguggcucaugacuguuaucccagcacuuugggaggccgaggugggaggaucaccugagguuaggaguucgagaccagccugaccaacauggaagaaaccccaucucuacuaaauauacaaaaaaaauuagccaggcaugguggcguaugccuguaaucccagcuacucaagaggcugaggcggagaguugcuugaaccugggaggcagagguugcggugagucgagaucaugccauugcacuccacugggcaacaagagugaaacucggucucaaaaaaaaaaaaaaaaguaaaacauuauaaaaggaugccugcaaucagguaaccauguauuaacuguuaguaucauugcuccugaaugaagaaaaucuacccugcugucuagguguggugguuuacaccuguaauccuagcacuuugggaagcugagaugggaggaucacuugaggccaacaguucaaaaccagccugggcaacauagcaagacccccaucucuccaauacaauaaaaaaauuaguugggcaagguggugcgugccuguaaucccagcuacuugggaggcugaggcaagaagaucgcuuggaccaagaagcggaguuugagauuacagugaaguaugauugugacacugcacuccagccugggugacaagcaagacccugucucuauuuaaaaaagagagagagaggcuagacgcaguggcucacgccuguagucccaaaacuuugggaggccgaggugggcggaucacuugaggccaggaguucgagaccagccuggccaacauggugaaaccccgucucugcuaaaaauacaaaaauuaggcaggugugguggcaggugccuguaaucccagcuacucagaaggcugaggcaggggaacugcuugaacccagaaggugggaguugcagugaacuaacagccaagaucaugccacugcacucagacugggagacacagcaagacucugucucaaaaaaaaaaaaaaaaaaaaaagagagagagagagagaaaagaagaaaaugaaguuauacuuguuuacuuguuucacuuuaaauaggauuauagggcuuggcgcaguggcucacaccuguaaucccagcacuuugggaggccgaggugggcagaucacaaggucaggagaucgagaccauccuggcuaacacagugaaaccccgucucuacuaaaaauagaaaaauuagccaggugugauugugggcgccuguagucccagcuacucgggaggcugaggcaggagaauggugugaacccgggaggcagagcuugcacugagccgagaucaugccacugcacuccagccugggcgacagagccagacuccaucucaaaaaaaaaaaaaaauuggauuauaaaccucauguguguuuugaggagguagaucucccuccccaaaauauauuucaucaauaaaacuuuccuuauaucacaacuaggaacucuucuauaaaaguuuuagcaagaaaaaaaaaacugaaauaugaaucccuguaaauaaaaguauuacaaaacuaugagugauuuucuagcaaaacuacuuacaaucagcaugucuaauuuaucucagcaaauuuaucuuagcaaagguaaguguaagucuuuuuucuccuguacuuuuuuuuuguacaaaguaaagacuuaaaguuaaaucucaguaaguucacagugggcaacuaacucagcaaaggguuuccuaguaauaggaaccuuaaaacuaaaagucgcaaacacucaaugcagaaaggaaucaugauaaauguguaggcuugaccuuagaugacugacaugguuccaagcuuugggauaacuauugcacaaccaacuuaaaauuacaaauucauauucuuuacucuugggcaauacuuuuuuuguuuuguuuuguuuugagacggagucucacucuguugcccaggcuggagugcaauggugcaaucucgccucacuggaaccucggccuccuggguucaagcgauucuccugccucagccccuggaguagcugggauuacaggcgcccgccaccacgcccggcuaauuuuuguaguuuuaguagaaauaggguuucaccauguuggccaggcuggucucgaacuccugaccucaagugauccacccaccucagccucccacagcgcugggauuacaaguauaagccaccaugcccggccacuuuuuuuuuuuucaauuuuuguguuuuuuuugagacacaguuuugcucuguugcccaagcugcauugcaguggcauaaucucagcucacugcaaccuccgccuccagguucaugccauucuugugucucagcauccagaguagcugggacuacaggugcguaccaccaugaccagcuaauuuuuguauuuuuuguagagacaggguuucgccacuuugaccaggcuggucucgaacuccugacaucaagugauccgccugccucggccucccaaagugcugggauuacaggugugagccaccauacccgacccauacaauacuuuuuaaaaaaggacccauguaucucuaaaauaaauuauuggaggguaaauauaauuagagaugcuggguuuuuuuaaaguucucagaaaccucaauaacuaugccaacauuuguaccugccugaauacauguacaaucagaaucuggauaaaggaaugaaguuaugaguuuuaacauuacaauauagccaagucauaguuucacucagauuaccuaggguuaucaacagaaaugacauaugugguacagguaacuuucccuaaacccuccuaaaaaagauaaaugagaaguaaaugggagcggguggaugugagcuacauaaagaguaaagggagggcugaggcaaacuuuguagaaugaugucugguuccuauuaauaaaggacaguuuggcucaccuguguccauaugugaaaaauuaaguuaaucauuaagacaauguuugguuaacucauuucagaaaauaaaauacuuggaccugaaauauuucagaucacuuaagccaagauaaauuccugaauugccagaauggugccacacucauuuuacuuuguugucuaaagacugauuagauggggggccgggcaccuguaaucccaccuacucaggaggcugaggcuugaacccaggaagcagagguugcagugagccaagaccaggcucaaaaaaaagaaaagaaaaagaaaauugauuagaugguuauuguauaucccccuaaguauuucaaaaccuccgucccccucauaacucuuccacuaucuaagcugaaagauuccucuggccgggcaugguggcucacaccuguaaucccagcacuuugggaggccgagguagguggaucaccugaagucaggaguucgagaccagccugacuaacauggugaaaacucguuucuacuaaauacaaaaaaaucagccggguguaguggcgcaugccuguaaacccagcuacucaggagguugagguaggagaaucacuugaacccaggaggcagagguugcaguaagccgagauggaacaauugcacuccagccugggcaacaagggcaaaacuccauccaagaaaaaaaaaaaaaagaaagaaagaaaaaaaagaaaaagaaagauucuucuuucaaggaaguauauaaggcaacucuuagauauggaauaaguugacuuugaaguuuccagccauuuuucuuacaaaugcacgcagaagguuacgaggaagauuucaggaagaaauuuaaagcaauccucacuaaaggaaaaacaacagugaaauacuaugucugcauuugaaaaguuucauuaaguuccaauguuauacacuuugacacauuuagaaucacccucaaacaaaaaagcaacaggcaauccucugaagaucacaaaauuuuacuuccaaugugaaaaagacuucaugaaaaaauuuuaagcacuaauuauaacuaguacaaauacacagauggauaauauaaucauaaaauauuuugcauuaagcuggcuuucauccuuuggaauccuaaacaagaauugcaugaauauuuauaauuuauuaaaagauacaugaaaguucauaucaaagcuccagcacaacuuuacauuauuuucuaggaccccacacagauuacacguuuuuucucuauguauuuucucauucuucucacucuuaaccuaguacauaugccuacaucccagugcuuucuaaaaauuauugaaugucauguuaugauccucacacaaguuuuaauccuaaaucaauaugaacugugauaccucaaaauaaacagcaagugacaugaguacaauauagacacacuauauuccuacagagcugaccaaauuuguugcugcaauguuaaugaugaaaugaaacucuggccuacucuguuccauagucacagaugcacuguuuuccagccauuuuucuuacaaaugaauguagaagguugcaaggaagacuucaggaagcaauucaaagcaauccucacuaaaugaaaaacaacagccaaauacuaugucugcauuugaacaguuucauuaacauuaugcugcuauauuuuuuaugcugcuauauuugaguuaaaugcuaacacagguuuuuagugcuuuuuauguucuuuaaucaugaaauuguacaucguguuacuuuccaaacuucaccuacaaaaaagauauagauguacaacuccuuuuaaaauguuucacggccgguugcaguggcucaagccuguuaucucagcacuuucggaggccgaggugggcggauuacuugaggucaggaguucaagaccaaccugaccaacacggugaauucccaucucuacuaaaaauacaaaaauuagcuuggugucauggcaggcaccuguaaucccagcugcuugggagguugagacauaagaaucacuggaacccggaggcagagguugcagugagccaagauugugccacugcacuccagccugggcaacagagugagacccugucucaaaaauaaaacaaaauaaaauaaaauguuucacuccauuuuuaccuuugguaaaaacaaauuugugaauaaaaaggcuuccucagcugaacagcauuuaauucuuaaaauuccuauacuaucuuauagacucuauaauacagaauacaaaauguuaaaacaaguaaacccuuuuacaccaccaagggagugaguggggagaaaagucagaaaaauauauaaagcuuugaaaggcuggauguguggagaaugccaggagagggggaggguuucaugaaguucuaggcaagcccuuugaagacgucaccucacauacauaauguuacagcagucagcacaggccuccugcuuuccuauuggugggcaccgugucagccgacaucagaagauaaucaucauuggcuagacaauuacaacuggagcaacuagcauccacugcuguuagcacaaaccuggcaggcugcugaaagagaaggcagagagagcccagcuucccuucucacucaaugaauuauaugucgccuuagcaaucaccaggugauuuugcucccuggcuagcagcacuuccaacuuaagucagcucuuagugagaaaaacagguaaaggccagacaucucauaaaagagcaaaaugucucuauuuucaauguuguaaaauugcaaggacuuuucagugaaaauuagaauucaaaacuccuauuuggaccuaugagcagacauuuuucucuaccucauguaauaaacucucauugaccagauaauauaaccagacaggauauuuuucacuggacauguaguuucaagaugaggcccaggaugauucuacaagggaauacacuuauuacuuugcauuucaauugcuauucuaaccuauuauauaugaaacuuuuugcuagcaaaguaaaaaaagucugcaguauuuacuuucauggcuaggccaaugaguaugagguuaaugauucauuaaagcagcaauaaacuugaaaacuagccucaguugaacccuuuaggguuuauacaaaugcuacuccaaaagucgggccccauuccauuaacacgugcuaugguuaguaaguauggauuauaggguauguuaacauuaauuugcgcuaugguuaguaaguauggauuauagcguauguuuaauaaaguauucuuauuuuagguccucuuaaaugaugcuaguuagcaaaggcagcauacuggcaaaauacuacuccuggccauucucacaguucuucaaaagccaauguaguucacuuuugagagaggauguuuuaauucucuaaauuaacaaguuuugccuguuacuaagaagagauuuauaaggacaaccauaaauucccaaaagacagaguagaagcuucacuauaucauguuuuuccuccagaagcuauuucaaaccauuuuaaguuaaugagucugaaaaagguaagauuuuaugguuuccucaaguuccucucuccucaagagggucuaagccuugguuauggaguucccuucuccuauuaaaaagggagugaaaagaaaaucugguucaagacuuuuuguccugcauuagcuggauucuauuaaaaauaaaaacuaaaagcuuuaauuugaaccucccggguucaagcaauucuccugccucaaccucccgaguagcugggauuacaggcacccgccaccacgcucggcuaauuuuuuuguauuuuuaguagagaugggguuucaccauauuggccuggcuggucucgaacuccugucgucagguaauccacccaccucagccucccaaagugcugggauuacaggcaggagccaccacacccggcuaauaaaauuaaauuuuaaaaaguguuuaaagucuuuuuggcuguacaguuuuuggggagggaggagagauaaaauugggcacccugggauauugggagaaaugcacaaaaucuggcauuuaaaaaaaaacaugaaaguaagacaauuagggucaggaagaguugcaagggagggguaacagccagcaggguucuuugacugcaauaagcaaucuaagaacauaacaucaacagagagcagaagccaggaagggaaaaaucccaagaugugacucugccacgguaugcaaguucuagccuguuaaccuucggguauuaacgaguagugcuggcaauaaaaugggcaccaaucaccauuucaacucacuggacauuuucucaagaaugugccuuaugcaaagcacucugcuaggugcuuugcagaaucaagagugggaugacaagaaccguaaccugaagagcugauggucuguaaguuaauaaccauguauauaacaguaaaggauauugccagaagaaagguacagauaaagaacuaggaggaaacaguggucagaaccuaacaggaguagauacguuggcacauuuuugucauuuucagucccacgagggcugagaccugucuggcucaguacugagugaauggagagaagaggcgggaaaugguaccugaagcaggccuaggaaguggccucagagaaaaagcaacaaguaaauaagaggcaguaucgacugcagugggcuaggaauggcgggcguacagugaauggggucagccagcaaagcgagggaaagcggacuccggaagagcagguuaaaccaggacgcagcaagucagagauucggcacagaagcaaaugcugaccacacugaccacacaggcuaaugcgggaggacugugggcccgaacaggccggcuggaggauaugacaaacaugugcggagaagacccgggcccggggcuagccagcagcgcgguuccggcgcccgccggcuccggccaccgcccccuccccgccuccagcaccacccccuaagcgggaggaggaagugcauccagagaaggaccccgggcgguggggcucgaggggccucggcugccccgaaacgccgaggucuaucugcggucucgacccuuaguguccaaccuccuuccggacccaccccugcacccccuggccucagcggcccgggagggcaccagcccugugccuguguggcugcugcacuuccaguccuuccgagcggcccgcguccccgccucuuaggcuccggcucgggccagacgcggcccuugggccccuagcccaccgccgccaccagccacgccgcagcucaccccaagcaggccugccccgccggugcgcgcggcccaggaggcgggcuccgcccggcagccgccgcaaauggccauuggggcccggaccagcccgcgggaagcugggagugggcgcgcuccggccgggcgggaggagaaggaagcggcggccgggccucccgacacuggccggcgacuccagggggcuggaggacaggaaguugaaacccccuuuucgcagcugcggccccguggcaccagcuccuacugcaccaacccgcccaggccacaggcgcgccggcguuucugguuuccaguugaagagggcaggcgggagggcgcggggcacgcgcgcucgcgcacgcggcgggcggaaucccccggcucccgggagacccugcggcccgacccuccccggucaagccaucccccgggcugccggccccuugccuagcuccggggugcguugggcuugaacuuuacagaucgccagacccgaaguuaaggggaggagaggaaugccucugccacaacccugucuacaagaagcgagaugagcacacccuccucuguuaaauauugcaaggugacacuggaucgccucccacacagggauuuucaaaaggucuggcggggggacuacaguaaacaagaaagguguuuucccugauuauuaguuuccuagggaagagccccuaaggacucugcagacggaggggcuuuuaaucugugugccugaacuccaaucagcagcuacgcacagaauuagaaguguguccaaaaggcguuuccguaaaacagaaacuuaauaauggcguggcuccacucgcucggguucauucauuuauuacuguuuucauuguccccuccucccucccacccggucucucuaugaaaccggaaagggaaccgcguggggaaagggguacuaaaaagggggcauccgccugaggagcggcagacagaggaggacggugaaguaggagcgcugcaaggagaaaggaaggacacgagggauggagagacagcgaggaccagggccaagggcggcgggcgggagaggguuaaaggcaacaggagacaagguccucccuccacugccuuucacacuccgguugcgggagaggccaagcgagaaaacccaaaucuagaugaaaaccgggggaggggaggggagcacagguaggcgaucuggacuguggcaucucucccgccuucccugucgcgcagacaucacccugugcacacacauauguucuguguuauauaaucuauauaaaagaugccuauguagccgcgguucacacaggggcacccacagaccucgcgcuucauguacccccccccccccagcgucuccugcacccgggagacccgagaacucagcgaucagcuggcugcccgcgauucaucgcuccauucacgcccaggcagggaauaccgacauuaaggcacuccgggaagacgcgcagggcucccgggaacaguaucaggcgaaagcaucacguaccaguuuuccugcauccauuggauggcuucauucucguugaacugcuuuucgaauucauauucuuguaaagucaacacugacauguucauuggggcugaucuucggagucgcuacguguucucuauacaaaauaaaauaaucuguaaagcgcuugauuucgaguguucuccugucugcuucccccacccaccccccuaggucuuccccacgccgcucggucuccagcggucgucucuucucccagccucucagcuacauccagggcugagcauugccugcgccuccgcucccagcuccucucucuggggcucuccuccucccggcguccgcauccaccguaggaggaaaugaaugccuugcggucuuagu

SEQ ID NO: 191336 - RNA, 9918 nt, Homo sapiens
cuuuuuucuuccucuuccggggacguugucugcagguauggauguuguucucuuuucccugucuuuauuuccuuaccaaucggcugccauccgaggagcugaggaagccuagagcucucagaagcaguccuuugagcugguguagggguaaggggcacaacagggagguugguggugaggaaguuccuuacuuugaucuuuggaaaucccuuguuccugguggcaccuccaaagccgugaguagccacagcucaccacccgggacuuugcugcauuccaaguguagcguuuggagacuaacgaguugugguuuggcgguuugagucuggaaaaucgccaaacguuuucauauuuuacacccacguuuucacagcacgccuguacguguccuuagucuuugggagggcaggguccggcgaguucgggugguuucgcuauuuggcuucugcguccaaggcccaugucaaggaagagaaaaauguguuagaaguuucugucuugcuuuuggagaugcaaacagaauaauggcuucauaaaucacucgcacugguuuuacgugucaaguuuuggugucugguaauucuguuuuaguuuaauuuuagugagaggcuugugacaacaaaugaggugguuacaagggguggaaugggaagauuaaauuaguucaaguauugauuauguuuuacguuggguaguucccuuaacgaaguugcucguaugcauaucuguauaaccgauuugcuaaauaacaucacgauguuuccagaagugggaagaaagcaggugccauaacccaaagaaacuuguguaauaucaaaauuaguauuaaaggguaugccuuuacgcagguggugcuuuagggcaagacauugaacccugauaugugccaggcauuguguugggacggauagcccacgucguuuaauccuaaugacagcuguauaaaguagacagaauucccauguuagagauaaggaggcuagcuccuugcccuuuauauucccaguaaauggcauagcuaaggauucgacuucagagcucacuuuuugugcucuuuguuuaaagcgguguuucuccaacugggcucguggcacuuuucuggacaccacuccaaacaaaauuagacucugaguaaggagccuggucaucagaacguuaaggaagugccacguuugauuaccaucaggaaagcuaacauucuuggccucuuguuuaucagucaccuuuaaauacaaguaguuuuaaaauguggaauaauacaucuuaauuuaaggguguuacauacaaggauauguaugugaaugaaauagaccacaugauacuguuuugagauuuuauuuacuuuuacaauggaaagauuugauguuacucuauucuuaauuuaggcacucagaaugguccagcguuugacauaccgacguaggcuuuccuacaauacagccucuaacaaaacuaggcuguaaguauuucugaaaauuuuaaguauauauugucauuuacucuacaaaaugcugaccuacugacuguuucacuuucuaggucccgaaccccugguaauagaauuguuuaccuuuauaccaagaagguugggaaagcaccaaaaucugcauguggugugugcccaggcagacuucgagggguaaguguaccuuuuacugugugcagccuaacaagucuugaacuuacugagcuuucaucccuugacgauggaaugaaucaaggagagguuaccacuaagaggguucagaauuacuaaacauucaugagccaaaucugccacgaacauagacuuuuuaaaccaaucugagaaaugcagugaaaugccuuucagauaaaugaguacaccauuucccuuuguaaccuacuuuaaacuugcccuuaacacuuaacaaaauuuagggaaauuucuguuaaagcaucacaaaaaucuuaauauuuuucuuaugcagguucgugcuguaagaccuaaaguucuuaugagauuguccaaaacaaagaaacaugucagcagggccuauggugguuccaugugugcuaaauguguucgugacagguaaguuaaaugcuuaaaugggcuuuccuuagcaaauuauuguguguguuauacugucugcugaucaguacaauggugaagcaacucauuuuaaaccaguugcaugcuuuagaacccuuucuuugcuauggauaauugaugcugcacaaagcaggaaaugauauucaaaguaauaauuugggggcauauuuaugcuagauguggagauuaaaaggaacuugguuuuguucaggagguggguaagaaagucucuguuagugguuuggacaaagauagauggaguguggaagguguuaaaaguguaggaacagaagaguuguguauucucaugugcggaagguguuaaaaguguaggaacagaagaguuguguauucucaugagcauaggguugcaggagaugauggacaacaaagguagaaaagccagauuauggccaggugugguggcuuaugccugaaaucccaacacuuugggaggcggaggcaggcagauaccugagguugggaguuugagaccaggcugaccaacauggagaaacaccgucucuacuaaaaauacaaaaagguagcugggcgugguggcgcaugccugugaucccagcuacucagagacugaggcaggagaauugcuggaagcugggaggcagagguuguggugagcugcgauugcgcuauugcacuccagccugggcaacaggagcgaaacucugucucaaaaaaaaaagggaaagaaagaaaagccagauuaugaggggcuuuacagaauaaaagguagauuagcuuaauucuuuuauugauugauugauuuugagauggagucucgcucuguagcccaggcuggaguccaguggugugaucuuggcucacuguaaccuccgccucccggguucaagcaauucuucugccucagccuccugaauagcugggacugcaggcacaugccaccacacuugacugauuuuuuguauuuuuaguagagacaagguuucacuguguuagccaggauggucucuaucugaccucaugaucugucagccucgaccucccaaagugcugggaauacagguauaagccaccgcacccaguccuagcugaguuuuuaaaccaaaccuuuugacaccaaaugcaggcuucauucugcauuuuaggagguagauuguaagagaacaguaggagauacuacauuaauacaaauaggggauaaauauagcuucugugauacacagcaaagcuuaacuaugauugaaguuuaaaggagaaauuacuugcaaauaacuaggaauggcauuugaguuggaaccuaaaugaugggcaaauuuuggacaaaaggcagaaagggcauuccaggcaaggaaaguacggacugaucuggcacauugugggugagaaauggaaguguacauuggagauaagucaugaguuuuaagcugaagaaguuuggcuuuuuuucccccagucuuugguucuaaaacuuugcugaacacaaaaucagaugggcacauuuauuaaaaauacaaauucucgggccuuaucuccugaagauuugaauuuagguuuacaggauagccuagaaauuagcauuguuagcugugaugcugagcaggucugcauguggucugugcuuugaguaaguuaagggaauuuuuaagugauucaguuguaugugucucugauaggaucacaugggggagauuugaagaaauuagaaaacccagaguuuugaggguaggguuugauaaccagguuuaccaaugggaaauggggugggggaagguuuaaguugaagcaagaggagugcuuuaaacucuggugguaacucugauuuaacaaaugcuaggaagaccugcuuuuugcuagguccugugcaacacuguaaugauagugauccauaaaaugcacuccuagauggaggcucaaagucuagaaaaucuuuccaaauuuaauccucauaaacucccuguuaaauacgugugaaacuauuuugugccuuaauauagagaagguaacuuguccagugugcagcuagugugugguggaguuggccguaaacagguucuaaaauccuugcucuuggugaggugucucuugcuaauaucccuuuaccuuuuaauuuuaguucuuaacacauagccccuuauguguuguuuuuuacugggaauuuucaaaaauaugguuaaaauauucuaagacauuuugcaaaucaagaaauaccacuauuccuggauccuaacaauaaauuagagcucucauaaguggucuccuguggggaugacuucauaguuuaucuugacucagaaggaggacagauaacuacuggcaugaaauugaaggauuauccugcuuuaaaugaauuucaccuuuuaaguuuuacucuguauuuguguauccuguaguuuccuggguucccugauugcuuugcuugguucuuuaccauguuugccuucucugugcuaaauaaaaaaugaaguucauuuuaaagaaaugauuaauuugguauuuuccuuucuaggaucaagcgugcuuuccuuaucgaggagcagaaaaucguugugaaaguguugaaggcacaagcacagagucagaaagcuaaauaaaaaaaugaaacuuuuuugaguaauaaaaaugaaaagacgcuguauguaugacuuuuuuuuuuucuguuguaauguguuaguauacagauuuuguuucuguaugguauuuggggacccuauaguuuuuagcagauuacuuuuucuuguuuuguuuguuguuuguuuguuuuugguuugguuugguuuuuuugagacggaguuucucucuuguugccuaggcuggaguacaauggcaggaucucggcucaccgcacccucugccuuccagguucaagugauucuccugccucagccucccaaguagcugggauuauaggcaugugccaccaugccuggcuaauuuuguauauuuuaguagagacgagguuucuccauguuggucaggcuggucucaaacucccgaccucaggugaucugcccaccucggccucccaaagugcugguguuaaggugcgagccgcagcacccagccaguggguuacuuuuucugaagaaacaguugguggucacugauggccagaauuuuuuuggugacagcucuaccgcugcauuggagcauaauguccuucucuuugugggcugagacuucagggugguuugggaggaauggcccuucuauuugaaacuuuaauaucccuuugauccuuacuaugguaucuccuuuacgucagcaaguuucauaggauagaaaccuugguauucuaguuccuuggaauggaaccuuuuuaagauuguuuuuaaacccucuguucuuuuaggucacuucaguucaaaaaugguaucuuggagagcucagaacuccuuauuuaacaaaugagugagcuacuauauauaaaaccuugggucaaggguauaguuucugaucuacauuggauuuauuauccaggccagaauguuaaaauacagaccucauuuuucuugggaacuauguaguguuucugccagcucagacaagguuucacuccugcugcccagccuggagugcaaucuuggcuugcugcaaccuccaccuccuggacucaagugauucucugccucagccucccaaguagcugggacuacagguaggcaccaccaugccuggcucauuuuugguuuuuugagaaacaguuucaccauguuccuaggcuggucucaaaacuccugggcucaagcagucugccugccucagccucccagcgugccaggauuacaggcaugagccauucuucugcccaaccuguuggcugacaaccuuuuuuuuuuuuuuuuuuuuugaaauggagccuugcucuugcccaggcuggagcguacuggcucgauuucggcucacugcaaccuccaccuccuggguucaagcaauucugccucagccuccugaggauuacaggcgcccaccaccacacccggcuaauuuuuguauuuuuaguagagaugggguuuugccauauuggccagguucaucuugaacucuugaucucaagugauccgcccaccuuggccucccaaagugcugagauuacaggcgugagcccuugcacccggccaacaccaucucuuaaagccauaacaagcuuuauuccaaucugaguagagagcagagaccuugagccaucauggaaugcagaagcugaaaguaccuggggaguucaguaaauuuugacuauuuuccucaguugaggaaaauuuaccuacuaacuggcaugauguaacuacuuaagcagaggagaguuaccgcuuagcuauacauaagaacaugcuuuucuggcuggacgccgugguucaugccuguaaucccaguacuuugggaggccaaggcgggcggaucaugaggucaggagaucgagaccauccugucuagcacggugaaaccccgucuguacuaaaaauacaaaaaacuagcugggcguggugguaugcgucuguaaucccaguuacucgggaggcugaggcaagaggauugcuugaacccgggaggcagagguugcaguaagccaagaucgcgccacuguacucucgccugugcgacagagcgagacucggucuccaaaaaaaaaacaccuuuucuuaggccagacccaguggcucaccccuauagucccagucucaacacuugggaugcugaggcaggaggaucacuugaggacaggaguuggagaccacccugggcagcuuggcaagacccugccuaaaaaauaauuaaaaaauaagaauaccccuuaagguaaaaggcaaaaaaaaugggauuucauaacaccuuuacuguaccccacugccaguuaacuuguucuugguauaaaaaauuuuuaauuaguguuuugcagaagaggagucacagaacuaguaaguggcaaagcuggcaguugaacucccuuuuaagaauuuaaccgccaggcgcgguggcucacgccuguaaucccagcacuuugggaggcugaggcagguggaucaccggaggucaggaguucgagaccagccugaccaguauggugaaaccccgucucuacuaaaaauaacaaaaauuagccagaagugguggcaugcaccuguaaucccagcuaucaggagaaugaggcagaagaaucgcuugaaccugugaggcagagguugcacugagccgagauugcaccacugcacuccagccugagugacagugagacuccucaaaaaaaaaaaaaaaauuuaauuuuaaccacaguacacuugauuggcugugugccugacuccaccaaauuuguuuuaguccucccagcaacuccaacagcuuuauucccauuuuacugaugagagaacagacacagguuauagaaaacccagagccauuuguauuguugguaggauuuuugcagcuguguuagugaauaaguguaaugaccgggcacccuaauaaaugcuagcauaaucaaugauagcugggaucccuguugucaacauucauagucucaaacgauugagauacauuagcuuucuccaaacaccugccaaucccaaagauuguuaagcaaccaggauaauagaauuaauuaucuuguauaauguuuaaucacaguauugaaaauauaaaacggggauagaauugaaaagcuugaauucuaaggcagauuuacaucacuuucucaugauucaggcuuauauauacugcaccaagcaguucugugacuguguuuuauuguauuugauauaaccaucuaaaaauuggcacuuuuaauaauauacucagacaauaauguggcuuaaaacuuaaacuaauuggcugcucuguaggccagucuaguuuuugaaagguuugagauguaauuucugaaaaaauugcuguggaagagaaagccuauuugccaccccaaccugaguucuugcugguggaaggaggcuccucccucuccuugcugcuccaaguuagguagaacaacaugacuggacacaggcucuagcuggugggaacuagcaaguuucagcaaaauaugaaaugggugaccuuugagaaauguaaggaaguuaaagaauugagguguacauucuuuuccaagaauucuugguauguuaaaugguuuuacuuaacaaacagcuuuguagacuauuuggaaaguuuggaaaaauagaaugauaaaaaaucucaauuucacuacuuacuauuauuauuauuauuuuggagacagagucucacucuaucacccaggcuggagugcagugacgcgaucucagcuuacugcaaccuccaccuccuggguuuaagccauucugccucagccucccgaguagcugggauuacaggcgccugccaccacaucuggcuaauuuuuguauuuuuaguagagacggguucgccauguuggccaggcuggucucgaacuccugaccucagaauguccgcccgccucggccugcuaaaguguugggaugacaggcuugagccaccacgcugggccacuacucagucauuuuuaauaguugaauguuuuuccucccaucuuguuuuccaugaauaaaauagacauuuuaagucaaaacuggaagcccacugcauauauaaacuuuuaacuccuuuuuuucucccacauaaccccugugauauuucuuuucaaagaauauuuuaguagcugccugcaguaugaaauuuacaugcuauaauuuagacauucccuuuauuuugaacauuugggcuauuuccaguuuuucucuauuuuaaaacaugagccuucuuauauaucugauuauuucacuuaugcugaauuguuuuuuaauauucacaaguugguguugaaguucaguauuuagaagacaaagagcauugacgggugugaacauaguaacgacucuguccaagugacccaaauggauucuauaacucuucuggguuuugauuuuuguaaaaaacaaaaugaagcucuuauugaauccaguucuaugugugugacaaaguauucuugacagguuccuaaaaagacaugugaauguagucagugguuuucuuuuuaaagucuaauauuucuccuuccguugaauugcuuauaaauucuguuagaagguugaaaggguucuuuuacccuuaaaaauauaaaaucuccaaauguuuaaguaagcaaaucaaguuuguuuuagcaacuuaauaacauccuauaaucuuuaccccagugauuaagagcuugggcuuccagaauuuugauagucagggcuauguccaacuuucacuguaaacuaugcaucuuaucaaaccaacuaaaaucacauauaauccucacagaguaagauugugaagcaguucugaauguuaugauuuuucccuaaaguauauuauuuauugccgguaauaauuauucugccauuauuagguccaauagaaaaaguuggugugcuggagcuaccucaccucagcuugagagagccaguugugugcaucucuuuccaguuuugcauccagugacgucugcuuggcaucuugagauuguuauggugagaguauuuacaccucagcaaaugcugcaaaauccuguuuucccccagagagcuggagguuaaauacuaccagcacaucccuagauacuacucaaguuacaguauaugaucacuaauauaguaugcucuugguaccaggagcucugauauauaucugguacauguuugauaaugacuugauuguuauuauaaguacuuauuaauacuucgauucuguaaagaguuuaggguuugauuuuauaaaauccaaaaugagccuuuuauugaauccaguucucuaugugaccaguucucuguaugaauggaagggaaaagaauuaaaaaucuugcaaaggggaa

SEQ ID NO: 191337 - RNA, 21897 nt, Homo sapiens
uuaaaauaguuuaauaaaagcaacaaaacugugcuaacgaugagaaucaaaaaugagauauuagguagacuuauaaaacaaaguauaguuauuuuuugauuucaaauaaaccaugugcaaaauuguaaaaugccaaugugucugagaaaagcauuaacaguccuuuuagcaauuuauauauaaagauguuuuuaaagugccacagcuuaaggcauuauauuuuaaaguuuaauaaacaucuaauuucaacaucucuccaagaacagacuucuucucaauaagcuauaaacuauuugguuaggaauauugaaaaugcauguauaauuuaaggaguaauauacuuguuaaugcugaguuauuagugcaauucaaaagcauaugaauuccauaucaagaacaaacucucccgcccaagguacaguguaauccacacuguaucaucucaucuaaaaaucuauacagcagcuaccccauccacucaguuccucugcaguuaggcuauuagcuuuucuuuuucaaaaagcaaaaauuccuaagacaccuaaagauuagccuguauuucauuuaucuauacggaaagugcuuaguaauauuucuaaaaaggaaaagagcaguaugguagauaaagaauguagagucaaaaaucaaucauuuuaaaauuuuucuucuuccuaugauuauguuuugguuaagcagauauuauuuucauuuuuugagcuugcaaaagucugccuaggaaugugcuaaaucaaaggaaaaaucuagccucauguucacaauugcccuggaaugccauucccagacugagaucuaacuacacagaguauggcuaacggcagaagucagagguuagggagaucuggugucuccauuuaucuggaaaacagagcaaagaagggugaucaguuauagaaggccaaacagaaguguuuuaaguucagaauuucaucuuucguuuaauuuucaaaguaacagccacucuggaucuuuucuugcccucuucucuaucaguaugaacagcguagcugcuucucuccuuuaggaaagucagugugaggucccuggauauggccuagucuccagguggugggaguuuacauucuguuaccuauaaacagcuaaggcaucguucuaaguuuguuuaaaaugguuguuuuaaaugguaaacacaaaaguccagugauuuuuuuaaaaacuggcuuuaauggacauuaacaaauaauauacacugauuuaucaccuuuaagcaacaaaaacaugacuuguaauuauucaaauaagguaggauuuuucucuuaaguacacuucuuaaaagucauucacaagacaacugggcauccacuaagaccaaggcacugugagggaggcaaacagcacaacauccucaccucaaggagcucagccugggaugaagacagacacacacaacuccagcaugaggccaagggguagccuguuaugggaucaagugguggcagaaucaagaagugguucugaaaguguucuuuagucacagagaccaguagguuugaaacccagugauguuacuuuuuaacuuugugccuuaccuacuauaagccucagcuucauccacuacaguaugccacccucuuaauagaauuuauguaagaauuacagaaacauacaaguaaaggauuaaguguagagccagcaugaggaaagguucaggaaugugguugcucauaugacugcuaugcuuacuucuguacauggagcacugugggagaauaaaagaaagggguggucauuccuuagagcauguucucacugggggaaauccuggcaucuugagcaggacaauucuucacuguauaggacuaccuugacauuuagcauccuggucccauggcagcagaaggccaguagcacccccaucauuaugauaaccaagaaucauacccacacauuuccaaacucccucugaagggguuaccaccccugcugaaaacugcuuuuccagagggaccaucuacauuuagaaacaauuuaguucucuuaauaaaaagagagugaauucuuugagaguauauucaaggaucagaugcauugggccugguggcagggacgcuaggacaggaauguucaguauaguuugaaagcagaauccuuuccugaugagucccaguaucaaaauccccaugcucaccauucaggccuuaaguaaaaagguagagcugcaucuuugcaaauaacucaguagaaaggaauucugccaagaagcuacuaaagaaguagcaaggcucacuguuccuguaguuguaguagaaguuagacauauaaauuuagauaauaauccuacaagggauuuuuuaaaauuauaauuucuuuuuuccucaauauacacgacagaguccacuucaucccacaucuacaaaaaguaaaaacuaaaaucauaaacaaaaagauagugacagaacaagcccaaagaagcuggcauagaaucugugcugagaaaaguucucccccaguauaaccuaaauccacacccaucucugacaaagcauuccaggcugaacaccacuuucauguugucauaggucuuuaaaagccagcugauagaucuucuucuccugaaguucuucuccagaacuuaacagcauuuuagagauaucagaaaagauguaaggcauuugaccaucauuagugcugagagguagagagaagccaaguuuuauuacucucauuuuacauaugggaugucugaggcacuaagaaaugagaagauuggcccaucgguggaagccacugcaaguaaaauccagauaucccguuucauagguacuuuguuuucuaucccccaaaucacagaccugcauuacuaaaauggcugaaguauccugcugaggaauccuccaagaugaaaccucccagugugcucuacccuccuuccgaccucugagcccagcuuggauccacugaguugcuggauucacuguccuuugcaguaggaagaaucugcuuagaaggauauguauuuauauaucuuuuuaccaucucuucuuggagaugcucuucaucuccuugaaauaguuauauuaaauggauguggggcuaaaguuagaccaaaucuuccagucaggaggggcuucuuagaauccucagguaaagcaaaugcgaaacucugcauuaggcucacaaacauuaggaauaauuccaucuuugccaguuguucucccauacacacccgcuucccuaaaaaugagaucagaaaaaaaugaaggauuauaauaccaucccuucuccuauuucaaaaaguacaaauuuauaugaaauaucuaaauugaguauucuaaaugcagauggaguuuuuaagucaaauugccauauauaccacauagccucccacagcauaugcugaucagaauuuuuacauaucaaauccacauuuuaacucuuacucauaaaaaccuauccccauucuagacaggaacuagagacagauccaguguggcagcuauccugucucuucugugccuacuuaccucuuuccuccacuuuugccuggaagauuaaggcaaaaaaauucagauaagaaucccuagagccucccuuuuuccacagaaagaauucuauguuccuaaucuaggaaccuaaaagaggaacuguugagauuagagaacccauccucucacccaccagaccagaucagaaauugcucuuaaguagcucccugggaccccccaaaauuaccugaucagcucugaaaguaaaauuucuagucacauuuagagauuuaaaaccaacugcuuuauuaaaaucugaaaugaacauaggggagaugccuugucuaaauuauugaucccuucucuuauauuagcuugccaagaaagaaacauuuuuaaaacaacaugaaauaauaaaauauuauuuuaguucuacuucuuuuaaaaauuaugcaguuuaaaaaaguguaacugaccuaucccaaaaggaauaaagguuucuuuuuuaauuaguuguccuuggucauccagaaaucgauuaggguagaaauccuccgguuucucccaaauggcugggucucuauguacugaccacagguuggguaagaucaaugugccuuuaggaaugguauacccuuggagcacuaaaacaaaaggaaacauauggguguuauucaguaugcuuuuacuaguaguucucccugaacaucauuaucugaaaaaaaaauguaguuauauaccuaucacuuuaauuggcugagaccaaacugugagguacuugagggcagggauaagaucuuaccaacuggcaucccucuccccgcaccauuccaggacccaccugagacagggagcaggcagugcuccaaugaaugcugaauuaauaaauaaaaccauaaaaacauuacaaugaagagaaaacacuaaaacagaaacaauaggggauuucaaguaaacguucccuaaaaauuaaaauucccaauauguauaaaacuuaguuuacagggucauuuauguccauauaacaauguaaugaggagguaaacuaagauaaagaaauauacaggguagccaacccuggcucuuaccagcugacaagucaauaugcgcuuuaaacaaugcccaaaagauacuauaaacagucuaucuaacuuguaccaaaaaaaacccguuaagugauccaaugucauguauaagcaacggcaugcuauaacugucuuaaaacuagaucaagcccauuauacuaugggcugacuccagagguaaauucuuuguuaauagggauguuuaaagagagucuggacaugaccaaauagacagaguucacuguagaugagaggcugaaacaggugacuuuagaaaaagaugggcucuucuaacuaugaugaugaugaugaugauuauuauuauuauuauugagacaggcugucucacucugucacccaggcugaagugcagaagugcaguggugcaaucuuggcucaccgcaaccucugccucccggguucaagugauucuucuccugccucagccuccugaguagcugggacuacagaagugugccaccaugccuggcuaauuuuuguauuuuuaguagagauggguuuucgccauguuggcuaggcuggucucgaacuccuggccucaagugauccauccuccugggccucccaaagugcugggauuacaggugugagccaccgcacccagcccuuuuuuuuuuuuuuuuuuugagacagaggcuugcuccaucacccaggcuagagugcaguggugcaaucucagcucacugcaaccucccagguccaagcgauucuccugccucagccuccugaguagcugggacuacaguugugcaccaccaugccuggcuaauuucuguauuuuuaguagggaugggguuucaccaucuuguccaggcuggucucgaacucaugaccucaagugauccaccugccucguccucccaaaauucugggauuacagguguaggccaccacacccggccuucuaauuauuucauauuuaugcuucagcugcagaauuuuaaaaguugaaguaagauaauuuucaggcaaaauccuuaauccacauuuagaugagcucuucugaccuccaugaaaaggagggagaggugccuuugucaauucuggagcuuuuucugccaacauagccaauuuaaauuuugacauuauuuguuuugccaguauaauuguguaugcucugaaggcuacagaacuacuaguaaaacuaagcaguaguagaauucuaguacaaccagugaugcacagcggagggcugaacauucccuagacauuuuauuacauaugacacaaugcuaaaucuucagaaggaucaagcuagacaacagucaccacaccccucaccucaacuacccuggauuagagggcccugcuuccgucaagggcauucaaagaggaagacccuggacuugccuguguucucugaggucauaugaggaauggcaagcggcaccaccacaguuagccucugcacuuccaugaugguggcuucuguguagggcaucugggccuugucugugagggaaggagcucgguuggcgccaaugacucuuucaauuucuucaugaaccuuuucuauguaaaaagggaaaaauaaaccagaagauaagcaugggacagagucgaacgugcccuccucugcauacuuuccaucaccacuaaugcauaacuggucaguuggcaguucaggccugauucugccucagugaaguugaagcauuggucagacauuucagguagagacagcuagccccagggugccugugccacucugugacuuagaagugggauaguguaacagauagaggggccaaagagaaaacacucuggauucaggagcauccuaagucauacucucauuaugaacaugggauugacucucuaaguagacugugacaacaugugauagccuaagguggcccccaauauucccuauucuugugguuuauauccuugugcaguccccuccuacucuguaccaaguuggucugugugaccaagagaguaagggugaagugagggcaugucacuucugagaucagaguggcuccucaucuuugccacucucuccucucucagguugcucacuuuuggggaaggaagccaccaagugaaguggccuuauggaagggucacagugguaaggaacuuggccaauagucauauggauagccacccuggaccuggauucuuuggucucauucaagucugcagccccagccaacaucuuaacucuaacuucaugagaaacccuaaacuggaagucauuccuggauuccugacccucagaaacugggagauaaugccugguggcaguuuuuauaaagcuagcaaauuuggggguaguuugcuacccagcaauaauuaacuaauacagguagguauaaucacaucuauaguaggcagaauacgggcccauacaagauguacacacccuaauccccuggagucuguaaacauaauaccuuacauggcaaaagggacuaaacugauguaauuaacuuaaggacacagagauuggaagauuauccuuggucaccugggugugcccaaucuaagaacauggguuuuuaagucagauaaccuuucccuguugaguucagagucagaggaagaugugacuaugaacaaaugguuacagagaugcaacacugcugccuucaaagacagaagaaggaaaccaugagcuguggaagccagaaacagcauggaaauugauucuucuuuagacccuccagaaaggaaugcagcccugucaacauccugauuuucaguccaaugagacauauaucagacuuagaauguauagaacucuaagaaacuuguguuguuuuaagccacucgguuugugguaauuuguuauaacagcaacagaaacuaauaauacaccauccucccuguauucuucuacucugaacugccacagacuuucaguaucuauugggacuaggugguagaacuagcugugugaccuugugaaagucacacaacuucucugagccucuguucuccaauuucaaaaaaacaagauguguucagaucagcauuaugauucccuucagcucuagaauguucuucucuaaaggucuuucaugaucauagauuucacauagaaucagacgcguagagauuuaagcagggguaagcaaguuaugaccucaguccuacugucuagaaacuuggguuucacuguuaacaucuuaccaacucccuaugaguugcaaguauuuguuugccagccugaagacauugcucaguguuagaagccaccagaucacugagguugcuaauccucauuuaaauuaccugguuuugccaugaacaaaggaaacaccuauuaauuaccuuguacaucgggguucagcgacauauacagcaggcaccagagcaaagaguuaguugugguaucagucccagcaauaaagagauccccaaugauauaaaauaaguacucuucaucaaaacugcuguuacuauuauuuuuccucuccucuuccauguggagaagguacaugucuaugaaguccugaggguucucucuauccagagacucuugauggucuuugaugauuuuuuuaaggaaacugguuauauccuuuucaauuugucuuaauuccuuaaaugguccaaagggaagguaauaaagccaagggcauauguugaccaggaggacuugacuguucagacagauuucuaggccucgugacauaaaaccaagcauuuucuugaacucacuauuaguguaaucaaagcgcuggccaaagcacaaggagcaaaugauguuagagacggcauugcugaugauggagaaagggcagaaggggucuucuccgugcuuuugcauuucugcuuucacauauuugaacuccucaauaaucuugggcuccaagcuaaguuuucccaacccaaaaugacgaagaguugaaugagagaacuuccuuuguugucuccagacgggaccauaaugugcaaacacaaccccugcaaagggacaccaagaaaggaagaugagaaacaguauuccugauaacacugaacagaccuaccacggagugcauucuguauuuuucaagucacuuauggaaaauuccucauauaaauauauauauauguauauauaaagaccacuagucaagaagaaugauuggcaaaauuuaguuaucaagauaguauguguuucuaauaauaacaaaaaucauaucuaaggagaauuugcucuaaagcuuauuauaguuaguaacuccuggugaaaugaaaagcaaugaguuucauuuucaaaguuauugugcauuucaaaguauuauauuucauaagagugaauccaggcuuagaaaauuucucagguggacagguacaguggcucaugccuauaaucccagagcuuugggaagcugaggugggaggacugauugaagccaggaguuccagaccagcuugggcaacagaacaagaccccaucucuauuuaaaaaaaaaaaaaauuagccgggugugguggcaugcaucuguaagccccagguacucaagaggcuaaggucggagaaucacuugagcccaggaguuggaugcugcaguccacuaugaucaugccacugcacuccagccugggugacagagcaagacccugccucuaaaaaaagaagaaaaagacagaaaaauaauucaggcuauauauccccauguucuaaacaccuauauucuaaacauucugaacugaaggauaauuauagcaacagauugacaugagggcacagaccauaucucauugugcucaccauuaaaauccagcuucuggcauagugcuugguacauaggagagguuguuaaauauuagcugacuaaaugaauagcccaacuagauuagaacuacuggacaucaaaauuuggaaucugauaacuggcagguaaucuaaaaugucuguugucggcagcagcccugauuuuaaaacauaugaacuuguuaaggucauccacaacuacauccuauuugauuuucacuuauacaucccaccaucaaaccccacaaaauugcucccagauguuguaucaaauuguucucaaauauuccuuguuuacugucaccuauuucauccuauuuuccaugguguacucuaucauuuuggcuagcuuccuuccuucccacauuacuucugaauucuuacuauuugccaggcauggggugcaguagauacagcugcaaaugaaauaaagacccugcuccaugguuaaauuuucucauauucuuuaaugucccuugaaaaugucuuucaauguaaacauccaugcagucaaacauaccagacaauuuaucaguuccacuuuccucauuggaaucuuccaaaugucugcucaaaucugcagugguugcucugcaggccuuugguucaggugcuaugacuucuauuaguuaucauuugggaauuuucuucugugucagaacccauuuccugaauuauauuucuuccucuuuguuuuacucccccauuuugcugaagcacauccucuaguagcuucugagaaaggacgcaugggaggcgaauuucuaaagauuaugugugauauuuauuuuaccauuggacuuccucagaauuuuaaagacauugcuaagacuggacugacugauaagucauaagauauguacauauucaguaugacuagacauugcaguuuacucucugaauuggagaguacucugaaagcguguucacagaaguguuuaaauguucucauuuguucagaauaguugccaucacuugauacuugucaauguuuuaguuuugucaaucagaaggcugaaacguaucucaucgauuuuuauuugcauuucucugauuguuaccagugggucagagcagcuuuuuauacgguuauuggccagauuuccuauucuguaauuugcauuuaucuacugugcaauuuucuuuuucuuauauauuugaaaugcauagcagaucuuuuaucaucugauuuuuuaaguuucuaaaugguauuauuugauaagcagaaguuuuaaauauaguuggauuuaucaauccuuugauuugugcugcauauuuuagaaaucuccuccuaccauggguucauaaacacauucucuauuuucuuguaaaaauuuuaaauuuuguuuucacauuuaaguuucuauaaucuaccuggaauuuauauuuguguuagguauugcuaccuauugugagguaggaauccaaacauuuuuucccuauguagacaaccuauuguucaagcaugauuugucaaaggguccccacucuaccucacccuucaccaccaaucuguaaugcugucucugauacacauuuccuauauaggggugggccaguuuacaggcuuucuaguugguuauauuggucuaugcguuuaucacugugcucaaagcacauugucuuaauuacuguuacuuuauaauaagauauaaauagucuuuauaguaauuuuuauaucuaauagggaaguccccuuuucccuacaaaaccucguucuuuuuaaaaacuguuucaaaaacuucaaaaucaguuucucaaacuuauuuaggauuuugguuggaacugcauuuaauuucuuuuuccuuuauuuuauuuuuuuuaaacacagaggucugggggauccacagagcauaggaggcauuugcugaggugcagacaguggguggaggagccuaauagguggugacuggcagcuaaguugucuccugggagggcuuggguucacccccaggccccauccccagucugagacuguuugucucuggauguggccaccaagaccccaggagaggcagaauuucugcuggcagaacuuggcuuggacgcucacuuuguagcgucuaugucuccauugucacgcagauacacuucauuucuagguuaauuugaaaacugccuucuuuaugauuauugaacuuguaaucuaagaaugaaucuaaacuugcuuguuuuuaaauuucuuuaaaaaauugcuggauuuuguuucguaauguaagcuuuuuaaaaauaguauauucacgaaugacaauggcuuauaaguuuccuuucucaugcuguauuugucuugaauauacuggccuccuaaaacaagccaggguguagucuuugucucugaaagaauuugucuaaaauuggaacauguuccucuuuuccuuuagguucucuuuuuauuauaauacauaauguuugccaucugacucauuaauuuucagaccucuaucuuaauaaauaauuuaaagcucuacauuugccucugucuggguacuacucuagcugcaguucacaagucuuguuuccauguauuuucauuauuugguuuuaaguaaaaaaaaaaaaaaguuucuauuuugagucuucuuugcuaccuuaccugguuuaucuuaugcugauauuugacauuugacauuugcuugcuuuuuuacccuaguauguggccaaugaaauuucuaaauaaaguugagaagaauguuuguccaaguaauuuugaggaauauguccucucuauauguccaauagagaaagcuugauaacggucaaagccaaauuuucuguacccuuaacaaauuuuuaacugcuugaucucucaaccagauacuuauauuaagcuauuuugcuauaaugguggauuuaucaguuucucuuuacaguucuguaaguuuuugcuaaagguagauaaauaucaauguagcuauacagauuuauauuuauauauauauaugcuguuaaauacagauauauauuagaugacauuguuagguacauucaagcuuagaauucuaucuuccuguuuuuuaaauuuuuuaaaaguggauccauuuaucaugaaugcccuccuuuuucuuaacaauaaaguaucacuuagaguaccuuuugucaaaaaagaaccacuuuucuuuuuaaaguauuuucuuaguauuguaaaaccuuuucauuuugaacuuuucuguacccuuauguugggggaaugucucuuuuuuggggaagauagauuaugucucuuaaaacaacauauaauuggauauuaaaaaaauccauucuggcaagcuguccuuuagccaguaaguuuaguccucuuacauuuacucuaauuacuaauaucuaacauacuauucugagauuuguuuaucugcuuuauucauucuuuucccccuuccuucucaucuuccuuuagguugagacaaacagggugaauguucacucuuacauuuuuaacacgcuuacuuaaagucuaguugagugguuggcaaacuacagcccaaaggccaaauccauccugccgccuuuguacagccagagagccaagacuagcuuuuacauuuauaaaugguugaaaaaaaaaccaaaauguuauuuugauacgugaaaagcauaugaaauuuaaaucuuuccuuuaguguaaaaucaaggggcaaaaagaucuauuuauagaucuauuuacagaucaugaaauucgaauuucaugaucuauaaauaaaguuuaacuggaacacagcgguucaugauguaaaaaaacuaauuuguuuacauacguucuauggcuguuuuugcauuaaaauagcaaaaucugccgggcaugguggcucaugccuguaauccuagcagguugggaggccaaggugggaggauugcuugaacccaggaguuucagaccaccuuggcaacacagugagacccugucuuuaaaaaauaaaaaaaaaauuuuaauuagcugggugugguggcucaagccuguaguuccagcuacucgggaggcugaggugaaaggaucacuugagccugggaggucaaggcugcaguaagcugauaucacgccaauggacuccagccugggugacacagugagacucugucuaaaaaaaaaaaaaggaaaaaaaagaagaaauggcagcgucaaguauauaguugccacuuagaguagggguaggaaaacauuuucuaugcuaagguccaggccaagauagacaaauguccuuguuuucuuuugucgguggccaggguuguugaguguucucugucaaacuuucacccaguugaagcacuucaagaguucugucuuugucuagaagcaacuuuucauuuugccaggccauaucucuuccccaccccccaucccccagccaaggcucucuagaucaucuaccuacuauuuucugcaggggugggggcagugauaaggaccugaucuuauuuuaugugcauuccaaacuauccuuguucucagucuacuggcucauuucugucuccuaugaucacugguaccuccaauuucuaacccguuuugagauucugcaugguaaacuaggggaguaguucucauucuguccucucauacuccacuggcauuccccucuguagaugcuuaaguguagucauccuccacucuauuaagucauuugccaaucauauagccacuuugucuucagauguuguggugcagaaauguagaugugucauuucauuucaauguggauagaguguguucuucuguucaacauuccucugguaugguaugugauuguugagacaaagaaggaauggaaaugucuuaaccacuccugaaaccagaacucuccuuuuguguaauaaaggcccauaaacuauuuccuaggcuacaaaaguuuaaucauuccuccugucuuuaaccaugaccaagucuucugcugcagaguauucagaggccaaguguuggugggccuccucuucucuuggauagauauggucuuccacaccagcuucaggauuugauaccaaucccaccuacccucucucccuauuuuuauuuauuuuuuugagacggagccacacucugucacccaggcuggagugcaguggcgcgaucucggcucacugcaaccuccgccuccuggguucaagcgauuguccugccucagccucgaguagcugggacuacaggcgcaugccaccacacccggcuaauuuuuguauuuuuaguagagauggggcuucaccauguuggccaggcuggucuugaacuccugaccucaggugauccaccugccucggccucccaaagugcuggguuaacaggcaugagccaccgugccuggcccucuccuuauuuaauauaucauauauagcaucucugcuuuguccuauuuaucaaaaaacauuauuuuuccuuuguuagguccucgaucuuaucaucuaaccauuuuuaaacuacaaauuuguauuuuagaaauauuuggucuagcaaaauggcuccgaagcaaaaaucaggacucuuuugcuucagaauaacaaaaauauacccucaagcuaguucaucaaacaggccaguuaggcuauggaaugaacaaacaggaaggaaaggguauugccaccucagggaauacugucacagaacucuuccucccuguaccuauuuuucccuccucucucucugacuucauucuuuccaacugcaaaccagcuuuucaaugaaaaaugagcuauccugagaugccuauuuucccaguuucaccaccaaaaggaaaagcccucuauuuucuagauucaaccugagaaauucuggggaaggauucaaaugcuucaguaagguguccugcggugauaccaacuugagauaacuuaaauuuauuuuauggcuugagguuucuaacuaugccaugcuauucuuaucccaaaacuaugugaggauugauguauaguugugaauuguugaguucugugccuggccuacagauuaaccaguuacaaaaagguuagaaauucugaucagucuacuuuuggucaguaugucccucaacuuacuuaucacuguggccaagaaggugaguuuauguaaagauauggcaucugccguucaaccacaguuaaggguaaaagggacugaggucagaaaaaaggaauuccucagaagaagcagguauucuuguccaaggaacaggugcuagacaguggaaacauaaaaauccaacucaaaccaaauaaaguauagacuaaauugacauugauacauucucacaaacagauauuauacagcuccuaagaacuuuacaggagaauauuuaauaauaugaaaauaugcucauaauacuuuaagugauaaaaagcaauuuuuaaaauuaugaaaauuauuccauuuuaaggaggcaaauauauuucuaaaaauacauguacaugggccaggcacgguggcucacgucuguaaucccagcaauuugggaggcugaggugggcggaucaugagguuaggagaucgagaccauccuggcuaacacagugaaacccccucugauaaaaauacaaaaaauuagccagguguggugcaggcgccuauaaucccagcuacucaggagucugaggcaggagaauggcaugaaccugggaggcggagcuugcagugagcugagauuuugcaacugcacuccagccugggcuacagagcaagacuccaccucaaaaaaaaaaaaaauacauguacauguagaaaaaagacuggaaggugauacaugaaaaugucaauacgaucucagucuuuaccuacugaacagaggauguuguacacugauuacauuuacccuuuucuuccauaggaucauagaaguguuccuauuagggagaauucaggccgucucaaugugagugcauaacuauuucaaaaucauuucaaauaccuauuuuauuacauacucaguuaacuuguuucccuauucauuuucaaauuccccagaugaacuuucauuuucuguuuaucuucauuuccuaauuucauuuugcaucuuguuccccuuugagguauauaucagacugaucuaucccauacuucuaaaauucuucaaaauuucuuuuugccuucuauuuuuauggcuuuacaacuugcuuugacucuugcuccaagucuccagugauauuauccgagccauaucagguuuuaagagucaaaucaguguuucuuuuucuacuuucaugacuaguguccuacaagcacuugugguagcauaguuuguaagagcaaaaaaaugcaaaauuuaccuaauuuuuaucaacagugaaauagagaauaugauaccauuuuauucauucuauuuaguggaauacugcauaauacgguuauuuuaaauagcaaaagcuaguuagagaaagauacuuuaaguauccaacauaggcaaguuuuagaagaacauaccaaauaaagcuauguguuauuuauaaaucugaagcaaaucugagcugcagauaaucaaguuuauacuguucuuuaagcuuuauauuugaauauuuuaaaauaaaaaugugauguauacaaaccuuuuagaagaaacagaucacaugucuuacccuguuuuguguugcuauaacagaauaccacaggcuggguaauuuauaaagaacagagauuuauuucuuacaguucugaaggcugggaaguccaagaggauagcacuggcaucuggcaagggccuucaugcugcaucaucccaugguggaaggcagaaggguaagagaggaugaaagagagagagagagaaagggggccaaacucauccuucuucucagaaacccacucccacaauaacuaacccacucuggugauaacagcacuaauccauugaugaaggcagagcccucaugaccuagucaucuuuuaaguucccaucucuugacacuguugcauuagggauuaaguuucuaauacauaaacauuuggggacaccuucaaaccauaucagcacacuuaagagugaaacgcuccuuugguagccuuagcucugauuuuguaauuuucuuuucuuuuugugcuuaggaaaagaaucaaucagaaugauggacacagcaucuuuauggccuaucuaguuuacuguaguuuuuaugggcuuaagaagaagaccaccuugucuaaucaugaaauuuugaaaaauuuaaacauaaaaaauaaaauuccuacauucuggaacuuuucagcaaauguauuaagucaacuauuucuagccucucuuugcguuaugaaacauacccuucucugcuauucucaccaacuucagcagcaaaguucuuucaaaaaauaauaaauauucaauaauguuauuggccucuaauuccuaacauaauuucuuuucucuuauggccuacacaucuuguuucuggacaguaucacauuuacuccuuugcuacugggcacaguagccaaagaugguuugagcuguccucaagucuugcugagcugagcaucuugacuguagucacaguggccucuuuucuucaggcugauaaugcuguccauuucuugaucugggaaguccacucacaccucaucuguuccuucauccuuugaugaucaucuugaaauaaauucacauccucccuuuuuauucuucacucuugaaaaaguucuauuaaaaaaauccucugcuagccacacuuucuuauucagaugaucuguucuuuauuccauguuaacuccacaagcauuuacuucaugccauaugguucuugccuugcauuaucuugucaacaccuucucuagccacugaaauuucucucauuaauucuuuuacagcacauucacccaaaacauaccagagcagcauugccuaagaaaauccugucucuugggggaauaaauacuuuaguugagauacuacugaagcaccaaauugccuccaggcucccagcccuuuucuaaauagagauuuaauaguaagcagucauccaacuaaugcuuagaaaugaccuuguuauagauucucaaccaaacaguagccaccaagaagcacucugauaaacuguuuuguuaagaauuggaaacuacacuguugagaucucaaagaagaaaaccuaauuccuaccuuaagaaauccagaggaagagacagacacacaaaacaaauuacaauaaaaugugauacauacaucaauagaugcuuguaugcacgaauucauucaucuuuugguucucuauucugugccaagaaguagggauacagugguuaacaaaagaacaaaaucucugcccuaaagaaacucacauuccguugagaggugggaguggucauaggcuaaauacuugccaguguuuacugagaaaaauaugaaugagauaaaauaagaggugguacugggcauugaccaaaauagcacugaaagguaacaauuggccugagaggccugagggaugacaagcaaucagucaaguaagaaguuauuccaggcccaaagaagacaaacaucguaccuugaggcaggcccaggcauggcagaaaucagcuuagugugucuagaguaggaaggucagguugaaauguacaagugaaggcagagcuaaaaaagagaaaggcagcagccagauccuucaggccauaguaggucaaguaaggagugcagaggcaauugguuucagccagagagcuacaagauuugauucaugguuuauguaagagauacuuuuggcugcucuguggaugaaaaucuggagcggaagcaagcaggucgguuaagaggcuucuaaaguaucagcuuagaaaugaugguagcuuuagaaaaaaaagaaaaauaaauaaaugaugguagcuuggaugaggaugcugacaguagagauggagaaaaguagauggauguagcacacauaucugcuguaggagucaguaagacuuauggauugauuagaagggacugggaaggucuuaaaaugaaacaaugguaucauagaaguucaucuccuucugcaggguagggaagcaucucaggguacacauucucaaagagguaacauuuaagcccaaucuuaaaagcaagugugaaaaaaaaaaaaaaaagaaguguuggugaggacguggagaaauugggaccccugugggaauguaaacuggugcacucacuguaaaauaguaugaugguucuucaaaaaauuaaaccuagaauuaccacaugaucaaguaacuccuagggacucagauauuugcccccuucuauuuauagcagcauuauucacaauagcccaaaguuggaggcacaagugucuaucaauggaugaauggguaaacaaaaugugguauauacagucgacccuccacauuuauggguuccacaucuguugguuccaccaaccgcagaucaaaaaaacacaucuguacugaauguguagacuuuuuuucuugucauuccuuaaacaauacuguauaacaacuauuuacaaagcauuuacauuguaguagguauuauaaauaaucuagagaugauuuaaaguauccaagaggauaugcauaggcuauaugcaaauacuacaccauuuuauaucagggacuugagcauccuaggguuuuguuauucgcaggagguccuggaaggaauccccuacagauaaggagggaugauuguacauaugauggaauauuagucuucaaaagaaaauuuucacauaugccacaacauggaugaacacuaagacauuaucuaaggauuuuaaaugaguagggauaaagaucauaauacuuuaaaugccccacugaaaaacaaaugucacaguucacaccucauccacuacaugccuucguaauacugcuucuaccuaaaauucucuucugagcucaugggugccuggagaaaaccuaccugcuuuucuuuucuuuuuuaaaaauuguggugaaauacauauaaaauuuaccaucuuaaccauuuuuaagugcacaccuuaauggcauuagguacugucacacuguugugcaaccauugcuaccauccauccauagaacuuuuuucaucuugcaaaacugagacuuucugucccuaugaauuucacuacgcuaggaggcaccucauauaaguggaucauacaauauuugucuuuuccguuuaaaauccugaugcaaaacucuggcuuuaucagauucugaaaagccuagaucuuucuuugccauguuauaggggcaggaaauagcauucauuuaauagauacuugaacuccuacuauguuucagacagcaaugacucuguccuccuagaugucagaacaguggugaagacugacauccaggcccaaggucauaaaguuauguagcgucaguuuugaaaaguguagugaaggaaaagugcuugggcaagggaccugguucuaacaagggaggcuacccuacuugcagaggcugugagaaaaggcuuccccaaggaaaaggcauuuaacaccugacugaugcguaggagugacucagaaaagaagucagagaccuaagccagccaguaagacaaagggggacgguagagacagguuagauuggacauuuuauugcagcagauaacacguuuuccaacccccaaaaauguccaauuuagacucccauacgcaggaaucagaggcuaugaaccaaagccggagauuugguaauaggcuucuucuguguuuucuggacuuuuuaucuuauuggaaauuaucuucuuaaauucuuacauucgaaacccacaagguaaaaagaauauccuucccucuuucuaacaugggggccaaaguuucucuccgaggucacagcugguggaagggaaggcuacuuuuggaaagauggaaccuggcuugccaccuuguccuuccgccaucccuauuacucucccucaaucuccggaugacuuuucuacuuaugaucuuggaguaugagcaagucacgcguccgucacuacuugaugggaucuuaaaggcaucagaaaggagaagcgccgccaccaccaucaccuguuaguucaggaugcaggugugaggcagccugggggcgcgggcggccggaaggggcacaggaacugcagcccccacgcaccuggagacucauccgcggcauccgcguacccacagcccacgaccucccgcucacccuucuccuuggucacgauggagaugagcggcacccgcgggcggucgcugaagaccucggccugcugcaccagcgccucgcgcacgcuguggaagucgcugaggaccaccaccagguaguggccgauaaagaagcugaagaugcugccguacacgcgggcuaggugagccaggagcaccugcgggccuaugaccgagggaucaaucccugcggcccugguccugcugcucagccagcuccgccgccggaggaagggaggcagcagcacgugaccgaaguugcccaccagaggccagggcgugggcccgggcgggaugccccgcgcccggcgccuccgcagccagcuccagcccagcagcgcuacgaggccgcauagcagcagcgcgcccccgcugggguccagccgcagcagccccagaggcgcacgcaggaggcgcgcgggccagggcggguccucggccggcggcugcgacggccccggagacgacaugguccgggcgccggcggccucggguuccccuugcugccuggaggagacgcgcacgcagcugccugacccgcggcgccaguguc

SEQ ID NO: 191338 - RNA, 270191 nt, Homo sapiens
agcguugggucgcgguggcugugagggcggaagaaaaggccaggcugaggggaggguagagggugaaaagcucggaucuguguuuggggaaggccaggcuugcgcuccucgccggguuccgcgaagguuaaccuuggcugacuuggcucgcgagcaaagggcagcgucugagcucccggcguuccaggaguggccucuuuuguaggagcaccugaaaugcagcgucuggugcacuaagccguagcggcagcagcagccacagcgacagcgcuggggcccuguguagaagcuccaucccccuugucuuugugcuugccugcguccccagacucagaggcagguauuuggguaauccaguuuuccgugucguaguggguggggucugugggagguagaggacuaucaggagcagugaguggccccgcaugucuucagaauagauagagaaccgagcuguggagccgcuugcugauagguacugucuccaucccuagcuacagcccgccuuuccuguaaaucagguucaccugagucguuugggaaccguaggcuuaguaaucgcucugucacugccucaaaggaaggcuaaaggagguuagagaaucuagaauccgccccuccauuacucaccuuggaggcagaauuuugcuuugguuuguuucuggcccucgagguuuagucagucgucaaaguguaacacccccuugagcaguaggagaaagugaagcagaggaaggaaguuacuugaggauugucaguggcugcuuuucaaggaucccuguccugguuucuaucuauuugagacaaaaauaaccucuugagagaauguauauauaaaauaaaugaauuaguaucauuuuccuguugaagaaaugugaaauuuuauucaugauaaaaucggcgucuuuugcccuauuuuuuacuuucuuuccccauucgagucguuuaaaacucuaaguucuuugagggcacagagucugacuuguucauuauccuuugcccaccagcuggaaaaacaacugacuuaaaauaggggcuucaaaauauuuguugaaugaaugaauuuucaagcccaacugcuugcacugcuguuucccucaucuaaucucucaucucuacguuuuuuuucccccgguaguuuucuuccacucacgagguguaagugaauguauguguguguauuuuugugugugagccuuuuuauguacaaccauuuaagagguaguggaaaaagaacacugauuaugcuaauuaguguuuuaucuuuuucgaucauuguguuuuauuugguuauuuuauuuucagcuaugugaugauaaagacaucugauugaaaauaaaauggucgggcgcgguggcucacgccuguaguccuagcacuuugggaggucgaggcggguggaucaccugaggucaggaguucaagaccagccuggccaggauggugaaaccccgucucuacuaaaaauacaaaaauuagccgggcgugguggcgggcgccuguaaucccagccacucuggaggcugaggcacagaaucgcuugaacccgggagguggaaggaugcagugagccgagaucaugccacugcacuccagccuugaugacagagugagacucugucucaaaaaaaaaaaaaaaaaaaaaaaaaaucaaguaguauagcguaguaggauugaauaauaaagugcaacugucucaccuguccuacucucaguacuguucuucaaagauaaccacuuuuaaccuuuucuaauuuuaggucuguagguuaaauaauaaguuaaacuguuaauucuuuuuguugacuucuugagauagcccuaaguugaacugcuaauucuuuuuccguugacuucuagaaauagcccacaccauucacaaucuccucugaauuuuggaagagucauaaucauaauuuuuaguuuuuguauugguuacuuuauaauucaaaauaauauacguaaacuacuuuuuucacaucaacuuuugaaaauauauuugacuccuuguuugguaaaacgagaaaaguagugauucuaccuuuuucuuuaucacuucagaaacuacauuuaugcccacuuucucuuagcuggacauuuacuuguacauugucaaaguuaguaauauauuucuuaacuauaacauuugcgcuuuauucacgugccaaaaaccaauaaaaaaaauaaaauguuuacaguauuauggcuuuauaguuguuacuuagagcaaguccaagcuguaugcucugauauguuuuuuuccccagaguuuuaacuucaugaucccugugccauacuaaggagauuauuuaugauaucaaggucaaauggguuuuuauuucuuuccugccaagggcaaaauaugcuguaguugagcaugcuuuauauuuuggaguauguaauacauaguuuuuaaccguccccacuuucuuaauugccuuucugcuuucuccuggggaauagguagguggaugugcuuucuucacugaaucuucucauucuuuguaugaugcacauagaagcaagcuuccauuccucuguuugaagauuuuccccuuaaagcccaauggcuuucuguuuaauuugaacagauugcauucuaguccuuuuguauugcuccuauccugggcuuauauucauucuuggguaaauaacauuguuucuuagccccucaucuucuguuauugggcuucccccuauuucccuggaauauauccuaaggaaacuugcucacaaaaggcaagugaaagguaauuuuauuuuuuaauguucguauagcuguaaauuauaauuugcucuuaugacugauaauuuggcuguauauagaaucaaaaguauuuuccuucaacucucaauccuuccaugucuucuaacuuuuuuuuuuuccuuuuuuuugagcuggagucucacuguguugcucagucuggucugaaacuccugaccucacgugauccucccaccucagccucucaaguaucugggaucacaggcacaagccacugcaccaggcucucuucugacuuucauuauugcugaugagaaugccagucucacuuuaacuuguugauagcagaaucaguuuuuucugucugaaauguuuacaauuuucuaguuacguuugaugcuuugaaaauguauagcaguguuuaucuucucauaagcuguuuuauuuugugugagauaaaauuugauacauauuaaaacacauugauuuuaaguggccaauuuaaugaguuuugaugcauguacucauccauaaaaccacuaccaccacaaucgagauagagaauauuucuaccacuacagaaaguuccucuguuucucugcuuauucaaccccucucccccaucuacaguacuaucuucugauuuuuuuauuaauacuauaguuuagaacuauaguucuggaauuacauuuaaauggagucauacaguaugaacucuuuugugucugcuucuuucauaaacuuuauguuuuugaguauauccauguuuugacauguuuguuccauuuuuguuaaauagaauuucaugguacaaauauguuaauugauucacuuaugggacauuugcauugcuucugguuuuuagcuauuaagaguacaguuccuaugaacauacucauacaguguuuuuuuuuauggacaaauguuuucauuuuucuugguuaaagaguggaauuucugagucauaaguuagggauauuuuuaacuuuagaaaaguuuuccaaauauuuuccaaaauucuuuugccauuuuacgcucccacuagcaauauagcaaagcuccacuuccacauucucaacacuuguuacugccagucauuuaaauuuuagccauuguagaaguuaaagguuugucauugugauuuucauuugcauuucccccaauuaaugauauuaagaacuuuuucaugugcuuauuauuuucaugccuugugugaaaauauguuugugacuuuuaccuauuuauguauuggcuuguuuuauuauugaauugugguauuucuuuauagacuccgaauacaggucaauuauauacagacacacauauguuugauuuuaaaaggucauauauauacauaaugucauauguauauacagacagauguaaauaauauuucccuuuaacucgaauuuuuauuuucucaggggugccuuuggauaugcagauguuuuuaauuuugaugaagucuacuuugucaaaauugucuuuuguggcuagugcuuuguucuauugugucuaagaaaucuuugccuagccuaagguuguaaagauauucgcuuauguuuucaauuagaagacuaacaguuuuaccuuuuacgcuuaagccuauguuccaucuuagauuuuuguggauguaucaguagaaguugagguuauuauuuuuuuauaugaauaucuuuuuccagcaccauuuguaaaaaggacuuuccuuuuccuguugaacucuuuugcuuuuguugagaaucaauuuauuuuauuuaaauucuuuuaauuaugaaauaugugguauuaacacacacauauguagauaaauauagauacagagcauggaaauuaccaagcauaaugauaacaugaacacccauuaauucaccagcuaaaaacuaggcuauuacucaagauuuuugaagcuuuuuaugaauuuuucccuaaccuuaccccacuuuaauuugguaguaacccauauucugaguauuuuuuuuaaauucccuuacuuauugaauauauucuuacaauagauauaaguauuccagaauuauuuguuuuauuuuuuguuuuugaguuuuaugaaaacuggaauauuuuauguuacuuuuuucacucaauauuauauuucuaagauucaucuaugcuauuaaauauggcuauaguuugcuuauuuuucauuauguauacaggugaauaaagcacaauuuauuuaaccauuuaccuaccauuggacauuuaaauugucuccagcuuggggauauuaggagcaauaauacugccuugaucuuucuugcacagguccacucuguguguguguguguguguguguguguguguguguguguguguguguaggaguuucuguaggaauauaauagcaagauaguguaaaacauaucuagugauuuuacuaauuuacacucccacuuacagcaaauuagagauccuauuuuuccacauccuucuaacauuauguguuaucagauuucuuaauuuuugacuguccaguagauaaaaauuuuuugugguuuuaaugugcaauuccuugauuauucaugagguuguuuaucuucucauguaucuauuggccauuucucuuuauucuuuuguauaauguguuuuucuauaacuuguuuuauguaauggaugcaauaucuccucaaaucucucuauguuuguuagaguugguuuuuguguuauuuuuucauaaauuauuucaguugcuuccaaagccagauuuuuggagguuuauuucauuguuugcccuugauacuguagucuuuccucaacuaucugaugauucucagacaacucauuauuuaagagcuaaggcuuccugggagcuuugcauauauggacaggcuuauugacggauauauuuuguuuuaggauggcugggugaacagccaaaucuuagcugggguccuacaaauuccggaauugugaggaguuugcucuucucaccaguguccauagcaacuaguguaguucucaguuuguucagcuucuuuagggaagaaccuuaucuuuuucuuuuuuucauggaguguaaauaacugccaauguuguggggcugguggcagaauugacgcuucuaauuauucaacacuucacccuucugauuucaaacccucugacugcuguuuaacauuguucccgccuucucugagucugaagccucugaaucugaagggaccaaacaaaccucuugacuauuacagguuguagcuuauuucuuucugcuucacucuuccuuauauauuuuguuuuguacaaguuucuagaaaucuuucaucaccucauggccuguuucucuuuucuuccuuguuaaggguuuauacguuuuauaauauuuuauuuuuaaugauuucaguaagguuucuugucaaaguggauuuauugaauuggaauuccagcauauuuaucauuaagcugagaagggaaaaaugcagggcuuuaccaguagaaugucuucuuagugagguccauggguaaaagauuuuugugucagaagacccuuuuuuuuguuguuaugguugccuuaaugugauucagauugauauggagcaaguuuccuacucuccaggcuacuacuuuacgcaacuuuggggcaccauuuauuuuggaguaagugcaaauaggacgccucaugcuauacacauggaacaacuaucucuaaacuggagccaauagcucugucaggauuauuaaaaggauuaaagcagaucauacauuauguaaaauaucuagcauaaaaaugaaaauugguuauuuaauauuauagagccuucuuuuaaucuaguuuaagcuuuacuacuauuaauaagguccccuauucguuacuaguugguaccuauauuuccucuuuccugaccuaccucacuguaugagaaggaagguugucagugguguguggguuauucaaucuuuagguaaagagaggagccuuauuggcugggugugguggcucacgccuguaaucccagcacuuugagaggccgaggcggguggaucacgaggucaggaguucaagaccagccuggccaacauagugaaaccccaucucuacuaaaaauacaaaaaguuaacuggguguggucgugggugccucuacucgggaggcugaggaaggagaauugcuugaacccgggaggcagagguugcagugcgcggagaucacaccacugcacuccagccugggugacagugcgagacugucucaaaaaaaaaaaaaaaaaaaaaaaaaaagagaagagccuuauuaauaauaugaagaugcaguaacaaacuuccucuacucuuuaaacugucaaaugucauugagaauggaauaaucuuuucuuuuuuaugccauugaaaaucuuagaguuugauuuagagcugcaauauaaauuuaugcugaguuguuuuguccucugauauuuuagaauuuucuuauacuuugauauuuuuacugugaaguguucagguuggcauuuuccuccaaguuguauguuaaucaugcuuaagauuuggucugucuggcuuaauguuuggucuguccuaaaauucucuccuuuuccagauuaucuuagaagaccuaggacuccaaaaauguuuccccugaaggacgcugaaaugggagccuuuaccuucuuugccucggcucugccacaugauguuuguggaagcaauggacuuccucucacaccaaauuccaucaaaauuuuagggcgcuuucaaauccuuaaaaccaucacccaucccagacucugccaguauguggauauuucuaggggaaagcaugguaaguuauuuucuuuuuuuuccuauuuauguucucuacuuuguuacccuaaguuauaaauacuauauccacuaaauauauaaagcuaucaucaguaccagugcacacauguccuucuuucucucauccuuuucccccacccugccucucucucguacacuuccccauuuacuugcaaaucuaccagguaaaauucaaacucuuuacuaggcuauugcauacaaaauccuucaucuaguccuugaucuagucugugcuguccucuuucgauguauugcuuguuguuuccacuaauuuaacccuucaugccagccaagcugaguugcuuugagguuuuuugauucacauauccuugauuuuguacuuugcaauuuucucucauggauuaugcuaugcuccauucccugcaaucugagcuaagucuuuuuccuaaguucuuuuauagcuuuuaucacauuuuauuauuuucuauuuaauuuuucuccucugaggauucuuaguucuugaggauaaggaccuuuacuugugaccucagagcacucaauaaguguuuguuagcugaaugaaugaauuaacaacuauauuugaaugauuaauguuucucagaucugagaaucaggauuuuuaauuuucuuuuucagggaaaccgucuauucuuaaacauauuucuuuaucuauaugaaggaaaugaaguucuaauguuaggaacuuuagaagaauuaucuaacaauauauuuuaugauugaaaguaaugauuuuggcaacugucuucaaaugaaaagggagucaguagauuuuuuuuuuuaaacuccauuagucuuuuuauauagcagcccauuuagagaacugaauuagaaaaguugaacccuauugguuaaaaagucaguguuugaggaagauguuuacugcguuuuuaguaguguaaucagguucuuucauucuccacuuaaagauucuuaugguggcaauauuuuuaauuauuucagaauuauuuuuggaagcuuaauugcaggguaagguugcauuucuuaaaaauauuuuaaaugcauuucagugaaauguauuuaauuuuucuaacauaaaauaauuuguagacguaaaaaaaucugaaaguaaacccuauguaguuggugauauucaacuuuuucccuauaaaaguggcaauuuuauguguuucaaccuaauauuaaaaacccugauaaaugcaaacaauguuuucuuuacuguuuugcugaaaauagacuaaacuguacuuucaaguucccugguuuauuucucuuaaaauauuuacucugagaauauuuguguuuuauagacugaguagaaauuuuuuuuguaaugauaauuauuaaucguuaaaauuuauugagcguuuauauaaggcaauauucuuaguguuuuacauauuuuaauuacauauuuuaauuaacuuaauccuuguaacauuacugugugaaaggaacuaguccugucauuuuacagauaagaaaauuaaaccacagagcaauuaagucaagguucacaauuaauucauccaagggcacacgaaggaaauuaaggaaaaauggacugcuaauacauuuuauuauuuuuugaaagauuguacauguugcuguaaguguauaauaaugcaaauauugacagaauucuaaucagagcuauuccguaccauaaauacuguugagcucuaccacauaccuagugcuguaaauaguuagauguugucaggaggcuucgugagagauuugggaaagagagugguaaaaaaaguuaauugucuagcagaugauaaaaaaaaauuuguuuuuucauauugacauauagguauauacacacagacauguuaaaguauacauuauuuuauugagacuucuuuuacuguucaagguugacuuugauugauugauucugcaaauauuaguaaaugccugucauguuuggcuuaaucccucaagcaagagcauggguggugccauguugaggccuuaagggucucucucuguagggaacaaauugggaagucagagcugauagaaaccuagcuuugaagcaaaaguaauaaaggugcugaugaguugaagauuuauuuaggaaccugucuuucuuguccacugcuuugacaaacauguacacugggguuauaauaccuugguaacccuugacugauacuauggcccuccuucugcuagaugccaaauauacaaaaaugaguaacucauuaccccaggucccaagucagcuucagaaacaguagagaaaaauacaaccaugauaauauuaaauaauacaguaauaguuguuauaauaggugauguacaaugugcuaugcuaugcuauggaaguacaaagaagagaauguuaauuuugcguugaagaauaucaaggccaagcaugguggcccaugccuauaauccuagcacuuuggcaugcugaggcaggaagauugcuugaggccaggaguuugagaccagcuugggcaauguaauaagauucugucucuaccaaaaaaaaaaaaaaaaaaaaaaaaaaaauuagccaggcauggugucuuguuccuguaguccuagcuauucaggaggcugaggcaggaggaucauuugugacaaggaguuuggggcugcagugaguuaugaucauguuacaggaaagggucccaauccagacccccaagagaagguucuuggaucuugugcggcaaggaauucagggcaaguccauagaguaaagugaaaacaaguuuguuaggaaagugaaggaauaaaagaaaggcuacuccauagccagaguagccccaagggcugcugguuguccauuuuuaugguuauuuuuugauuauaugcuaaacaaugaguggauuauucaugcguccccuuuucagaccguauaaggucacuuccugacguugccuuggaauuuguaaacugguaggaguguagcagugaggacaaccagaggucauucuaguggccauuuugguuuugauggguuuuagcuagcuucuucacugcauccuguuuuaucagcaaggucuuuaugaccuguaucuugugcugaccuccuaucucauccugugacuaagaaugccuuaaccucuuaggaaugcagcccaguaggucucagccucacuuuacccagccccuauucaagauggaguugcucugguucacacgccucugacagucaugccacugcacuccagccugggugacagagcuagacccugucucuaaagauaagaaauaauaaaaaauauauauauauuaaucaaacucauauauaaaagguuuuggugggauaaaggacuuuagaccacagagcaauggcucuucugucuguuauguuuuauuugcuuacauucauucauuuugaugaugcugguagucucaaaaauuaauggauuuucaaaagauguuggccuuuuauuguugacauauuucuaggaaacaaagucuuaauaucauuauuaauuauucuuaauuuaaaaagacauuuaugucucuugauuaauuacaagcuuacuuuuuucaaaaauaauuugagacaagaugcagacauucauacaguauuuuauauauaguacaugaaagaaaaauaaucaaggugaagauguaaaaaaggaaaaaaaacuuucucuacucucugaugcuuaaugguaggucccaggaaucaaacugauaaaaggcugguuaacaggagaaaaaaacaaacaaacccagauuuaaucuauaggcacagauuucacaaagaaaugcaacucauggagguaguuagaauugaggcuuauauaccaucuucacaaagggaaauaaaguauagagaagaggguagacaaaggaagagggguuugggauuugagaaagugacucagaaaugcaugguaaauaagaauuacuuaguaaguuuguuauguagauaagagucauuuuccucuuccuaguguaggagaggauaauuuccaaauggaauuuaucaaauggaaauuccuuucaucuuuacagagggagauuuauguucugcuuagacagaaauggagagagaagagagcuaauugccuucacucaaaauccuuaugucaaagugggauauuuugagauggcauauucugauuuucuucagggagaaaggaaacagaauaagauuugagguuaguaauauuaauauuuuuuuaguuggacuauaaauuugguuguauacuucuuauaggccagggcaaagaaguaaaucuaacugcuucaaauuauuuuuauaaugaggcagcuuauuaagaaauuaauuucuagauacuuaaacguggaaaaaauaucaauuuaaagcuuuauaauguuuguacaaucuguugucuagaugaacuauggagacuaugguauagaaauuuauuugguaugaggaucugagaucucugaucugaucuuaugucuguuguuauggguuugcuuuauuguucuuuuugguguuaaucucugaacugggaagucucuguagcuuuuugucccccaccuuuuuuugugugagggagguacacugaagaaugaagagguucauaaacuuagaaaggagagcuuuauuuaucauaaggguuauagccugcagggugaccacugugacaggcugggaagcauagccuuuugugagaagcuugaaacagauacuuugagggaggggcaaagggaacagaaauuuauacugagcagaguggccaaauauacauauucaguaagcugugggaggaguuaugaauauuuaugaaaggagaaccguguguaugugcauuaaacuucauuccccuucaagccccuucaugggucccacauauaaaaaauggcaaugcuagcaucaucugagggucaugauccgaggguggaguuuuuggcccucugaugucaaagguggagcagaggacacgaaaacccuuacugcuuauucuugguagacuggccagaaccacuucaugguugguuaucaggcaaauggucucuuaucaggcaaaaaagaagggguagugucagguaguugguugauaucaguuguggaaucuuuugaaagggcugguuuuuguuaagucccuagggaagaaagccuaaucaugguuaagggggugggguauaaugagguugucugacccuaaguccuaucauggcugagaacucaguuuucaagguuacucugggguccccuuggccaagagauggucucuucagucaguugaagggcuuugaagauuauuuuuagucuauaguaaacaucuaaggaaaugaaauuuuaaguuuaaaauugcagcuucaguaggcuuugggaggucugugaaccccuucaaauuacauauaaaauuguguauguguauauacauauguacacauguguuugcugaauaaugaaaaugcauaguuuuucgcagauuuucaaaaaggauuccuaauggaaaaaaaagaaaaaagggcuuaaaagcacugguguagaguaucaagggguauggagagauuaucuucuuuacuuaaaggcuaacuugagaaguucuaaugucagguacuagacuuuucaaaauugauuugaccuguaccuaguguugcaccaugucauauauuuaccaauuaggagacccacagucagggccacuguguaggguuuugccucacugcauaaaagcuucuggauaauggaguaagugggagcugaaaucugauucucuaauuuauucuagggggaggggugcuuuuucuaauuugcuuaaagagaacugugaagacuagugguaacuauaucuaauaguagacuauagauagcuccagccauuugcugaaagcccagaaaauaacuuucagugaguuaauuuuuguucaaaaaauaauuuuuugccaaagauuuuuauuuguuaccuggcuuuagugacauuaauuagauguugaaaaauuacggggaucauuuggagcuuuuuacaucaccaagcaauuaauagauauuuucaaucccuguauacuucaacagcccuuacccuuaauccagcuacagauucuaaagaauuuccaguuguaaguuuauccuauuuccaaaaccauucuuugguugacaguacaguagaugcugaguauuaaccauggguggugaacaucuguaaauuuggcagaggccugucuuuccacacucuuuccaccaagagcccuuuguuuauucccacuguaucuggaagccucuuuggagcuucacuuuauguauuugggguuuuuuccucuguuccuaggccuccuuuucucaauugacaaaauaguucuaaagcuccuucuuuuccuuccucuaccuaaacgggccucuauaaacaccgaauuaggaacugcguuauagcaugauucucuuuggggaguauucuuccuuauuuucccugugaaccuucuuuuugauuaucaaagucgggugggaacugauccgcuuagaaacuguaaucguucuacugauuguuguucucugaggccaguucaacagcaugguuagucccguuagcccuguccacuauauugcuguuuacucugcuucccugaccugcccugcuacuccuguauuucagcagcccucucugcuaggguaacauaggucaugaauauguguaaaguuuauauauucuaagucuaguugucugaaaugaaaauauggauugucauuaggcuagggaauuugauuaucuuguuuuuauuggcaauguuuagcauucugaaaaguuguguguauaaggaauaauuuaccguuagaguaauugcuuauguaaaagucuguuuguuccaaaacauucuagucauuucaguugcaucuacuuugaaaaauuugaaguuucugaugaacagucuccuuagugaaaguauuucucaauaugaacacauauuuuucaaugguguaauaccacaugacuuugauuugugucuccucaaagaauuuugauuuugauucuacuuuuccucuuuuauucuguucuugcuaugcagauaucuugcuauuguuagucaugcccccucccacccugcauguuauuguuaagucaguaacaauugacuucuuacuuggagucacauacucuuguuacauguggucuguuuuaguaacauuauguuuucacauguuauguuagcucagaagucuagcuuucacuguuuucuauagaucauucgaaacuaaucaaagaugauaauauuuucuugcuaacucagcaggaugaaguuuuuaaucucaggaauggcaaacauuuuauuagaguuucagaauuuuuuuucuaauaggagaaaaauaucuuuaggagaaaaaaagccaguaaagccugaaaauacuauguuaacaaauuuuaucuuuucuugugagcuugaaaucucagcuguguuuagaagcagagugaagaugguaaaugguagugcauccuuuuuuauuugguauugauuauccagaaaucuuucaaugauugcuggugaaaucaagaauaaaaauuauuuuauuugaaauuaaaguagagaauaauagaauuauauggaacuacaagauaauuuauucuguaucucuagcauauaaauuuuaaucuguauuaguuucauaagagaaacagaacaaauuauauauauaauuauauaaguuauuuauguaaguuauaugaauauauaaaaaagaauugcugggaauugguuugcaugauuguggggugcugcuaggcaaguuugaaauccaugaggcaggucuucaagaaggacaagcugaacucuugggcagaagcucaagcugucauccacaguuggaauuuauuguucuucauggaagcuucaauucugcucauauuuauuuauuauuuauuuauuuauuuuucagagacaggagucucacuauauugcccaagcuggucuugaacuccuggcuuaaagugauccucccgucucagccucucauguagcugggauuauaggugugagccaguguacuuggcuuucaauucugcucuuaaaggcuauuaaacugauugaaucaggauuacccugauuaucuaggauaauuucccuuaaaguaaacugauuauagacuuuacucauuuacaaaauaauuucacagcaacaucuagauuaguauuugauugaaugacuggauucuauauucuagcuaagcugacucauaaaacugaccaucacaguguucugguaccaauacuauucuuuaagcauaauguuuuucuuuguugguuuugaacuguauaaacacuuauugaaauaucauauuuuaaaggugaugagcuagucucgauuuuuacuguuaauaacaaaagugaugcaguaaauauauuguaauaacccuuuauauuauuuuaagacauucaugauucaccucuuucucuaaauuuaaacaaaaaaaccacuacuuuaaaaaacuuuauuuuacuucccccuacuccuuauucaacuccuuuauucuugcuuaaauguguguucucuucaguuucuuaguguuaacuuuguauuagccuguuuucacacugcugauaaagacauacccaaaacuagguaauuuguacaggaaaaacguuuaauggacuuacaguuccacguggcugguggggccucacauucaugguggaaggcaaggaggagcaagucacgucuuacauggauagcagcaggccaaaaaaagagaacuugugcaaggaaacucccccuuauagaaccaucagaucucaugagacuuauuaauuaucacaagaacagcaugggaaagaccuccccugugauucaauuaccucccacugggucccucccacaacacgugagaauucaagaugagauuugggugggaacacagccaagcccugucaaaccuaaaacacacaguucaggcuagagacgcuacaucauacuuuugcuuccucaaaucuuuguuagaaguaagacuauuucacaauuauuguauauucuacucuuuaaaguucaucuuagcaucacauuauuuuuuauaaauaaugcuacuacauugaugauuuauauuuggcacauuaugauuccuaaaugcuuuauucugugaaacuauauuguuuuuauaacauguuauuuuuaaacagugguccagagauuucagaaugaagacucucuaaagauuucuuuaaaaaaaugguucauauuggaaauauuguuuugguauacacuccauuaucucugggagaaacuuugauguucugcugaggauuauggcucagcaguauuaaaacuaugcuuaauaguuccauagaaucuugaagcuuuggcaaacacuuguuuaugauguuuugaagggguuuccagaaaccugaaaaauuuuaguugugccagauacuuuggaaaucucuuauagauaugaagaauuaugaauauccaauuuaaaaugguuaauuaauggaauaugcacauuuuaauaaauuauuuuguuuuuguuuuacaugaaagucagugcuacugaguuauacugaguuuauaacgugggcauguaauuuucuacacaggacagggcucuguucagugacuguggucauaugagauucuucauuucuaauggccacaucaugccuuugcuaaaguuaauucaucuaacaguuaucuuuauauuacaugccuauauguuguaggugacauucuagacaccugugaugcaguacaccugugugcacuaggcuccugugauguacuacugugaugcaccugugugcaacuacugaugcacugcuaggcaccugugaugagacccaccucauuccugccaucauaaaauauauuaucugauaggaaaaaagauaucacaguaggccccccuuuuccucaggggauauguuccaagaaggcccccagcacccccaguggaugucuaaaacugaggauuguaccgaaucugauucuuaucagucagaacguguuucuucuguuuaugucuucuacucacaaauuuaaugccuuuuccaucuuaacuagacacuucucuugcaauguggucauaauuuuguaguuugaggcgugagagcaaaacugguaugauuuucuuuuuucuucacaauuucacgaauagaaaauuucuuaccauguaucuuaacaacugguuuuuuuucuuuccuuaucaagucgagaacuuucaccuuuucacuugaaggaagcacuuuucgucuucuuuuuuuuguuguuguuuuugagacagucuugcucuguugcccaggcuggagugcaguggcaggaucucggcucacuacaagcucugccucccggguucaugccauucuccugccucagccaucgaguagcugggacuacaggcaccugccaccacgccuggcuaauuuuuuuuuuuuuuucauauuuuuaguagagacaagguuucacuguguuagccaggguggucuccugaccucgugauccgccugccucccaaagugcugggauuacaggcgugagcuaccgugcccggccacgucuucuuuuuggcauauauuaauugcuggugagagauuucacugugcuacucagaauggcaugcaauuuaaaacuuaggaauuuuuuauuucuagaauauuccauuuaaaauguuuggaaacugcagaaaguaaaaccauggauaagguggaguuacugaugaugcuggcuggaccaaaauaagaaugcauacaaauuauuagaguugaaacaagugcuacaaaacaaaauuaaaauguagaauagaguauguuguaggacagcaaaucgauguuggggggaugagagaagugucccuugaggaagucacauuuaacugagcccugaauaaugaguaauaauaaaagcuaacaaucagcuauugcuuguuaugugccacacacuauucuaggccuuuauuauauauuaacucauuucaaccucacaacaacccugugaggcagguggcuauucuucucuucaucuuacagaaaaaaucuggcauagagagguuagaaaauuucccugaggucacauaguuaauuaguagcaaaacugggauuuggaucccagacaaaauagucuauacucuuaaccacuaugugggaaagaucauuucaggcaauaagaacccauguguaaguguccuaaggcaggaggccagaaggaagaucagugugauggaaguugguaaacuaagauaaaauaauauagaugaagcuagagagggaguuucauauucagacuucuuaugauuuuaucaguugggcuuuagugugaaaauauguuggaaagaaauaggaauuaaugugagaagaucaguuaaaagauuguuguaguuaucuaaugagaugaugcuggcugggcccagauuguggcagauggagcaaacuauauagauucuagaaauguuugagaaguaaaaauaacaggacucuguuuauuuggauuugagaaggggagauuacuguuuaguugcuagcuagagcaguugacuggauagugauaucauuuacugaaacaguauuaaaggggacagacuuuaacaguaaauuauaaguugaaguuugguugaguuucaggugacuuuuauauuaaagccuauaauauaggcuauagaagccugcaguucagaagagaguuuugggcuugcaauaaaaucucagaguuuuucagccuugggaauagaugagaaaacaguaaaaaagacccagaaucaaagguggaggaacugguagcauuucaauuuggguagaagagguaaagauuuacagaggauacugaggggagggagccagauaaauguaaggaaaauggacaaaacgugguaagaugaaaagcaaaggaaugcagcuucuucuuuugguuuucugauaauguugccugcuuuuuucuucuggaauuucacuguuguacuaaauugcuuggagcuuaccuuugcauacgcuuuucuuuguuaaguaaguaacuugaccuuuuauugcaugguuuccuuuucuuuuucuuuuuuucucauuaaguguucuuuuaaaguuaauuuucuuuaaauuccuguuaaauauuccugcucaccucucucucuagcuucaucauuugcuauuucauuuuauuccuuuuccucuacaauuggaaucuuuuaucugaaaaugauaauauucacuuauagcauuuuuaauuuuuguguuucagaucauucuguauaaucccauuucacuagacagaguaaacuuagauaagauccaagauaauacuuugcuccugcacuugacaugucugccugaacacaauuguccaucucuacuuccccauucaagaccaugccuuaauccaaucauuacugaacuauuuuauauacuagauuucuuacucugaacuuccucuuuccuaucuucuucugucucuuuuuucuaccuuggcuacuuuuucauuuucaccaaaccuucauuuuacaguuaucauuauucgcaguuucuuugcaccuuuaccuuaucuagucucagucuuuguguuuuguguuaaacuuauucuuuauuuuacuuagaaucuguuuugcauagauacugacaacacuccaacuucuuuugaaccaaacuccucaaauaaccuugucaaauccccaaaagcuuguaaagccaguuguacuuuucuuuuauuccucuuagauucauuaucaagcaucauguuagugacuuggaauaauggaugaggcaaaaaaaaguauaggcuggcccuuagaacugugccaucuugaucaguugaucuguuggaaaauaaaaaugacaucauuaauguugaucaugucuaccacuguuuuauaauauuuaaucucaacuguuguucaguugacccuugaacaacauggguuuggacugcacacauccacuuaaauaugcauuuuuuucccaaugaauuuauauuggaaaauucuuuggagauuuuugacaauuugaaaaaacucauagaugaaccauguagccuagaaauauaggaaaaaauaagaaaaaaagguaugucaugaauccauaaaauaaauguagauacuguucuguuuauguguugucaauaaggcuucaagucaagaguaggcaaauuaguaguuaaguuuugggacagucaaaaguuauaggugauuuuugaccauuuaggggguuggcaccuuuaagaacccccugcguuguucaaggguuaacaauaauucuagguugaauuucuuucucuauaguuaugauucagaucauuucuacuuuuuuucaaguuucugaaugcaauuucaaaggucuguguuuaaaaccagagugucaagcaaucuguaccuagcuccuuuucccuucuuucaaaauucuuuauauauucaucuaaucuuuuacuucuuucuuucaaugugugucagaagaagggugaguuauuuuuuuccccaaggacagucuuuccaccuauuuuuccugacguauguaagaaaaacucuagaggaagaaaaauacaagagaaaaaaauaguuauuguuuuauuagauguuuauuauccuauauacuugguaauaauguaguuaauauagaguuugaaaggcucuuuuaaaauauuguuauggguguuauauauuaauaucaucaguggagaguauuauuuuguuuuuaacauguuguauugauaaaauauaacauggguuugcuuuguuuuucucagaacgacuaguggucguggcugaacauugugaacguagucuggaagacuugcuucgagaaaggaaaccugugagguacuguauaguaucagaacaauuaaaugaaaagcagaacuuggcaaacaaaaaggcauuuuguuuaaacugcagggguuugguuucuuuuguuacuuguuuaaugauaaagguaggugcaaauuuucacuugagaaaauuuaauuuacagauuacauaugaauucaacauuaacauaguccaguguucaucuuuugugagguaggcauucucugaaauauuucacaaaaaauucuucaaaaggggauauaugaaaauuugaaaccuucuuaguacuaagcauuucacuagcugagauuaagauuauuuuccuggccaggcgugguggcucacgccuguaaugccagcacuuugggaggccgaggcgggcggaucacaaggucaggagaucgagaccauccuggcuaacacggugaaacccugucucuacuaaaaauacaaaaaauuagcuggacgugguggugggcaccuguagucccagcuacucaggaggcugagaaaggagaauggcgugaacccaggaggcggagcuuacggugagccgagauugcaccaccgcacuccugccugggugacagagcgagacuccaugucaaaaaaaaaaaaaagauuauuuuccuguauuuuuaguauaagaguggggcuucacuauguuggccaggcuggucucaaacuccuggccuugugauccacccgccucacccucccaaaguggugggauuacaggcuugagccaccacagugggcaugguggugcgugccuguaaucccagcuacccaggaugcugaggcaggagaauugcuugaacccgcggggcggagguuguggugagccgcgaugcgccacugcacuccagccugggcaaaagagcgcgacuccaucucaaaaaaaaaaaagauuauuuuccugaaaggaucacauuguaacuucaaauaggauacuuguauuccuagggacacagugaacuguguuaaauaaaggucacauuaaagaguagggagaaauauuaaucauagcuuggauagaauuuaaugauacaguuuaaaugcaauuauuucaaagacucaauaaauuuacucucuuggcaaggaaaguauguggucuaaacuuuuauuagaaauauacuauuaaaugaacuucuucacagauuucccgaagugaccuuaaaauuaucaaaaaucuuucuuaauguauaaaucaaguuguauuaaaccaauaaaacaucuugccacgaguguuuauagauuuauaauuauccauccuaguuuugaaaaauauuguuacucugacugguuaauaauuuuccauuaccacaauauucuagaugaaaaaucuuuuucaagggaagaaaagcauuuaucuuaauaaaugguaguaauuugauagaagcaaaacaaauaaauugaauaaaagugcuauuauugcuccuuuaaaugauuugguuuuggguagccucuagaaugaaaaaugcagauaucauguauauaccagcaguccccaaacuuuuuggcaccagggacuaguuuuguggaagacagguuuuccauggauggaggguggagggaugauuuugggaugauacaagcgcauuacauuuacuguguacuuuauuucuauuuuuauuauauuguaauauauaaugaaguaauuauauaacucaccauaauguagagucagugggaucccugagcuugcuuuccugcaacuagaagguucuauguggggaugaugggagacagugacacccaaagucuguugcuuauguucauucugcucuguaaucucguuuugguugcugucacugcagaaaacccugcuucacaaagauaggauguuggaaauggaagcaggcugaaaaggagugauuuugugccaaucuugggauauucugucuugacuuuaaucuagaauguauggagauuugauauugucuaguugauccucuucuagcacagaugaagucaauucaccugguuuauucacaaauggguugcggaucuauuccuucccauucagggguccuuugugguugggaaguaaugcuuaaacucuuuugaaagcugagauaggugaucugcaccaguugggagaaagaaggcccuggcucagccucuuucaaaaucucugcuaauguuugaaacaugucagaaaucccaguguucacuugccacccccauaauuccaguuuggcuuugaaugcagccacuuuaucugcgaacuugaacagaguuguucucuccugaagugacagauugaguuuguugagcagguugaauaugucacauaaggaagcaagcuuugugaccuauucugugucacugaaaugugcugccaguggugacuauuuuucuaaaagaaaucucuggaacagcucucauaacucaaaacucuggccagugauccaccuuuagaaagccaccuacuucuguguuuaagagaagacguguaugcucuguguccaucuccucacagagcugcaugaacagauaugaguuaagggcauguacuuuuuuuuuuuuuuuugagauggagucuugcucugucgcccaggcuggagugcaguggcgugaucuuggcucacugcaagcuccuccucccggguucaugccauucuccugccucagccuuuugaguagcugggacuacaggcgcccaccaccaugccuugcuaauuuuuuuauuuuuaauagagacaggguuucaccguguuagccaggaugaucucgaucuccugaccucaugauccacgcaccucagccucccaaagugcugggauuacaagugucagccaccgcgcccagccaagggcauauacuuuaaugagguugauaauuuuaaucauauccugcaaaacguuguuaaguucaggugacauuuuucagguagccggcauuucuguauggauggcacagugcauagacucacauuuagaagcaaccuuuuugaccugagaagugaaaccagaaagccguccagucaugguggccgcugugucugcauauaccgauguaaagugaccaauucaguuucucugauauuuaaucauucaaagacuugaauaguucugcagcuuugguguuuauuagcaacaaaagugcacauaaauauccucaugcauauccuccugaaaaauauauugcacaaaagcaagcauuguugcauuguugucaacaucggucaacucaucagucugaauuguguaccauggugacucauugauucuagcaauugugccucaauauccucuguuauuucaucaguuugucuaguuauggugcuagucgaaagaggaacacgugcuaccuuuugaucggcauccucuccuaaaauuucaugacagaugucuuuagcagcaggcaggaucaaaucuucaccgauaguaaagggcuucuuagcuuuagcuauguaguuagucgcuaagaaugaugcucuuagugucaacacguuugaugaagugguggcuuucaguaauuacuucaguucuucguguucauguuuuuuucuuuugaaaaacugcgaagacuugucuuuuaaucagucugcuuggucuccaugugacaaagcaguuuugaagguuuuauggcuucauuggauagcuggucgccacauagcauacaaagcauacuuggagaaugugaaucaucuguuacaaugaaccuauaauuuaaguaggacuguugguauuuucuuuuaaaugaagcuuucuuuuuguuggcagucuuagagucuucugcugucucaucauggggucuuucccccuuuuuaaagaaggucuccagugauguuugguuuuuacucauugugacuagggguuagcuuguaggcuuaucaaaacugugaccaagacaagugugcagugugggaaggaggugcagauggaagagguaaauaaaauaauaggcaggccacgugcagacuaaaauaaauguugcauuuugacuuaaagccugccaccagaugcagcuguacacuugaaguacaucaacucacuugccacucaaaagccuaccaccagauacagcuuaauugucacuugccucucacugauaggguuuugaugagucugcaaguaauugauuuauuauggucucugugcagucaaaccucucuauuaauguuaaucuguauaugcagccacuccccagcgcuagcaucacugccucagcuccaccucagaugaucaggcguuagauucuuauaaggagcccgcaacccugaucacucgcaugcaugguucacaguaggguucgugcuccuaugagaaucagugcugcugcugaucugacaggaggcagagagcucaggugguaauguagcgauggggagcaacuguaaauacagauggagcuuugcuggcuugccugcugcacaccucuugcugcgcaguccuagguacaggguccaggacuaguccaugguggggggguugggaaccccuguuguacacuauagccuuacauccuuccuuagaaaagucuaaucugacuauagguaagaaaaauaacuuuuauauguauuuagaaauaguuuaaccuuauuuaguaaauguguuuuuauaguuauaauuuuuguaaugucacuaaucuuugauuuuuauuuaaaagaauauauuauuccggccgggugugguggcucaugccuguaaucccagcacuuugggaggccaaggugggcggaucacgaggucaggagaucgagaccaucuggcuaacauggugaaacccugucucuacuaaaaauacaaaaaauuaaccaggcgugguggcaggcgccuguagucccagcuacccaggaggcugaggcaggagaauggcgugaacccgggaggcggagauugcagugagccgagaucacgccacugcacuccagccugggcaacagagugaaacuccaucucuaaauaaauaaauaaauaaaauaauauauuauuccuugcucacuaguucaaauuuacagucuccugcugcuaaaaagcaauuuucuuuaaaagcuaguugacauuaaaauugaaaaccaauuaugcccacaacuuuagguaagaaaaaauauuuuaguugagccuggguuaaauuuguguaaagauuuacaaugcaauauguaugaugaaaauaugcauuuacaaugcaauaugugugaugcaauaugcccuaacuaguuaggcauccuuggacaagucucuuaaucauuuuccuuaucuguaaaacaaggaguuuuacugauugagagaucauuguagcacaaguuauucuuaacuuaauguuuuauuuaauaugcaucauaucugauaauacaucaaucgucuuuuuuuuuuucuuuuuuuuuuuugagacagagucucgcucugucacccaggcuggagugcaguggcaugaucucggcucacugcaaccucugccucccggguucaagugauucuucugucucagccuccugagcagcugggacuacaggcaugcccaccaugccuggguaauuuuuguauuuuuaguagagaugggguuucaccauauuggccaggcuggucucgaacuccugaccucaugaucugcccgccucagccucucaaagugcugggauuacaggcaugagccaccgcgccuggcugaucaauugucuucauaaauauaauuuguuauauuuuuauagacuaauauguuaaccuacuauugcucuuuguuuaaaugguagauuucuugacagaagaaccuauggcaagucuacauuuaaaauuucaaugcuauaaaaaaggcuaaauuauuaauagaaacaucuauuuuaugauccagcaauuccaguccuaguuauaaggccuccuuaaauuuuguacuguaguacuucauuugccucacucuagucccagcucugucuagguauuuauccaagagaacagaaaaauacauguccaccuaugcaaaaagauuugcacuagaauauucccagaaacauucuucauuauagcucuaaacuggguagaacucaaauguccauggacaggagaaugcauaaacaugguacagauugauaauucuuuauccauaauguuugggaccagaaguguuucggauuugggauuuguuuuucccagauuuuggaguauuugcauuuacauagugagcuauguuguagaugggacuuaaguguaaacacgaacuucauuuauguuugaaugauagcuuauacacauagccuggguguaauuuuauguaauacuuuaaauaauuuugugcaugaagcaaaguuuacacuaaauacuuauguguggaauuuucuacuugugguaucauauuguugcccaaaaaauuuuggauuuuggaacauuuuggauugcagauuuucagauuagggaugcucaaccuguuaaucaacaaugaaaaagaaagagcuacugguacccacaacauguggauuaaccuuauaaauauuacgcugagcaaaagaagccagacauagaagauuaucgguauuuaucuucggugauagaaaaacagugcuuuauucuguuagagaguaagggguaauucaagaacugauucaaaauggccuugagggaacuuuuuaaggggaugaacauuuuuguaucuugaucagauauuaccuauaugguguaugugugucauaacuaaaugaaauaugcacugaaaauguauaauauaugcauuuuaccuauguaaauuauaccuuaauuuaauuuuuuuuuuugagacggagucucgcuuugucgccccggcuggagugcggugguacgaucucagcucacugcaagcuucaccucccagguucaagugauucuccugucucagccuccugaguagcugggacuacaggcauacaccgccaugccuggcuaauuuuuuguauuuuaguacagacaggguugcaccguguugcccaggcuggucgcgaacuccugagcucaggcagucugccugccucggccucccagaguucugggauugcauaccuuaauuuuuuuuuuuuuuuuuuuuaagaaaggguuguugaguuauucacuuggcuugaguucucaaucccucauagagaaacaguauuguguuguuaaugaagauguuugagccacugacuuuuuuaauuuuuugguuuuuagaagaaagaguaugaauuaguuauugcuuaacaaguuaccucaacacuuuguggcuuaaaacaacaauaaaaauuuauuaacucauauaauuccuuuggaucagaacauaggaauagcauaacuagaugguucuagcucaaggucucacaagauuucagucaagauaacagcuggaccuccagucaucuguuauaaaagcuuuucuggaguugggugaucuguuucuaagaugguuuacuuauaaagaaggugcuaguuguugacaagaggcuuaauucuuuucuacauugagggccuuuccacaggccucuugacaugcucaaagcauggugguuggcuucucucagagugaacaaucuaaggaaagaaaacaagguggaagcuacaguggcuuugguaaccuagugucaacaaacacacacuguuauuccugcaaugcaauauccuguuaguuuacacaggucagccauuaacuguauucuguguuggagaggauugcucaagaaugcacaugugaauuucaugagucauggcucauugggggccauccuggaggcugacuaccacaaaugucuuagagaccauacaaauacuuuugaaaaaacacuccuacaaaacaggagugacaugcuaaaucaauauuaaugcuaacugaaaaauaucuggaauucuuaaaauuauucauauuuguuuaaaguauuugggguagaaaaaagaaaggauuauacacuaagaauaggggguagaguauuaagggaauauccagaagucccacaggugaaauagggucuuuauggacauagcuaugaucagaauugcuauacauccugaaaauugauguuauccauggucuugugcucccaaaaguuccagaacaccccgaaguuccagaggaccccauaagccacaaagagagcaguccucuggucaucaguaugguagucucuuaucuccacauuucccccucugccuguauaugguccuucuuuuacuugguaaaggaacugaggcgaaagaaguuggugauucaaaagauaaauuuccguuuucauuguuuuaccucaacucuauuccacccccaccccuccugccuuuuuguuuuuuugagacagguucucgcuuugucacccaggcugcuggagugcaguagugcgaucacugcuuacugugaucgcugcuuacuguagccuugaccucgcuuacugugaucgcugcuuacuguagccuugaccuccugggcucaagcgauccuuccaccucaaccacccuaguaccugggaccacaggugugcaucaccauacauggcuauuuuuuuauuuuuuguauauacaggggucucauuauguugccuaggcugguguugaacuccuaggcccgagugaucuucuugccuuagccucccagguguugggauuacaggcacaggcaugagccaccaucccccaaccuuuuuuaaaaauguuuuugaacuuugaauuguauuauauaaggauacaaucaauauugcuuugccaguaugauuaaaucauuagcucaugaaaaguuuugcauuucugugcuuaccauuuuuuaucuuuguuugaaagacgacaaaucuuguggcaaugaacaucagugguuucuucaaugauuuugcuuuugucuucaugaggauaaaauaguguagauggaagcacauucuuugaggauguauauuaacaugaguaggauuaaaugcaaaauuuacaugaucuuuuaugccaguuacauuuucuuuuuucuuuuaaauagaacauauaguagccuuaacaggucuuuccauuuuuuccauugagauguauuuaagcauuuguguaaauaaaguacuauuuuuaaauuauucugauaauagacuaaaagucaguguuuucuuuguacauuuuggaauauaacauucaguacuuacugccuuuuaguaggaaugauccuuuuagguucaguuccaaguuguuaucugauccauccaucuaaauuaauuuugcugagaacuauuugacuuuuccacauauuuggauuacauuagucuccaguaacagagcagguauauguguagaguugauguacugcaauuuuaaucaauuuuauaaccuguuuauagaaagugagaagauguucuuaagguuuauaaauuaguucuuuccuuuacuaccaaaaguaagcaccugcaccugcaagaagggcugauguaaacaggaaaccuauuuagaugggguugcaacuugacauuugugauuuuuacuuguuccuuugucuauaacuguugcaaaaccauaagcugccaguugucuggucguaauuugcaguugauuuucuaaacauaagcaucauucaaagcauauaucuuacuugauauauauuuugaagaaaauuuuaaauauuugguaagaaauuuaaauuuaaauuuuaaauuuuaaaucuuuggugggacagggaucaggggaaugaaaacuaggaauuuagagaagagucugugucaauuugcugacuuuuuuucaugaccgauuuaauauugaaugaaacaauauuguacugaaaugucauaguaguaauuugcuacuacuaugggaauaauuacaauuuaagccuaucgugaagcuccagaucucacuagaaaaucaaacguucucucuuaguauuaacggccguaaaacccuuuugagaauuuauauuauaaaaggagaacauaaguuuguuuuaugagguguuaucaaguuaguauuuuauagacuaauguuauuuguguggauaguuggcuaaccugguuuaaaggaaaaaaaauauucaacauuuucuuuacaguccauucaggcuuuaauauaaggaauuaauuuugagacagcugcugucuuuccaguggcuuuuauguuaucugugccauaguucaaucuugccagcauuucucuucaguuuaaguuaaaugaucaaaauuauuuuuugaaaauauaaaauugucaaauuaaauuccuauagugauuagguuucaagaaaaaaguacagcauuuagauuuguuugaagucaucucacauuuagugccuauuaaucuaccuaaugcuacccuaaagcaagauucaagagacugagaaguggagaaauuuagaucucaacuccucuuugaaaugcuuuccagagaauauuuaaaaaacagauauaccuuuaucacugcuaucaaagcaggcaugaggaaauuguuuuucuuuuaagucuaggugcuguaugggaaguauuucccuuuuguguuagaauuauucagagcauguacuuuugcuuaaccuaugaaaguaucagcaaauguagcucauggacagauauucagcagaguuuuggcacuuguaauagaguuucuacauuguguuaaguuugcaggugaaugcagggugggcaguagagccauauuccuuuaacaaaauguaguuugucacguuuuuaggguuaugguuuugaaaauuuaccagaauaccauuaguauugcagaaguuauacgugaagacuuugaugggaagcagacuaugucugcagcuguuuacuagccugauggaaaacaugaucugacuuacucaaauuagugaguuuuauuuuccccuguuaaaacauugccuacucacugaaugagauacucgaaagaauuuggacacauucuggaaugugguccagaguugaauaaugagcuacagguuguaguaaucagaaauagauguuagauauucuuauuuuauaauauaaacugauaauggaucuugaggcuuucauaucuuuuuuacuuuugaggaccguaguuucaaaaugcauuugaaauuaugguagugaagucaugugaauuagagauuuauauaacugaucuauaauucucuuccuguuuuacauguuuuguuuaaagaaggaaaauaauaccgaaagaugcucuacauuuagacuuguuaucuugcaacaaacuuuugcuuucugccucucuuguaccuuauaucuuacuaauugccaaguguuguuaauacaaacuuggcaauaguucucacauaucucugucuuauacauucuuuaguuuaaaucuucacuaacaaacagcuuggcuauugcauuguaacguucuaacuggucuuccuggcuucagccauacuucaguccucccacuuuuucugcuauguuaauauuuuugaagaucaguccauucucuguucagaaacacuuggagguucuccauuucuuuuuuuuuuucccccagaggaaaaggcaucuuauuagcauaggaucugacuucaaucuaauucucucauuaaauaacuccaauuacuacuacugcuucucuaaauauuacucucuaacucucuuauuauuuccaaugugccuaaauuguacaauuaguuuuaauuauuccuaauacacauugaggagagugaaugccaaaauuuugaaauuuaccauaaaaacugaaaugucuuuuugcucaacccuguuaucuccaaucuuuagugcaauguacagcacuucuucaaguaauacaucuuacuguuucccuucguacucuucuucucaaccaaagcaaaaauuauauuuuccuccuccaaaugccuauauuauacuguaacccucuaguaguaagauaucuuucccccuucaggcuuauaauuguuagucuacaguuauagaauuaaggaaggaauuguuuaucuucucuaguuaacguuuuugacauacauacuguaauuuauuuauugucuccuaaaguuguaaguauaaaaguuuccauuuaguaaauauguggcaaauggacuauugaaugaaugaauuauacuuuuagguuagucauggaguuugaauauuucccuauuaucuuuuuuuuuaaucaugugcuacaauuuuauuucucaaacaaaugaauuuuggugaaaguaugaugcaaauaugaauuucuuuaugauauuccuagaaauguuuuuuaaaaauaaaaugauaugguuagaggaaaugaacucucaauuucuuuucuuguggcucuggggaagaauucuucucuaagcugauaaagguuguuggcagaauuuaguuccucgcaauuaauuuuaggacugagguaucuguuuucuugauuacugugacugagugcugcugucagcuccuagaggccaucuacauuucuugucauguguuucugucuccugcugcccugugaagagauucccucugccaagauuguauguuuccugaggccuuuccagccaugcagaauugugaaucaaucuaacuuauuuucuuuauaaauuacccagucuugguauuuguagcaaugugagaacagacuaauaaagggggucaauaaagaaaugaagaaggaaauugaaaaauuucuugaaacaauaauggaauggauaaugaaaacacaauauaccaaaaccuguggaauacagccaaagcaguauuaaaagggaaguuaacagcuauaaucaucuacaucaauaaaguuaaaaaaaaucaaagaauauaaugaugcuuauucaaaaacuagaaaagcaagagcaaaccaaucccaaaauuaguagaagaaaaaaaauaauaaagaucacagcagaaauaaaugaaauugaaacaaaugaaauaauagaaaauauuagugaaaugaaaaguuuguuuuguuaaaaaagauaaagaagauuuacaaaccuuuagauagacuaagaaaaaaaagagaagacucaacuaauaaaaucagagaugagaaaggagacaucacaacugaaaccauagaaacucaaaggaucauuagagacuucuaugaacaacucuaugccaauaaauuggaaaaucuagaagaaauggauaaauugcuagacacaugcaaccuaccaagauugaaccaugaaaaaaauccaaaaccugaacagaccuauaaccaguaaugagauggaagcuguaauaaaaagucucccagcaaagaaaugcccugggcuagaggacuuuauagcugaauuccgccaaacuuuuccagaaaaguuagugccaauuguacucaaacuguucugaaaaauaaaggaggaaggaauucuucuaagcucauucuacgaggccaauauuacccugauacccaaaccagaaaaagacacaucaaagaaagaaaacuacaggccaauaucccugaaaaucauugaugcaaaacucccccacagaauacuagcaaacaauacauuagaaagaucauucgucaugaucaagugagcuuuaucccagggaugcaaggaugguucaacauacgcaaaucaauuaacaugaugcauaauaucaacagaaugaaggacaaaaaccauaugauccuuucaauucaugcugaaaaagccuuugauaaaauuccacaacccuucauggugaaaaacccuuaacaaacuagggauauaagcaacauaauaaaagccauguaugacaggcccacagcuauuaauagcauuauacugaagggggaaaaacugaaagccuuuuuacuaagaucuggaacauggcaaggauacccacuuucacuacuguuauucaacauaguaccagaaguccuagcuagaacaauuagauaagagaaagaaaucaagggcaugcaaauuggaaaggaaaaaguugaauuauccuuguuaacagauaauaugaucuuauauuuggagaaaacuaaagacuacaccaaaaaaaaaaaugauuagaagugauaaaugaauucaguaaaguugcaugauacaaaaucaaaagauaaaaaucaguaacauuucuauaugccaacagcaaacaagcugaaaaagaaaucaagaaaauaauuccauuuauaauagcuacaaauaaaauaaaauaccuaggaauuaaucaugaagugaaagaucucuacaaugaaaacuauaaaacacugaugaaauaaagaggauacaaaaauggaaauauauuucauguuuauggaugggacuaaucaauauuguuaaaauguucauacuacccaaagcaaucuacagauucaaugcauucucuaucaaaauaccaaugacauucuuuacagaaauagaaaaaacaauccuaaaacuuauauggaaccacaaaagauccagaauagcaacagcugucaugagcaaaaagaaugaaacuggaggauucaaauuuacugacuucaaauuauacuacagagcaacgaaaacagcuugguauuugcauaaaaauagacacauaugcugauggaacacaauauagaaaccagaaacaaauccuuacauuuacaaugaauucauuuuuaccaaaggcgucaagagcauaaauugaggacaggaaagucuuuucaguaaauggugcugugaaacuggauuucuguaugcagaagaaugaaacuagaccucugucucucaacauaaacaaaaauucaaaucaaaauggauuaaagacuuaaaucugaccucaagcuaugaaacuacuacaaggagacauugaugaaaacucucuacuaggacaucagucugggcaaagauuuccuguguaauaccccacaagcauaggcaaccaaaacagaacuggacaaauggcaucacaucaaguuaaaaagcuucugcacagcaaaggaaacaauuuaaaaagugaagagacacucacagauugggaauaaauauuuguaaacugucugacaaggggcuaauaacuagauuauauaaggagcucaaauaacuuuauaggaaaaaaucuaauauuccaauaaaaaugggcaaaagauuugaguagacacuucucacaagaagacauacacauggcacacaggcuuaugaaaaggggcugaacaucauuuaucaucagagaaaugcaaaucaaaacuacacuaagauaucaucucacuccaguuaaaauggcuuuaauccaaaagacagacaagaauaaauguuggcaaggguguggagaaaaggaaacccuuuuacgcuauugguggaauguaaauucguauaacugcuauggagaacaguuuggagguuccucaacaaaacuaaaaauaaggcuaucauaugauccagcagucccacugcuagguauauacccaaaagaaaggaaaucaguauaucaaaaagguaucuucacucccauauuuguugcagcacuguucacaauagccaagauuuggaagcaaccuaacuguccauuaacagaugaauggguaaagaaaauaugguacauauacacaauggaguacuauucagccauaagaaagaauuagagccugucauuugcaaccacauagaauaaacugaaggucauuuuguuaaaugauauaagccagggacagaaagacaaacuuuacauguucucaccuguuuauuggaacucauggagauagagaggaugguuaccagaggcuggaaaggguaguggggcuguggggaugaaauagggguagucaaucaguacaaaaacauaauuagaaugaauaagaucugguauuuaauagcacaacauugugacuauagucaacaauaauuuauuguacaucuuaaaauuacugaaauaguauaauuggauuguuucuaauaccaauaaaggauaaaugcuugagguaauggauaacccauuuauccugauaugauuauuacacauuguaugccuuuaucagaauauaucauguaccacauaaauauuuguaucuauuguauaugcacaaaaauuaaaauuaaaaaaauuuuaaaaaaucaucuguguguaaccucagugaugaauuuuuacaagguucauuuacugacuauauuuucuguauucaaucaguuccuucaguuagcgaggaaacuucaguaaauugacucagguaggagauuaguaauuaggaguugcccugacuucaaaggaacauuuugaauuuuauuuugugguauugucuauauccauaaaagguauagaaaaggucuauauccauuaaauuaacuagucuaauuuccuguugggaauuaucugaagagcagaaacuacugaguuaauaaauaauaaagugugaggguagaaggauuacaacuaaauaagcacuuggaauuaggcuacaagagacucagagguuuuuuuuguuguuucauuuuauuuugucuuuuaucuuuucuucuuagcuauauuuuauuuuuuggguuauugcaauagaguuuacauuaugcauccuuaaaauuuauaguguuuuaugaguugauuauacccauucacauauaagauaggaaucuuauaaugacauacuucuauuuacuccucucaucuuuuggguaguuuuguuauacauuuuauauuuacuuuuacauauauuauacauuucaccauguaucuguacuauuuuuggcauuaaaguuucuuuaaagacuuugagaaaugaagaaaaaauucuuuuccauuuaauuauguauuugccauuucaugaacucuuuuuuuuuuuuuuuuuuuuuuuuuugagacagaguuucacucuguugcccaggauggagugcaguggcacgaucugggcucacugcaaccucugccuccuggguucaagcaauucuugugccucagccucccgaauagcugggauuacaggcacgcaccaccaggccuggcuaauuuuuuguauuuuuaguagagaugggguuucgccauguugcuuggacuggucucuaacuccugaguucaggcaauccaccugccucggccucccgaaaugcuaggauuacaggcaugaggugccgcgcccagcccaugaacucuuuauuucuuuguuuugauucaaguuugauauccuguccuuucugccugaaaaacuucauuuaguuuuguacuuuuuuagaucaagucagauacuuacaaauucucacagauuuuggucaucugaaaaugccuucauauuaccuuauuuacuuuuucuuggcuauuauuuuaugaaaaaaugcaaauaguaaaauugaaauaauuaugcaauauaccuagauuuucuaauuaacauuuuaauuaaaacuaacuuuaacuauuuuaacauuuaauuguagcuaaauuuaacccaucuuuauuauuuugauguauuucaaaguaauugcugauaugaggacacuucauuccuaaauaguuuagcauguauacaacuaacuacauuucaauauguguuuauguuuuaguuuuagguuaaauuuacauuuggugaaguacacaaacuuuuuaaguuuacauuugauguguuuuuacaaauguauacacuuuuauaaacuaaaugcauuaagacuagauuaccaccauuaucugagaaauuuuccucaugucccuucccaguaaaucucugcaccuccccuccugcaguuuccaagcaacuacuuuucugauuuuuuaaucguggguuaguuuuguuuauucuagcacuuuauauuauuggagucauucaguauauacuguuuuguguaagacuucuuccuucauucagcauaauuucugagggucauccaugugguuucauguaucauaguucauuuguuuuuguugcugaguuguauuguguuuuauaaauauauuuguuuuucaauuuucucuuguugaacuucuuggcuauuuucaggguuuuggcuauuaugacuaaagcugauauaaaugcccuguuaagucuuuuuuuuguggccuucuguuuucauuuuucaugaggaaauacuuugagcagaauuguuguguuauaggauauuaaucauguguaugacuaauauuuuauagaaacaccauuagaccuuuuuccaaaauguuauaccuuuuacauauuuucaccaacaauauauaauuucuccacauccuuuccaggaguugaugcuuuuagucuuuuacuuuuagccauuuguacaagguauaaaguaguauuucguuauagauuuacuuugcauucccaugauauucaaaggauauugaguauuuuucaugugcuuauuagguauucauaucaucacauauguauuuguucaauuuuuugucauuuuaaguggauuguuucucauuauugauuuguaggcauucuuuguguauucucuauauucuacauacauauuguuagauuuuuuugcaaauauuuucugccucuuuggcuugccauuuuauuuuauuuauuuauuuuauuuuauuuauuuuauaauggagucucacucuugcccaggcuggagugugccuggaacugcaccgccuccuggguucaaguguuucuucuaccucagccuccugaguagcugggauuacaggggcccuccaccacggccggccaauuuuuguuuuuaguagauaugugguuucaucauguugguuggccagguuggucucgaacucuugaccucaggugaucaacccaccucagccucccagagugcugggauuauaggcgugagccacacugcgccuggccaggcuugccuauuuuuuaaagauauauuuugaugagcagaaguuauuauuauuauuguauuuagagauaggcucucacuguguuacccaggcuggucucgaacuucuggguucaggcaguccuccugccucagccucccaaauagcugggacuacaagugugugcuacugcacccagcuuaaaaguuacaguuugugaucaagucuaaugugucaaauuuuucuucugugguuacugcuuuuuauauccuguuugagaaaccuuugccuacuccgaagucaugaagauauucccauauuuuauucuagaaucauuauaguuuucgauuuuauguuggcucuaugauucaucucaauuuaauauuuguauauaguguugagguuacuuuuucccauacugauauccaguugccuuaccucugaucguuuaaaagaauuuucauuuuugauugcauuccuuuggugccauuauugaaaauuaaaaggccauauaaguauagaucugugucugagcuuuuuguauuauuucauugcucuauuuuucuguuccuaugccagcaucauaacaucuugaugauuauagcuuuauaguaaaucuucaagucaguaaauauagauuuuccaauuuuguucuucuguuucaagauugcuuuagcuauuuuugguucuuuguauuuuuauauaaauuuuauaguaaguuucucaauuucuaaaauuucuguuggcaucuugauugagguugcguugcauguauggaucaauuuggaaagaacugauaucuuaaaaauauugagucuuccacuagauuaacauguuauuucucuccaaauuuuuaagucuuccuuaguaucucucaacaguguuuuauaguuuaugauguagaguucuugcuuuacuuuuuaaaaauuuuuuccuaaguagcuuauguuuuugauaugauuguagguaaaauuuaguuuuauuuuccaauuguuugcugcuaauauauagaaauaugugaauuuuuuauauugacacuuucucuguaacuuugcuacauuauauuuacuuauuaguugaaauaguuuuuugguggauuccuuaggauuuucuacauaaacaaccauaucauuguugaauagaaauguuuacaacuucuuuuuuaaccuuuauggcuuauauuucuuguucuugaccuauuucacuagauaggaccuccacuacaaugcugaauacaaauauugaauggucaauauuuccuaguuuuuuaucucagggaaaaauguuaaguauuucaccauuauauacggucuuagcuguaagguuuuuauauaugccuuuuaucagauugaguuagguacucuuauauuucuaauuggcuaaggguuuuuaaaaucagaaguauuuaauguuguuaaauguguuuuugaaucucuauugagacuaugauaugauuuuucuucuuuaaugaauauguaaauugcuuugauuuugaauucuuuuuuuguguguaugugugacaggauccugcucugucauccagguaugaucauagcucacugcaaccucuaacuccugggcucaagcaauccugccucacccucccaaguagcugggacuacaggcacacaccaccacaccuacauacuuuaaagcuuuuugguauagaugggcucuugcuguguugcccaggcuugucuugaauuccugggcucaagugauccucucaccuuggccucccacagcacugagauuacaggccugugcuaccaugcucagcugauuuugaauucuuaaaauugagauguaauucaccuguuaaaaauucaugguuaugaaagggaaaauucaguggcucuuaaagagccacuucacaagauuguacagccaucaccauugucuaauucuagaacauuuucaucacuccaaaaaagaaugagcagucccucgccuucucucuccccaccccuggaaaccacuaauccacuuacuuccuguaugaauuuaccuacccugaccuuuucauauaaauggaauuauacaguauaugacuuuuugugcuuagcuucuuucacuuagcauaauguuuuuaagguucguccauguuauagcauguauuaguacuucauuuauuuguauugcuaauuuucuacuguaugucuuuaccauaguuuguuuauucauuuauggguugauggacauuuggauuguuucuaccuuuuggcuguuaugacuaauuuugccaugaacauucauauguauuugauugaauaccugcuuuuaguucauauuggaauggaaauuuuaggucaaaugguaauucuauguuuaccucuuugacaagccauuuccaaagauagcccuaccacuuacuaucccacuagcaaugcacaaagguuccauuuaccucacauccuuaccaacauuuguuauuuuucaucuuuugauuguagacauccuaguggguaugaaguaguaucucacuguaguuuucauuugcauuucccuaauauaaacaauaauguauuguucuuugucccaaguuccuggcccagagcuucaaaaacccuuggaauuuccugaguaauaggauugacuuguuauucaugauggcuucuuuaagccauagcugaguauucugaugaggugacacuugaaagccucuagcuucaggaugggggcuauuucgaaagaccaaacaugugauggaaaguuggaacauuuuauuaguuuucuauggcuacugcaacaaauuagguagcuuaaaauaacagacguuuauucucucucagcucuggaggccagaauucagaaaacuuacuguguuggcagggucacacccccuuuggaggcuuucaauaaaaauccuucuguuccuuuuccaguuucuggugccuguuggcauuccuuggcuucuuuggcuuguggccacaucacuucaaucuuugccccugucuucacaucaccuucuuugugugucuucucgucuaugugucucccuuuuauaagaacgcucgacauugaauuuugagccuaccuggauaauccaggaugauuuucucaaaugaaaacacccuuuuuccaaauaagguaacauucagaggugccaggggugaggaugugcacaaaucuuuuugggggccuccuuucagacaagcuaaccagcaaauaaacaaaagauacauacucuaaaaauauuauuucaaaugcagaaaagauuuucuguuagauuucaauucuacuugcugccccuauaaacaaaguucauuuucuuuagaaaagaggucaggaaaaaaaguuuuauuuuguuguuucaaagucauugcugugaggcauauaucucauaugauuuguauaaaaauuuauuaugucuaagauuuagauaucccaguuaauaucagaucuuuucaagaggaacuucaucuuaaguuguauuccuuuuacauuuuguuguuauaguuacaauuguaaagccaaggguugaauuuucauccauuuauccagacccagucuuuaauuuagucacaaaguuugugacuuaaaaaucuguauauuacaaaagguggauagaccuauuaaagggcuauacuuauaguagugguugugguaugguuaucuuuaucauugcuauuauuuuaacuguuacuguagguagguagaaauaccagguuauucaaugggaccuacuagacuauucaguuaagugaacccauaauugggauuuaaauuuuaaacuuuuacccuguacuuacccacgcgauugguuugcuuugcuuauauucuauuacaucuuugcuauaugcaaaauacccuuaacuguaguuaaaaguuaaagaggccaggcgaggugacucuugcuuguaaucccagcacugugggaggccgacgugggcagaucacgaggucaggagauugagaccauccuggcuaacacggugaaaccccaucucuacuaaaaauacaaaaaaaaaauuagcugggugugguggcaugcgccuguagucccagccacucgagaggcugaggcaggagaauggcaugaaccugggagacggagcuugcagugagccaagaucgcaccucugcacuccagccugggcgacagagcaagacucugucucaaaaaaaaaaaaaaaaaaaaauuaaauaaacaaugacuuuggagcugaguaagccuagauauuuucuuaguugaaaaaaaaauugucaucagcgucaaaagaaauuaaguugaugaguucuuucuaugaacuuauucuuggaagagaaaggaugaugggggcuauacacacauuaagaaacguauguagcacggaaagaaaccaauauuugaguaccuacuuuauaccaggcucuauaagcauguuauauuuaaacuuuaccacauagcuguacuggcgguuauuauuacuucauuuuaaagauuaagaaagauacuuagagguuagaugacaauuagaaaaagauagcccagggguuuaaacuuuguucuguuuaaaucuaaaaccuauuaucuuuguucuauacuauaccuuccuguauaccugaaagugaaacagguucauuuauauucgccuucuacgacagcgguucucaaagugugguucaucaucauuaucaccugggaacuuauuagaaauauaaauucuugggacucaucuuagauacuauaucagaauugcagggaguagaacccagcaguaucuauauuaaugagcccuuaaggugauucuguaccauugcuuuugaugaaagguucuuaaaauucuuccauuggugggaaaccuagaaaucaaugugcucuuuguagaacaauaugagauacugacuuauacaacuuaagaacaguuguuuuuuuguuuuguuuuuuuuuuuuuuugggacaaagucuugcucuaucgcccagauuggagugcaguggcgcgaucucagcucacugcaaccucugccuccuggguucaagcaauucuccugccucagccucccaaguagcugggauuacaggcucccaccaccacacauggcuaauuuuuguauuuuuaguagagaugggguuuugccauguugguuagucuggucuggaacuccugaccucaggugauccuccugccuuggccucccaaagugcugggauuacaggugugagccaccacuguuaagaacaguuuuaaaguauuugagcuaaauuagcuaccaucuuauagauucugguugaaauaagugauugcagauauugcacaagaaaacaacacacacaggagaaccuaaaauuaagaauccauauuuauuaauauuauauuuuuugugaauugguaaaagauaacuauucuccaauuuuuacacaguauuccugggucauuaugggauuauauggauaagagcuuuuucuuacucuuuuuugugaagcuugcuguaauugguaugaucuuccuuauaucauaguauugagaacugaaagucuaguucaagguuaggugaaauagacagaacuaacuaauucaaggugaucugguuuagggaaaaguauuuauuuauauagguaagcagaacucagaguucuacauuaaaauuuggagacaaagcuuuggcuauuaaaguauuauuuugcuuugucugccuuccuauuuaugaaucauaggaagcuuauggagucuaguagaaguaguuaagaauaaaauuuggcuauuuuuggauuuucugaucuaaauauaaucacuguaucaccccaacugcugacaaauacaagggacgugguaaauaggguuuuuucagcaaucauacuggucauaaguuacuuaagacagaccaauacuuauuuaacugaacauuucaguuugacaaacuuuuguuuacaauaugcugucuugcagaugcuguaauaagcaauccauauuauucaggcccucucccauucauuauuugagauggguagggugauaaauuagucaucuaaaauauuaguccacuuaaaaaugugaauuggucucaaaucaaaauucugaacaguaauagaaauuuguuucucuuuuuuucacauggcaauauauacauuaauuuuaauuuaaaaaacaacuuuggaaugaugcaggguacagauuuaacccacuauaugccaugauaaguucugucuuagagaaaaguugcagucuuccaacaucccaaaugcugccaggguauggggaguuggacuuauuaccuaguguguuugcacagccagaauuagugacuaugaugacaaaagagguuuugaaguuucugugcaaggauaggaaaaaaugcuuaggagaagaaaacauugauggggcagaaauaugcagccaaucuugagauccuccagaccuguguaucaaauggugauuuuauucucacagagaaguuagaaaacgguucuucugauucaguuaugucaggagaauaguuggagaacucaacuugcaauuuuuguuaauuuauaggauauauacauaugauauaacaaaauauauuguauaguuucagaaaaacccugggauuuuugagggagacuuggacuuuuuguuuauuuuguuuugcuuuuaagaugauuaagauucugugcagggccgauagcucauugaucuccauuuagcuucuguuugguguuacauuuuuuacuuuauaaauuugcaaauggaggcagggugaaguuggaacacugucuaagcauaacaaaucagugacagagccuccuggcuuuaugucugaaccucaaaccgcuagacuauguuuuccauauguauuugauuuuaccaaguuaauuuucugcugagaagaaaaguuaucuaguauucaaguuggaaaguuaauuucccaauuuauugucuccuguugagaauuagacacauuccagacuuacaggguucuauuuugauuauuuuggaguuaaagcuaaauuguaaaauaugccuagucucacaacugaaagucagauggacugauuacuuuuuuuagacuuacuauaaaacaaucuuuagguagcaguuuaucaaugcaauuuccauuucaaaacaucugaaucugaggcaaauacauucuuaaauuuagcauggauaguuguguccuuucaggcuaaaacaugugugcccaguacugaaauguguuauuuccuuuuucaauuccagaaacuguuguauuuuucauccuuuuugcucuguuaaauauugugguauuuuuuuacaaaacaucaaaauuuaguaagugauaagugucaaauuaaaagccucaaagacacuagcucaucauuggaaacacccuccccaaauucuggaauuauaaacuaaugagucuuuaaaaguuauauacuagcugagcucuuuuguguucaaguuauaaaggaaaguuucuuugaagauagcacagaauuauucacuuguaauauuaucugaacauuaaucauuaguaagcauuuuauuuuuccucuccauuucuuaaauuacacaguagcuaaccauuaauauauuucaucuguauuuccucucucuuaacauuuuaauucaggcugauaccaaguaaggaauguuuuagaccaaaaggaaaauuucugugggagugaucagguuuuauaaggugaaagaacaucuugaacucauagaaugcagaaauguguuuccucccuugguuagcugacacuauggguguuuuggcuuguggaguggcccuuagaaauaucauggaucauggaucugaggaaauagcaugugugguuuuaguuaucacuuauacaugaaugauuuccaaaucuaucucagcaaccuugaccucucauucucuuuccuggccccuauuucuugcaauuugaguaacaucucuucuuggaaauguugcagauaccuaaaagagcugaugguuugaggccaguaguaaucucucucaacaauuuagucuaauuuacaguuuuagacagauauuaacaagauuauccuguuacccaguauauccugauuuauuccuguuucuuucaguaaauaaaagacuagaagaguuguauuuucagcaaaugaauuuuuuuuguggauagccauugggugaacuugagcaucuuguguuuucuugacuaacuaaaagauuauacauucuaucuugagguguuauucuauuagugguagagaauuuaauuaucuuucccccuuguaccauugugugauauuauuuuauauauguauuuuaacaccuauuuuuaauacaugcuuauugaacaugcacauuacagacacugauagauauacggagucauaguugaauaagcuaguccauacucaagauacagugggaaagacaagcuuauauagaaauaauuaccauaaaaucuagaaacccucaacuguguacugucggaaaucaagaaagggaguucaauucuaccacaagggagagccauugaaugagaacccauuaaggaucuuugcaaaaaauuauugaaauggcaaaccauaucugucagaauaaagaaugaugucaaaaaggggccacuuggcugggguaacagaggaggcuuagagaacagggaccccaaggucuugaugagcuuaaagaguggguccucaggaaugaggaacagagaaguauaggagguaguaguuaaaaauuuggauguuuuaaguaaauauagguugugcagugucucauugugacagacuaucuguauuugggaguauuggcugggguuagaugaaaaccuguggcugugaacauacgaagucuuccauucugcuuaagaauuaaauccaugaucuuggccucaguauguuuuaaccaacaacuagagaugauuuauggacgauuuaaucaugaagacaguaaauugccuuugaaauauaucuggaaagggauaaaaaaauauacuugggauuauaccaaccuaauagauuugaaaauuuauugagccauguugaaaauccaaauacaaccaaguugacucauaccuagaaacuaucaacaucuuuuuuggugaugguggugguggugauaguguuuuucucuuuuagauuuuaagcuuacuuucccaagauuuaugacuuuuguaggucucuuuuggucucaccaauguuauaaguaaauuuuuauguuuuauuuuucuuugaagacaaaggaaaaugaugaauaauucuuaucugcuuaguuaauugcuuauauuauaauuaucaguuuguaaaucuguccuucuaaguauacuauaggcuuguuuguagugcagaucaauucuucuucuugguaauugugggcccaaaaauucaguaacaaacaaauagccacucaauugauauguuuuaauauaaguaaaaauguccucaaauguaaucuugcuuuauugggaguuaucaauuauauuauuuugaaagcuaccuuuuggucuuaucuguauuuauaaucacuagggauucuuauguucaguuguucaggacaaugaugacaaaguaaacgcuagccacccaggcccugaaguaacaauaauuacugaaaaaugucaaaaggaguagaauauuuuuugauuuaaaguauaauuuuacauuuucuugguuacugacggguuugucuauuuaacaagauucucacuugggaauuguguaggauaaagucccauuguccccugucaguaucuuuuuuauauaacugugugaaucuaauucucuuaauccuaaaucuucuuuuaguguccauguucaauuaaacuguaacauguuaacuacuacuagacauaugauaguuuuacuuugcuguugcauuagcuacuuaaaaaauuucaugacccaaguuauugguaguauuaaagaauauaacuuaaaaagcuaguaaguacauaaaauucugcaaauacugauuuguucuucucaugguauaaaauagcauuuuuuguuccucuuuauaccuuacauuuuaaaacaaauuaaaaaaucaaauucugagaauaugaaaggacagaaaagcaaaucagauuguaauugacauguacucucaaguaauagcuaagaaacgguaugucauuuauguuugaauuuuuaaaaauuauuuugguaugcauguucaucagcucauuuuuaacaugaaugugcuuuuugacaugcaagucuaaugucuaauagcucacaauuagcaaaagcacaguauagagaguagaaaaugcagucuauguguucaguaguuucagaacuuguucaaugggaaaaucacuuuaaagguuuggcuuuaauuucaugagaaagacaucuauauugaaguaguaugcagcugagguccucuagugucauagcugaauauggcaucaguuuuuugugaguugugugagaaacagacaagaacaagagaagcuacucuaaaauugacuuguagagccaaaugaguucauaaaacuagguuuacauuuugcuaaucucagggaauguuucucuuuuuuuuuaaggggaagacuuuguuuucuuucaugugcacauauuuaucaauguaauugugcuuuuacauaaaaucuuugccucuauaacuauugauaaguuacaaauaauuuuuuuuaaguuuggaauauugccauuuauacaguuaguuuauuuuuugaagauguuuaugaaaacucuguuuaucccaaauuaugcuuguuucacacauucccuauuuguuuaagacucagugauauggcacuuuaauaugggagaaauuauuugauaaaaaggaauauuuuacagucaauuuaaauagcauucuuuauaaauaguaacccucauugcuucuuuuuuacacacauuauggggaauaucagcuuauuccuuuacuucaaaauaugacaaccagggaucggauuaccagagguaauauuugagguaaaaaaauaguucgagaaaaacagagccuggagaugggguggagagggaguacucaccauagaggaaaugaagauaauacucuuuucccagaauuaaaagacuucuaacuauucucagagauacucaaaggaaugauguauccauaaccaaagaacaguaucuaucgacaaggaacaacuagaggacauaauagaaaugcuggaaauuaaugguuuggauuucucucacucucucucugucucuuucccucuugcucucucucucucucuuuggaucucuggaucucucucucuccuggaauuaaguuauauaauagauaggacuaaagauuaugcucuuaaaacagaaaguuaauacaacgggaugacuguagucaauaauaauuguacaucuuaaaauaacugaaaguacaauugaauucuuuauaacacaaaggauaaauacuucggggggacaccccauuuuacauggugugauuauuacucauuuugugccuguaucaaaacucauguaccucauagauauauauaccugcuauauccucaaaaaaauuaaauuaaaaaaauaguuccaguuaucaucugucuacuaagaguuccaacuuagagaaaaagagagagaaaacagugaaagauguagcaaaucaaauuuuccuugugaauauuucuguguuaauggaacaugugagucuucagauugaaaguacaugcuuaaugaugacuggcacaaauaugcccacauuagacauauugggcugaaauauuauaacucuagggauaaaguaaaaauaauccucaaaacuucccagggaagagugacaggaugucugcaacaaaguuggaaacagacugauacuagccuucucgccauuaauaaagaaugcuauaagacaauggaguaauucuuuccaaguuuaaaggcaagaauaagauauuuucagaugcgccgugcaugaaaauauucuacucaugcucucuguaugaaacaauuucucaagaugucuuauagcuaaacaaaaaagaaauuuaaaaauaguaugagauauaaaaauuauaguagcugaugauaaucuucauaaauagaguuauaaaauuaugguauccguuaaaucuugaugacugagacauuuucucuugacagcuaggguuuaaguggccuagguuucuauuucuuucugugcuuaguucuacaguaaauauguguuaaucauuauuaucauauggcaaugugccaaucacuucccaucuuucucagaguaaaagcccaaaggucuuaaaguggccuaaagggccuuacgucuucugacucauagcuaucucucugagcuuaucuccugucacuuuaaucuuugcucauucuacugcacgcacugaauacacuuuugugagcugcugacuuuauaccaguucaggacuugcuugcuguggccucugcccgaaucauacauuuuccagagaccuaccugucuuuuuuacuucuuuuagauuucuacauaagugucaccucagugaggacuucccugaccacauuaucugucuucccuacuucauuuuuuuuucuucauuuaaucacuacaugucacauuaucuauuuacuuauuuguuucaccuuccagaaaggaguguagguuuccuuuaucccacuuacuguuugauaauguaaaaacaauauaaugaauacagauaagaaguuugggaagaaaauuggggaaguugugaaaauaugacaacuguauccucuugcagaaugaagaguuaguuauauuaaguaaaagucuaccaccagaauugaaaacuaccugcugaugauuauuugauaauguaaaauaaaauuuguuaauguaaaacaauguaauaaaaaggacuugaggaagaaaaauaggaaaguugugaaaauacgucaauuauauccucuugcauagugaagaguuaguaaguaaguaaaaaucuaaccaccagaagaauugaaaacaaaaccugcugauucccucuggaaagucaaacuaggaucauagaggcaaauuuuagcuuuuaucucugguuauuucuuuugguuuuaauuucggagagagaaucagguugcaacaauuauuuuuguaaaaauuuuauucaaucuaguauuuuuuaaagucaggauuauuaagguauaauuuacauaccuuaacauuuacccuguuuuauguaaaguuuaaugaguuugauaaacaaaauuauguaaccaucaucaaaaucaaggauagaacaguucccucaugccacaaaacuuucucauacucuuuuguaguccaccuaccccccacccaagcccauggcaaucuguuaguccauuuuuuaacuuuuaaccuaugucuuuuauuuagugcguuucucauagacugaguauagcugaguuuaaauucuuaucaaaucugacaauccuuauguuuuaauuggugaauugagaccauuuguacuuaaucuauuagucauuuucuauuuguucuguucuuuuuuccuuuuauucugccuguuuguggauugaauauuuuuuauuauuccauauuaucucuacuauugguuuuaaaaauuauguuuaguggcuaucugcaaacacuaauuuaauuuuagaaaaauuuaaaaaaaauggauagaaaggaaaauguuaauauuguagguauggggaaauuuccuaugugaacaauuuuugauuaaaacauuagaggauaauuaauaaagcuagguuaauuguaugugaguauuacauuugucuuaugcucugagauuugaacuuuucaaaaagaaaaggaauguugacaagaaaauauuuuaaugcaggcaccaaugucugcaaaugaacaauccauacuuuauaaaguguaauaauaaaaauuaaaacauguuccaaauccuacuuacuacugcuaaguagcaguauuuacccaaauacaguaccuguuuccugauaauuugcaugaguagacuugcaaauuggaaaaaaaauuagggagaugguuggugagagagacaaggagggaaaaggagaaggaaacuggaggauaucugugugaaggauggcuuguagaggauaggauaagaauuaaagagaaaaguuugcuaaaucauaaaugaccagagauugcuuuauagguugaauauggaaaauaagcuaguguuuguauaccauaaaauauauuguuacuacuuuuuucgggggcuuagguauuuuguauugagcaaaauaguuuuuagugacuuaguucugccauauacuugaaacuuaaccugauaauuuggcgaagccaaaccugcuauagguuaguugcacucaccaccaaaauuaaagcccuuucguggaagaaccaaauacugcuauuacaguagccuuuaggaaacuguaggaucuuugucagauuaauucuguuauaaucagaaaaccuaaaauauguagagguagauauuuuagaaaauauauagauucuauuuucucagaauaaaagaggagcaauaaaaauauaacuuuuugaauauuuucacuaggucacauuucacuuguuaaaacaaguuauuuauuugcuuuguaauugaucuuugacuuuuuguuuucuuuguagcuguucaacgguuuuguguauagcauuugagguucuucagggcuugcaguauaugaacaaacaugguauaguacacagggcauugucuccucauaauauccuguuggaccgaaagguaauuguuaaaucauguaauaaauauuuauauaucauuugaaauuggaagcaacugggaucagggcuacucagucagaggaacaauagaaucagaauauguuuuaagaauauucauaaugaaaagucuauaugaaagugauguaacugugguuuuugaauuuaaggauuaaauaauccuuaaauuauuuaaucuguauaucuuucacauggauuauuuuucccacaagacccauuuucuaacuuuaugguuuuuuuauuuuacucuuauuucuaaagccuuguggcgucccaguauacuccuccucuuaauuuauuuucauuuuuaagaaaauggcucuuuuugcuagaauguuauucauauaaaccaacugcauuguguuuucucuauuuuucuucugccuucuuuccucuucuauuuaucuccuuauuuaccaacuguucaugccuaccuccuuuuacuauugaagugcuguuucucuacuggaaaucuuauggggcauuaagaagaagcuuguaaacccuucaaagagaauuauggauaguaagguuauauauuuucaggaauaauuguaauuugauuccuuuucauaaaauacauaaaaacaacuuggaggaaauuuuuucaugggcauuauuugcuguguuaggauuauccuuguucucugguucuuuucccaaaucaauacuugggaggcugagaugagaacauugcuugagcccaggaguuugaggcugcagugagcuauaaucacaccaaugcacuccagccuggaugacagugugagacccugucucuaaaaaacaaacacacaaacacaaaaauagaaaauuguacucauuaguuucagauuuauggcaguaaagaaucauuaccuuaucaauuuaagcuguuuuuaaauauaaauauuuuauaaugcuuggaaauaauguucuugagaagacaaaccaauuuuaagaucaacuuaauauuuuaaagccuuauagauuaaaagggaaaaacuuaaaauauguaaaauuauauuuaucauuuauuaagagccuuauacuuaugauaguuauuuuuguucucaaacaauauaaaaaguuauugaaaaucuagcagauucaccaaaaucuugaugauuuuugaacugaucuuuucaaguuaaguuuuccuauuucacaguuaaauuauaacuauaaauggacuuucaacuccauggaaaaaaauuugcucugugaaaauuaccacaaaacauucuaaccaagguuucaagacagaugagaauguuuuugccuuuuuguuuugugaaauaacuagacaauguaacagcaaaaauauuaaagaaaaaugucauuugucauuuugagauauauauguguacauaugcauauauacauauuuaaugaguauaaagcagacuauuggcagauaguuuuuuauaaaauuaugauuuuuuaaaaucuacaguggcauuuugauaaaauauuguuauauaaugguuucuuuaguuauaaaauguauaaugauaauuuuauaauauaaauuauauguugccaauuauaauaaauuauuugauaguguuuuuuuucuuuauuaucauagggacauauuaaauuggcuaaauuuggacuuuaucacaugacagcucauggugaugauguugauuucccaauaggguaaggauauguuuuccucuauuuugaguuucuuuuuaacuuuguaaucuuugauaacauguauauuuuguuaauuauauuugauauuccuuuuugauaugcaaacagcuuuuuuaaaauuaaugcaucucaauuuuccauauacuuuuaaaaugaguagacaaugaguuuuucccagcauccucguugauguucaucauucauugaauuggcagagaagcuaacaguauugacauucuuuacauuauaauauuuccuaauuaucuguauuucauucagaaucaaaucaacuuaaggcaagaaggaugacuagauucucaacuaaugauaaugugugugcaucaagagacugaaaaacaucacucucacauuauuuucaauuuaauguuuuauguuuaauucccuuuucucuaagauauauauuaagauucaaguugagucauuguggauauuagagauagagauaaauuccauaccugaaagucuauguuuaaguucagaaagguuuauuuaaucacuucuguuauggaauugcagauguauguugcccuccacaaaagaaauggaagguuguuucaugcauauucaaguagauguuuuugauacggauuucuguguuauauuugugugguugcuuuuagacauuuucauuauuauuuucuuuucugaagauuaaguugagauuguuuuagauaaaauaguuacaaaaauaguauaaagaauuccucucuacccuucaucaguuucuccaaauguuaacauuucacuacauuugcuuuuucucuguuuuuucuccgagcauauauguguguauguguauaaugauuguuuuuuauaaucacuuaagaguaauuaauuacauaauagcacuuuaaccuguaaguacuucaguuuguauuuucuaaaagaaggacuuuguuuuuuuacaugaccucagaacaguugucaaaacaaggaaacuaaacuugaugcaguauuauuaucuaaccuagagacauuaaucauauuuuuucaauuguaaugugacuguuuuugauaguauccauuuguguuuuccucuuugggcuuccuaaaaucaguucuaucacaccguuacugagaauugugauauggagucauggaguguguuuuucaaacagaauguuacucaaaaacuuaauuugauuuuuuuuuuaaagccagccucauauauaacuugcccuuuuuucuuuauaacucaaauuacagguuucuuaacuaaauuuuuuaaguuuaugacugugucuuauuauuaagacauagauaauaaucuuaaacuuuauucagugaggaaacauuuauugagcaauuucucuuaugccuguugguuuuacaaaaauaaauaagauagcuuucuguccucaagaagcucauuguuuagugggagaauuuucuguuuugauggacugcuuauuaagguacauaaauucguagucuuacaguuuuguguauugaaaacuuacaggcaaaaaccaauucuuguuucauaagcaugaaaaugguauuuugcaaagacagucuacaauuucuuauuuguucaaaaaagcccuuucgaauaugaaagggguuuuuuauucaacuuauaguugaauauaaguuuuuagugaggcucuagcuccuuugucauguaugauaaaugccuuucgaggugacuuuuaaguagcuguaguacaagugauugcugcugcuucuuuugucuaaaucaauuuguguaagaaagaaauccaaaaaccuaaaaauuacuuuaaguuuuugauuuuuauuuaaagguacuuuagguuucagugaugaaucgaagaaaggaggugauuuuucuuaaagcauaucaaguaagagcuacacuugaauuuaaaaugcuuggauagaauuggucuuguguuacccuuuggucuggcuugcuuugaagucuuagacccaaagggucuuaccagaaaauaucaaagagcaaaaugugaaacauuagccaggaaaaauaaagugaucaaacagcuaaggcaugaaagaaaauauuuacaccagaagaagcuugcaguugauucaaaagacaaauauuaaggaacaacaaaguaaaauguuaccaucuguuucaaaauacuguaaagaguuggaaauugggcauucauuucaguuggccaguagcuuaauaccuuauuaaaacaucaaacagaugaugaaagccacuuuauuuaccucaucagucauacucacagcaaaguucugguaauugucuuugaguguuaaaaugcuaugcuacagaagagaaaguuguugaaaaaagaugaacuacauuaaauaacaauucuagagcuuauuauuuuuuaauaauuuuccugugauuaaaagggaaacuaaaauauuugaaacaaaguuuaucucuguccugucagaaguuuuugauauaacaauuuaccuguaguuuugcuugauuuuucauuauuauuauuuuuggguuagaugugcuggaaaucaggaaaaaagaugaaaacugacuucuggauguauuguggugaugauaaaaguauaccauugcauuuguauuaaauuuuuuauuuuuauuuaaugucuauauauucacuaauauuuauaacagcuuugugacguaggcaguaauauuccaguuuuacagaugaagaaacccaaaucacauauagaauaugugguagaacugaaauuagaacacagguauuauaacaucuagucuagugcugcuuccacuagacuucagcuguuucuagagauaucacacauucauuuggaagagcaguaucaucuuaggguaaaauaacacaauacgaauuuguauaugagagaaauacaugagcaaaucauaagaagauacugguaucaccaucaucauucuauuaaaaugaaaaaggaguuaaaaaacaaauuuacccauuugaauuuaagucacauucccugacuuaauugacuuguauuuugaauguaaauaagaaguacuagcaaugauagugugaggagguagcuguagaaaagguaggaagaaaaauagaaauaauauuugaaugccuacuuaauauauauuacauagaugauacauauauuuaaauacauuuugauuauacuuaucauuguaagaggacauaauuuaaucuaacugguuuuaaaaucuagauuguggugcucaugacuaaaucugacaauaaaugacgaaagggcaugcacauauguaauaaguauggcaaaauuucacuccaugucucuucuaaaacgguucuuauuccuuuuauuucuaggcacugggauucaaauuuagcaauugcuccuaugucuaauucuuauuuacuaccugcuucuuaaauuguuguuuguaaggccauccuaauggguauuuuuuauaggaauuuuuuuuuuaaagcaaaacuauacugaguauauccucuauuuaagucucauugguaguuguagaggguuuauaaaaagauacgcaagugcccucagguauguaguucuuuuuuuucuaauugagaugggagguuaaauuuuuguaugugaaauauauaguauauaaaacaaacauguauagcaucauaccauguauagcuuuuauaagauauagaacaggcaaaauagguacuuuauagaaucaaaucagguauugauggcaguggcggccugucugggauggccacuaccaugaugccggcugcaguguggaggaggugcugcuggggcugucacuucacggagccuaugggggccaggagcaggcaggagccccacguucccgggcacaguugcagcugccuaaguuggugcugcagacccaggccucccugugcucuugggggccggaagcaggcaggagcccugcucucccaggugcagcuguaggcucggaaaugucuacucccacugccuggccucucccggcucccuguacacacucugaucuuggagcgauguuggggucaagcccaggugcuguuggaccccggcugggugugugcacacucgaggcagcacugacacuccagcccccugcugccuugacucccuguggacuucggacaccaacaagcaagggagggagucugaaggggggcugagggcagcucagugcuggcgggcaggcgcuccguggcacgaauagccugggcaccaugaagagugacaggagucagacagguuccuggguagaagggggcaggucccuggugaagcccugccuucaagcccaggagggccugaagcaugggagaugggcugcaggucccguggaccugagugggaacuuguggugcuuuuucugggcccacccauggccgcccauggaccaauggacgugcacuucuucccucugaggaccauaaaaacccuggacucagccagacuugagcagaugauggauggccagcuguagagaggagcuacccaccccagggucuucucucugcugagggcugaaugcucauagggacaccccaccugaggggaaaagcuauccacccuagggucuccucucagcugaguguuggacacuccuugggacacccugccaguggagaggaacuacccacugugggucucuuuagguguucuauagcucaauaaaucucuucaccuugcucacccuucacuuguccauguaccuuauucuucuuggaugcaggacaagaauuugggaccugccaaaugucagagcuaaaacagcuauaacaaacagggcugaaacaaccccuugcuugccacauugcggguggcaaggaaagaagacagaaggagagaggagcugcagcccuuuggggagcccagaccuaggaacuuucugagccagggcugugacacucucuuuggggcucugcaguuccuggcaucuccaaguuuccgggcacaaccauguucccuggugccagccauggaagcugcuugcaacgcaccugguccaaccacagccuugcaggaagccagugccuaugccagcaccuggaccugcuugccaugccacagccagugugccuggcugugcacaguggccagaccccacacucacucauacaccccuugccacgccaugccuggcucucccuuggccgcguggcauccaggccaguagcacgagcugagcacagccugccaguccaaguggauggaacgggcccagugggucccagcaaaacucaggcaaaggcaccacuggccacagagguuuccaccugacaaagugacaccacaaaaucccgugauauguuccuuuauggaaaaaauauaaaucuuuuugagagacauuauagaagaccuaaauaaauauggagauaucauguuuauagauuguuaggguuaguauuguaaagauguuaguucucuacaaccugucuuuauaucuuaucuauuuucaauaaaaauucaguaugugaaagagaagauacuuggcaagauaguuuuaaaauguauguagagaagaacaaacaccuacaaagagccugcauuuucccaaagagaaacuaaaagguauguauguuuugagagcucuuaacaauuuucaguaauuauuuaauaaaauauauuuuauauaaaaauauuuuauuuaaaauaguguaauaguauacucuuaggcaaauugaccaaaugaacaguugagggagccaagaaacaaaccuauguauguguggagauuugauuuaguauacggcuggcacuacuuggggagaaagagguuucaauaaagggaacagggcucaauugcuuauuuauguaggaaaauaaguuguaccuugucugacaucauaugaaaaaugaauucuagaugaaucaagaaacuuaaauauaaaaggcuaaacugaaauuuugagaaaauuaacagauuauuuugacaaaaucauuaaguauaaggaaaaaaguuuaauucaacugaaagauaagaacuucucauucauaaacagauaccguaaagagaaagaaaagacaaaaccacagagugguagaaaauauuucaagucauaauuacugaagaagacauuaguaucuggaguuaaagaacaacugugcaguaaaagauuaucauaggaagccuaagacugcuauccuuagaaacuaaguccugcuagcaauguuugcccuuggcuguugccuugaaacuuggguugcagaaauguccccauggaugccuaacugcugaggcuaguuuacugugcuuguaaacaaccaaagugguuuaugcugaacacuugcuuuccuucuugaguucuugaauuuuuguacaugccaggcagagagugccugugugacaagucccaaauaaaauccuuggauuuucaaugagcuucucuggccagaaacaucacauaacauuuguucuucaagauuggaaagaaguuaaaaaaaaaagaaagaaaagaaaaugaaagauacaucacauacguggugcuauauuuuuguugcuggaagaagaauguauucugugugaucccugauaggagggagagagcauaaggaagccuguauauagguuccuggagacucccucucuaucuuugucccuugugauccagcuaugcccuuacuaugucacuguaauaaaucuuagcugugaguacacuuauuugcuaagucuuguaaguccuucuagugaauuucuaaacaugagaguggucuuggggaccccaaaacaacuagagaaauaagcgaaagucuugaaugggcauaucacacaauaauaaacccaaaugacuaauaaacauaugaacauaugccucaaugucauuaauuuucaaggaaaugcaaaguaaaaccacaauagauuuuauauaccagauuguuaaacauuaaaaagucugucaaauaucaaguguuggugaagaaguaaaacaauaggaacagucauucacugcuggcaaguguauagauugguauaacucguuuugaaaaacauuuggcauuguguaaugaaguagaaagugcacauauccuauggcuuagaaauuugggucuagguuguuaaccuugggaaccuuuugcagauguauaccauacauggcauucugugcaacguuguucauaauguuaauaauaaaaagcaggaaacagccuaaaugccauugccauuugaauguauaaauaauguuauguucauauaauagaaauaagaauuuaauggauauagcuucauccaacaauauagauaaucuugauugaaagagcaaaagaauacagucauccuaauuccaguguuauaaaguucagaaauaugcuugacuaaacaguacauuuuuuagggauacaaacaugguaaaaccaucaggaaauggaagagaaugacaaacacaaaaauuccaggugucuucucuggaggaacagggguggagauacaaucagggagaagcacaaagggacuuuuggugauaauuuuauguucuucacuuaaacugcuucuugguacauggguguucauugaagcuuucuucuuuaugccuuauucauauuuaauaggcaguguuuugcauuuauucaauauuugcuaaaccgguuuucaaaaaacguuuuaugucagugaaguugugaggaaauaggcacccucauguauuacuuaugacaauauaaauugauacaaccuccccaaagggcaacuuggugugguaaaucaaaauuuaaaaugcacauaccuuacgaucuuggaaugccacuucuaagaauauaucugucauuuauaugcauauacuugugggauauguaauagucauaauauauucaucucauuauugguaauagcaaaagaauggaaguuccaaaauguuuuuguuucaucaaauuaaguacaucaaugaaauuauugggaguuuucaaaaagaaugaggaaacucuauacuuguguuuuuaaagaacaaucucuaaaauacacuuuaaguggaaaaaagguauauagcaauauguauaguauuccaccauguggggcagaggugauggguggacaaaguuauauauacauaaauauguauggaugacagggguguagagauaggaguuuuacuuuucaauuuguaucuuuuuuauagcauuaacauucuuacuacuaaaaauaaauacuuuuuuaaaagauaaaaugcacuuuaaauauuaauucagcguuaagggaagauaggcaauaagaaggaaggaaaaacacuuggaagccuagaggacuguguuaaaaacacagagagaagcaaauaaaggagcuaaugcuggagggagacaugaagguuuuaaaacuauuucagacuuguguauauuuucucuugauuccuugacauuaaaguucuguauuaugaugguuaguuuagaaugcuuucuagcaacaguuguuaauuuaauugcaugagacuuuuacauagaucuuaccacauugauuguaaaaauguacuaucgcuucuuucccuguuguaauuuuucauuauuuuaauguaucauuacagguaucccucguacuuggccccugagguaauugcacagggaauuuucaaaaccacugaucacaugccaaguaaaaaaccauugccuucuggccccaaaucagauguauggucucuuggaaucauuuuauuugagcuuugugugguauguauaaagaaauauuaauauaauaaaaggaaauugugcauuuauuggaauaaucuuuuggagaggaaaguuaauaauaguauguuuuugcuguacaaauuaauuacauaugaggagaaaaggcuuaauuugacuuaaucauguuugauaauuucacauauuuuuuggcaucucuggaaacauacuuuuacuaagugugaauguaaauguuaccagauauauauuauuuugauaucucuauaauguguauauuuuuacaaaguuaagauguuuauauuaaguuauauaagauauauggaguaccauuaaaaguuuaacaagauauugaaaugaaaacuacguuuuuagaagauugauaugacaguaauguaagauugagaagaauagcagcuuuuuuucaaugaacucuaccuguaguucugauuugguaaguguuuaagaacauuuuuucuucucuauuaaaaaaaaaucaaagcaucucuuuuuucuauaaacaccagguaaucuuaagccuuuuccuucuaaguuuauuuaaaugaucauauaagcuuaauuuguuuaugauaagagaaauauaaugauagccaacauuaaugaagcauauucugcauuacauaacccucaccauaaccugugguauauguacaguuaauauuuuaauuuuacagaugagaaaagugaaacuucaggugguauuaaguaguuugccaaauuuauauaacuauuugaugguggaagaguccaauuuggcacacaaucauugcucaacucauaaaugcugaagguauaaguguuugacuccagaccuuauacuaaggagccuccugaggcagacuaguaaggaaauaauuaaaauauaaugugugcaucuuaaaauauaccaggugcuguaggagcaugaaggauggcugucugaaguuauugugguaagaggaaggaguguuaugaaguuuuuuuaauggagaaacagacuaaccgaaucaugauauuuaaguaagaauuagcucgguaggcgaaagaguauaaucagucuuacccaggaggcaucuuggucucaauaaaguaagacuccauauggccuggaauacaucuagauauccagguauguguggaucucaaaagugaacaaugcuuacaucaaacuagaauguaaugacccuuagauguauaaaauguuuaaaugauaacuauuaugcaacacuuucuaaaauguuauuucaccaguaauuuuucuuuaguggagcugacuuuaaaaauccauuaaaacuuuuggagauaaauaaagaugccugauaaaaucaguuucagcuauaaggggagaaaaaugccuuccuagaaaaaacauguaaauauuaauagaaauuucuuuucucauuuuauuuagggaagaaaauuauuucagagcuuggauauuucugaaagacuaaaauuuuugcuuacuuuggguaagugucguacaauugcuuaucuuucaaauauaaauauaacuuacuauuaguaaucaugcacauugaggauguguucuuuugaaauagugaguacacugaaauauccucccuuuacucaaguugcuaaugaucagugguaaugaucagcagaacagcauaugaggucccuucuaaaauauuacagcagaaauuucuuuauucucugaggaauuuuaaccuagauggaaauaaucucagcuuuauuaucuagccaaguaaauuaacuugugaaaucaaaaugagaauauaaaauuguauuucuguagcaguuuaccuucagacaauguaucuuaacuuuugggcuaucuuucuauuugaugaaucauguacaaauaacaacucaagaagaauauugauuuuuccuuauaaaaggcucauaugaauuuucauguauguggauccaaacauguauaauucaaauuaauaaaaauuuauguaaucuacuuuggaguggaauuaauuaagcauguuugguaauuaaggagagaaaaacagugauagaacacuuuaugcaaaagagugacagauuaguauccaaguuaaaaacauuuacaaauaagaauauguacaggaaaguauuaguaaacauuaaauaauaaugaauuauaaauaaauuugcaaaaguuuuaccagauuuaccacauuuaauuacaaagauugauacuacagcuauuaagaagccuuggagauucuuaaauguggucuguaaccuaaacuuuuuacuuuaaauucccaaauaaauguaaguacauuuuccaaauuauguacaauaaaaauaaguuagucuuguaaucaugaaaaaacaaaacaaaacuacaaagccuucuuaaaaagcgcuguuuacauacagucaguucuugaagaggauugguucuagcacccucacauguaccaaaauccauguguacucaaguuccacagucagccccacagaacccauguguaugaaaagucgguccuacauacaugcagauuucgcauccacaaauacuguauuuucaacccauguuugguuggaaacaauccacauauaaguggaccuguguaguuuaaacccauguuguucaagggucagcuaugugugucugcauguguauauuuagagagagacagagagagcuagaguaucuuuaccuuccuuguaaaggaauugcuccuuuaucaaacuauuuaagcugguaucuuucagugucaguuauucaauuaguauuuaucugaagcuuuucauuuuuaucaaaacauguaaagaaauuuaacaaaaugauaaaguuuucaguauuuuaaguuucaaaauugcauuacuccauuaaaacauuuuugaucaguuuauuuucugguuuguuggacagauuagaaaaauagcauuuauucauauaguuuuucuguuuuauagauuguguagaugacacuuuaauaguucuggcugaagagcaugguuguuuggacauuauaaagguuugucauuaaucugggucuuaguccauuugugcugcuauaacaaaauaccugauauuggguaacuuauaaagacaaaaauuuauuuuuccacaguuauugaaacuaggaaguccaaguuaaaggcaccaguacguuuggucgucuggugagggcugcagucuucugagagagaaacacuguccuuacaaggcagaagggcaagcuaggcaauugcuaugugaggucucaccuuuauaagccucuuaaugccauucaccaggggaagagcccuuaugaccuaauuacuucuuaaaggccucaccucuuaauaccaucacauuggccauuaaguuucaaaguucaugaagccuaaacuuuggagggaacacauucaaaccauagcaaucugugaaugaaaauuuauuuuacacacuugggauccaguuggaagcuauuuuaaagcaaugcuuauuucucuuuaaguauuugcuuuuucacagugacuaaauuuguauaaaguacaaauaaaaacuuuaaaaacaucaaaaacuucuagauuagcaaacauuugaauaaaguauauuucuaaaauugaucauuuuaauuaauuauuuucucucuuuauuuaccaggagcuuccugaaacugugauagaucuuuugaauaagugccuuaccuuccauccuucuaagagguugauauuauuuagagauugggauuacauugagauccuuuacgcauaagcaauugguuuuuuucuuguuuuaauauaauggauuaaagauaauguacauauggaguaguauauaauugacaucaguaucauaacugugaaugauguaagcuuucauuuuuugugaauuaaugaaaaaguaauuaaaguuaaacuacggucagaaaacugacauacacuaaagaaguuacuaguucauuuucaagcuuuuaaauagaauauuaacuaaacuauggaauguagguauuccuagacccaauaauaacaucagugaaaugagaauaaaaguuuguugucaauauguauuauagcaaugaacuuggaucaguggugugauaaacuaacaauuguugacaauaaaaaaggauuucuuagaaguuucauuaauugacuuugacuugaugaugucacuacuagucauacagcuaucccuaaauuccuuuacuauguaauguuugaaaauaauguauacaaauuugccuuuagaaaaacaacuuuaucaagacauguuagagagaaauaguuuugugucaauguaccacauuaaaggacaggaagaaaagccaaaugguauuauuauaauaguuugcauaaauauuauuuaauuauuuaagauauucaguaaagcaggugaaugcuagucaggguaaaaguaaacaaugcagaagcuuuuauggaaugauauuuuugauacaucaugagguaaaguacaacauaaguaaaaaaaauucaguauuuacucacaguuauuugauuauaauauaaaaguaugcaucuagacucugcaaaagagagcuguauuauuuucugugcuaaugagguauuuaagacuuuuauccauucucuugaauguaugccauuauucuaggaaauuuuuuaugacuuucauucaugcucuguauuuuaaauguucucaaggccaaccccagaucaauuaaugaaggacaaaguauucagugagguaucaccuuuauauacccccuuuaccaaaccugccagucuguuuucaucuucucugagaugugcugauuuaacucugccugaggauaucagucaguuguguaaagguaaugauaaauuaaagcauagagaauaauaugagccuuguuuuuaaagaaguuuccuuguccuacuuucaguuuugaacuuaucaacaauauauauuggugggaucaugggaauuaagagacaauucuggaagugauuaaaauauaacugacuggcugggugcaguggcucaugccuguaaucccagcacuuugggaggucaaagagggaggaucacuugaggccagccauuugagaccagccuggucaacguagagauauccugucucuacaaaaaacaacaacaacaacaaaaaacaaaguacaugcacacacgcacaaauauauauauauaguuagucagagccuaacuuccuuggauaauaucagagccuaacugaacuggugaggggaaauagcaaauugcagccagcucuagccuucuguguggugguuaaaguuaacagaagcauucuguagucaauccugugauuaguucugaaucuuuaagugagccugugccucuagccuuuaaacaagugcuuucuugcccuuaaggaguggcuagaauacacauaaacacacacauuugagcuaacaguuuauccuuucuauuuaaguuacugauauucuauauaauuuauuuauaaaugaucucuaaaaauaauauuauugauaagaauuauauaucauuauauucugcauauugaagagaauaucagcuuuuagacuuuuaauucuugugugaagauuacgacucuuggaauguaagguuuagugacaccaguuaccuuuauucugaaaaguuguuaugacuuaagucauagcagaaaaugguuacuaaacauucauucaauuaaacauuuauugaguuccugguaugugucacauacuguaucuuuaaguaacauucaugccaaaugggaaggcagacagacauuuaauuauacaaucacuguuauaaaugaaggucaauaugaauauagcacaauggcagcauagcaggagcaccuaauucuguauuucugucugggacaucaaggaagacuucagaaaaggcagccagccguugccuugagauaugagggaaggaacaauuuguguugguugccuccccaugugcuauuuucuccccuuauuccuuuuccaauauagaguguaaaauuuccaauacuauguauucauuauaaagggugaaaauuccagauguuuuuuucuaguuucccuugcuaugggcaguaagcuugugaacuagaguuggcuaaugggaucuaaaugaaagugcuggacauaagggcuacuuauagggaaaaaacaaauuuucuugucaagaaagguacugcagcauagguucaccacuuucuucucuucugaaugcagaaaauggucuagaauuuugauaagcauaggccccuccuguaccuaugauuuuauuaacagagaugaauaaaugucuuuauuauauaagccacuuuuaguaguauauuauuuucagucgggagcauucaaauuauuacaaaaauugaaucagaaucugccagucauggcauaccuccaguaggagaggggaaauaucaagcuccaacucguucuagccaccccuuaagggcaaggaaacacuuugucuagagugacuggcucacuuaaagauugagaccuaaauuguaggacugacuacagaaugcuucuguuccccauaccuuaaccaccacauagaaggcuagagcuggcugcauuuugguauuuccccucuccaggucaguuaggcucugauauuaucuaagugaguuagccucugacuaaccgguuuauccugaagacagaccuuguuaagaacagugcucauuguauuucagaaugguuacauuuccucugccacugcuggaaacauaagggcauuuuccuccaauauuuacugugagaaccuugucagucuccagacucacaaaaguguggggcuaucccuuuugacugguucccucuggaguuuuuaacucucagacuuguccacacugagccuccaguaauuuaucaauuacaguuuagguuuuccaaacuuggcacugguuccugaggcacugcucaugaaugucuguuccagaaugccauagcucccuuuauucuccucucugucuccaguccuggggacagaaguuuguccuauguccucaccucucuuacagauccaagaauuguugauuuuucagucuguucaacuuuuuauuuguuguuaggauggaguagcaaauuucaggcucccuacaaucagaacuaggaacuggaagucuguucuucagaguuuauuuuuuuuagaauggcagcuauuacugccuguugacguuuaauaaaaguagaaaauauaauacaaugauuccuuaaauuugcuuuuaauagauauaaauaaugauuaccuggcagaaagaucuauugaagaaguguauuaccuuugguguuuggcuggaggugacuuggagaaagagcuugucaacaaggaaaucauucgauccaaaccaccuaucugcacacuccccaaguaaggaaagaaacuucucuugggaauuuaaauaaauaaauacaugguaauaauucuaugguaauaauaaaaaagaaaaucgguguuuuuuuuuuuuaaauugguuguuuuuaaaauuuuuuugguaggcaucccagcuaagugauuauuggaagcaauuggaaucaacaccuuguuugauuggccaaaguuucuaauugcagaguucccaucaguugucuuugaucaguaauuugcuuugugaccuacuugaagugaaguuaauauuauggaauaucuugcaauaauugauguuaaugaaaaauacacaagucacaauagaauauuuaagacaguuaacuaaaaacuagcuuaauguuccuacuaugaagaacuauguucuuuuuccaaauauacuuguaaauguaaaugaacucuguggucucacuguguguccuagagaucauuacugugcuaguguguugcaaaaaaaucugccuaacuguauaagaagauaucaugcuagaaauuagacuggaaguuaaauaccucuacagccuuggggcuaagauuguuauuaacauugcuauucauguuuauucauaaaaauaugaaccuaaauuucuugagcuucuacuaauacuuuaaauuuuuaauuuuaggcugggcaugguggaucaugccugugaucccagcacuuugggaggcaaggcagguggauugcuugaaccuaggaguuugagaucagccugggcaacauggcaaaacccugucucuacaaagaaaaaaaauuagcugggcgugguguugugugccuguaguccuagcuacucaggcagcugcaggugggagaaucaccugagcccagggaaguugaggcugcagugagccaagaucaugcuacugcacuucagccugagugaaugagagacccugucucaaaauaaaauaaaauuuuaauuuuuagauuucuagacuuaguuuugauuauuguaggcaacuguagaagucaucugcucaucauuuuuuucuuuacuuuuuaaacuuuuguauuguuuggauugacuaguuucuauuuuuuucucucuuaaucugauuuuuaaauguuaacuuugauuauaccauucauacauugaauuaaguagaaaguuagagguaagauuacggaaauuccaagaagaaaugguuuaaaggauauguagauucuuaaaaguaauuuauugaaauuguaaacaaauuuuauucauuuauuauuuaauauccuuucuucuaugagguuacuauccaauaugcuuuuucuuucaucuucccuuuaucuuuuucuacacguauaaaguuucuugggaacacauugaguuaaugucaggagaguacuguuagcauugaaacugcaugaacaaaggguuguaaaugacacuuuuguuuuucugaaauucucuauacuuacauucauaccaacucaagagauauuugaaaaugagacuuguuugaagaaaucucaauacauuguuuuauaugcaauguauauguggcacauauguauauguuuauguauauguggcacauauauaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugagaauugaacagugagaacacauggacacaggaaggguaacaucacacucuggggacuguugugggguggggggagggggagggauagcuuuaggagauauaccuaaugcuaaaugacgaguuaaugggugcagcacaccagcacggcacauguauacauauguaacuaaccugcacauugugcacauguacccuaaaacuuaaaguauaauaauaauaauuaaaaaaacauuguuuuauuaaacauccagucuaaaguuuaauucuuuuuugaugaagggauugaugacuuagaauaaacuuuacuuucuagaagaaacaauaaacuggauuuuguguacauauuauuuuuaaaaauuucuuuucaguuuucucuuugaggauggugaaagcuuuggacaaggucgagauagaagcucgcuuuuagaugauaccacugugacauugucguuaugccagcuaagaaauguaagaaagauauuuugacaguucugcuuuagguuuuuuucuuuaauuaaaaccuuacagauacacaagaaaucuuguaugccucuuugauuucacaaaauaugggagagcuucuguaaaauaugugccccagaguagaauugcaucuguacaacuucagcuuuauuaccugauuguucacaaaaaugauuuuaucaguuuaucuuuucgccaucauuggguaacuguucucauuucuuuauuuaccugguaacacuuucuuuuaucacauuuuaaaaaauuguuaaucuaaugguauggaaagguauuuugcuguaauacuaauuuuuaauuuccugauuauagugcaguuguaagucuuuucacauauucuagcaguucaccuaccucuucuauguauuacuaguucauaucucuugucaguuuuucuguugagugauuucuuauugauuugaggacuuuugaaacuaugucccugauaucguaucuuugugagcuguaugucauggaaauauauucuaaucuguggcuuuuccuucaacuuuuugauucuuuuauugaauagaauucuaaauuuuuaucaguauuuucuuuuauagucaaauauauuuugauauauuuuuucuuguaacuuauuuaaaguaauagcaagguuauaaguauguuuuauaauguuuuuauauauuuccuuauaaaagauuuaaauaauuguuucacauuuaguucuuuaauccaccuagaauuuauuuuagauuaaguuguaaggaagguauccaauaucauauuucauugauuaaaaaaauaccccuugucucaguaccauauauugaauaguuuucucuucacuuuuuugaucuauaauaccaacuuuuucuauguauauggauauguuucugggccuugauauucugauuuguuggccuguuuuucuaauuuuagcaaauaccacauugccuuaaucuguaguuuuaugugaacuguugauaucuagcaagggaagaccuucaguuuuuuuguccucaaaauggaguaggaacucuuuaacaucuuccucuacuagcugauuuuuauaaucaucauaaagaacuucauaaaaaauuauaggguuuugauugacauugcauugaauugauaaguuaauuuguagagaauugauguauuuaaaauguaggguuuuauuucuugaacaugcuuaaauaaauaugucauuuauuugucuuauuuuauauaacaauuuuauuuuuaaugucuguauaucaguuaucagauuuauuucuaagguaauuuauuauugcucuuguauauagaauauauauauauauguaaguaugaguaugauuuuuuccaacauuuuauuauaaaaauuuuuaaacagaaaaguugaaaagcauuuacagugaacaacuuaccaccuacaucaagcauugauaugaucuauuagcaaaaucaagucacaccuauucauugaccuauuauguauagcuguuuuguucugcauuggcagaauugaguaguugcgauagagacugcauggcccacaaagcuaaaaauauuugucauauggcccugcauagaaacaguuugcuaaucccugaccuagauucuauaauuaacauuuuacaugcuuuaucacaugucuaucuuucuagcuauucaucaauccaucauauuuuuuguucuugcauuucaaaguaaaaugaagacauuacuacaauucagcuuacacauuagaguuuaagauuuguuuauaguucuuuucuaggcaaaauuuucauauaguaaaauguauagaucuuaaguauaccaguagaugaguuuaaaauauacaucaauaauauuuuuucauguaguaaaauguaccaaaucuuaaguauaccaguagaggauuuuaaaaaauaaaucaauaauauuuuuuaaaauacuauuucaacuacuguuuugugcaugauuaguaacacaauugauuuuuuuauguggauuuugugucaggcaacauugcugaaccuauucuuuuuuaaauaauaugucuauagauucccugugguuuucuuugugaauuaagguaggguuuuuuccuucauuuccaaauucuuaucuacucacuucaucuuuucucauuauuuuugcugagcgucuauaacgcuauugaauagaaacaaauagugggcacuccugucuaauuucugguuuuaaaaguuugcuuuuuauauuucauaauuaaguaugauauuuguugcauugaguuauagaggucuucuauucuuaguuauaaguuuuguuaugaauggguguugaauuucacugaguguuuuuacuguaucuauugggauggucauaugcuuuuuuauguauuauguuaauggauuuaauuauguugaugggguuuuucaauguugagccauguuuguauuucugggauaaacccaaacagaucaugauuucauuuuuccuuuuuuauacauuuguguuuugauuuucuaauauuuuguuuagaauuuuugcauuucuguuucuauuugagauaggccugugaguuucuuuucuuuuacugcacgaugcuaguuugguaucagggguauacuagucucauaaaauaaauaggagaguguugccuuuuuuuuucuauuuucugaaagacuuuauaugauuacauguaucuauuucuugaauguuucaugggaguuagcuuuaaaaccauauuguaagggcuccuuaucccuauuuggguguaaucauuacuucagucugcuuaaugguuauaaguuuacucagguuguuuauuuuguuuuuaaaucauuuucuaaaguuauauguuuuaaggccuuuaaacuugcucuucccacugccuguaacacucuuccggugcuuccauuucuuuucuuuacauucucugcuaaaaugucaccuauuggugggcuuuuguuggccauccuuuauaaaauagcaacgccacaccuaucccuuguauucuuuauccuguuuuguuuuuuuccuccauuguacuucucuucauuugauguguuauauguuuucuuccuauauaauaacuaaaugaaggaaugaauccuguuauuauguagaagcccuauuaauaucauaguaaaguauaggggagaaguauuuuauaaucuuaucauuaagucccaguuuuuuagugagccuguguuccugggcugugaccuucacaaggcuucucagcuucucccacuccuccuccccaacaugagacaggaaagcuagaggggcuggaguuggguauuucuguuccccuacaucaaagacuagaguggacuggaguugaauauuuccuucccaaguugguuagauuucuguaaaacccaaguuaguuaagaccugaccgaagaguuucccuuuaagacaggccucucaaggaaaacagaguacucuggcuguauuucagauugguuacuuuccaccucccccugcaggaagucaaggguauuuuucucagaucuucacccugagaaccuggugggaccugcagagguuaaucucauggaagcaaggaaggccucccuaaggcagggccuccagaaguuuuucucucucguauuagucugugcucagccugcaaguauuagauaauuaccuuuuaauugaucuuaacagacuccagcaguggcucuguuccuguugagcugugauucccuguauucgagggucccuccagcuuugaggacaucacaaugcucugauucugacagaugugagacgaguucuugauuuucaguuuguucagcauuuuucuuguuagaggaagaaugaugccuucuaagcuguuuauauuuuguauaagaaaguggaaguccuagccuuuuuauuuuuaaccauucauagccaaagcugaaauagguaccuauccuuguuuucugucuaagccagcaauuccccuaguuuuuucuuuacguggcuuuagaagggucuucuccauucugaaggucuguuauguagguucccaaacccuuaucccauuauggucuaaaucucuagaccacaguuauuaacuacuuucucucuaggccugguuuuauaucuguuaucacugcauuuuccuuauguuuuaaagcuuaucuaaccauuuaauauuuuacauguuauauaguaggagaguauuagaaucucuugucugccauaaugccagcaacagaaaauuaaaauauauaacuauuccuacucaguacucugaauuuauaaucucuuugaaagaaaggauguggaaaguaacaaaauaaguaauaauacccugcagcgaacaauaaauuacauccaaaauauaugauuucagcugauuuuguuuugcucuuaauuuguuucuucaauuuaaauauaauccaaguuaaaugaauguaggcuucaaaucuaaaugucucaauuccuuuacaguucuacuugugaaauuuaaaauacucuucuucuguaguuauuaagaaauauuaauuugcugaaucuuaaaaugauauggaaaccauauaauaauuuuuaucuuuaguguuuucauucaccuuuuaaaaauccuaaugugcuaaguuuuuauuuagaaaagacagacaagauacuuaauuagauaaaaucuaugacauacaguauacugaaaacuaaucuuuaaaaagauuuauguguauuaauaaugcaguaaaacuugggaaaauuuuauuuccuaacuuaaaauuuuaauauaugaaagauauaccuaaagguuuuuuaaaauaggauaaguacauagcacauugauuuuuagaguagaaccaggcauaaauucaguguuugcugaauucuuaguuugaguaaaagauuuuucuuaagcuuuaaaaauucugggaauaacucacaugggugcacaaagacucuaaucagcagaagaucagugcuugcugcacacacagcuugaauuucuaugucaauccccauaggagcagacauucugccuucaaguuggaaguugaacagcagagcagcaggcaagauggcauuaacuuuaaucaccuugcuuaggaugugguuaacauuuuacuuuacuacugccuuccugcuuaugauuuugaagaauaccuguaauccugucaggguuguuauuuggaacaacauuuauuaaaaugauuuugucauuaagugaacucucuccauugauuuauuagcuauuugaaucauacauguucaaaguaugaugugagaaauauuuuggaauccuuuuucuagcaccuuucuuuuugacuuagcuuguauuaugccaaagcaaaaauaaaucuaaguuguucuuuuaguauauacauggcuauauaguaccucuuuuuaaucaucuuucuucauauaacuuaaaauuuuuuucccauucauuaaguuuuauacuagugcuaguaauucugaguucuguuuggaaaauauaucaugauaagugucuaacauuuaugagugauaccuauagauaagaaaaaaauaguuguuuuucacagccaaaccguaaucaguagaggcauuguaugcuugcauguuuaugguaagaacugauuuuuagacucuauuuuauacuuuucuaggucccuuuauaaauuuauaguuguuauauuacuugucuuuuuaaacacagaucaggguuucugcccaauauguuuauacauaaauauuuugucuuuaaauacacagagauugaaagauguugguggagaagcauuuuacccauuacuugaagaugagugaguauauguagucucauuuuagauuuauuuuucuuucuauuuauauuagauuuauaagaauuuuauacauuuucuuugaaaaauguuuccuaaauagaaaauaauaaccugagguuuugguuuauuaaaauuuugugcuuuuucugaaaucacuguugguagaguuaggaaaaaaaaagaaaauuuuguaccuuuuguccauuuuuuuuuuuuauugcuuuuguucucuuuuacagccagucuaauuuaccucauucaaacagcaauaaugaguugucugcagcugccacgcucccuuuaaucaucagagagaaggauacagaguaccaacuaaauagaauuauucucuucgacaggcugcuaaagguauggauucuaaaguauaaaguguuaacaauagcccauauggaauuuuuuuuuaauuuuuucaauaauucuuagggaaucuugaguaauaagaagauuaauuuuuaugaccuaucuuguucaguuagcuuucuuucauuuuaaaaaugauacauguucuuaguaaguaaaauuaaaaaguaaaaacaaggugugguaacauaugcaaaaucauguuaaaaaaggaauaaugucuuuauuuuuuaaaagaagacuuaaaagucaacaggaaaaacaucaauauugaaacagagaaauggauagaguacauaauauaaauacagcuaguaaaucuaugcaaauuguucaucuucacugggaaugaaaaaaauacaaauuaaaauaggagugauuuuccauacugcauuagcaaagugagcacagaugcaaugauauuggaacucucauucuguuggaauaaaugugaauguacugaaacauuuuguaaaacaauuugaaugcauauaucaagaaccuuaacaacaucuguugccuuuguccuauuaauacucuucuagaaauuucuccuaagacacaaauuuauaaaaguauaaauuuauaugcaaaaugcggaaguacucauaauaguagcuuauaguuauugaucacuucucuaucaccacguuuuuaacagagugcuuuaccugcauuaucuuauuuaacccguaugagacugguacuauuauccuccaucugacucauuuaaaauccccccagagcaucaaauagagaggaaggauuaaaaaucagguagaaucagcugcucuucuuaauuauauaauacgaguuuuucaagguguuagggauucauucauucuacugcuuauuuauguguauuaauaacaccagacacaauaauugcacauacuuugaaauuuauugcaagucacuuaaguuuuaucauggguauauucagaacugucuagacuaaaagauggcacuagguaauuugagacguuuucauuucuuuuuugauaucauaggcuuauccauauaaaaaaaaccaaaucuggaaagaagcaagaguugacauuccuccucuuaugagagguuuaaccugggcugcucuucugggaguugagguaaggaaaaaagaaaagguuagaagcugauuaauuaugcaaagaaaggauggagaaggagagugcuuuccaaauauauauuuuucuaguuauuagaaaauuauauaguaaaauauaagcauuagaauauuuggcaauuuuaaguggaaagaauauaggaaaacaauagaauagaaaaauauaauggaggguuuauuagauuaugcuauuuaauguuucauuuaauaguggucacagaaaauguuuugauuauuaccauagaauauuuuaagaauauauaucaguuauaaauggguaguccugcuuauaaaguaugcuuguuauagaauaugauuguuuauaaaugguucugucuaaauuuggagaaaucuuuccaucuaaucugacuugucaaaaucacuaacauaauuuagugacuuuuggcacaccuauuccaccuggacuaugcuaccaagagaaauagcacuuucucugugguugugaggaaagaugugucacaaauuaugguggccugcaauacuaacagagaacuccgaugacaucaaucauaauaaugggccaaauucuugccagauuuuuuucauuucuugucaauuucuuugucaucuugucuucuuauauucucuuauagauaauuauccuuccuuuuuaaagaauuccagucuggaaugguggcacaugccuguggucccagcuucuuggaaagcugaggcagaaggauuacuugagcccaggaguucgaggcugcagugaaccuugguugugccacugcacucuagccugggugauagaacuagacccugacucuaaaaaauuuuuagaaauccucaacuauuuuuaauccuuuucaauccucuguuugaagaauuuccuuucuucauuccugauucccuugauaagagucuacaaauaccuuugaguuuaguugguuacuuuacaagaaugccaauuguucaauaucauacauuaaucauuagacuuguagaacaauauaaugcuaaaguucaagaggacuucagguaucagguuguccaacucucauuaaauuaaugucucaaagaaguugauaauagccgauauuggaguuugaacccuacuuccuggcucuuucucuaccaugauaauaagccagaauaauaauauuuuuuucaugcuugguccuauagaacacgaccaaaauuuguagucguucauucaguuauuucuaaauuuuaacagucuaacugaaaagcguaaaugaccucuuuaggcccuaaugauucuaucauguaauuauagauauaacauaacaagguuguguuauguuguagggucugggagguuggccaaacauacuuacuagcuaaguaauuaauccaugacauuuauguucugguauguauaauucaagaguuugccucagcaaaauggcaaauugucacuuaucagagaccuucaucacagauugucaaagacacagagaauuucucuuaagaugaguucuacccugaguuugaaugugcuuaucuguaguuggguagguuuccaaagauagauauuuguaaaaaauagauuucucuauauuacuauuuguauuaaggauaugauaaauuaauauaucuucuuuuauuuuuugcagggagcuauucaugccaaguacgaugcaauugauaaagacacuccaauuccuacagauagacaaguaugauuuagguuuucuuaagcaaccuaagauaauucugccaaauauuuaaauuuuaggaaggagcaugaagaaagccucuuucucucaugaauacagagacacugcugcauacauauauuguuagagaaaccauaacucuuaugcuuauaaauuaguaagaacaauaccuuaaaggacuuuaggucaaguuaccuuuuuaaaaauacuguaguucuucaucugaaaaauuugcccuucauuuggaccagauuauaaaggaaaauauuuuugaaaaguauauuaacacauacauaccuuucaaaagaaauggucuaauucuccuguuuagguauacauacaacuucuuuagucuuuccauaagaucaauuaaaaaauucaaaaaauuaggcacuuaagaaguuggucuguuuugaaauucauauuauagcuucuccuuuuccuuauuuaaugaacaaggauuaaggguuuauugcugauuacacaauuacuguuucaccuuauuauuuugcuauuuuaacagauugaaguggauauuccucgcugucaucaguacgaugaacuguuaucaucaccagaaggucaugcaaaauuuaggcguguauuaaaagccuggguagugucucauccugaucuuguguauuggcaagguaacuuuuguagucauuaaaacuccucuggaguauuagaaaauuguugcauaacugacauuuaaaaaaauuaaaauaucuaaacauccuugucuuuggggaaagucaauauugacgcucugauucauuuuuugagagguuuacauccaaacauuuuuaaaaaucuuugucuaaauccuaguagauaucauuaaaaaacauaauauuuaauauacaaguugauuagcaaagcagaaagaauauuuggagcuguugugaucuuuguggauacauuuuuuaaacgccuaugcaaauuguuaaaucaauuggggcuaguugagauucuuauaguuaaugauuucuaauuuauacuuaccauggcuauuagcacuuaaaaauagucuaucauccuaaaguccucauuuuauuuauugucuuuuuuuucuuguaucuuuaaugguucauaucuuuuauuuuuagcuuugccauuauuauuuuuuguguuugauaaagaaugagaaacccauuccaacccuauuuuugaauguguuguuauaaguggcuacuuuuauauuucaguucucuauuucuuaccauaguuuaaauaaagcuguuauuuuucuuagcucuguguauuucagagcuauucuauauccuccuaacaguuguagguagauuuauguacauucuuucaacaugacaauacaugcauaucauuauuaucaauaaaagaaaugucauauauuuggaauccacuucacaauuuuuaaagaauuuuuuuucauaaucccaaagaaaaacaacauaggcaaaacuccauguccuagaugagaaaguaugccagaagauguuaaguaauugccaagauuguacauuuagagucagagaugggacaauauccaaagcauuguaacauucuuacauuuuucuauuauuguauuucucuuuucaacucauaauaauauagauaauaauaacugauucauauuggacacauacugugugcuacacuaucacucacuccccacaguaacucaugaaguaacauauuucuggauggauaauacuucuaauguuuaaucuacuuggagguaaugcaaagaauugaauaagguauauaucuucaauucuacuagauuauauuuauuugacuucuuucucccaaccccucuguguuaggucuugacucacuuugugcuccauuccuauaucuaaacuucaauaaugaagguaagccucuuuaacauuuaaauaaucauugcgcauaauauucuaaaauauuugauucacacaugaaagguuuuuguuuuuguuuuaaggcucuuauucucucccugguagauuucugugaaauaaucuauuauagacucauuuuagagaugugaaggauuaauuuauuacuggagaguuucaguuaugcuaaagcuauuacuagaaauuuaguggaauuugauuauucuaaauucuuuagagauuaauuuuugucuaaguauacuuucuaaagaauuuguaaagaaaucaauuaugguggcacuuuuccauaaccuugcaucuccaaagccuaucauuuuggauaccucuuccuuaaugaagacuuuucucauucuccuucuucagcccauaaagcacuuuguauuuauaaaaauuuaucuugugucuaucuuguauucuaauacuuauauacuaauguuguaauauuuuuugacagcccuuuuucaauggcagguuuuuuuuuuccugcccuucugcaauaacuuuauuauuguaggcuuuucaauaaauacuaaauucgauuaacuccaaucccugaaaucacauauagaguguguuacuguauauagcuugaaugucuagaugccuuaucugaagaucucccuauuuucagauucuauuucaugaccgaauuugcaucgguuucuggaauuaaguaaaaauagcauaaucccagagaaaugaaauuuuacucuuugaauuguuuuuaaaauacucuguucugugauauucucacucauuaaucuagacuagaguuuuuuacuauguuuaguuaggcauagccaaugaucacucauacugacccaaacauagucaggggucuguguuugaaaaugugaauuauaacacuauuccuaaauccauaguucguagacucuuguuugcaucagcagcaguuaaggaucgugagguccguauaacuuacuaauaaugaucaugcuuagaaauuuuaagaaacaacguuuagguaauaaaaguugugauuauugugugauaaugauugccaugcuaguuugaaauugaaguuauagaauuauuauuuuuuguugucuaaaauaaaaauauuuucuauuuuaaagcauagaggcuuuuaucucuuaauuuuguuuuucuagcacuuggcuaucauaacuguuauuuaauaguaguuucaaggaauaugugcuaagugaaugcauuacugauggucaucuacccuguuaacuaauuuuuuacaugccuuugccuuauucucuuuuagccuuggcuuaugcauguaugucugcuuuuauucccaaauaccuguauaacuucuucuuaaaagacaacucacauguaauacaagguaagcaaaugucuuccaugucuuucuacagagaaacuacugauguacuggugugcugauguaauauuugauuaaauuuaagauuuugaccccaaaaauacgaugaugguccauccaauaaaauccauaaagagaaauuagaaaguucagucuuuccuccaaauccacaaagaauuaugguauuuuucuaauggauauuugauaucugaucucauuucaguucaauugcaggcaugcgaguuugagaaaauaagagacugccguuuguguuuuucacaaucaaaauugcucacaaaaagcuucaccaugggcaaguccauuguaaauuaguaaaaaguuuaaauguuuaauuguguaagcagaguauuaaaaauacuuuacauuuaucucauuucccaugcaugcauacccaaaauauacucccucuuucuucaacuucccuaaaauauaccuccuccuuaagaguucaugucauagcguaaccuguuugugaauucauucaggacaacuuuagccacauucaaacuuguacuauaauuuccugaacucuuuuuuggaaguaauagaauagaaguuaaaaauacgcagauuuagauagaaaaaaaaauccuaaaauuuauauggacccacaaaagacccagaauagccaaagcuguccugagcaaaaagaacaaaacuggaggaaucacauuaucugacuucaaauuauacuacagagcuauaguaacugaaacaaaaugguacuggcauaaaaacagacacauagaccaauagaacagaauagagaacccagaagcaaaucuauacacuuacaaugaacacauuuucaacaaaggugucaagaacauucacuguucuuaaagucucuucaacaaauaguucugaggaaauuagaucuucauaugcagaagaaugaaacuagaccucuaucugucaacauacacaaaaaucaaaucaaaaugguuuaaagucuuaaaucuaagaccucaaauuaugaaacuacuauaagaaaacacuggggaagcucuccaggacguugguccaggcaaagaugucgaguaauaccccauaagcagaggcaaacaaagcaaaaauggacaaaugagaucacaucaaguuaaaaaccuucugaacagcaaaggagacaaucaacaaaguuaggagacaacucacagaaugggagaaaauguuugaaaacuacccaccugauaagagauuaacagccagaauauauaggaagcucagauaacucuauagaaaaaaaaucuaauaaucugauuuuaaaaagggcaaaagauuugauuacacauuucucaaaagaagacauacacauggcaaacaggcuucugaaaaggugcucaacaucauugaugaucagagaaauucaagucaaaacuacaaugagauaucgugucacucugcuuaaaauggcuuuuacccaaaagauaggcaauaacaaaugcuggugaggauguagagaaaaaggaacccucaugcacuguuggugguaauguaaguuaguauaaccacuauggagaacaguuuagagguucuucaauaaacugaaaguaaaccuaccauaugauccagcaauccuacugcuagguauauacccaaaagaaaggaaaugagugucagagagauaucugcacucccauguuuauugcagcaccauucaugauagccaagauuuggaagcaaccuaaguguccaucaacagacaaguggguaaagaaaauguggcacuuaauacacaauggaguacuauucagccauaagaaaaaaugggaucccgucauuuucaacaacaugguuggaacuggagguuauuauguuaaaugaaauaagccaggcacaaaaagacaggcuucacauguucucacuuauuggugggaucugaaaaucaaaacauuugaacucauggagauagagaguagaaugaugguuaccacaggcugggaaggguaguggaggguaggaguuggaggauacacauugugaauggguaaaaaaaaaaaaauaaccgaaagaauaaauaagaccuuguauuugcuagcacaacagggugacuacaguuaauaauaauuuaauuguacauuuuaaaauaaguaaguauauaauuggauuguuuuuaacacaaaagaaaaauacuugaggugauggauaccucauuuucccugaaugagauuaugcauugcaugucuauaucaauguaucucauuuaccccauaaauauaugcauguucuauguacccacagaaauugaaaacaaaacaagaaaacccacacuuuuaaaacagaaaaguguuuaaaauuuaaguuucacuacuuauuauuuaaguuguguagguaacauuuuucucauaucuacaauaaaaauauuguagagguuaaacauaauauguaaauuucugguacauagaaauauucaauaagugcuauuauuuauuucuuaauguuacuguuacuguaaguacuaguuuuugcuaguguuauuauugugacauuuuauacuguuuuauauccuuucaacaagauucuguguauuuuaaggccagggaauuuucuuauaguuuuucuguucuuuuagagcagacuacaaagcugcucacucucccauuuacuguuuuugugaugcuuaucagauauccuuuugaucuuguuuuuaacuauauauaauucuuccuacguuauuuuaaacaacuugaaccugauucuguauuauauauaucauuaugguuuuauguaauucuccaguuuucauaagugaaguaggaauacuagauguuguaucugauucaucaaaaauucugaguaagugggaucucaauuaguaauaauuuuacuugguuagaaaugaauauaaaauuagaguaucagagguugauauaaugggaaaauaauuagaaaggaagcagaaaggaaaauguaaacucaaaaaaguaaagcuaaaaguaggaggaacagaauauggauaaauagcuuagcacauaaaaacauuuguuuuuucagcaucauguaccuugagguauagagaaaaauaauuaaaacuuuuuaaaaauuuuguguuuacaagcaaauugaaucauguguucauuccuauauaucugugucuacaguguagauaggaguuagaaauggaaauaaugauccauuaucucuauguuaauuuugaaacgcaaaauccauuggcuuuuguauuuugaaaugguuugguuugacauagauguguccaauucuuugcacauuuucuacaguguggacuuguauaaaguugagauuaauucaagaaagauuuuuagaagguacagcuuuuugcuuugacuuuuucuaauuaaggaggagugcauuuuguaguggaaguuguuuuuugcuuauagauuaccuuaauaaggucauugacuucaaggaccauguuauaccuucuucaaaauuuaugaaguaauguuccauaagguuguguccuguaccuuauuaagagggaugugccccauucuuacuaauagcuuccuucuuacccuuaucagugauguuuauuauagaauugauaguguacucuuucagauuucaguuaauagaaaaaugaguggauuuaauaaaaccuuggguaauaucacaagauuucagaaacuaugcaauuuaaauaaucugucaaauggugaccaaagacacugagaagauuaaaaguaaaaaauaagcagguuaguauuugugccguauaaaaagaaauuuaauaaucaucagcuaaauaugucagcaauauaaugcuguuaguuucaaagcuaacaugaaauuguaguguuuacugaacuuuccaaauauaaaagcccaauuaauauacaguguugggcuaaauuucuauacuuuagaaagaugaaaauauuggggaauccucaaauaagcaauaaaaacaggacuuauaacaugagcugauuagacuguuucuuagauggcuggaugauaccuggcuagauggccaccucuuaaaagaccauaugagacaucuucuguuacauugauuucuauuucuauuucuagaugccuguuacaaaacauagaaauuaucuuccucccaaaauuuuauuuuucuacuguuucauaucucagauacauacauuguauauuaauaaugaauuuccaauaugaaaaagacaaauuuccacacuuucuaauugcaggcuuuuuuaacacacuuuuuugauacaaggucuggcucuuucacccagguuagagugccauggcacaaucucagcucacugcaaccuccaccuccugugcucaagccacccuuccaccucagccuccugaguagcugagacuacaggcaugcaucaccacaucuggcuaauuuuuguauuuuuuuguagagauaagaguuuggccauguuccccaggcugaucucaaacucaggagcucaagccauucgcucaccucucccucccaaagugcuggaauuacaggcuugagccacugcggccagccuuaacacacuuuuaaaaggcauacuauacagauaugcaagacaaugucuuguuuaauuuauuaaauuagagacuguaguguacacaacaugaauuuggagagacuugucagaaaggccaaaaaagcugggcgcaguggcucacgccuguaaucccagcacuuugggaggccgaggagggcagaucacgacgucaggaguucgagaccagccuggccaacacggugaaacccugucucuacuaaaaauacaaaaauagcugggcaugguggcaggcgccuguaaucccagcuacuugggaggcugaggcaggagaaucacuugaaccugggagguagagcuugcagugaaccgagauugcgccacugcacuccagccugggugacagagcgagacuccgucucaaaaacaaacaaaaaaaagaccaaaaagacuguucuuuaguuugaucaauuuuaucaguaauacauuuuaacauccaauauuauaauuaaaagaccucucaacaauuauugauugcuuguuucucuaaguauuaauaauuuccucaguuaugauuucuauaaaauugcauuugaaaucuugaauugguauuuaauuuugaacuucuuuaaagccaccauaaauguucuuuaauauuaugcuaaaaaaaaaucaauagacaagguguuuuaaaucauuuguccaaauuuuauauugaccauauguuacauaagaaaaaaaacaguuucaauuaauuuagucuuucaguauauaacugugcugacacugugccaugccaagugcugcuuacagaauugagauucuuucaauaaauaacauuuauuccuuucccaaaggacuucauacuaugauacgguaaauaaaugugaaaaugacuacuuauaagucuaggagacaaguauacauacuauuauguuagcacagagcaagaaguuuaggggguuucaauuuucuugugugugguagcaaaaagaagagauagcauucuggaaagguuucauaaaaggaagauacuugaucaauuugaaguuugaguaggaauuucauuggugagaauagguaaagacauucuuaggacagggaacaaagaagaggacugaaguaaaagaguguaaaaugggaugauaaaauauccacuaaucaaaucugaucugucggguaggaaagagagauggaaagcuaaagaaggagcugaaacaguacacuguauauugguuacuaaaguuugauagaacagugguuuauuuuucuucaaaguguuuauuuuaggcuuagaauuagaaauagcucuuauuaguuuacuucuuuguuacuguguuucucuuuauuuuguagaguuuuaagcuuuacacuucaaaguaguaauugauuuuugguuggcauaaauaucacauguacacuuucuucuccacaaauuuugggaaaaauccuaagucguaagaaacuaauccauuuaaaagccaauuguagaaaugcauauuuacugaaucuuugaauugccuuuccggaaguuaaaaguuucuauguucaauagcaacuugaauuguucuuugaaaaaaaaaaguuauuauuacuauacgcuaauagaacuuaaaauauuuuguauuuuaaaguuuuuucuaaaauauauauacacucaugagacucuaaaaugcuuuaccucuuauagaucaguaaaagaaugcucaauuuaaucaagauacccuguuuuuuuaaacuuaguucuauugacuuguuaccugcagauauauuuaagauauaauaaauuuaauuacuuucugacuuaaaugaauauuucuuauuaucguuuguacuaucaaauuaucaccagaaacauuguuauugaguugacaaacuaucaauacaugggaacauuuaaaaauaacauacugauuaugcaacucaggauuggcuguugagauuaucuaagauuauuaaaauuauucuaagguucagaaucuuagaguauuaauuguauggaaaaagauggaggaauuagaaagaaaucuguugauuagcauuucagccauauuggaaaacaaguuuauaacuugcaggacagguauaucuuaggcuauugaggagaaaggcagcuucaggccagugaggaaccagguagacuauauuuggccaaugaaacuuuggcacauuaaacauacucuuguaguguuuuggaagaugugguugcuacaagucggaaagguaaagauaagaggagauaucauauaaaucugggaaauuaggagaaaguuuccccaauuuucuguuuaccuguauaucuuucuaaaucuuuugagggaaagaaucguauguucuucacugugauguccccaacauuuaauauaguaccacauauagcuagauugacuguacaacuaaauugggauguuucugagaguuuaaaggggcacuguaccagaugcugggucuacagaugccaacugggacucucucaggcaaacuaggagauaaguucauacuacacauauauauucaguaacucuuggaaggagaaagaggaagacagacauacaaagucuaaaguccaguugucaaaggugggguauaaaacucuucuuucccaccaaacuguaacaaugagagcgagagaauaugcaauuucacuccaaaaguuauguauuuagaaagguagugcauuguauuagguuggugcaaaagcaguuguguuuuuuuccauuacuuuuaauauaugugcagcuuagugcacaucuuugcuuaaugacuuuaaugauauuuggagauuguaguauauacagucuugggauuuuuaagaauaucuuguaucaugugacugaggagauuuuuccugaaacaguaaauguccuaccuaccuuuacuagaaauauuauuaugauaacuauuaagugggcucaucuguagauucuuuuuuuagcuagagcaagauaugugagaaggaaagaaagugguucacaaauguagcucuaaagauuacuuuucucuuuccuuucucuucuuuugaaccccuucuuuccacuuaguuauaaaaguuggugcuuguuuuuugugccuuuacuagauaggccaaauuuuacagcagaaaacuuuguaaugggaaguaauucagguucauuugcauuaaaauaacccugcuuuugagugcagugagucaacauuaucaccaaaugguuugguuugggcacauucuuaguugacaacagauacauaacucccaaccuaucuauauuuaucaucuucaugauagacuaguagucugauggaaaacaacaaauaguuauggaauugagaauaccauuucugaugugugagcugaggaaaacauuuguuuuaaaucccacccaucaucuuucaucuucuuauccuagcuaaaagagucaaagcugaaaaacuuuucggaagggaaaaauaaggauaccuauauguagggcuuucugaaauuuugucucugcauauauuuuuuggaaaacagauggcuuauuuauaaacaguugcacaaaaauaugauagugucauauaaaauucuuacaauaaauuuauuggggauugucauguuaauauauauaacaagccauuuuaaaggagagaaacaaaaauuuuuaauacagagcaauuagaagggaagaugacaauuuauuuucauuuuauauuucauuggaaaaauuaaaaguuauaagguuuuacaaauauaaaaugaagaaaauuuauauuagauagauuuuauacuguaauauaauaaacuucacuugaagcuuaaaugggaaauuuaauaagaaccuuaauuuauuuguuuaaauaauaccauuuaccucuauauaggucauguguagguuagaaaacacuauuuuugaaguuaagacucuagauucauauccuuauuauauaguauaaaucacaauuacagauuuuuuuuaacuuuuagauucaggguacauguacagauuuguuauauauguaaauugcaugucauggggauuugguguacagauuauuucaucacccagguaauaagcauaguaccagacagguagguuuucaaucaucucucuccucucaccuuccucccucaagcgguccuggagucuguuauucccuucuuuguguccaugucaauuacagagcuuuaacaauauuuuaaugucuccuuaaaaagagucaagauucuaugauuccauugaauccuuuguuuuauucuguuuuucuuuuuuuuuuguaacuacucuugaauucuuugauuugcaaaucaaaaggcauauauuuauuuugauauuuuaaaaauuuacaccaaggggcuuuuaaaagcuuuuuugaaauaacugagaauauuacauagugcagauuucaucagcugucacaugugcucccuuuagagacagaacuuuguaaauauaacaggccauauuguuaucucauuugaaagccuguccugagcaaccaaaacuuaugcuaguuuuacaaauuauauuugcauauaugaagugauauauaacauauaacuuuuaauaauacauaaaauaaauuuauauauuuuaugucuguguguguguguauauauauguauaugcaguuauaacauauaaauccaaucaucaguguuggccaggcacaguggcucaugccugcaaucccagcacuuugggaggccaagccgggcagaucaccugaggucaggaguucgagaccagccuggcaaacagggugaaaccccgucucuacuaaaaauacaaaaauuagcugggugugguggcaggacaguguuuucaugauggauuagauuucuucagcagauccuuaauuagccauguaauuuuacauaguaauuauuuuuaucagacucaaauaagaaugauauuuaauaaacuggagcauagcuguggaaaauugccugaggugugaauuucuguuuuaaaaugaagcaugcuuuuuagaaguuaauaacuguaugcuuucauugauauauaguugaaugcuuguaauuguugaugucacauaucucuggcuucugaguaaauuggaauuacaaacacaccaccacuaauuggaaggagaaauuaaaaaguuaaagaaaaguuaaacccagaaguucccugggcccuucagauauauuuugggucuucacuuugaucuauaacucuugaaacugauguaaauuguaccuuuuuugugcagagaggaaaaggugagacaauggacggauagaaugcauuuuguggcaguagaauuaacaucaagucaagaaaaaguauuacuugaguaucuuuuuuuuuuuaaauccagcauggguaaaaguucacauuaaaugaggaauucagcuugucauggaauacagcaccucaucuuuuuuucuuuuugcccugaagcucuucuguguaggauaugugacauguaagauguuugcuuauagggaaauaucuauuguauuuauccauuuucaugcugcugauaaagacaugcccgauacuggaaaaaaaaagagagguuuaauuggacuuacauuuccacauggcuggggaagccccagaaugauggcaggaggcaaaaggcacuucuuacauggcagcggcaggagaagaugaggaagaagcaaaagcagaaaccccugaagaacccgucagaucucgugagacuuauucacuauuaugagaauagcacgggcaagagcagcucccaugauucaauuaccacaccccggucccucccacaacaugugggaauucuggaagauacaauucaaguugagauuuggguggggacacagccaaaccauguuaucuauaaaauucaugugaucauuggaagcaaaggauuauuugagaaaaguaagggaagacuacuuguacugauggacugucaauaauuuaguacuauuuguucaaauauuaaaagcuaaaaacuuuaaaaauuuaacaaauaacaaggcagacauuauuuuuugaagauuauuuucaccaaauaaucgguuuuaaaaauagauguuacuuuacuguaggagaaaguugugauuaugaagggaaaaguuuuaugauguuauugucauuucaauuucaaaaaaaugagguugucaccuguaaucucagcacuuuggguggccaauacaggaggauugcuugagcccaggaguuugagaccagccuagacaacauagcaaaacccagucuauauuuaaaaaaaaaaaaguugagcucauugaaauauguauuaaucuugguuuuuuaauuaguaaaaauauaauaguuacuugcccuugaguagauuguuagcacuaucuuguuuagauuagugcauagugaguaaacuggcaagaauaguaacuuuggaagaaugaaaaaaaugaacauauuccucauauuucaacugaacucuaugaauucuaauagaauuagaaucaacaaaauauauuuuuaauugccuaccguaucucuacuuucugauuaaacaugguauucuuaugucuuuuuuuauacuuuuaauuuuuauuuuuauuuauuuuuuauuuuuuuauuuuuuuauuauuauacuuuaaguuuuaggguacaugugcacauugugcggguuaguuacauacguauacaugugccaugcuggugugcugcacccacuaacucgucaucuagcauuagguauaucucccagugcuaucccuccccccuccccccaccccacaacaggccccagagugugauguuccccuuccuguguccaugugaucucauuguucaauucccaccuaugagugagaauaugcgguguuugguuuuuuguucuugugauaguuuacugagaaugaugauuuccaauuucauccaugucccuacaaaggacaugaacucaucauuauuuauggcugcauaguauuccaugguguauaugugccacauuuucuuaauccagucuaucauuguuagacauuuggguugguuccaagucuuugcuaucgugaauaaugccacaauaaacauaugugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugaucgccauucuaacuggugugagaugguaucucauugugguuuugauuugcauuucucugauggccagugauggugagcauuuuuucauguguuuuuuggcugcauaaaugucuucuuuugagaggugucuguucauguccuuugcccacuuuuugaugggguuguuuguuuuuuucuuguaaauuuguuugaguucauuguagauucuggauauuagcccuuugucagaugaguagguugcgaauauuuucucccauguuguagguugccuguucacucugaugguaguuucuuuugcugugcagaagcucuuuaguuuaauuagaucccauuugucaauuuugucuuuuguugccauugcuuuugguguuuuagacaugaaguccuugcccaugcguauguccugaaugguauugccuagguuuucuucuaggguuuuuaugguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugugaaagaucagauaguuguagauaugcggcguuauuucugagggcucuauucuguuccauugaucuauaucucuguuuugguaccaguaccaugcuguuuugguuacuguagccuuguaguauaguuugaagucagguagcgugaugccuccagcuuuguucuuuuggcuuaggauugacuuggcgaugcgggcucuuuuuugguuccauaugaacuuuaaaguaguuuuuuccaauucugugaagaaagucauugguagcuuuauggggauagcauugaaucuauaaauuaccuugggcaguauggccauuuucacaauauugauucuuccuacccaugagcauggaaugcucuuccauuuguuuguauccucuuugauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaggaaugcuugugauuuuugcacauugauuuuguauccugagacuuugcugaaguugcuuaucagcuaaaggagauuuggggcugagacaaugggguuuucuagauauacaaucaugucaucugcaaacagggacaauuugacuuccucuuuuccuaacugaaugcccuuuauuuccuucuccugccuaauugcccuggccagaacuuccaacacuauguugaauaggaguggugagagaggucaucccugucuugugccaguuuucaaagggaaugcuuccaguuuuugcccauucaguaugauauuggcuguggguuucucauagauagcucuuauuauuuugaaguaugucccaucaauaccuaauuuauugagaguuuuuagcaugaaggguuguugaauuuugucaaaggccuuuucugcaucuauugagauaaucaugugguuuuugucuuuggcucuguuuauaugcuggauuacauuuauugauuuguguauauugaaccagccuugcaucccagggaugaagcccacuugaucaugguggauaagcauuuugaugugcugcuggauuugguuuggcaguauuuuauugaggauuuuugcaucaauguucaucaaggauauuggucuaaaauucucuuuuuugguugugucucugccuggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauugauuauugccacaaucucagauccuguuauuggucuauucagagauugaacuucuuccugguuuagucuugggagaguguaugugucaaggaauuuacccauuucuucuagguuuucuaguuuauuugcauagagguguuuguaguauucucugaugguaguuuguauuucugugggaucgguggugauauccccuuuaucauuuuuuauugcgucuauuugauucuucucucuuuuuuucuuuauuauucuugcuagcggucuaucaauuuuguugauccuuucagaaaaccagcuccuggauucaguaauuuuuugaaggguuuuuugugucucuauuuccuucaguucugcucugauuuuaguuauuucuugccuucugcuagcuuuugaauguguuugcucuugcuuuucuuguucuuuuaauugugauguuagggugucaauuuuggaucuuuccugcuuucucuugugggcauuuagugcuauaaauuucccucuacacacugcuuugaaugugucccagagauucugguauguugugucuuuguucucguugguuucaaagaacaucuuuauuucugccuucauuucguuacguacccaguagucauucaggaggagguuguucaguuuccauguaguugagugguuuugagugagauucuuaauccugaguucuaguuugauugcacuguggucugagagauaguuuguuauaauuucuguucuuuuacauuugcugaggagagcuuuacuuccaaguauguggucaauuuuggaauaggugugguguggugcugaaaaaaauguauauucuguugauuugggguggagaguucuguagaugucuauuggguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugagugcauauauauuuaggauaguuagcucuucuuguugaauugaucccuuuaccauuauguuauggccuucuuugucucuuuugaucuuugcugguuuaaagucuguuuuaucagagacuaggaucgcaaccccugccuuuuuuuguuuucccuuugcuugguagaucuuccuccauccuuuuauuuuuagccuaugugugucucugcacgugagauugguauccugaauacagcacacugaugggucuugacucuuuauccaauuugccagucugugucuuuuaacuggagccuuuaguccauuuacauuuaaaguuaaucguguuaugugugaauuugauccugucauuaugauguuagcugguuauuuugcuccuuaguugaugcaguuucuucguagucucgauggucauuacauuuuggcaugauuuugcagcggcugguaccgguuguuccuuuccauguuuacugcuuccuucaggagcucuuuuagggcaggccugguggugacaaaaucucucagcauuugcuugucuguaaaguauuuuauuucuccuucacuuaugaagcuuaguuuggcuggauaugaaauucuagguugaaaauucuuuucuuuaagaauguugaauauuggcccccacucucuucuggcuuguaggguuucugccgagagauccgcuguuagucugaugggcuucccuuugaggguaacccgaccuuucucucuggcugcccuuaacauuuuuuccuucauuucaacuuuggugaaucugacuauuaugugucuuggaguugcucuucucaaggaguaucuuuguggcauucucuguauuuccugaaucugaacguuggccugccuugcuagauuggggaaauucuccuggauaauauccugcagaguguuuuccaacuugguuccauucuccccaucacuuucagguacaccaaucagacguagauuuggucuuuucacauagucccauauugcuuggaggcuuugcucguuucuuuuuauucuuuuuucucuaaacuuuccuucucacuucauuucauucauuucaucuuccauugcugauacccuuucuuccaguugaucgcaucggcuccugacgcuucugcauucuucacauaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucucucagcucgucaaagucauucuccguccagcuguguuccguugcuggugaggagccgcguuccuuuggaggaggagaggcgcucugauuuuuagaguuuccaguuuuucuguucuguuuuuuccccaucuuugugguuuuaucuacuuuuggucuuugaugauugugauguacagauggguuuuugguguggauguccuuucuguuuguuaguuuuccuucuaacagacaggacccucagcugcaggucuguuggaguacccugccgugugaggugucagugugccccugcuggagggugccucccaguuaggcugcucgggggucaggggucagggacccacuugagggggcagucugcugguucucagaccuccagcugcaugcugggagaaccacugcucucuucaaagcugucagacagagacauuuaagucugcagagguuacugcugucuuuuuguuugucugugcccugcccccagagguggagccuacagaggcacgcaggccuccuugagcugugguaggcuccacccaguucgagcuuccgggcugcuuuguuuaccuaagcaagccugggcaauggugggcgccccucccccagccucgcugccgccuugcaguuugaucucagacugcugugcuagcaaucagggagacuccgugggguaggacccucugagccaggugcaggauauaaucucguggugugccguuuuuuaagcccgucggaaaagcgcaguauucgggugggagugacccgauuguccaggugccguccgucaccccuuucuuugauuaggaaagggaacucccugaccccuugcgcuucccgagugaggcaaugccucgcccugcuuuggcucgcgcacggugcgcgcacccacuugccugcgcccacugucugucacucccuagugagaugaacccgguaccucaaauggaaaugcagaaaucaccugucuucugcgucgcucaggcugggagcuguagaccugagcuguuccuauucggccaucuugguuccucccccgguauucuuauuucuaaauaugccaaauugcuaagucuuagauggaaauaaauuagaacuggaacagaugccuauauagaggcauauguuuuaucuguauauauaaacaaauuugagacauuauuauuccauuugugacugcuuauaaauguucuccuucauuuaaggaucugcuacacuuucugaacauucaagaaauacaaagcagauuuaauauuaccagagaaaaugugcuuguagaguuuaacaggaaaacauuauuuaucauguguacaauuugugacucaagaaaugaacugauaacucugaaggcagaaaauagguuaugacaguuuguuggugugcuuguuuaauaauuagcaguaaguaauuaaaauaguaacaaaacaaaauuaucacguaaaguauucucauggagaaauuaaaucucauucaauguauaaauaaaacuauauuugaauauaauguucuuggaguacuguguaaaaaugaugauugucucaaacuuuguaauuucagaguaucugacugucuucucucagaugauugcauuucaugauccagagcugaguaaucaucucaaugagauugguuucauuccagauguaaguacuuggugcauuaauagaacaugugguuaaaaaaaaaaagcagaaauuauuagcacagaagaguguauuuucuuaauuuuuguugucauagugcauaucugaacaaguuacugcuacuaauuguagccuuguauuaguaaguuuguggcuacuuuccauauuuccaccuuaaguaaugaaaauaagucauuuuucuuagcauaguugauaguuuugagaaaaucauuagugauaguguuguauuaaacugugcuguguaggcuuuucacuuggauuuuaugauauucaggccugauuuugaagauauaggaagucuauacuuaagugaaaguaacuucuguguuuuacuugauacuacuuugggagcuuagauagauuuuggguuuucuuuucucuguaguccacaucaagcuaaaagucagaguugaaaaucaaacguuagcuguagcgugacuuagccuguuuuuuauuuguuguuugucacauagaaucaagcccuuuuuaaaggcuguugaauaaacauauaucaaaacaucacauuguauccaauaaauguauacaauuauuacuuaucaauuaaaaauaacaaaugaaaguggagaggaaaauaaauuaauaacaaaaguuagcugcuuggugauggggaugcaagugguagcgugggugcaaaggaaauuguuuucuuguuacauuugacauuaaaaaauuuuuuuuaacacugugaauguauuauucauucaaaaguuaagcugaaggcaccugaccucaagcaauuauaauuuuuuaggaagauacuuuauuaaaaauuauugauaaaaaaccaaaauguucacauuacauaucauuaaaguaggaaauguaauuuauaaaauaauauuaugguauuaucucauuuucauaaaauagaauuuaguguauauguguauauacauaggaaaaguugaaaggcuauacucuagaauauuaauuaugauuauguaggguuacaggaguuauggguaccgagggggcuuaagugcaauuuuuaauuguuuucauuuaagguguuuuuuuuguaauguuaaaaacuuccuaaaacuauauuaugugaucauguuuaauagaauacuauaaagcaguuucuuaaaaacuguuuauucucacaaugcaugggaagaaauacauuuuauauugagaccuggggcacacagaauucgagugguguuguguauguguguauacaacuaaaauaaguuuuacaaaacaauguuuucugccuccuacaugugaugcauuguguuauuuuugaaaagucuacauuuaauaagaugauuuuauaaaccuaaauuugaaaaauacuuauauaaggaauuuaaaaaaucaauaaaaacugauuuuuaaaauuaaagaauaaaaauaaaaggcuguuggaguauaauaucauuauaaaugugagguauaauacaauauagauccaaucuuauggcuagaguugaagaagcugucaaggagcugacugccaaguugguaaugguguuagauuuuugaguaaaaaagaauauuaaguauuuaaaauuuagacuaaaaaagauaauuauuuucaaaaaauuuuuguaaaggcaccuaauuaaauugugcucagcacugaacagaaacagaaaacauuuauguagacaaguauguuuggaaaccaggugcgguggcuuaugcuugaaaggcugaggcaggaggaucacuugaggcuaggaguuugagaccaaaacaacauagcaacacuucaucucuuuaaaaaauaauguguagaauuauaaagauaauccaauaaaaauccuuagacauauucaugaacagagauaauauuaagaaaggaaacacacaaggacaaauaacuuuaguuaaucagaaaauugaauucugaaugaguaugauguaagaaacaauguugaguuaaaaauauuguuaaaacauaauuaaugugaauacauauuaaauguuuacuguguaccaagcacuuuuccacccucuuuaaauauuaucacucaucaaauacuacaaguuuauaaaucuguguaaaaaguuacuuaaauauauauaaauccacuuugggaagggcuaauaauaaggugaaaauaaaauucuaaauaauaacgugaaagguaaaaguaggugggaaucaguuaaaauguguucuaauguuuuagcauuauuuagagggaaugcucauuuuauuuagacauuaagucagggaaccuuucagaucugagauuugauuguacccuccuugaaagcuuauaaguuagccuauuacuguuuucuggauacaggcagaaaaugcaagauuccugggccagagaccaaggacauuaucacuaacaguacagcaagcagcaugaacauuagcauauuuguguugguuucucuugcucucaaauccuauggaaacaacaucaaggacccagaugauaccugcauauguaguggauuacauuacaagagagaaaccaugagcuuaaggaauuggauuuuuuuuuugccuucccuuuguucaagagagagagccugucuuuuucuucuaaggcuauuaguaaaucugucuuuugucuagaaggagauuccauuucugcuuuccaaggcuguuuuuuauacaaacauauuugaaaagauagucuagaacaaaggacaguaaaugucucuccucacaagaaauucagaaguucaauaaugcacauuaaaauuuuaauuuaaugguaauccugaaaagaauaaagagagaauauguaacuucuaaaccaauggaggggugcaggauagaacaaagaaaagacauuuaaucuuauaaaagcagaaagaacauagaaagaauguaagcuaauuaaauggcuuauuaaaggagauuuucagauauuuuugaaaaucuaucuugauaguacuuauaagagauaaauauaaaaacuuaaagauauuggccaaaggagauuaaaaaaaagucaggcaauuaaccagaacaacauuagugauauuaauagaagcuaguaaaauacaagagagaacacaaaacagacccaucccuguauagaauuuggugauauaugacagagaugaccauacaaucaauuagaaaagaaagcauuguugaugguccugauugaguaacuauguggauguggagggcaguguaaaugaaagccuaacuucauaccacacauaaaaauaaauucuagauccauuagaagacuuaaauauggaauauuauauuuguauuuuuuuaucuaagaaauaauucuuauuaagguuacagaaaguauaaaacauaaauuuaaaaagagaggauugaaauucaggaguaguacaaaaggggcuucuauuguauuggucauauuuuauuuugguuuaaaaaauuuuagaguaaauguggcaaaauguuaaugcuuguuaaaucugaguggagaguacauugguguuaagugugcugcuaugcagggugagugaauuacucaauaacuaaauaauugugacauaauauauuuauuuaugcuucccuguuaugaucuacacauaaaauuacuggagcauuauugcuuaacuucuuguaaaaaaguucugcaauuguaguguuauuaagaaaguaauauugauuuguauagugacagaggauuuuuucagugucacuuugccagcagagaucuucauggugggcauugccccugcccaugucucacuuggcccugggcuugccccacuagguacccugcccaccuggccaggcaggcugugcuuggcuugagcucuggcccagauccugcacuugcucugcggcugagccaggcaugccaugaccuacuuccaccuugggagccggcgucuggaugaggggaaugcugugacacuugaacagaggugggcaugugaccccaaagccccaaaggggguguuacagcaugcuaacaguucuuucagucucacauccacagcccaacaaauggagguguguggugcccagaggucccuucucccauuguuuggcaagcaggaggggugugcuacaggguuacagcuuuguuugcacuugccguuugguggguccugaguucuuuucccauguccaagaauaagguugugcugacagcuagcgguugagugaggcaaagaguuuuacucaguaacaaaacagcucucagcagagaaggaagccugaguuggacagcacccuuaccugaaguuggguagucuucccaccaccuaaaaguggguagcccaaaguguggcugagccuggggcuuuuauaugcucagaaugggaguguaugugcuaauugguuugugaguaugcaaaaaaagcuaaaaaaaaaaaaaaaaggcaccacucaaagauggccacaacaguguaaaaaacuaauuagggaaggguagguauauguaaaauaggugaaugguagggaucaaucagaggaaagugugccauacgggagagguucucaauacauucuguagauauguaugagaccuguaucuugguuuucagaccuuaaacugucuuugguuuaagauuggauuacacuggggacuugccccaucugccuagggauuuuucugccuccugcugcuaucaaugguagugugauuagucuucagagacaguuuuaagucauaugggaugggaaguaauucuuugugggauaggaauauccagcacauggcaaaugcugagcaucccugacccccaaccacucauugccacuagcaauccucuaaucaucauuacaaaaaaaugccucuacacucauuucugaguaauuaauucacauguauuucugaauguccucuagcaaacgguucugucacuuguuaagaauuuuagaguaaacagaaagaaaugaggggaaauaauauaucuuaaccugaagaagagucccaucuacaacuguuuucuugucacagagagugggcaaaguuauucaacaaagaaagcuaaaauguuaauaggaagacuguuuuuugaaaucuuuuucuuuguguuuguuuuuuaauucagcuguuuuucaagccuguggauaauauaaaaaugaugaggccuuuuuuaaauucaauuuugugaacagauuuaauguuucaauguagacauuauugacagugaguacuuaugggaggggcaugaugaaauggaggacuuuuaaaaacauuuuuuaacucuauuaauaacauauuuuaguuguauuuuauuaguuuguguauauagcauuuuuuaaaaauucugaaugguugucuuuaauguucuaccuuuaauuauugagguaacuuucuaugccucuaacaacaauacaagcuagauucaucaaguaaaagaguggguacuuugauaaugauuuaccaaaccgaguuuccuacucaagaacuaaaccuaucaaaguaagcccucauuaaucuuucaucauugaaauucaggcuuccauugcaguagagauugugauuucuggcuuuuuuccuuuugcucugggucacggaacucugaauacugagcacugcuaaagcuugaauaguuagaaauauuguacacugaugugaugccuagauuauacauuucaugguaguuaugugauuuacauauaaauagggugaauaauguguauuugauaaaauuggagacagggugauauuuaucauuuuugucuugauauguguuucugcuuuuaaaaauauaguaggccucauuuaaaaugagaucaggaaaguaugauucauucuuaagggaacuguuuuccugaaauucugugaauaguauucagcuugcaaauuaugaagaguugucagguaaccauuaagagaaaugauaaggaguguaucaguacuauaugugccuuuucaaccuacugucacagcuaaagauaaagcuaacaaauuccaugauaugcugguaaagccauugacauuuaacuacaaucugaaaggaugcuuauacuacuuaaaagcuuaucacaaucauuuucaaaauguauauucagccgaguuuaaacugcucagaaauauuuauguauuuguuccuucauuuguucuuuaucuucauuauguuguuacguaaauaaauuuuagauuuuagucuaaagagaauacugacaaugagcuuuucagauuuuaucaagauguaauuacaggaaaaacuaggaauauccaccuuauuuagaauaucucauaauaagaguccuacuagccuguuauagucucucugaagaguccugugauguguccucuugucugguagcugcuauguccccaacauuaguacaaaccccauucuacuggcauuggauccauuaaggccuuugaauacaaauggcuuauuaaagucucucucucguagugaagcuugauuaccuuucagaaagugcccagauuuuagaaaucaaaguggcuauuaauaguaucagggaugauaaaaugacauuuuugguacuuucuagccaaaaaacuauacacacaaguuaaauaucuagcaaguuuuccaauucaguaaauccucauuugcauuacccccacaucuguuucuaaucuaaugauuccuuaugcuguccagaaacaggugaaaggaaguauggcauaauggagcaguucuaaaacauuuugcucucagaaccccuuuauauucugaaaaauuauugaggaccucaaagaguuuuuguuuacaugaguuauagcuaucgauauuuauagagauuuaaaauauauuuauguauuuauaauucauuuaaaaauaacaauaacaaaaccauugcauguuaaccaaaguaacauauuuuucugagaaauaguuacauuuuuccccaaaaaugcaauagugguauuguuuuaccuuuuuauaaucuuuuacauuuuuauaaucuuuuuacuuguuuaacuauaugaagaaaaugugaccucacacagacacguuaauaguuucucagauagcgguaguuucuuaaacuucucagagcagugguuuuuuuuguuuuuuuuguuguuuuuuuuuugagacagagucucacuccaucacucaggcuggaagugcagugaucucggcucacugcaaccucugccucccggguucaagcgauucuccugccucagccucccaaguaacugggauuacagguguuugccaccaugccuggcuaauuuuuuuuuuuuuuuuuuuuuuuuuuuuuguauuuuuaguggagagggcuucaccauguuggccaggcuggucuugaacuccugacuucaagugauccaccugccuuggccucccaaagugcugggauuacaagcgugauccacugugccuggccucauuguuucuuaaagcuaguugcuauguacagucuaaaaccaugucagugaacuucucauacucuguuauacuaaaauccaucacucuaucuugcaauuuagauggcucuuuuacucauacauaauuuuguagugucaugaauuugucauugaaaaauauugguugcugaguuacacagaucuuccaacuaugaagcauuucauuauagaauauuuuuaaaaucacauuuauuaauaucacaacaggucuucuccaaaaagugauuaaguauugggaaccgaccaauuucacaguggcagauauuagcuuuccaaaauuuuaaucuucgccuaaaagcucucauuuuuucuuaaaguaacuguuucacuuuguacauuuaaaaaaaucauuguuugggccgggcgcgguggcucacgcguguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaaucauuguuugucugucauucuuucaaauaaacauaguauuucuugcagaaaccaucaauauuagcucacagaugauuacccaagugcuuuaccucuuuguacuucaguagauagcacaagugcuuuacacuuacuuccauuuuauuucacaaauuuuaaaagagauauuuaauaaauuuaauaauuuuuacuccuucacaugaccauuauuauacuucggugccugugccuuaaauugugcuaacaugccagcaguuuuauccaccaguggcuuugcaccauuagcauaaauaucaauccaguaaaaagagcaaaucaucuuaguauuauuacaaaaauagcuuugaauugguggaccccgaagggacuuaaggaccgccagggccugugaccaagauuuaagaaagcugguguagagguuaaguacucagacacuugugccaaaugguccaggguucuaaauucuggcuauuccauauacuaauuacauaaucuauuuuuagcuuuaguuuuaguuuuuucccugcaacccucuuaccauugauguagauuauaauaaauucuaccucauaaugaaguuuagagaaugcauauaaacuguucaacacagcuccaggcacacuauaauuguuaagggguauuguucuuuauuuaauauuacuagaguuugaucauguugcauuauuucuuuuauuagcaugauucauauuuagaagaacauuauauuacaagcuauaauggauauauuauuuugcuacaucaguuaaugaauacucugucagaggagguaugguacuaauaacaauaaagacuuucaagguugucugaauugaugagauuuucugccacuuugaauuuuaaucuuuuuaauugcuugauuuuaagguacuucucuaucucaacaaagugcuacauaacauguuuuauagucuuucuuuuacuuaaaguaaauuagaaugaauuauguuugaaaauuuugaaaaguuuuuuguaguaaucaaugaaauaauugaaauauauucuggaauaauagcucaucuuucccaaaaaugauaauguagaucucagaaccauuaaauuaucugagugauuuucuuguaaguuuucaguguauaguucuuuuguucaauauuguaagccaacugagaauaaauaauaaaagguauguuuauacaguuaguuauuuuuuauuuguuucuuuuuuuauuuagagaaaucaugaccuguaaaagauauaacuaauauaaucuuugguauauagaggaaaaaaauuaaccauuuacuuuuuggguccaagggaucuuuuacauuauuuuuauauguuuaagucauuuugugaauaauuugcagaaguagaauaaagcauaguaaaaaacuguauuaaaauauuaagaauuuaaacacaacaaacccaaaauuuuaugucauauauuccuuauuuugaaaguauauauauauauauauauaugugaaaauauauauguguauauguccuuugaacuuacugcucagcugucauacaugagccugaaggauauccaucauauaaauacugauuccguauuucaaauaugucucucauagguucuagcugauuucugguucuucuugcacuugcaugguuauaacacagucaucaaaaugaaacacugacagagcucauaacuugguugaagaacagcugucuuuuauuccauaauuugaaaacauuuucauuuuuagauuuaugaacacaaauuagaauaaauuuaauuuuuauuucuauaucaucuauuuauaauuacauugcaaacacauacacuuauagcauuuauuugcuuaaacuguaucaaaaauuuuggugcacaaauaucauaaaaaaucaaauauuacucucauauauccuuuuagcaaaguaaaaugguccagguuucuuauugcaaaauauuguguggugaggcccuucacauugaaugacugacugaaugagaauuccagacuuauuuauuguuuacucugauagcuguguuugaggaaauucaccuaagagacugucaucugagcacucacaauuugcaauaucacuugugugacuaauuuuaccauuugacuugaguuaaacuguugcuaucuuuuugcauucaucuucugauuaguccaguaauuguaaaacauuuuccccuguuaugaaacaguuuucucuuuucuuuuuaauaauaaagguggaaaauggaaaauucucaaucuuuagcuguguucaaugaaaacguaaaaaaacaacaaaaaaucuauaaugauggugucucuguacaucuuucauaucuucuugaaagauggugcaauacuauggcuagcacaaaaagaaaaaugaaggauggcauaauagugaugauuuauuuuaguacugugcuauccuuguagaugauuccaucauucuucuguuuucuuauuaguauuuuuaagcauaguugagaauaauuaauugguauugaugaaauaauuguuacugauaaauaaaauauuuuauacagugccuaggagucuauucuuuuuauuuucugcucaugccucuccuaauuuaaaaaaaaaaaaguguguaucuuuuguuauaugacuuaaugagguuaccucagaacuuuggcuuguuaaaauacuuuuccauuacugaagauucugggugaucauuguaacuccuauauuuaaguuuacuaaaugccagauguucuagauccauuaacuaaucuucacaauaauccuaaagguucaaggagauaacuuuaucaggucgcaaagugcagauuuuuacacauucuuuucuggaaugucuguauauauguuuccuaauguacauauaaagaaucauugcaaaagcauuaaacuaauggucaauauguauuacagagaaggcauauaauaauuuaaauaugaaaauacuucugacuuaagauagacaauauaguaugcuuauaaaggauguggauuaagaaaaucaauagaaagggacuccucuuuguaguaguaaaacauaauuuucugcuuuucaaaaucaagaaaauuaucccccuuccuuuguuuuuccuauugaugguucucccuuccuuuguuuuuccuauugaugguucuaaauuugacauuaccagaccacauggaaggaucucaugaaaugcuaaauaucacuacucuugcuugauauugcuagggggcaguauuuacuuagcugacuguguagaauagcacuacaccaaaucaauuguacauaauuucaugaucuggagaaaauacuuagaguauguaugauuucuuuucauuggauuucauuuucuauuaaaucaggaaauagcuaauaauaucucuaauauuaaauugcuuuucuuuuuaaucaaaacccaccugguauucaaaauuauuguaucuugaugucuuuuuuauaucaggcuauauuaugaagcugugccaauauccugaguaauuauuuaagaugaaaauaucaauauuuuaaacgggagaaauauagaaagaaaaaauaauagacauuacuaucucacagaguacauuacuuauuuauuaaucuuaauuauccuuaauugguaagagauaacugguucugguaagcaccuaggagcuguuauauguuauauuaaagauauuuauucaacuugaacuaauuauuacuuuucaaauaucauuagaauaagcuuuguuuugcuuauuuuaaauaauuuuuuauaauuauuaucaaaguauagguauauaacaaaaucucaaguuuaauuuuuuuaaauacaugccauuauuuaauaugaaggauuuuuccccaauauuaagcaaggaaggacuaacucauuuucucauuauuucauauuuguugaaaacuucuuaagaaaauauauaaucucaugacuauuuggaucuuuuaauuuaucacuuucauugauuuucauuguguuuuucauucauucuuucaacaaauauuugauugauccuuucaacaaauauuugugugccuauuaugugccagacauuuuucuaugccauggauaauauaucagcaauaaaauaagagauagacaaaaauaucugaccucauauucuagaguaaauagacaauaaugaagauaaauauauuauaugguagguagugguaaguucuaauuuaaaaaaaaaagcuaaagcagagguauggauguuaugugcucagguaaagaagagauugaauuuucauuauuuauuucugagacagggucuugcucugucaccuaggcuggagugcaguggugugauuauggcucauugcagucucaaccucuugggcucaaguaauccucccuccucagccucccaaguagcugggaccacaggcaugcgccaccagacccaucuacuuuuuaaauuuuuuguagacaugaggucucccuauguuacccaggcuggucuuggauucuuggcucaagcaguccucccgcuuuggccucccaaagugcugagauugugggaaugagccacugcaccuggccaugaauuuugaaauaaguaagguaaccaagaaaaccucacagaaaaguugacuuaugaauaaaugcuuuaagaaagcaaaggaaagagcaaaccaagcgaaagcagcagcaguugcuacagcccugauguggaagcauaucagagauguggaggagcagccaguagaccauuguaacuagagcacagugaacaagaagauaaggucaaauagguaauagagggccauauuacauaguuuuguugaucaucauuaggacuuuggcuuuuauuguuagagguggaaagccacugaugcuuuugagcagaggagugaugucucauguaaagauuuuaacaaggucauucuggcugcuaugcugagaaaaaucgaaggaugggcaagaauggaaucuaggaaacuagucauggacuauugcaauagucuaggcaagagauaauguuggcucgaaucaagauauuagcaguggaaguagugggaaguuuuuauaugcugcauaucuuuugaagguagagccagcaggacuacuggugacaaauauacagugugugaggaagagaggagucaaguaccugagcaauugaaaggggauagaguugcuucuaacugagauuuggaaacuacuuggagguauagauuuugaaggaagucucagaagcucguuuuaggauauguguaucuguuagacaugcaaguggagaaaacaggcauuuggauauacaguuucagaauuuguaggagagguuuagggauggagcugaaauaggguccucaaacuacacaguuauuuggagaaaaauagaaaagaaaagaaaagguaucuaagaacugaaccugggacacuccagguugagagugagagagaggaagaggaaccaacaaaggagauggauaaggagcaaucagaaagauaagaacaaaacuaggugaguaugguguuuuggaagccaaguggagggaaaaaaauguucugaagaagugggaauagucaacuuugucaaauccugcugauugguaaagaaagauugcaauugagaauuggccauuagauuuaaugacauagaaauuauugaugaccaagguaagaacaguuucaguggugagguggaggcaagaacuugauuagaguggguugagagacuauuuaaugaauaucuacugcucuuauuguaaguucccuguagccuggaacuaugcuuuguucacugcuauagccuaucaccuaacacagaucuggcauguauuaggcacuuaguaaauauugaauuaaugaauaaaugaguaaaauaacauuuauucacaagaauccuaucauucuccugcagagaauaugauaggaaaggccauaagcuccuguaacuuugcugccauuaccuuauaccagaacuuguauugucguacuuaauaguaaagcauuuuagguaucuguucguaugucugacucuucugcuagagugggacacguggcauuuagcacaaagcauuucauauugaauaaaugaacaaaagcaagcaugaaugaaugaaagagugaaugaauauacccagaauuaaguauaguacaaguauguugugauagguaauuauaauauaaaaaugauuaccaugauuauauauaauacaacuauauuauauaugauacaaagcauagugggauagguaucauaaaaaauauacaaaaaguuuucacagaacaaguggcauuugaggcaggcuuggaaaaaucuuguagagcuuuggauugauggaaaugaucaggaaggagcauucaaagaagaaaaugcaaagugcaucguuaggaaaguaguguguucagaucauaguaaaucugccuucucaggaaguagaacauguguagggaaguaguaaggugcaaagaaauuuagaguuucuuauacugauauuaauaauaauacuacuuuaaauuugcagguuguuacuguuuacaaagcauuuucacauauauuauuuccacaucacaccaucucuaugacauaguuaagacagacauuaguuuuccuauuucaaaaacgaagaucugggauucacagagguuaacuaacuugaccaaggcacgcuauccaguaaucaucagagucaaaacucaguuguauguuuucugacuccaaguccuuggcuuuuucacuaauucacaguggccuuaaaugcaugaguacaaaauuguacuuaauuugguaugcagugggaacauauugaugugguggaacagaggaaugaugucaucacaguugcauauuuagaaaaaucaauuuggcuaaaggaaauauuggaccagguagaaccugaacaacuaugaaacauuugcaguaguccaugaaagaagaaugagaaccaaaacaagauuaguucaguaugaauggauagaaacagaagacugaagagaccuuguaaaaauaauaucuaucagacuuacuuuuauaccuaagauuuuucuaccuaagugacuauaauaaugguguugguagaaaaaagaggcaguuugggggugaccaugagugugauugggugcaguuaaguuacacugaaacaauuugauccuuucaaggcuugcuuuuaagguuuauuuaauggggccagagcagcuugguuuuggagcauaauuuuccuccauuacuaaagcaaugcucuucugacuacucucccuaaugccuuguuuauaacaguuguggguguuuuuuuguuuuguuuuguuuuguuuuguuguuuucauucugguuagugaaaaaaugaacucuucuuggcauuuuaugaucuuggcauuuuuucacucugaucauuugaagugguuucugcccuacuuuguauuauauauauauauauauauauacacacacacacacacacacacacacucagauauguuuucuguguacacacacacacacacacacacacacucuucaguaauuagcaaagauuugaggggaaucuucagcagacuucuggagcuuucucuaugcaucucucucucuggcagaaucuuccaggacacucuccugaagaguauagccaccuugaucuccccagauuuccuacucugcauauucagcuuaggacaaccaccaagcucuuucuggguucuuccucccugucaguggccuggaacuucuuugcaugcaguaaauugggcaauuuuaggguucauuucauuuguuucuccucucucagguaccacucucuaagauguacaaauuguuguuuuauauauuuggucugauuuuuagguguuucaguucaggagguaaaucugguuccuguuaugccaccuuggucagaagcagaauucuuccauagaucuugaugaagcuaauuacaaagacuaguauaggagaaaggcacuguuagcuaguugcugaaauaauuugaagaagauucuuaaugacaguuagcuuucaucaaaaagggagaagguaauauugaugucgugucuuuaaaagagauguugaauaauagcaaugaaacuaauuuugcugacuuuauuuuuuaauuuaaauuuaaaugaacaauuuauguuuuauuguuuucuacaacccuuacucauuacagugaagucauauaccuuuguacuuuuuccuuuuuccauuuauauugucccuagaaaaauguaucuaaaugucagccuauaaaaaaugaugauaugguggagaugaguggguuuuauuucacauguaguacuuagauuuuaauauacuuauaaaguucuugacugucaucuugauaguauaaauacucaauugagugaaaugcaaagacaauaugcaccuuuuacucauaaauucauaauugcuaggugcugaaauaauauuuauuuaaacuaacccuguagguaguaaagaagucuuuaauagcagccuguauuaacucauaaagugaaauaaaauuagugcuuuuucaguaaauuauuguugauuuuugauacuugcuauugacaaaggagauuuuuacucuacuuuuauaaauuaaggaugauuugucacuucuaaaaccuucuaaaauuugaaaauguauaugucuauauguguguauauagaacgauauauacuauauauauagcuauauauguguguauguauauauuucuagguaguaaacuuaggagaauaaauuugucaaauuauuaauaaugguaauauuagaucuuauuacuuuuagucuguuaugaagcauccuguuaauuaagugguaacaaaaagcacaugcuucauaauaccuuuuauugagacauuuugaacauuuaaaaaguaucuaauuaauucuuaaaaauacaauuaagaguaccucaaaacuuaugaggacuguauuaggguucucuagagaaacagaaccaauaggagauauauaaacauagauagaggagauuuauuaugaguaauuggcucacacauuuauggaggcugagauaucccacaauaugcuguuugaaagcuggauacccaggaaagccagugguauaauugagagucuagagguguuuguaauucugauuccaaaggucugagaaccaggaagcuggugauacaaaucccagucuaaaggcaggggaagauuagaugaaauguuccggcucaagcagugagguagaaaagaagaggcacauuccuccuuccucuaccuuuguuuuguucaggcucucaguugauuacaugauaccuacccacacuggagaggacaguuuacugaguccacugauucaaaugcugaucuuaucuggaaacaccaucacacacaaacacacacacacacacaaacacacacauuuaaccagauaccuagguaucaccugaugcagucaauuaacuaacacaaggaucuuuaaaaucucagaaauauucuguacaaaccuguaaaguaaaauauacccuugaaauuaguauaccagcauugcauuuggauuagccauggucuugagucuauccuuuggugaaauaaagacauucugugaauaaucuuugccaaaagagucaucuacauuuguaauguggauaguaucauuauauaagaguauuuguaauaacuguaauuaccuauguuaaaagaaaaaccuuugacaaauuaaauuuaacagaguuuaauugaggaaagaccaauucauaaauuggcagcccccaagccagaagagguucagacacuccagcauagccacaugguggaagauuuauggacagaaaaagaaaagugacauacagaaaacaaaagugagguacagaaacagcuagauugguuacagcucagcauuugcuacagucuguuuacacauccaguuagauaugauucacuauguauggagaaaucuuuaggccgaacuuaaaacauuuaaggaggcagcuuuaggcuaaacuuaacacuacauucucuuuuauuuuaaccaauaaaguagaccaaaacauagaacuuacauuuaccauuuaguuuauugguaaucauucuaauuaucuuuuuuauuuccuuuuuauccauucccuguaccccuuuuuccacucauagcucuaugccaucccuugguuucuuaccauguuuacucguaaguaugacuucccccgguuuuuuugauauuguauuagcaaaaggacagcccgaugccuccccauauuuuauauuuacaauaacauugagcagauuuaguaaguauuuuuauguguuucuaacauaauagaguuagguagaaaagaauuucaguuguucugaucccugaauaucaaagugagaauucuauaaaauaaaaaccuauuggacauuucaugauauuuguacaaacucugccccccuuugaaaaaaaauuaacuauaauauuuacauaaagcuuauaagggcaacuauuacaaucaaaucaggcuuaauuuucagagauucuucaguaacuuuuauuuuuuaaacuaggauuccucuagaaauuaagcagauuaugugaaugcguaauacuuuaauuugcuacaaauauuaauaaaguggacauccuuacuaauaaaauaugguuuacaugguaacuguaauaauauuugaaguagauauuuaugcaguggccuggaagauauacauaguauuguuaauaagaaaaaggaaguuacaaaaaauaggaaguugcucauaggauuuuuggugggaauuuauuaaaacaguuguuuagagaauauaauagauacguuauuuuacuguaccuaaaacaacacuaaaguucaucuagauaaaucugugagaauaauauaacuggaaaguucugggaagaaauauuaugaaugguuaauaggguuaaaaauauuaucuguuugauuaucaauuuuuuaagaugccuuaggaagcuauaaauuuucaaagccaaauaaacauuucauaaaaagaguuugguaguauuagcucugaaguaauaguuuugaccauaagguaauaauuauagaacuaguaaaguaaguuguuauuguuuuaauuguuauuuugguuuuuuaauuuauuuguauuuuuaucguuuuacagauguauuuccacuacacaaaauuuuccaccucugggauaccuuacuacuugggaauuccucuuucccauucuguauuggaguagcaauucuucagcagcugcgggaccggcuuuuggcuaauggcuuuaaugaguguauucuucucuucuccgauuuaccagguauagaucuaaauaaauggagccauuaaaugaaauuugacuaugaaauaaugacacauucuuaagccauuggcaaaaauaaccauccaggccuucagcaucucuucuguuugggccucaucauccucucuggauucuuucucucauauacugcuucuucugcugacccagcauuguaaauacaaaucugggucauacccgcucacugugauuuacuuccaucuugguaaugcuacuaaauggguaaaaugccaggaaguugggggcaauaucauauuugcucuuuugcuuaggacaggggcuguuucucuucagugauggaaaguauagaaaggccacuugggaagguguuuaagaaucuguguuuauaaaaagauacaauucacaaaacuuuguugccucccagccaaagcugcuugcuaacaauuuuacgauuugacaaaaggaaauacugcccucuugggaggacaaaucaucuaugucaugcaaugcaggagaauauguuaagcuauauagaguauucacaaguaaggaguuuguaaaccuaggaguugaaugcuuaaauguagaaauauggauaacuauagucugagcuuugaagcuauggguaaaaagaugaaauuaaugucguuaccuaggauguaacuaaaucuauauuuuugcagaaacuucaguuuuuuuaggugaaaaaacuucacaguacuuuauugacagcaucccuugugcuguucuccauauuuucaggcaggcccaaguuacugcugauaauaaacacacuuaaaauuaucccagaaucaaauuugccugaaaaccaaauaaaaaacaaaaggaaggucccuuaagauuaugucuuuauuaauuacucucaagaaaaauaagaaaccuacugccagcccucauuuuuauguuuaauggaugaucuguacuugguacuuuaccgccucucuguugaaauuuuuuaucauuugugggaaaauaauaagaaaaauaccuuggauuuauuuaaaacuuuuuauucccccuucccucaaaauugaaacuauuaucaucagcuuucugacuuaucaaauuuuaauuaaagugaguuauuucuuacuaugaaugaauaguuuaggucauauuuuuuucugggagauuaugaaaaucaaguuaucuauuuuuuuguuuugaacaguaauaaauaagcuaguuucgcaaacugggaauacuguuuauauuaugcagaugauuucuugucauuuccagcuugccaaaguaaacauaagaugauugauuaggauuaaaauacauuuucuggccaguucuaaaaauauauauauuaggaaugcugauuguacauuuucaaaucaagcaaauguauugccuuuccaauucaauacauaaaugcuccuguuaaacacuggugaagcaucuguuuuuauacuuuauagggagauuaguggcaacucugcuugucuguuaaaaaauucaugcaacuguguauuuuauggucgacugacauauuucugucuuaauuccauaggaaaaauuauucuaugucuuuaaaauugccugcuuuggguuuacuuuacagaugguauaagauuagaauaaaguuucucgauuaauucaaaacugaaaggaauuguacaguauucuuacuaaugaucauucaagagauguuaucuugcuuguuuuaggccuuaaaaaugaaauucugguaauuuuauccuuucuagucacuauaucauaacaucugucaaaccuuauuaaacacucauguuguucagagcaugcuauucaaauaggaaugaaaucuauuuaguugauguagugucagcugguacaauuggguuucuuugcuuaauugcucuuacugcaaauucaucuuuccaugaaauaauuaaucuguuuugcuuauaaauagguuauccuacaugcaaagacccaagauauuucaucuuauauuaauaacucuuaaauucagucccagcaucccugcuccuaacaucucaaugcauugaugauagguccuauuaaagcacuuaacuggaugaacaggaaugacauuuuccacauauuuucaaagcugccuagcuuaucuaugucuucuuccuuuccauuuacauuaccaccucauuccugaacaaaauauuauuuauuaguaauaguauaaacuucaaauaaauaaguucaaauguucacaguaggcacaaauuugauauuuuuaacugaugagcauucuaucuguuaaaaguauguaugaauaauacuauuuucauuuuauagcaagauauucagugaaauacaaguucagucaucccccgguaucgaugggggauugguuucaggacucccccagauucuguaauccacaaaugcucaagucccuuugcauguaaccuaugcacauccaccuuuauacuucagaucaucucgcgauaacuucuaaugccuaauacaauggaaaugcuauguaaauaguuguuauacuguauuguuuagggaauaaugacaagaaaaaacgucaugcucaguacagacacagacauucauuuuuauuccccaaauauguucacugagcaauugguuaaauccauggaugcagaacccauagauauagagagcugacuauuuaagaaaauuuuguauguacuuaaaaguucuucuuaccaaccuggcuaacauggugaaacucuaucucuacuaaaaauacaacaaauuagacgggcgugguggcaggcgccuguagucucagcuaguugggaggcugaggcaggagaauggcaugaacccaggaggcggagcuugcagugagccgacauggcgccucugcacuccagccugggcaacagagugagacucugucuccauaaaaaagaaaaaaaaaaaaguucuucuucuucauauguuuagauugaauguguucugcguguauuuggauaaguaggacaagaaucuggugaccucugauuuuauuuucacacuuauauuuuauguagcauagaauuugagagaauuuauuuggucucuuaaaacaauaaggcuuugaguuuacuugaaguaaaacuuauuuuagucagagauauaguguaauugugaaguuuuagcuaaaacaaauguucauauucaucuaagcagcaguuauauuuucaugaaaugcuuaaccaaagcaaagaaagcagguaucaauguugugguucaauaucaccaucagaugaguggacaguugacuacuauaacuuuuccauuauucaguacuuaucuuaauaaagcaaaagugcugccaaguaaauuuaguuauacuacauuuauauccaaaguuuuuaaaguauuuuagagauguuuaaguauauaaaugggaaacaauuuggguuuucagucaauaguuuuuuauuguaaucuagggauaaauauaaauuaaauaggguuacuguaagauuuauguguaaucuuuccauuauaaacaguggcuuagauuuuugaaacuauaagacuuaaucaaauagcuuauuauagccaguaggcuacuaauuugugaccucuuuguuaaauaguuaucauggugaugaauacugcagaaaacaauaggaguuuaaaacagggaguuaggcaguuuuucuuaaguaaaugauaccuaagauaauauuugaaauuauuuaagugauauuggggaguggggaguggaaagagaggaaaaucuuguagacagagggaauaaaaugcucaaaggccugaaacagcugaaggaaguuggagcaaaugggaaaguggagaggaguggcuagaaaagugaauggagagguagacaaagaaggaucaugcagcaucuuguaggccacauuaaagauuuuuaaaaauauauuuguugagauauuuuuucaguauuuuugaaguaaugaaauaaguauuuaaaauaacaucagguaccaaaauacgaaugcuauaauugauauuaauauuuguagagcuuucugaucucucuacauuuuuuucaaggugaucuaucaugagugaagcaaaggauucuuaacauaagugcucccaauaguuauccaucauuuuuucucccuggcuuauagccagauaugggauggagaaaugauuugugaaagaguagagcaacuguaguacacaguuguucagugaaaguuuuguauugucaagccuguaagauugaugccacuuuaccugaagcugagaauuaauuauucccauuuucugcuuguagcuacaugauauucaugcaugucaugcaugucuauuuuucuuuuuuuuuuuuuuuuugagauggagucucacucugucacccaggcugaagugcaguggcacaauuuuggcucacugcaugucuguuucuaaguacaccuuggaauugcaaaaggacaaucaaaauggaaauuaaauuuggagguuuuagcagugguccuucucucccccacccaucuguaaaaauuacauauaaacauuaaaaucuggauggcauauuaaagucuugugaguuuaaaauuaguuaaggauaagugagaaaguaguuaauuuguuuauauuggcaugguguauagucacugaaauaaaacuuuaugaaaaauuacuuuuaaaaccucagguuaugucagucuuguuugugguggaaauacugcauuauuuuauggaaaaggggaaaauuuaaaaacagauauuacaauacaucaccuccaagcuaauaaauggucaugaaaauagcagccaggagcaugacugaugaagacucugaaauuguaacgugauucuaggaagcugaaagaauucacauaacacuaaccuaauuguugcucuugaagcauacaacuaauuuugcaacauguaaauacuuuauaaaguuuaaaagaaauauuucguacguauugggaacuguaaugaaaaauaauguuagaggugaucagaauuuuuacuuaucuugaaaauuuagaguagaucugaguucuuauacaucuuaaaccuggucccaaauugucaagaaucugauaggaaggccuuucucuauagcagagcugcuuguuuuaugguugauaaggguuucugguuugugaaaggauuccugcuuucugaauuuuuugagcaguccaaaaauuaucuuauaguuuagaucaguguuauuaagcauauuuuguuucaagauaccaaugauggcauuagguuuauauuugcuuuacuauugaauguuuauaugugccuuagauuugcaaaacaaaauauauagagcauuuuucacuuuugaaguagauuaaaaguaauuaaccucaaaaaccuuuaaaagucagaaacuguuuaaaauaucccuacauauacugcugauagauauugcaauaagaauguaaggaccaaaauguauuaaauuuaagagagagauuuaaggcaucaaaagaauauaccuugaaauaauaagagccaucugugagaaaccaacagccagcaugaggcugaaugggcaaaaacuggaugcauauuccccuugagaauuuaaacaagacaaguaugcccacucucaccacuccuauuccacauaguacuggaaguccuaguuacaacagucaggcaagauaaagaaauuaaaggcauccgaauaggaagaaaagaaaucaaacugucucuuuucacaagugguaugauuuuaugccuagaaauccccauagccucugcucaagagcuccuagauuugaugaaaacuuuagccaaguuuuaggauaaaaaaucaauauauauaaaucaguagcacuucuguacacuguguccaagcugagagcccaaucaagaacacaaucucacuuacaauagccaauaaaaaaauacauuacuuaagaguacaucuacccaaaggaggugaaagaucucuacaacgauaacuacaaaacacugcuuaaagaaaucauagauggcugagcacaguggcucaugccuguaaucccagcacuuugggaggcugaagugggcagaucacaaggucaggaguucgagaccagccugaucaauauguugaaaccccaucucuacuaaaaauacaaaauuaguugggcgugguggcaugcgccuguaauucuggcuacucaggaggcugaggcaagagaauagcuugaaccugggaagcagagguuucagugagccaagauagugccacugcacuccagccugggcaacagagcaagacuccaucucaaaaaagaaaaaaaggaaaaaaaaaaaucauagaugacacaaacaaauggaaaaacauuccaugcucauggaucagaagaaucaauguuguuaaaauggccauauugcccaaaggaauuuauagauucagugcuauuccuaucaaacuaccaacaacauuuaucacagaauuagaaaaaaauauucuaaaauuuauauggaaccaaaaaagagcccgaaucaccaaagcaauccuaagcaaaaagaacaaagcuggagacaucacacuacccaauuucaaacucuacuacaaggauacaguaaacaaaacagcacgguacugguacaaaaacauacacauagaucaauggaauggguuagagaacgcagaauuaaagccacacaccuacagccaucuaaucuucaacaaaguugacaaaaauaagcagugaggaaaggauucccuauucaguaaauggugcugggauagcuagcuagcuguaugcagaagauugaaacuggagcgcuuccuuucaucauauaugaagauuaacucgagagggaauaaagguuuaaauauaagaccacaaacaauaagaauccuagaagaaaacuuaggaaacaccaaucuggaccugggccuugggaaaguauuuaugacuaaguccucaagagcaauugcaauugcaacagaaacaaaaauugacaagugggaccuaauuaagcucuuuaagcuucugcacagcaaaagaaacuaucaacagaguaaacagacaaccuacaaaaugggagaaaauauuugcagacuauuuauuugacaaaggucuacuauccagagucuuaaaaacaacuuaaaccaacaaggaaaacacaaaugaccccuuuaaaaauguaaaaaguacaugaacagacacuucucaaaagaagacaucuguauggccaacaagcauaugaaaaaauguucaacaucacuaaucauuagagaaaugcaaaucaaaaccacaaugagauacuaucuaauaccagucagaauggcuaugauuaaaaagccaacaaauaacagaugcuggugauguugcaaggaaaagggaacccuuauacacugccugcgggaauguaaacuaguucagccacugucaaaagcacucuggagauuucugaaagaacuuaaaacagagcuuccauucaacccaacaaucccauuacuaggcauauacccaaaggauuauaaaucauucugccauaaagacacaugcauguguauguucaucacaacacuauucaaaaauagcaaaaacauaaaaucaaccuaaaugcccaucaaugguggacugcauaaagaaaauugugauacauauacaccauggaauacuacacagucauaaaaugaaugagaucaugcccuuugcagcaauauggauggagcuggaagccauuaucuuuaacauacuuaugcaggaacagaaaaucaaauaccacauguucucacuuauaaguagaaacuaaacauugagugcacauggacacaacgaagagaacaauagacaccagggccuacuugaggaugaaagaugggaggaggaagaagaucgaaaaaauaccuauuggguucuaugcuaauuaccuggguaaugaaauaaucuauacaccaaaccucugcagcacgcaaccuacccauauaacacacccauacauguacuccuugaaccuaaaauuaaaguuggaaaaacaagaaugaaagaaagggugcuuccugaacccaggcugcugcucacaauguugugauccuuuuccuuucucuaggucucagucuucccauuaacaugugaggguguuguucuagaaucaucauggaaucuuuuaaaaaauguaaguucuugucacaggaacaaauacagcaugauuccacuuauaugagccaucuaaagcagaauuauagaagcagaaauagaaugauuaaacauggguagugggaaaugggaaguuguuguucagugaguauaaaguuauacaagauauaauuucuagggaucugcuguacaacaauuaauauacaguuaaugauauggugugcacuuaaaauuucgugguaagagggugaaucucauguuguguucuuaccacacacauacacuagacauauggacacauacacauagacuagauaggagaaaagagaaauaauauaccagaguauuuauagaaauaauauaccagaguguuuauagcauagagggaaugacuagaauauuuuuauuacaagaaagcacauuuaauuacuuaaaauuucaagccauuuuaauccuucugugcaaauuaucaaucauacgaaaacugcuuauugaacuuggaacaagguucuacuugccacaaaaaucaaagacuccuguuuuguucugauucaccgugaaguguaaaagaaagagagaaaacgauggcugcaacugaccuagugcuaaauuuuccaagcugcugcaaauaccugcucuauagguagaguagauacagauacuuugcaucaaaguaucuaccuacucaacuguuaacucauuaagacaacuauguuaagaauagaaaacaguuuacccauauaucaguaauguauugcauuuccuauuuauuucucauuucauuguagguauuaaacaacagaaaugauagaugcuuaggaaaaugugccaguaauugcaugcacauauaccagaguugaaaggcugggugaauuauaucuggagcccgguaacauauuguaccauccuuuucuccuuagacauuaacuaagaagauuguguuuuaaaauuauauucauuuauuuaaauaucuguugacuucuaggaguggguguaucuauauauauaaaacacauguaucucuauauauguauacgacuagucuuauuggugguuuauuauuucuuuguaccagaacagaauauucaugcauaauuauuuaaagaugauccagugguaaucuguaagugugacugauacuucuaacuuggguuaucuuaauuauuaauacauaggguauuacucccuuguccugguaagucacuugacugccuuguguauuaguucucuaauauuuucaguuagauaauucaacuucccuuuuagaauuucucuauagaaucuccaguggaauguuuaguguauggaaguauuccuuauauuuuaaucaagguggguaaugggaacauauuaggaaaugagugagcaugguacugacaaagauagugaguuaaguuuuagauacaugcuuaagauauuacggggcagcuagauuuagaagcugaggcacuguuagagauuuuuagugacaaaaugacaaguauaauuucaagaucuuacuugucagagucuaaaguuuccuguagucaguuaggcuuuggugaagcccuaguaaguuaggcugucauaaaaauauuucacuuauuagggagaauuauaaugcucuuggcauauuuagaauggcucuuuuuuuccucaauaccugcuaggagcauaaagggauuuuuugugaucuugaugauguuugaagcaugaaucagcuaaauacaugagaaggaucauaacaaggacaaauaaugcaaaaauguuguauagauuacuaauggugucagugagacuaaacugcaguaagugggacuugugaaaaauacuauguuuggaacaaaaaagcaaagcaagauuguaauuacuuuuggaaaacauccaauaauguuuagcaauaagaaaacucaccaacuuucuuuaguguuuuugagaugugaagcauacaaauugugugaacugcuggucaggaaauuguguccacuuucuaugagaccuauguaaguuuacucacugauuacauguuuaauaaauacuauaugacaggcacaguauuaugcacuggggccauaaaaauaaauaagacauaguguagcucuguaguaggauggagagaaagcauuggcagcuuagaaaauaguauaaggauaacacagauaugugaggcucauggcugucuuauuguaaauaggauguuaguagaggauagguugagagagagaaaccugaaguggaugggcugggguggugguacuggugguagugauaaaaguugguaaaauagguagaggaaugguuaugggggccuugcaugauaugcugaggaaauuggauauuauuuuauaugcaauuggaaaguuuuaagcacagaaaugacaugauccuaucuauauuuuagaaaaaugauucuggcuguaguauggaagauggauuggccaccugaaaugcuaugauucuaagcaguagaaagagagcagcuguccagggauaacuucaagaaugugguaaaagaguauuauugaauuuagcucuuuaccaaaauaaauuauaugacaaaguccugagagauuucuaauauuuuagaauucucucuuaaguaauaacauucuaugcuguauuccuugaaguguaguugauacuuacuacuaacaguccuuaaacguggaucagugaguuacucaagguuauuaauucuuuguuggaagacuaauucuaugccauuucuauccacuauaauuuuauuuuaugucaguacauuaaguagugauagaugugcugucaacuugaaggugucagaguauuguccuuagaccuuaccuuacagagagugcuucauaauaugcauauuuuauucccucuacuuucuucuccacuaauaagauaaggaacuuuauaauuuucagucuucuucuacagugauaauuucauuguguuauuguugggauaguucgaugucauaagacauuauaagacagaaccaaugacaaaaaccacaugauuaucucaauagaugcagaaaaggccuucaacaaaauucaacagccuuucaugcuaaaaacucucaauaaacuagguacugauggaauguaucucaacauaauaagagcuauuugugacggacccacagccaauaucauacugaacgggcaaaaacuggaaggauucccuuugaaaacuggcacaggacaaggaugcccucucucaccacuccuauucaacauaguuuuggacuuucuggccagggcagucaggcaagagaaagaaauaaaggguauucauauaggaagagaggaagucaaauugucucuguuugcagaugacaugauuguauauuuagaaaaccccaucaucucagccccgaaucuccuuaagcugauaagcaacugcagcaaagucucaggauacaaaaucaaugugcaaaaaucacaaguauuucugugcacuaauaacacauaaacagagagccaaaucaugagugaacucccauucacaauugcuacuaagagaauaaaauaccuaggaauccaacuuacaagggaugugaaggaccucuucaaagagaacuacaaaccacugcucaaggaaauaagaaaggacacaaaccaauggaaaaacauuccaugcucauggauaggaagaaucaauauugugaaaauagccuuacugcccaaaguaauuuauagauucaaugcuauccccaucaagcuaccaaugacuuucuuuucagaauuggaaaaaacuacuuuaaacuucauauggaaccaaaaaagagcccacauagccaacacaauccuuggcaagaagaacaaagcuggaggcaucaugcuuccugacuucaaacucugcuacaaggcuauaguaaccaaaacagcaugguacuguacaaaaacagauauauagaccaauagaacagaacagaggccucagaaauaacaccacacaucuacaaucaucugaucuuuaacaaaccugacacacacaagcaauggggaaaagauucccuauuuaauaaaugguguugggauaacuggcuagccauaugcagaaaacugaaacuggaccccguccuuacaccuuauacaaaaaucaacucaagauggaucaaagacuuaaacguaagaccuagaaccauaaaaauccuacaagaaaaccugggcaauaccauucaggacauaggcaugggcaaagacuucaugucuaaaacaccaaaagcaauggcaacaaaagccaaaauugacaaaugggaucuaauuaaacuaaagagcuucugcacagcaaaagaaucuaucaucagagugaacaggcaaccuacagaaugggagaaaauuuuugcaaucuauccaucugacaaagggcuaauauccagcaucuauaaagaacuuaaacaaauuuacaagaaaaaagccaagaaccccaucaaaaaaugggcaaaggauaugaacagacacuucucaaaagaagacauuuaugcagccaacagacauaugaaaaaaugcucaucaucacuggucauuagagaaaugcaaaucaaaaccacaaugagaccaucucacaccaguuagaauggugaucauuaaaaagucaagaaacaacagaugcuggagagguuguggaaaaauaggaaugcuuuuacacuguuggugggaguguaaauuaguucagccauuguggcgauuccucaaggaucuagaacuagaaauaccauuugacccaguaaucccauuacuggguauauacccaaagaauuauaaaucauucuacaaaaaagagacaugcacacauacguuuauuguggcacuauucacaauagcaaagacuuggaaccaacccaaauguccaucaaugauagacuggauuaagaaauuguggcacauauauaccauggaauacuaugcagccauaaaaaagaugaguucauguccuuugcagggacauggaugaagcuggaaaccaucauucucagcgaauuaucacaagauagaaaaccaaauacugcauguucccccucguaagugggaguugaacaaugaggacacauggacacagagaggggaacaucacacauuggggccugugcggggugggggcuaggggaaggauaacauuaggagaaauaccuaauguaggugacggguugaugggugcugcagaccaccauggcacauguauaccuguguaacaaaacugcacauucugcacauguaacccagaacuuaaaguauaauaaaaagaaggaggaaaaaaaacauacuacuagagaaaaucaccuaaccacaaaggaagacuuuaagagaggauaaaaggaagaaagugucuacaaaacaagcaaauagcaaguaauaaaauaacaguagcaaauucuuaccuauuauuaauaaucuugaauauaaauagguuuaauuuauccaauuaaauuaauuauccaauaaaaagagcuagaauggcugaauugauuuaaaaaaaaagacacaacuauaugcugucuacaagaaacucuaccuuugaagacaugcagagacuaaaagugaagggaugagagaagauucagaaacuauagagagagcugaagcaacuguacauauaucagauaaaauagauuuuaauucaauaauaguuuuaaaaaagacaaaagaaguccauuauaugaugauaaaagucaauauagcaagaggauauaacaauuauauauacacccaaccaacucuggagcaucagaauauaaaacaaauauuaauuaaccuaaagagagagauugagugcaguguuauaauagaaggggacucagcaccccacuucuagcaauacacaggucauccagacagaaagucaacacagaaacacuggaguuaaacuguacuguagaccaaauggaccuaacagacauuuacagaacguuccauccaacagcugcagaauacacauuuuucucaaaagcacauggaacauucuccaagauggacccuguguucacgaaacaagucuuaaauuuucaaaaaucaaaauuauaucaaauuuauuuuuagaucacaauggaauaaaauuagaaaucauuaagaaaaggaacauuagaaacuacagauuuauggaaaucaaaugaugugcuucugaauagcaaaugggucaaugaagaaauuauaaaggaaauuauaguauuccuguauuuaacagaaaaugugcaaaugaaaauggaaauauaccaaaauauaugggauacagcaaaaacaguucuaagaggguaguuuauugcaguaaacaccugcaucagaaaaguagaaauaauucaaauaaagaacuuaacaaugcaccucaaggaaguagaaaagcaggaacaaacaaaacauugguagaaggaaaaauaauaaagagcagaauaaaaacgaaugaaauucaggcuaagaaaacaauacaaaagaucaacaaaaggaaaaguugguuuuugaaaagauuagcaaaaucaauaauccuuuagcuagacuagcaaaaaagggacuaggcccaaauaaauaaaaucuuauguaaacugagacauuuuacuacagaaugcagacaaauuauacuacagaauuacaaaggaucauuagagacuauuaugaacaacuauacacuaacaaguuggaaaaccaugaagagaugaauaaauuucuggacacauacagcuuagcaggauugaaccaugaagaaauagaaaaccugaacagaucaacaauuaauaacaagauaagcagcuguaauaaaaaagucucccaucaaagaaaaguccagcaguggaugccuauguugcugaaagaacuaaugcaaauucucucaaauucuuaaaaaaaaaaugaagaggagaggauacuuucaaacucauucuaaauaccaauaucccugauggacauagaugaaaaauucucaacaaaaauacaagcaacugaauucaacaacacguuaaaaaaaucauucaccauggucaagggggauucaucccaggaauucagugaugauucaacauaugcaaaucaauaaacaugcuacaucacuuaacaggaucaagaacaaaacccauaugauucuuucaauagauacuagaaaaguauuugauaaaauucaacauuccuucaugauaaaaauucucaaagaacuggguauaagaggaccacaccucagaacaauaaaggccauaugugacaaccccacagcuacuacacugaauagggaaaaaccaacaggcuuuuuuguaaaaucuagaagaaaaagaugccuccuuucacuacuuuuauucaacagaguacuggaaauucuagacagagcaauuaggcaacagaaaaaaaaauuaacacauucaauuggaaagaaagaacucaaauuauucuuuuucacagaugacaugaccuuauauuuggaaaacccucaagacuucaccaaaaaacuguuagaacagauuugcgaauucaguaaauugggauacaaaaucaacauauaaaaaucaguagcauuucuuuaaaccaacagugaacaaucugaaaaagaaaucaaggaagcaguucugcuugaaauagcuacaaauaaaauaaaauauguaggaacaaauuuaacaaaagaagugagagaucuccacaaugagaacaaacacuaaugaaauaaauuauagagggcaauaaaaaaugaaaagauaucaugugcuuauagauuagaagaauuaauaauguuaacauguucaugcuacccaaagugaucuacagguucaauguaauuucuaucaaaauaccaaugacacucuuaacagaauucgaaaaaauaauccuaaaauuuuuauggaaccacagaagaccccaaguagcaaaagcaaucuugaguaaagggaagaaaacuagaggccucacacuaauucccaaauauacuacagagcuguaguaaccaaaacagcauuguacugacauaaaaaccugcacauagaccaaugaaauggaauagauaacucagaaauaaauucacacauuuacagccaacuuacuuuugacacaggugccaacaauauacauuggggaaaagacagguuuuuuuuaauaaauggugcugggaaaacuguaucuccauaugcagacuaaugaaacuagaccccugucucucaccauaugcaaaaauuaaaucaaacuuuauuaaagacuuaaauguaagacaugaaacuacuagaccacguuguggaaaugucucacaacauugaucuacuaggcaaggauuuuugaggucagaccacaaaaacacaggcaaccaaagccaaaguagacaaauagaauuacaucaagcuaaaauucuucacagcaaaggaaacaaucaacagagugaagaaacaaccuacagaaugggaggaaaugugcaaacucuucaaccaacaaaggauuaguagccagaguacauaaagaacucaaaugaauagccaaaaaacaauccuauuuaaaaaacggguagaugaucugaauagacauuucugaaaaggagacauagagacagaugugaugguguauacuuguagucccaaguauucaggaugcugugauauaagaucacuugagcccagaaguuucaggcuugucguaggucauagucuaugaucaugucuguagucauuacacucuaaccuggguaacuuagugagacccuguauuuaaaaaaaaaaaaaacacuuaaaaauggccaacaaguauaugaaaaaguacucaauaucacuaauuaucagagaaaugcaaaucaaaaccccaaugaaauuuuauccaaguuuaaaaggcuauuacgaagaagagaaaaauaauagauggugcagaaagugggauguuaguacacuguuagugggaauguaaauuaguauagcuacuaugaaaaacaguauggagguuccucaaaaaaguagaaauagaagcaccauaagauccagcauucccacugcuggauauauguccaaaagaaaggaaaucaggauaucgcagagaugucugcacucucauguuuauugcagcacuauucacaauagccaacauacagaaucaacuuaagugucuaucaaugaaugaaugaauaaagaaaacguacauaaaaacacaaugaauuaccauucagcgauaaaaggcaaugaaauccugucauuugcaacaacauggauguaauuggaggucaucacauuaagugaaauaagccaggcacagaaagacuaugucauauucacaguaucacauauucuaacucauacuugggaaacuaaauaaguugagguugagaguagauugauaguugcuagaggcuaagaagaaugggcugggggauggggaugaagagagagguugguuaauggauacaaaauacaguuagaccgaaggaauaagcucuguuguucaauagacagcacaguaggaugacuauaguuaacaauaauuuguuauauauuucaaaauagcuagauuuaaaauguucccaacauaagaaaauaaauauucgaauugguagauguucugauuacccuguuuugaucauuacacauuguaugcauauagcaaaauaucacauguauuccauauuuaauuaauacauaaacuauguacaauuuuauguauuaauuuaaaaauaacaguaaaguagaaaaaccaagccaucuucauguuuuguucaagucuuuauaggcaaaguuuggacccuagucaaaaaagggcucuaaggagccuggcuagacuuugguuaaggagagcaucuuugucaauacccagaaguuacuucagauaacaaaaauaugaccuauuaaaccaaaguaaauauguucagcuuacucuuaguuauauguagagcaugcacagccauuguaauguugcccaauaucaaggaaguauaauggagagaauuugguguagaaagaggcagcauucuucauuguugugguugaaauauuuuuacuuugucaaauuuuacaaaagugaccauuuuaaugguaaauauggagaggcauucucuggaguaguagagucacugagucuugagacucagagccaauaggcauagcagagagcaggagugagugaauguauauaguuauacaggccccuccuauggucauaucugggaaggcuggcaaggaugagcuuagaagaucagagaauuaucuggaaaaacucaauguucccagaaggagaaauaucuuacuuaggagucuucuaacaaaauaaccauguccccaaauuaccuuauaguuaauccaccagucacuaaccccagcccacauaaaaaaaaaaaaaaaaaaauucaaucugauuuuuggugcuguucuuguaaauauguagaaucaaagaucacaaaaucucugaggaaagcuuccaauuaagauacagaauaguauaaacugaaaaaauaauuuauucagaaagauaacuaugagaaaauuaacuaugaaaaaacagaacuuuuaaacauaacaaugaaaauuguugaaaaucuggaaauugauuuuuuuuucuuuuuuuuuuuuuugagagagucuugcucuguagccaggcuggaguacaagcgugauacaggcgugaucacugcucacugcagccuucaccucccagguucaagcaauucucgugucucagccuccuaaguagcugggguuacaggugcacuccaccacauuuggcuaauuuuuguauuuuuguuuaguagagacaggguuucaccauguuggccaggcuggucucaaacuccuggccucaagugauccuccuaccuuggccucccaaagugcuaggauuauaggcaugagccaccgugccuggccuggaaauugaaauugauauagaaaugcaaugauguuugugaugaaaauguaagaugauaaaauuuaggaaaucucacagaguaugaaacaaaaauacacguggaaaguaagaacaaaaugacaaaauuauuagaaauuaaauucaggaaguucaagauucuuauagaauagaagauuuaaaaagaaacaaauuaucacaaacaucaaaaacauacuuuuuguguaacugaaggacuacucagggauccaccaaaugcccagcacaaugaaguauaugcguaaguauaucaccaugaaauuucauaauacagggauccuaaaacuuaacagagaaacagaaaaucauguacaaauaauccuaaaucagaauuuuaucagacuucucagcagcagacauuggagcucuaccuuuaauaacucagaagaaaaaaauucaacccuagaaugcuguaucuggucaaacuaucagucaagggcagauuaaugauauucauugaagguuuuugaauaguuuaccuccuguguacucuuucuuuguagcugcuggauaauguguuucaucaaaaugagaaguaaauaugaaagagugguaaauaaugucuuacccaaaaaguuaggaaucaaauauaggggauagccuaagagaauuggauaaugguaaagagaaguuccaggacaauagcuaugcaauaaauuucagaaggaauuuauagccauuaaagugagagaagagcaggcucaggaaagcugucuuuuccaucuauccuugcccaaaugguuguguuuaucauauugaaaauaguucaguauuucugaaagaucuaauacuaaugggugccaaugaagaaauuaauagauuuagagaaguuauuuuacccagaguugcaaaauaccucauggagcuuuaauucaaaccugggaaaccauaauccauguuuuauucacaaugcauugucucaauaauuauaaugcaagguuaaaaaacaguagugccauguaaugagagauuacuuuguaggaguaauugugcauuuuaauguacacuucacaaaguacuuuugcauuauauuuugauuaugauaaugugcuuuggaaggguuuugagaugagaggugacaugagucaagugaaauggaaaaugagauaucuguuagaacuaaccaucaggguagaaucgggauggaugccaguacaucaucaagauucacuguaaaccuuuuaugguguugaugggaugucuuggaagcagauaaaaauaacuuuuccaaugccagugauugaaggacugcacuacaaccuuuacucuagaucacugacucaccuucaaacuuugcuggugacagaugugucaaauugauuugagcccugcaaauacaaaaucuauggacugaaacccuuuccuuuggaaacuaaacuguguuaaguagacagacuuuagaugguugaguauuuucucucauuagcugccaaauuuuuaucuuaacuauuugaauugaaaguuuucuaaaaugaauugugcuaucucuuuuuucuuaaacaggcuagagaaaccugucuuaaaccuugauuuuucuucuaguuuguguuuguauuuucuuugugaaauaacaaguugauauuguuagagagcuucacuauauuauccauugcccaaauaaauaggcccaugccucaaagcuuguuucacucuguuuuauaguuuuuauauuaggaauagcauaugaggugaugaaaucugaccucuuuuuguagccauggaaguaaugagcugugaaguugguaaacaucacuaaggaaugccuaauugaguaacuggucuuaucagacuaucuuuucauauuccaaaucuaaguuaggaaguaacaaaagaugccuuauaaccuuauaguaacuucagacuucuacucauaguaacauacuuaacaaaucacuuaacuuccuugugucuuaguuucuuugucuuuagcagaaauagaaggugggaagaagaauuacgauaccugucuuuaauaaaaucauuguaagaauuaaauggauuaagugaaaguauacaauaccugucacauaauagauggucaguguuaccuucuuuuucccucuuccagauuucuucaccuuaccacagcagauaacucuaaaugauuacucaugcacuauccacagaauuuacuuaaugccuauuuccuuuuccccuuacaagcccuucauuucaaaaagagggggagaaaaaaagaacuuaccacuuucugacauguaauauauuuuucuccauugccugccugagcccgacacuuggacuuuuacagaggaaaugagaauauaugccauuuguacuuuuagaaauauggaaagauaaaaacuagucagugcuaaacuccaucacagucaacuucuugaauuucuccgccuuucugugaucuuucuacuuucgccauagaggacuggcuaacuucucaucaggacuguuggccuccuaaagagauacagucucauccaaaacacaaacaauauagaguuguaguaaccuuucuauguauauuaccucugcauuaaagaugcuuacauuucaaacaugagaaacaaaaggaaaucuaauaugaaaguguuucuauuuuaucuuuuagucaagugcauuuaaaccuuacuugauuaaacuuuaaaaccuuucuucauuuaacucaagagauuauuaaagaauggagaaaugcuaguugggcaugguggaugaucccuguaacccuagaauuuugggaggccgaggcagguggauugccugaggucaggaauucaagaacagccugggcaacauggcgaaaccccaugucuacuaaaaauacaaaaaauuagccggguguuguggcauaggccuguaaucccagcuucuaggaaggcugaggcacgagaauugcuugaaccugggaggccaagguugcagugagccgugauugcaccacugcacuccagccuaggagacagaacaagacucuaucucaaaaacaggaaaaaaaaaauugagaaaugcugaauugagauucugaaaaauuuuuucugauaauuuuauaucuuauuuaauggcaguaaaacugucaguucacuuuacuagaauucauucugaaucagcaaucaacaucuucuaaaucuuuugucuaccuauucccaaauuguauucucccccuauaacuuuuguuucacauuggaaaaguggaaacaucagcauaaauuuggcagauuuuuaaauaaggagauguguucuauucuguggcauuuaaauaaugauacucugaaauauauacauauguauauguagauaauuccaaguaaaagacacacaugaaaacauaaguagauacauuuacaaauauauauaagcaaauuauaccaaauauuuccaucaauccagucauaaauaugcugauuaauauauacauuguuuuuuuuacugacauuuuuucuaauaacuuaucaucuuagccauauuuagauauauucacuuaggagagaugguguuuauuacauuaaaagagcaaucuaaauucuauacauuugcuuuuuuaaaacauuucuaucuagaaauugacauugaacgcugugugagagaaucuaucaaccuguuuuguuggacuccuaaaagugcuacuuacagacagcaugcucaaccuccaaagccaucuucugacagcaguggaggcagaaguucggcaccuuauuucucugcugaguguccagauccuccaaagacagaucugguauguauuugcggauuuaguuuacaaacucuaaaaggagauggauguuaaaauuaauauacccuaguaucuuuauuguucuuaauggugucauuuauguccuuuuaauguagauauuuucuaacacaugauuugauucauagaaauauuccagaaaaccauuauaucuauuugguuauagaguuaggaagauuauuuugacguacuccuccagguagcaaguuuugcuuuuuuuguaugcauuuguaguaucuguuuauauaucaauugguuauauagugagagauuacagaagcaaagaaagaauuaaaaaaauagaaaaagaguuguuaauagagcaggaacuuauuguugguugacagaagaaacagcauuuguaaaacuaugccauguagguguuucaacauuaucauucuuacuaaacacaguuuauaaauauggucaacaaagcuuucaguuauaauaauucauacauuucgaauauucuaauauuaucauaguaucauaauuauuuccacgaaauugaauuucuguuaauauguauguauugcuuuucagauauggcacuuucuaugauuuuauuuauguccccaaauauauggguacauucauuuguucauauauuuccaucacaaucaaauuauauuaaggucacuuauaaacaugacccugcuuaugauugaauacagagcaauuucaauaauuacaaucucugccucuagauauacagaugauagagagggaaacagcuaaaugaauauauauaugaaagauuauaagauauuucuaaaauauccugagagagaaaagaauaagaacccacacuuauaaauaaauauuugcauuauaguuuuccaaaaguaguaguugucuucugccugccuggaagaaaguaaguucucaaauacuagaaauauucagcugaagauauuuccauguaaugaauuuuggugagagaacuaauuugucaguaaaugguaaauguuguucuagaucagggauccccaacccccaggccacagacugguaccagucacaggaaccaggccauacagcaggaggugaauggcaggcacaccagcaaagcuuuaucuguauuuacggccacugcucccuuacuugcauuaccaccugagcgcugcuuccugucagauuagcagcagcauuacagucucauaggagcacaaauccucuugugaacugcgcaugugagggaucuagguugcauauuccuuaugagaaucuaaugccugaugaucugucacuaucucccauuauccccagaugggaccauuaaguagcaggaaaacaagcucagggcucccacugauuguacauuaugaagagucauguaauuauuucauuauauauuaugauguaauaauaauagaaauaaaguacacaauaaauguaauaugcuugaauuaucccaaaaccaucugccacacccuggguccauggaaaaauugucuuccaugaagacaguccuuggugccaaaaaaguugaggaacacuguucuagaugaccuguaagauagcuugaaacuuugaaauucagcaguucuaaauacaaacuuauuuaauaguuucuuuguuucaaauuuugaauuauauccucuuuauagcagaaaaacauuuguuaaaaagacugacuuuuccauuuuauugccuuuguuccuuucacagauuaguugguuguauuuauguggguugauuucugaacucucuauucuuuuucauugauguuugucuguucuuuugccaauacuaugcuguuuugauuuauaauuugucuugaagcucagaagugucaguccuccaacuguucuuuuuaauacuguguugguuauucugagucuuuguuuccaaauaaacuuuaaaauuaguuuguugauaccuacaaaauaacuugcugcuauuuugauugggauuacauugaaucuacauaucaauuugggaagaacuguugacaauacagguugauugucucuuuucaaagaugcuugggaccaaaagugcuucagauauuuuauuuguucugauuuuggaauauuugcauuauacuuacugauugagcauuccuaauccaaaaauacaaaauccagauugcuccaaugagcauuuccuuugacuaucaucuugguacucagaauguuuccgauuuuggaacauuuuggauuauggauuuuggaacuagagauauucaaccuuuauugagucuccuauccaggaaauggaauauuuuuucauuuaucuaguuguuggauuucuuucaucagauuuuuauaguuuuucucauuuagaucuuauauauauauaguuagacuuauaucuaaguauuugauuuugaggaaugcugauguaagugguauuauuuuuuauuucaaauuccauuuguacauugcagguauacaggaaagcguuugaccuuuuauauuaacuucgaguccugcuaccuugcuguaguuacuuauuagcuccaguuuuuugcucaguuccuucagauuuucuacauauaugaucacauuauuugaaaaauggacaguuuuauuucuuccuugccaauuaguacaccucuuauuuucuuuguuuguguuauugcauuagauacaacaucuaauauaauguuaaaaagaaauggugagaggacauccuuaccuuguuccugaucuuagcaggaaggcuucuagggugucaccagaaaguauugugugagcuguagguuuuuguagauguuuuuuacaaguugaguaaggucucuuuuauucccaauuugcugagagauuuuuuaucaugaaugcauguuggauuuuguagaauguguuuccuguaucuauuuguaugaucaugugaauuuucuucuuuagcuuguuggugcaagaauuacauuaauuaauuuucauauguuaaaacagccuugcaugccugggauaaauucuacuuguucaugguauauaauuuguuuuauacauuguuggauuugacuuugauaauauuuuguugaggauuuugguaucuauguucaugagagauacuguuuucuuguaaugucuuugucuaguuuuaguauuuaggguaauacuggccucauagaaugaguuaggacauauucguuuugcuucuguccucucaaagaaauuguagacaguuggcauaauuucuuccuucagucuuuaauagaauuuaccagugaauucaucugggucugauacuuucuguuuggaaauguucuuaauuauugauugaauuucuuuaauagaugcaggccuauucagauuaucuaauucuucucauauaaguuuugucauauugugucuuucaagccauuuuauccaggcuaucaaauuuaugggcauagaaugguucauaguauuccuuuguuaucauuuuauugucuaugggaucuguacugagaucucuuucauuucugcuauuuguaauuugaauaaucuuuuuuuucuuagcugguuaaaggcuuauugauuuuauucaucuuugcaaggagccagcuuuuggugucauugaucucuuugauuuacuguuuucaauuucauugauuucugcucugauuuuuauuuuucuucuacucacuuugaacuuaauuugcuguucuuuuucuaguuuucuaagguggaagcuuagaucauugauuuuagaacuucccuuauuucuaauauauacauucaaagcuguacauuuuccucugagcauuguuuuugaugcauuccaccaauuuugauguuguguuuucauuuccauuuaguuaauauuuugaccuauguguuaauuaaagguguucuguuucgugucuaaguauguugguauugauucucuaagacuaauagcuuguagcgaauucaaccaauuguauauauauauaaauauauauauauacaguucuauauauauauauacaguucuauauauacaguucuauauauauaguucucucucucucucucuauauauauauauacaguguguauauaauacacacacacacaccccuauauauaugaauaaguuuaucucuuucuuucaaguuauuauguuuccaauuguuuauugucuauugcuuuggacagaaccucuaguuuaagaguagguagacuuacuuguucccgaguuuaaugaaaaugcuucuaauuucaucauuuaaguuugacguuuuuuauacucuuuauugagacaauuauuguaccaucuuuucuguauuugaguguuuaucaugaauguuaaauuuuaucaaaugcuuauuuuguauuaauuugggauuauuucaucuuuuauugugauaauguauuauauuauuacaguuucuuauauuuaauggucauuacauuccugagauaaagucuacuuggucacuaacaaaaagacauacuggcuauauuugauuugcuaguuuuuaaaaaaauuuaugcaccuauguuuauagauuagauaagucuauaauuuucuuuugcuuuuuguccuugucaggcuuuggucuuaagauuauauuaccuauuggguacuguggucacuaccuggcugacaggaaucacccuaaaccucagcaucauacaauauacccuugugacaaaccugcacauguacuccuaaaucuaaaauaaaaguugaaauuauuuuuuaaauuuuauuuauuucuccugucugcuauuuaaucauuuucuauaaaaggaauuaccucuuuuacauaaauugaggaaacuugucugaaaaaccacuucuguaaguucauguuguuugaaaaguauuucuauuuaguuaacauguuuauuuucucaaaauuuuuucuaaaaguaccuauuuuguuuaauuuuuuauguuuauagaauucuguacauaaaauauuuuugauuuuuguucuuuuuuaucugaaaugucuacauuuuuaauauuguuuauuugaagguucaaauauauuaguauaauagaaagcagauacaaaaauaauguaugcaugcuguaaaaagaauauuuauuaaaauuagcauaaucagaauucagguucauauuauauauucuuaugucugagucaaaaacagauuuuaaaagcggcuuuuauaaacugagauaaauuguacucuauuacuaguagaauggaagguuaaaaguggauauuagaagaaaaaucaauuuuacuuucauuucugcaugcaucuauuguauuuauucccugaagcagaguuuuauaauagaaaaagcaugagcuuugcuguuagauggacuugguuucaaauuucaagccuguuccuuuuucuucauauaaucuugaauaauucacauaaccucucuaguucccuauuuguaaucauuagcauacuuaaaauaauaccacccuggcaggguuacuuuaauaaugauauacguaaagcuccuaauucagugucuaguacauaauaagcacuccaaaagaguaaaaaaucauuauuacaaguuuaguaauuaacaguuaauuuuuuuuacuuugcagucugcccaagaacuuuaugacagucuucuauaucuaaauaaucuguacaaaggacaugauguucuaguauucuguuuuuccucagcuauguuagcucauuacuaucacuuuacauuuagaaaccacuauaaaaacaguguggagaguaaggauuagggaggcuggcuuuucaaagaaggaaucuuucuggcaguuuuaccucaguaaauucaguuuaaaauuucacuuugaccuuuacuucuuagucuuaauacuauuuucaucccuaaacuaaagaauugccaaaauaauuauuucaucuagugccaaagucuuucccaucaguuuucucuuaaauagcuaaaacugcuugagaauucugacugaaguuuauuaauugaagaaaauaauaaguaaagauauguaaucuugguuaauagauugaauguuuuugaacggaauguauuuugggaaaaucucuacuuaaucuuugauuuuuuaaaaucuauuucuuuguuaaauuuuaaucacauauuuaugacugguauuacuuacaugcaguauguaaaugagcaauaauuauuguuaaguucuuugaauaccucauuaugaauacauauacuaacccaagauuuuauuaaauuaauuuuuuuauuuacauaaugcuaacugcuuguauauacuauuaccauaaaaaugauagcauuuauugcauuaccuucaguuuauaagguaugcuuucaguauagauuaaacaugaguuuacuguagauaaaaucuuauuuaaagcacauuuuuauacuuuugguucaaauaguuuccaaaauucaaauauaaaugccagucuacaaaguuucaucucaauaauaacaacacuacuuuuuagauuaugaacaguuuaaaaauaacaccacagugcuuuaugauuuucagguacccagauacauuauuuuuaucucccccuaaacaaaucucugagauguuugauccccauuuuagagguaaagagacucagaaaccuuacuuaauacaaguuaacuuauaaauugccauuuuaucaguacuguaaauguguuuuucacucuuauuuauugaaacauauauauuaauauauaucauauccuacuguacacuuggcuuuucaagcauuuuuuaauuuuucucuauuucucuagaaaauacauuaacauauacucaugcaaucaucugcauaccuacucuuaaauaagaagaaaucuuuuuacaguaaguauaaggaaaaguacaauuauguauccuuuuuuuugcuaacauauugaggguaaaauguuaaccuaaaggagaacuaaacacugucugcugaaauuauuuagagcaauagaugcauugaaaacaaaaagguuagcuuugcaucuguucuuuuuacugguucaauucuucugccauuaucuaauguucuguaggcaauuuuagagcuauuaugauaggcacaauuuuagugaaagaugaagacuagaaacccuggcagcuacauguagggguaaaauguaucagcccucuagaaguuaaguagaagacauuuuauagaaaaucauaucuuuugaaauuuguuuuuccauaguaauguauaaucuuauucuaccauuggcccaaaaaauaagcaaauaauaauaauaauccaacauaagaaaauaagggauaguuggauuuggggauaggauaucaaaagaccuugauuuccuggauuaaaauaugaauuuuucuuucuauauuccaaguguagagaagaagaaaggcaaacaaauucccagacagagauugauaugguuugacuguguucccacccaaagucugaucuugaauuguaguaauucccaugugucaaggacaggaccagguggaguaauugaauaauaggggcaauuuccccuauacuguucucauaauagugagugaguucucauaagaucuguugauuuucuaauggacuuucuccuuugcuuggcucucauucucuuucuugccaccaaguaaagaaggacauguuugcuucccauucuaccaugauuguaaguuuccugaagccugccaagcauugcugaacugugaaaccucuuuccuuuauaaauuacccaguuugggguaugucuuuaugagcaguaugagaacaaacuaauauauuaaauagguacugguacaguugggugcugcuauaaggauaccgaaaauguggaagugauuuuggaacuggauaacaggcugagguuggaacaguuuggagggcucagaagaagacaugaaaaugugggaaaauuuggagcuuccuagagacuuggaauacucagaagacaggcagaugugggaaaauuuggaacucccuagagacuuauugaauggcuuugaccaaaaugcugauagugauauggaugaugaaguccaggcugagauggucucagauggagaugaggaacuuuuugggaacuggaguaaaggucacgcuugcuaugcuuuagcaaagaaacuggcagcauuuugccccugcccuggaaauauguggaacuuugaacuugagagagaugauuuaggguaucuggcagaagaaauuuccaaguggcaaaguguccaagaggaagcagaccauaaaaguuuggaaaauuugcagccugauaaugugaagaaaagaaaaacccauuuccuggggagaaauucaagccagcugcagacauuugcauaaguaaugaggagccaaaugcuaaucaccaaagcaauggggaaaaugucuccagggcaugucagagaccuucacagcagccucucccaucauaggccuggagaccuaggacagaaaaaugguuuccuaggcugcugcuauucugugcagugucagaacauguucgccugugucccagugacuucagcuucagcuguggcugaaagaggccaaggcacagcucagacccuugcuucuaaggguguaaacccuaagccuugcaguuucccacaugguguuuggccuguuggugcauagaagucaaaaaucgagguuugagaaccuccaccuagauuucggaggauguauggaaaugccuggauauccaggcagaauuuugcuggagaggcagagcccuaacagagaaccucugcuaaggcagugcagaagggaaauguugggucagaacucccacacagaguccccacuggggcacugccuaguggagcagugagaagagggccaccauccuccagaccccagaaugguagauccaccaacagcuugcacuaugcaucuggaaaagcugcagacagucaacaccauccuaugaaagcaguggaaaguggggcuauaucuugcaaagccacagaggcggggcugcccaaggccaugggugcccaucucuugcaucagcaugaccuggaugugugacaugaagucaagggagaucauuuuggagcuuuaagaucuggcugcccugcugaauuuuggacuugcaugaggccuguagcccuguuguuuuggccaauuucucccaauuggaauggguauauuuuucuauugccuguacccccauuguaucuaggaaguaacuaacuugcuuuugauuuuacagucucguagguagaagagacugcuuugucucagaugagacuuuggacuguggacuuuugaguuaacccugaaauaaggcuuugggagacuguagaaaaggcauaacugugguuugaaaugugaggacaugagauuugggaguggcugggauggaaacauguaaucuaacuuuuaaauaaauggaaucauagcauuuguguuguuucauguuucauacuugcauccuacaguuaccauggcuuccgguuauuagcuccagcccaaacuucucucuuuuuuugcuuagcaauaugucuugaaagucuucuuacauacacacauacacacacacacacacacacacacacacagacacaccuaauucugguuaacaagcugcaaaccauuccuugguacagaaauguuaucaugguaguaauacuuaauauuauuuguauaucucaaaugcaaauagcugagcuaauaaugucuccuuaguuuacaacacauuacaauuauuggacugggucagacacuuucuccuauuuccuuuuacuucuuucuuucugcccugacccucacuccuuggucucucugcacaaucauuuauaaaacagugguuugcaaauguugauguauauuauccucuccaggaaagcuaagaaaaaaugaggccccucuuguuuaaaagauaggcccugagccuuuguguuuuuagcuuguucuccgugaauucuaauacugguugcucuaauauaguuuauauagguuucugaauauguacaaacccuuuuaaguuaaauauauaugcauuuauuuguauuuguagggaucuuuucuaauuuuuuuauugugauaaaaauacacacaacguaaaauuuaccaccuuaaccauuuuaaguguacaguuagugguauuaaauacauucauaauguugugcaaccaucaccaccaucuaucuccauaacucuuuucaucuuguaaaacugcaccucuguacccauuccauuguaauuccuuauucuccccuccucuccacaaccacaauucuacuucugucucuaugauuuugacuacucuaaguaccucauagaguuggaaucauauaguuuuggucagauuuuuuuuuucuucuuaaggcuaaauaauaccuauuuuguauauauaccacauuuuguuuauccauucauucaucaguagacacuuggguuacucccacauuuuagcgauuguaaacaaugcugcuaugaacauggguguauaaauaucucuucaagauucugguuucaguuccuuuuggcauauauccaaaaguggaauuucaggaucauauguuaucuaucuuuaguuuuuugaggaacugccauacuguuuucuacagcagcuguaucaguuuacauuuuuaccaacagugugcaaggguugguuucaguuucuucucaaacuugcgaacacuuuucuauuuugauuuuuuuucuuuuuuucuucuuuuuuuugaauaauaaaugugcaguggaaucucauuguaguuuugauuuauauuucccugaugauuagugauagugagcaucuuuucauguacuucuuagccauuuguauaucuucucuggagaaaugcccuauucaaggucuuuugaguuguuucuuuuuuuguugaguuuuaggaguucucuauauauucucaauauuauucucauauuaaauauaugauuugcaaauauuucauucuguagguugccauuuuacucuguugagugucuuuugaugcacaaaauauuuuauuucacaaaguucaauuugacuguuuuuucucugucaccuagggcuuuggugucaucuccuagaaaucaagugccaacuccaguaucaugaagcuuuugcccuauguuuucuucuaagagucuuaaaguuuuuggccauacauuuaagucuuugauuuauuuugauuuaauuuuuguauauguuauuaggugagaguucagcuucauucuuuugcauggagauauacaguuuuuccagaaacaucugcugaaaagacuguucuuuaccccacugaauggucuuagcuacccuucucagaacuuauuugaccauauauaggaggguuuauuucuagcucuagucuguuggucuauaugucugucugccuuuaugccaguaucauacuguuuuauuacaauaguuuugaaauaaauuuugcaaucaggaagucugagucuucuggcuuuguucuuucuuuucaagauuguuuugucuauuuuaggucucuugagauuccauaugaauuuugggauaggucuuucuauuucugcuaaaaacaucauugauacuuugauaagaauguguugaaucuguagguggcuuugaguaauauugauaucuuaacaauauuauaucuuucaauccauaaacguggcuuguguuuucauuuauuuaugucuuucuaaauuucuuucagcauucuuuuguuguuuucauugcacaagucuuucaccucccugguuaauuccuaaguauuuuauuccuuuugaugcuauuguaaaucaaauugucuucauuaauuccuuuucugauuguucauuguuaguauauagaaauacaacugauuuuugucuauuuuuuucuguauccugcuacuuuguugaauuccauuauuaguucuaacaguguuuuguguaauguuuaggguauuuuuuagauauaagaucacaucaucugcaaacagauuauuuacuucuuacuuuucaguggauggcuuuucuuuuucuugccuaauuucuccagcuaggacuuccaguacuauguugaaaauacaucccaaaagcaggcauccuuguuuauucauuaugucagaggaaaagcucucagccuuucaccauugagcauguuuucuguggguuuuucauauaugacuuuuauuguguugaggaaguuuccuucuauuccuaguuauuaaauguuuuuaucaugaaacaguuugauuuuguucuuuuuuugguaucaauuuagaugaucaugugguuguuuuuuuuuuuucucuccauucuguuaauguaauguaucauauggauugauuuuccuguggcgaaacauccuugcauucuaggaauaaaucccaauugaucaugcuguauaauuuuaauaugcuuuugaauucaguuugcuacuauuuuguugaagauuguuguuucaauauucuuaagggacauuugucuuuaguauuccguuuuugcagugucuuuguauggcuuuggaaucaggguaaugcugggcuuacacaaugaguuaggaaguauuccacccucuucagcuuuuuagaaaaguuugagaaggauuuguguucuuuagauauuugguagaauucaccaguuaagccaucagaucuaggacuuuucuuucuuaggagauuuuuuauuacugauucaauuucccugcuaguacuagaucuaguuagauuuuuuaacucuuucugauuuuagucuugguaagcuuuguguuucuaagaacuuaacuacuucauuuagguuaguagcuucauuuuugacuccugccuuaccuuccaaauuuagucaaucaaaaacuuuuguuuauuaaucuguauacuucucuccaauucugcugacaauauuuuacucauguucaccaugauuacaggcaugugcuaccacacccggcuaauuuuguauuuuuaguagaagcaggguuuuaccauguuggccaggcuggucucgaacuccugaccucaggugauccacaaccucccaaagugcugggauuaugggcaugagccaccacgcccggccuguuguacaauuuucugacuggucucucugcauccauucucauuuaucuuuaauccauuuuucagacuucagcuaccauaaucuuuuuuaaucaaaauguuuaccaagacucuuauuauuauacugacaauaaaauucaaacuucuaacauggucuaaaagucccaauguaauauuucccuugacaacuuuaccaagauuuucugucaguauuguucccucuaauuuuucuaugcuguagcacagaaauuagauuucguucaguuuuagguauacccuauacauacuucugcuuuaaggccucuaugucugccuucaucuucucuuuuaacauaaauuccuaaagaucaagaacuguaucauagauucuuaaaugaaaugauagggagggggcaaaguaagauggccaaauugaagucuucaccgagcaugucuucugcacagacaccaauuuaacaacugucuacacaagcaaagcaccuucauaagaaccaaaaacuagaugagcacucacaguaccugguuuuaacuucaugucacugaaaaaggcacugaggaggguagaaacagucuugaaucaccaauaccaccccuugcccaccccccagcaggaauugugacauugcauugaacucagugauauccuguuacagcagaaugcaaaaccaggcugcacuuagcuaaugcccacccucagagaagauauuuaaaccaacucuagccagaggggaauugcccaucccagugguccaaacuucaguucuggcaagccuuaucacccugggcuaaaguguucuggggcucuaaauaaacuucaaaggcaguguaggccacaaggacugcaacucuuggggaguccuagugcuuaacuuagauuaaagugaguggacuaaggaggcacguaaccuguugagacacagccagaguggcuaagagaguacuugcaccaccccuaccccaaacccaggcugcacagcauggggcuccaaaaaagacaccuucuuuccacuuaaggagaggagggagaagaauaaagaggucucugucuuacaucuuggaaaccagcucauccacaguaggauagaauaccagucagagucaugaaucccccuuuccaggaccuagcucccagacauuucuagacacacccugggccagaagggaaccugcugccuugaagggaaggacucaguccuggcaggacccaucaacuacugaauaaagugcccuugggcccugaauaaccaguagaaauacccagguaguaugccacucugagacuugcuggcuucaggugaaacucagcacauuacuagcuaugauggcuauggggagagacuaugauugagaacauuagagggaaaaguaagggagcuuugucuuacaccuuagguaccaacucagccacagggaaguagaguaccaagcaggcucuuguggcccccaauuccaggacuuggcucuuggacagcauuucuggaccugccgugggccaaagggaaacuacacugaagagugagucccaggccaggcagcauucaccacaagcucgaugaagagcuccugggccuuaagagaacaucagcaguagccuagcaauacucuccauggguuugugaugguggucauagggugaggcccuucugccuauggaaagcagagggaagaaugggaaauacugugucucaugauuugagugccagcuuagccacaguacaauagaacacuaggcacacuucuaagguuuuugacauaagucccuggcucgcagauggcaccucuggaccugccuggaggaacuucugcccugaagggaaggaaaaacccuggcuggcuuuaccaccuaaugauuguacagucccaggaccuugagugaacacaggcaguagccaugauaguaguuaugacagcaagccuugggcgagacccagugcuaugcuggcuuucagucugauucagugugguaccaguggugguggccacaaagaugcuugugucacaccaccccaagcucuagguggcucagaauagagagaaagaggcucuauuuuuuuuuaggagaaaguaaggggaaagaacaacagucucugcagagaauucuggaucuuaucuaagaccaugaacgcaguaccucuacaagucugcaagaacaauaguguuacuggguuugggguguccguuaauacagauauagcuuagaucacaacacucaagucuucugaguaccugaaaagccuugcaggaaauacagguucaaauuagcccagacugugaagacuacaauaaauaccuaacucuucaauguccagacacagaugaacauccacacacauuaagaucauccaggaaagcaugaccucacuaaaugaacuaaauaagccaccagggaccaauccuggagaaacggagauaugugaccuuuuagacucgaaauucaaacuagcuguuuuaggaaacucaaagaaauucaagaugacacagagaaggaauucagaauucuaccagauaaauuucauaagagauugaaauaauuaaagagaaacaagcaggaauucuauacuugaaaaagugcaauuggcauacugaagaaugcaucacaguccucuaauagaauguaucaagcagaaggaguuagugagcuugaagacaggccguuugaaaauacacagucagaggagacaaaagagaaaagaauaaaaaacaaugaagcauaccuauagggucuaggaaauagcuucaaaaggucaaaucuaagaguuacuggacuuaaagaggagagagaaacacagauagggauagaaaguuauuaccccuuugaauaaaaaggauguuaaugagugauaauuauuacagagaacuucccaaauguagagaaagauaucaauauucaaguacaagaagauuauagaacaucuagcacauuugauucaaagaagacuaccucaaggcauuuaauaauuaaacucugaaaggucaaagauaaagaaaggauccuaaaaggauaaaagaaacaaauaacauacaauggaacucuuauauguccggcagcagacuuuucaguggaaaccucacaggucaugagagaguggcaugacauauuuaaagugcugaaaaaaaaaaaaauuuuacccuagaauaguguauccuccaaaaaugucauuaaaacaugaaugagaaauaaaacuucccagacaaacaaaaagugaaggauuucaucaauaccagaccuauccuacaagugcuaaaggcaguacuucaaacaaaaagaaaagacuuuuaaugaguaauagauuaucugaggguuaaaaaaaaaaacucacuaguaauaguacacagaaaaacacagaauauuaucacacugugacucugguguguaaacuacucuuauacuaacuaggaagacaaaaugaugacccaaucacaaauaauguauuugcccauucucaaacugcuauaacuguaauaaaauaccugagacuggguaauuuauaaagaaaagaaauuuaauugacucacaguuccacuguacaggaagcaaggcagcaccugucugccuuugcggaggccucaaggaaauuuuucucauggcagaaggcaaagugauagcaggcaucuuacguggcagaaacaggaauaagagaggggggagaugcuacauacuuuacacaagaacucacuauugcgacgacaacaccaaggacggugguguuaagccaugagaaaugacucccaugauccaaucaccucucaccaggccccacauccaauauugagaauuacaauuugacaugagauuuggguggagagacauguccaaaucaugucaaauaauaacuacaacaacauuucaagacauugacaguacuuuaagauauaaacaggaaaaacaaaaagcuaaaaaguaggggaacuaaguguagaguuuuaauuuucuuuuugcuuguucauuuguucuaugcaaacaguguuaauauuaucagcuuaaaauaauggauuauaauauauuauuugaaagccucaugguaacgucaaaucaaaaaacacaccacagauacauaaaaaauaaaaagaaauuaaaucauaucacaauagaaaauccccuucacuaaaaggaagacaggaaggaaggaaagaaggaagagaauaucucaaaacaaccagaaaucaaauaacaaaauggcagggguaaguucuuaucaauaauacugaaaguaaauggaauaaacuccuuaaugaaaagauauagaaugguugaauggauuaaaaaagcaagaccuaaugaucuguuuguuaccuacaagaaacacacuucaccuauaaagacacauguugacuaaaaauaaggggauggaaaaagauauugcaugccaauggaaaccaaaaaagagcuggaguagcuauauuuacaucagacaaaauagaauucaaggaaaaaaaaaacucuaagaagagacgaagaaagucauuauauaaugguaaaugggucaguucagcaagaggauauauaagcaguguaaacauauaugaauucaguacuggaguacccaacuuauuagcacuaaagagagagauggaacccauacaauaaaaccuggagacuucaacacucuuguuucagcacuggauacaucuuccagacagaaaaucaucaaagaagcauugaacuuaaccugcauuauagaccaaauggaccaaauuuacagaacauuucauucaacagccacagaauacauauuaauuuccucaucacauggauuauucugagauagaccauauguucucuauccagagauagaccauauguuuaagacaaagcaaaucuuaaaacauucagaaaaucgaaauaauaucaagcauguucucugaccacauggaauaaaacuagaaaucaauuacaagagaaauuuaugcaaacacauggaaauuaaacagcaugcucuucaaugacuaguaggucaaugaagaaaucaagaaggaaauugaaaauuauuuggaaaugaauuauaauggcgacacaacauaaaaccuaugaaguacagcaaaaacaguacugagggaaguuaauagcuauaagugccuacaucaaaaaagaagaaaaacaucaaauaaauaaccuaaugaugcaucuuaaagaauuaguaaaaugagcaaaccaaacccaaaauuacuagaagaaaagaauaaggaaaagagcaaaaauaaauuaauuugaaaugaagaaaacaguacagaagaucaaugaaacaaagaguugguuuuuuugaaaaguuaaacaaaauuaacaaauguuuagccagacuaaccaaaaaacgagaagauccaaauaaacagagauuuaaaaggagacauuacuacuguuauugcagaaauucaaaggauuagcagcugcugcgagcaacuauaugccaauaaauuggaaaaucuagaagagguggacaaaugccuagauacauacaaccuaccaagauugaaccaugaugaaguccaaaaucugaauagaucaacaacaaguaaugagagugaagccauaauaaaaauucuaccagcaaagaaaugacaggacccaguggccucacgucuuaauucuaucaaacauuuaaagagaacguguaccaauucuauucagacuauucugaaaaauaguggagggaagauuuccaaacuuauucuaugaggccaguauuacccugauaccaaaaccagauaaacacaaaucaaaaaaagaaaacuguaggccaauauuacagaugaauguugaugcaaaaauucucaaaaaaaauuuagcaaaccaaauuuaacaacacauugaaaagaucauucaucaugaccaagugggauuuaucccuggaauguaacgaugguucaauauaugcaaaucaauuaauguguuaugucauaucaauagaauaagguacaaaaaccauaugaacauuucaauugauacuggaaacacauuugauaaaauuuaacaucuuuuuaugauuaaaaaacccucacaaaacuggguuuagaaggaacauaccucaggacaauaaaaaccauacaugacggaccauaaugagcaugauguugaauggggaaaaacugaaagccuuuccucuaagaucaagaauguaacaagcauggcccacuuuaacuacuguuauucaucacacuacuggaaguacuagccagagcaauuagacaaagagaaaaauaaagggcaucuagauuagaaagaaagaagucaaauuauccuuguuugaagaugacaugaucuuuuauuuggaaaaaccuaaagacuccauaaaaaacaguauuagaagugauaaauucagcaaaguugcaggguaaaaagcaacauauauaaaaaucagaagcauuuuuauaugcuaaccacaaacaaucugaagaagaaaccaggaaaguaaucccacuuacaauagcuacaaauaaaacaaaauacuuaggaauuaaccaaagaagugaaagaccucuacagugaaaacuaugaaacauuaauacaagaaauugaagaggauacaaaaaaaggaaagagauuccauguucauggguugaaaaaauuaauauuguuaagauguccaugcaacgcaaaacaaucuacagauuuaaugcaaucccuauuaaaaugcugauggcauucuucacagaaauagaagaaacaauucuaaaauuguuuagaauugguuguuauaugcaaccacaaaagaccauaaagaagaaugacauucugucauuugcgacaacacagauggaacuggaggacauuauuuucaauaaaauaagucaagcacaaaaagacagacuuuguguguucucacuuauuugugggugauaaaaauuaaaauaaauugaacucauggauauagagaguacaaggauuguuaccagaggcugggaaggguagugggggugggguguguguugagaauugggaaugguuaauugguacaaaaaaauaguucaaaagaaugaauaagaccuaguauuugcuggugcacagggugauuauaaucaaaaguaauguaauuguacauuuuaaaauaacuagaaguguauaauuagauuuuuuguaacacaaaggauaaaugcuugagaugauggacucccauuaaccuggauggaauuauuauuaugcauugcaugcuuauaucaaaauaucucauguaaugcauaaauauauuuacguacuauggacucacaaaaauuaaaaaaugaaaaauaaaaaauaaaaguuuugaaaagcaaacauacauacauaaaaaccuaccuuucuuucuucacugguaacuuaugggugcauuaaggaaaggacuguucuuaucauuggacccucagagcuuaauucaaagcucugagaaauaguauguucucaauauauuuguauuuauuugauguaguuacuacaaaaaagguuauacuaguguuaacucucauuucaacaaagcauucaguuaauuuagucacaguuccuuauucaucaacuaugcuagcucuuucuacuuugucuucauggcauggauuauaauuacauacuuaucuuuguguuucuuuuaucauuuauuccacauccaggcacaggggagagauuggaucuuguucaccccuguacccccagugcuuaucuuagccccuagcauauaguugguauugaauaauuuuuuuagugaauuaacagaaaguucauuccagcuaauguuuuacucuauuuucuguaaagcaauguaucugaaaaaugguccucaaaaaucuucuauaauaguuguugaaagugcauuuuuaggacucgaugcacacaucauaucuacuaaaucagugauugagggguaucuccuguaacuuauguuuuuacuaaagucccuauguguugcuuaacaacaugugcauacaggguucucacaacucauaucuuuguaacuaaacaaaugauuauucauaugggggaaaauaucucaauaaggcauucauauuugugaucauaguguuauuuuugugcuuuuguguguauuuuuauacuagucuacuuguuuuauuguuauuauucuaaccuuuugccgcaaguuaacuuuuucuucaugaacaaaagcaacagcccuuuucacuauucaacaaucucagccuacucacucucuaagccucucuuuuuauuuuuacugccaaagggcaacucucuuuuaauucugucucccugacucccccacucuucuuacgccauuuugugaaagcaguuucuaaacaggaacaacagaauuucuaaagucauucauguggaaauaaauuagagugagaaaucuauccaggacucaaaaaaguuacauucccugcuuuauguuuucuuucuugaaaucaguaaaagguaaacccauuacuucaacuuagaagauaugcaguaaaggcacacuugaguuuguuuugcuucucaucacugcacuuucacuguuauugcuguuuuauacaaauuaaaaguugguaguacccuuguaucaugcaagucuaauggagccauuuuucuaacaauaugugcccacuuugugucuuugugucauacuuugguaauucuugcaauauuucaaacuuuuucauuauuauuauaucuguuacggugaucugugaucagugcucuuugauguugcuauuguacuuguuuuggugcaccacaaacggagcccauuuaaaauggcaaacuuaagugauaaauaugugcguucucauugcucccccaaccagccauuccuccauuuuucucccucuucaugugucucccuauuccuugagaaacaaagauauugaaauuagaucaauuaguagcccuauaauggacucaaaguguucaagugaaaggaagaaucacacaucucuuacuuuaaaucaaaagcuagaaaugauuaagcuuagugaggaaggcaugucaaaagccaagauagcccaaaagcuagacuucuucuaccaguuaggcaaauugugaugcaaaggaaaaauucuuaaaggaaauuaaaaaugcuacucgagugaacaacagaugauaagaaagcaaagcagacuuccugcugauauggagaaaguuuuaguggucuggauagaagauugagucagccacaacauucccuuaagccaaagccuaauccagagcaaagcccuaacucucuuugguucuguaaggccaugagagaucaggaagguacagaagaaaaguuggaagcuagcagagguugguucauaagauuuaagaaaagaacugucuucaaaacguaaaaguacagggugaagcagcaaguacugguggagaagcugaaggaaguaaucccaaaaucuagcaacuauacagcagauuuucaauguagacgaagcagccuucaguuggaagaagauaccaucuagggcuuucauagcuagagagaagagaucaaugccuggcuucaaggcuucaaagcuucaaaagauaggcugacucuccuguuaggggcugauauagauggugacuuucaguugaagcuaauacucauugaccauuccaaaauccuagggcucuuaagaauuauacuaaaucuacucugccuguguucuauaaauggaacaaccaagucuggaugacagcacaccuguuuacagugugguuuacuaaauauuuuaagcucacuauuuagaccuacugcucagggaaaaagauuucuuucaaaauauuacugcucauuauaacagugcaccucaucacccaagagcucugauggauauguacaggaaaauaaauauugucuucaugaaugauaacauaauauauuggggaaccugcccugauagucauguagguucuuuucuauuuucccuaagcgucagcugguuugagaaauaaagggacagaguacaaaagagagaaauuuuaaagcugggcauccgggggagacaucacaugucgauagguuccgugaugccccacaagccgcaaaaccagcaaguuuuuauuagggacuuucaaaaggggagggagugugcgaauaggugugggucacagagaucacguacuccacaagguaauagaauaucacaaggcaaauggaggcagggugagaucacaggaccacaggacuggggugaaauuaaaauugcuaaugaaguuucgggcaccauugucauugauaacaucuuaucaggagacagguuuugagagcaacuggucugaccaaaauuuauuaggugggaauuuccucuugcuaauaugccugggagcgcuaugggagacugggguauauuucaccccuacagccucgaccauagaagauggccacgcccaggggggccaguucagaggcccacccccaggcgcauguucucuuucccagggauguuccuugcugagaaaaagaauucagcaauauuucucccauuugcuuuugaaagaagagaaauaugacucuguucugccuggcucacugguggucagaguuuaagguuaucucucuuguuuccuaaacauugcuguuauccuguucuuuuuucaaggugcccagauuucauauuguuuaaacacacaugcucuacaauuuaugcaguuaaugcaauuaucacaggguccugaggggacauacauccuccucggcuuaugagaugacaggauuaagagauuaaaguaaagacaggcauaggaaaucacaaggguacugauuggggaagugauaaguguccaugaaaucuucacaauuuauguuuagagauugcaguaaagacaggcauaagaaauuuugaaaguauuaauuuggggaacuaauaaauguccaugaaaucuucacaauccacguucuucugccauggcuucagccggucccucuguuuggggucccugacuucccgcaacaauaauauccauucuccagugcauggaugaagcaaucauuucaacuuucaagucuuacuuuuuaagaaauacauuuuguaaggccauagcugccauagauagugacuucucugaucaaucugggcaaaguaaauugaaauccccuggaaaggauccaccauucuagaugccuuucagaacaguugugauucauggaaggagaucacaauaucaauaugaaaagguguuuguaagaaguugauuccaacccucauugauaacuuugaggaguucaagacuucacugagguagugauugcagaugugguagaaauagagaacuagaauuagaacuggaaugugagaugugacugaguagcuguaaucucaugguaaaacuugaauggaugaggaguugcuucuuaagaaugagcaaaaaaaguuucuuagaauggaaucuacuccugguacagaugcugugagcauuguuggaaugauaacaaugcauuuagaauauuauguaaacuuauuugauaaagcaacagcaagguuugagaggagugaauauggagagaaguucuuuugugggugaaaugcuaucaaauggcauugcaugcuacagagaaaucuuuugugaaaggaagaguccauugaugcagcaaacuucacuguugucuuauuuuaagaagcugccguagccacagccaccucagccuucagcaaccauuacuuugauuaguuaaaaguccucaacauugaggcaagaccguccaccagcaaaaagauuaugacuugcugggggcuuagaugaccguuagcauauuuuagcaauaaaguauuuuuuaacuauuauuuuagguuuggggauacaugugaagauuuguuacauagauaaacacgugucacagggguuuauacauauuauuacaucacccagguauugagcucaguacccaauaguuaccuuuuuuguucuucucucucuuuccacucucccuccucaaguagaccccagugucuguuuccuucuuuguguucauauguucuuaucauuuagcucccacuuauaagagaacaugcaguauuugguuuucuguuucugcauuaguuugcugaggauaauagccuucagcuccauccauguucccauaaaagacaugaucucauucuuuuuuguggcugcauaguauuccauguauauguauauguauuacauguauauguauauguauauguauuacauguauauguauauguaccacauuuucuuuauccagucugucauugaugggcacuuaggcugauucuaggucuuugcuauuaugaacagugcugcagugaacauuugcaugcaugugucuuuaugguagaacgauuuauauucuucuggguauauacucaguaaugggauggcuggguugaaugggagcucugcuuuuagcucuuugaggaaucacccuacugcuuuccacaaugguuggacucauuuuuacucccacaaacaguguguaaguguucccuuuucucuacaaccuugccagcaucuguuuuuuugacuuuuuaguaaucgccauucugacuggugugagaugguaucucauugugguuuugauuugcauuucucuaaugaucagugauauuaagauuugcuucauaugcuuauuggcuacauaugugucuuguuuugaaaaauaucuguucaugucuauaaggaacuuaaacaaauuuacaagagaaaaacaaccccauuaaaaaagugggcaaaggacaugaacagacacuucucaagagaagacauacauuaucuucuucuagaucauguuuucgcacaucuaauagauuauaguauaaacaacuucuauauguacugggaaaucaaaaaaauuaagucccuaauuuuacugcaauauucacuuuuuugucaugguuuaggacugaacccuccauaucuccaagguaggcuuguuguaauuacaugguguuaauaugugaauaugugugagcaugaguauaaacacaguuguuauaugccauggaaagcaccacaaauugaaauguucuuucuccugaaaacuuaaaaauaugaacaaguuuuuuuguuuuguuuugugguguugcuguuucugagauggagucucacugucucaccaggcuggagugcaguggugugaucuuggcucacugcaaccuccaccuccuggguucaagcaauucuccugccucagccucacaaguagcugggacuacaggcucacgcgaccacucccagcuaauuuuugucuuuuuaguagagacgagguuucaccauguuggccaggauggucucaaucucuugauuuccugaucugccccccuaggccucccaaagugcugggauuacaggcauaagccaccgcaccuggccuuuuuuuuuuuuuuuuugacacggaguuucacucuuguugcccaggcuggagugcaguagcgaucucagcucccugcaaccuccgccucccaguucaagcgauuuuccugccucagccaccugaguagcugggauuaugggcguauaccaccaugccuggcuaauuuuguauuuuuaguagagacgggguuucuccaugauggucaggcuggucucgaacucccaaccucaggugauccaccugucucggucucccaaagugcugggauuacaggcgugagccaccaugcccagcccaaaaaaauaugaacaaguuagaggagaaauguaaagaagcaagagaaaauauugcuugagauuaaggaaaagccaaaagaaagauaaucauuuuuuuaaaaagaacagacuuacuuuuccuuuugucccucucauaauuuuaaaagaauuuugacuuaaguuuuauucauucagcauuuauuguacaccuaccaugugccaggcacuuuucaacacuucagcuugugaagggcuuugcaauuacagagaggucuucagagaccccauuucauaguagcauggacugcaucuuuuccaauuaccuugguaauugaggguacaugaggagaggugucugggaacauauccucaauucagacaaaggagaauaaguugagcaaugccccugccaugcccccuacaacugugcuguuuauuuuccagacucaacuuacucaacuuuuauucgaaacagagcucuucaauuuacaguuaacaagauuuuuaucauuuuauaucaauuuccuuucccacaguauaucaguuccaaauuugggacauaauuuaauucaaacaccagaaaguaaaggcaggauuuuuaaaaaauguauuagauuguuuggaaggguauacuaagucaauaguugucugaaauccuuuauggaaagaggcagaguauaaauaaguaaguguaacacaguaacuuaaggauaagucucuauuuccugguccagaaacuguuaauuagcgaugcaugguuaccauuucuuuuacucagugauucuucauauguuagguuggugcaagaguaauugcggguuuugccuuuacuuuuuuuuuuuuuuuuuagacagaguuucgcucuuguugcccgggaugaagugcaauggcacagucucggcucacugcaaccucugccuccuggguucaagcgauucuccugccucagccucccgaauagcugggauugcaggugugcaccaccaugcccggcuaauuuuguauuuuuaguagagacgagcuuucaccauguuggucaagcuggucaugaacuccugaccucaggugguccgcccgccuuggccucccaaagugcugggauuacaggggugagccacggcacccggccugccuuuacuuuuaaugacaaagacugcagucccucuugcaccaaccuaaauauuucugauuuuaaaaaucaaauuuuuuuucacugcagcagucugaagcuuagaaaauagaaaauuuacaugguaauuugccacuauauuuaaagacauuuacuauuuuccuuuuuugugacauuaucuucgggaaaucauaauuuguacucguauaguaaaaauguuuucuuccucuaaguuauagaaaucucuggguuuucucauccuaaaucaucaaaugaguaaaugccacuuuucucaauguagaaauugaaguaugcacaagugucuucugaauugagcagugcccuguaagcacaacaagugaaaaaggggcaggaaaaacacccagagccagauaagaguugcacuagaguauuucuagaauauauuguauugaggaagauuugggguuuuuugguggguuguggggaagaaaagaaagagauauuuagaaauuugggguagaagaauguugggauggauuucuugaugagaaacacaaaagaagaaaauaaauaugaauuauuguuaucguugguaaaaauaacauugucaugauauaggauauaguauuucacuuaggauugucccaagcuaguagcugaacugauuugaaacaaaggcacgcuuccuacagacaucagggcuaugccuugacacaguauuaacauauucacauugcaguugcuaggaagguuaugcuggugacaguuuuuauuucuuugcagccugacuuaacucaguauugauuugagacagcuccuguagugauguuuuuccaccagaaagucuauagaauauauuuucuucaugaagagugaugggcacagauaggguaauucuaacuugcuaaugaagaucuggggucuugcacugagaucuuccuuaugcagccuuaaaguucaaggaugucauuucauguaucucugacauccuuggcauuuaaagagaaauggauuuuggcacaauucuacggaaaggcuagcaacaacagacacaguuguuauauaaaggauucagugagucuacugauuuuaaaauccuaguauguaaaugcccuguuuauuccagcccuucucucaggauuuccuauaaaaugugcaaaauaaauaggccauguuauaugagauucaaaaauuacauauaaacuuacugcuaaaaauucaguuugucaaccugcuuuguacaggugcuaacacagaauuuaauaaagcaagguacauaaugaaaaaggaaaaagaagcuuuuaucugcagcauugucacaucuguuagagaauuacugcuaaauguuguuucauccuuuguucuccaaaccaaaaaugagcaacuuaaaaacccugcuaaacugaaguuuuuccaaaauacaucuaucugaauuauagauuauuguuuagauauccuacagaaauuaacuagaacacuuagcaaagcgaagcuaaauaguccugacagauuugacuuaauuaacaaauuuuaaacuuuuauacuuaucaaauggauauuugaauuaguuaauaaaaauaaucuuuauuuucuuggauaacccauugauucuaaauaugguuuuaugauaaacuagauucccacauguauuuugcuauuucuuuguccuuuuuucgguuaaaaugauauuucuuaguuuauuacuuuucuaguaccaagaguuaagauuauaauuauaccauguguuuggugcuguguuucuacauaaauuguagaauuagcuuucuuuuuucuuuaucccuugggaaaaauuauuuuaguauugugauugaauuaaacuuauagcuaaaugaagaaaauuaaccuauggcaugauuauuuuuuccaaaaacaggguaugucuuuccauuuaagguccuccuuuuuaggauccucuguggaauuuuaagguuuucuagauaauucuuuucaggguuauuacuagauauuuuagccuuuuguuguuauuauugggauaucuuauuucauuacauuuuauuugauuguuuuugauacauagaaagauuguugauuucaccaacaguuugauauagugauuaaggacauagacucuuaaacuuuugaaucacagcacugccacaccagcuguguaaccuugaacaauucucuugacuuuucugugccuguuuccuuguucauaaaauggugauaauaauauuauauacuucagaggauuauugggaggauugaguuaauauauggagaauauuuauauauacugcugguauauauaaauacucugcaaguuuucaccauuaccauuauuacuuuuuaucagccauauuacuguucucucauuauuuguaauuauuuuucauuugauucaaauuuucuauuuaucaucuacaaauuauaauuuuaccuuuuucaauuuuauacaucuuauaucuuucuauuauuuaauugcuucaccuuuuucucuagaacaauauuaaauaacaaugguaaugguggacaucuuuaucuuacacuuacauuaaauggcaguguuucuauuguuuugcugucuuuuugcuugagagauaaauuuuauuaugucauaaaaguaucaugcauucugauuucuugagaguuuuaucauauaucuuaucaacacacugucugguauucaauaggaacuaaauauaagccaugacuauggauuacugagcuuugccauuuuagacuauuuugauuuuagagccagcuuuaaaucuaggcucuguccuaauuucuauuuauguggagggccuugauccuaucagaaacuaccaaacuuucgguuuaagucaaggguauauuuaaagucucugaucaccacuggguggagauauuacagaaauucauagaaugagcaauccugugauuugagagggaauuagaaaaaaaaaaaauuuaacuagacuugaaaaacaaugaaaccuuacugaaaauuuuucagccaaaguuaaauaauaaauuucaguuaaauuuaaaacuaagacauuauuuguaccuggauuguuuggaaaggugauuguuguuucuagugauacacaauaauaaguacucuuaaauuuucuuucuugagaggcuaguaccaacuuguggcuuuauauucccauuugucauuuguugguuaauucuugauuauauguaguuuuuuuuauuuguagcauuauuaccauuucaauuaaaguagccucauguguuuuaaccaauaaauuuaucaucugguuuugcaauagaauagcuauuuuauuuuauuuauaugaaaaaugccuguaaacacauucaaauaucucuggcaauguggccagaaaugcaaaagaacuuaaacuuuuuuuaaauaaaauauauguguugaaauguaucuguacauuuuauagacacuauaguauuuuaaagauuuacuucaccacaauaaauauugcccauaacuccauuuaucaaauacuuuuucuugucuuagauuaccuuuuauugcauauuaaaguaaaccaacaggaagauaugaagaccuuuuuuaauuuaacaacuguaaaauugaauauaucuacaauaaauauuauuguaauucaucuauuacaauucaucuauuauauacaucuauuacaauucacuuauuauauagcugauaauuuuaauucauuauaacugcuauuauauuuaacaggcuuuuuguacauaaaauaauuuguuauauuuucuuguagaaauccuguacuuguucaugcccaauuuguguuucagaauguagaacuuuauucagagcuuaaaugaauaauuagcuuaccccugagaugcuuuuauuuucaauaagaaaauaugaaaaaauguguaccaaccaauuuaauguuauagaaaggaaccauucaaauuuaugaguucauauuccauaauauaugucauacuauuacaaacucaaaguacaucucuaugaucucugguuuuaagguuggcuguggcauguacauaaccuuucugaucucauaaaaaucagaauuuuuucuccuauuuaaaagaaguuugcaguauucacagcuaaacacauuguagacauugaugcuucuguagcuauauucuuguaagaaucaucugggaugauuugugguguguuaaaauaaaugauuaaagauuagagacagcugaauacucuuccuucucauuuaaaauguuaaacagucuuuuguguuuauugcugaaacuuuugaauuuuccuuuauuugggacaucuuaauugcauucaaauguaaaugguuggcugaugcaugauauuagcugaauauuucccagaaaucaaucauggcaauaacaguuaauaucacaaguacuuuagagaccuuguuuaccuuguauuuggcacagcagugagaaugaagagaggcagaucuccagacuuucuuccucagggaauaagugucuggccagagaguauuuugaucauuuaguugacauccuuugguuaucuagugaggagagugaugugggggcaaggagaauauuccaagugacaaggaggaccagagcaaaaaugcuagcacuaaucacuuuaguauacaaggaagaggauaagggugagagugaaggguaauauagucagcagcccaauucaagauuguaccuuggaaaauuagaguuugagaugaaaacaucaguucuacuaacuaaauuacugugaccucuugucaccagcugacucuacucacugaaacuccagaucaguauugccauugaaacuugaccauaacggugcugugugaauagcaucucuaucacauuucagaagaaaauuaucaaaaguucuaccuucagaaguuauccagcuaaguagggcugcucucauuaacuuuuucauauuguucaccugaguguaggaaacuuaccugguucugguuuuauuuuaaauaauuauuucuggauauuaauagaaacguauauccuaguagcaaagcaacaccaacaccaacaccacccuacauugccacuuugacccuguuuuugccuuauaagucagugacacuagaguucuucacuuacuguaaccucuuccacuuaaacuguaugaaauauuucccaauuauuugucuuuucaaauaaacaaguucuuauugaucuaagauuauauaagcaugccauguucaugaacaacacuuaacugagucucauaauuagaaucacuucugaaucuccuuaaauagaaacuccaguggagucauuaaguauuauguauugguuuuuaacuuuugucucagaaaguaagcaagaguuuugggaccuuuugccaguugaauauaaauuuaaaaaauaagguaauagaauuauauacuuaauagaaaauacagucaugcagcacauaacaacauuucagucaacaacggauuacauacaugaccguggucccaugagauuaugauagagcauauacagaaaccugauauauagcaauugauacuggcauuacagaucaacuagaggaaauaauugauauucaguaaugguucugcgacauuugguuuuccauauuaaaaaauacaugaaauaaguauauaugccaucuuuguuuguguaaauacacccuaugauguuugcacaacacacuugccuaaugacacauuucuuagaacauauucccuuuguuaagcaacacaugacuguacaaauacugucuacuccugcccaucauuugagaaaacugaggcccagagagauaaaaugucuccagaaugauaccguauagcaaagaaaaaauuacucucuuuacagaagcuuagcuuguacacaauuuuuccagaguacaucugugaacguuuuagcauaaagucucuaaucacugaaaaaaaaaaucugucucuacuuuucuuuauauuucauauucauguauguugucucucuucuguuugaggggaggagauucucucuagugugagagcuauacuaugcagcuuucagaguaugauaguuauuucaaacuccacaucagaugcuguauuucuaaauuuuaugaauagaaaccucuuccuauuuaaaacuaagagggagaaaugaaaacuugaaaaugucacugaaacaauuuauuguuuuaaauauauggaucaaaaugauauuuguagauugauaguuuuugaagguaacuuuucuuguuaaaauuccuuugagagugauagucugugccauuuacaaagccuguacccccucuugcaugagcuugaaauaccuaccacuaugaaauuagagucuguuuauuguaaacauuuggaaaaaugagaauugauuaauauuacccuaaaaaucucaaauuuauguuuuuacaagucuuauuaauauuauacaauuuaagauuuuucucagcauuauauagauugccugccaaaauugagauauuugucaauuuuuuuucuuuuuucuuuaaauuguuuauccuuucucauaaccuaaacugcaauuucuaugcugaucauuccaagaauaugauauucuaaccaugacuucuuccagaugccacuuuuuaucucuaaccacaucuuugacagugacaagugucacuguaccaucucaguuucacauaucuagauuuaaacauaucuucccuuuaucugccaucugucacuguuaauaucuuuuuuucuaaucaaccauguucaaaacuuaagagccauuauucacucauccuugaccuuuaacuccuguauauuuucucuuucuguauuuuccuauacaggcucucauacaucuaucuuucuuucuuuaucauuucauuaaucuaaccaauuuuacugaauagcuacugaguuccaggcucucugcugggcaauggagguaugaaaacaggagcucaugguauauugaaagagaccaguggcagugauuuauagaguaggggcuauaaaccugagaaacuuugauuggcuauuugugaacuaagcuucaggaaauuaggauucaaauuaaaauaggaugcugacugaacuuucugcaucauucauaccagguuaaguuggugggggagggggagaauaaaaagacuuuaaaugagaggauuucuucagcauaccuccuaaagguagaaccagugccuuagaaauagaaucgaaguaccuucccaauuucacacagaauacuauacuugaaaacccccaguuauuuauacggcaaacuccuauucauccuuucaaucuccacugaaauauuaccuuuucaaagaagcguuccccaguuuuccacuucuuuucuggccaaaugaacuacuccuccuguaucaugacagaaaccaaguugcagugaguucaggagacaaugguaaggagaaaauagagaugagaaggagguagagagguaguagcuugggagugauucacuccuugaagaguaguuuuauuauuuauuguuuuaauuuaccuucuguuuacuguagauggauggaauugcauguauuuauagaccaaggaaaaauaacagaaaaggaaaaauaacaguaaaggaaaaacugaauaaaaaaaggagauaaagaauugagcaaagcucucgauuaccaaugccaucacuuaaucuagauauuaauaaaauacacuuucuagcaagucuuucucccuuuaauuuuucccauuucuauuucauucuuggaaaaacagccaaauuaauauuccuaagauacuguuauuacuaugugacacauuccucgaaaaauccugcaguacauaucuguaaguuugaucuauauccucagacuucucugucuuucagagaucucauaaucuggcacuugucuaccuauucaauacuauuuucucugauucucaggauggauggucaauucagugagacuagucucuccauugucauuuuuacacccauugacuuuaacuuuuauaagaacaaguaucuuuguuuuguuaauugaaauaucccaaguaccgugagugguaccuaauagguauucaguaacuauuuaucaaauuuuucugcgcuccuccagagcuuuuauaguaacccacuucuacaacagucuuccuucucuuuucuucuuuuccaaacccuacuugguuuuccuuacucaagugccacuuacuccaccaauauauuacuaacuacuucugcccauauuguguuucacucuuucccugaguucucauaguaugcaccuuugguuccauacauggaaucuuacaagagaggcaggguagugaugugguuaaguguacauucuccagagccagacugaccaaauuugaauccugauucuguuacuguuauauugccuuuggcagguuuuuaccuucucugcaccugaauuuccuuaucuauaauaugaauaaaauaauagaaccucccucaggauuauuguaagacuuaaaugaguaaguaaauguauacaaguauacauuuauuauauauaaaauaucuauauauuuucuauuauuauuguauaguuuuauuacuaauucauuccuguuagucuugccuucccaacuggauuguggagucuuugagguagaaaugauauuucaucuuucucaaaauggccagcacaggcuaguucaucaacuauuugucaauuaaugauuacccaacauuuagaugauauuaagacgauuuuaucaggaaauuaaaccugcuucauuugggauccaauuuuaauaacauuuuauguaaagaucuacagucuaccaagcacuuuagauugacuguacugguugauucucacaguauuuuugugagguaaauagaagagcagcaucauucucauuuuacagcuuaggaaagaaaagucaagaagguaggugccuaccacccacucugucaguacuaccaucucucucccuacuucucaccugcucagagagguacaagguaaauuaaugucuucugcugaaguagacauuccacugcaauguagaaugucacccaugccuuauuuuagguaugcccaaaucucuacaaugauuguccugggaacuacacauuugccuugcaaggggagaauuugaguggcuaaaaaugcccacuacucuaaccuauaguuuaggaauggaaguacaucguaucuuaaauacuguguuuuccacaaagucaauuccccacuuccccaaaccuaucuccuuauaaaggauaggaggagaagggauguuggggugacagucagaaguaguagagucacucugucccuucucaguuaguccuuggacagauuuuguugguagcuucacuuauagcagacuagcauaguauagccuuuuagggacaacaucacucagcaugcuuuuauacauacauucauuuaucaaaccuuuuagcaccuucucugugcaggaugcuauuauaauuaccacagaauaugcaaaugaaauauaaggaauuuaagcuguugguguaccuggcucucuguggucauuagcauguuucuauuaauccaguuucccuccuagaaacauuauacgucacuuuaaaaaaaaaucucagaguuuuacuuuuauacauuguccucaaaacaaaaaguguacugucauuauguugaaacaaacuauuuaguaccuagucagcuauuugaaagauguuaccugccuuaccaauaugccuacuuuggcuuuuuguuuuguuuuuuuuuuuguuuuuguuuuuguuugagacggaaucucacucuuguugcccaggcuggagugcaguggcaugaucugcauucacugcagccuccaccucccagguucaagcaauucuccugccucagccuccugaguagcugguauuacaggcacccaccaccaugcccggcuaauuuuuguaguuuugguagagaugggguuucauguuggccagccuugucucgaacuccugacuucaaguggccaaggcccacaucggccucccaaagugcugggauuacaggcgugagccaucacgaccagccuaaauauucuuacauguagccaaugggcccuuuucucuaaauucuaaauauguuuugugaaaauguagauaaacaucaguuuauuuaaaaauuucuucauguaaaugguagaguaggccuuaccaaugaaacauuucagugaaccuaaaacauuuuuuauugacuuguguauguuaucuuuuguguguuuuccagccuugaaugcaugaaagccuguccuauuuaaugaucucuuuuuaucauuuuuggacuuuuucuguguauuagucuguucucaaucuacuaauaaagauauacccaagacugaguaauuuauaaaggaaagagguuuaauugacucacaguuccauuugcugggaaggccucacagucaugguggaaggugaaugaggagcaaagucacaucuuacauaucagcaggcaaggggaacucccauuuauaaaaccaucagaucucaugagacuuauucacuaccaugagaacaguaugggggaaaggacccccaugauucaauuauuuccaccugaccccacccuucacacuuggggauuauuacaguucaaggugagauuuggguggggacacagccaaaccauaucauucugucccuggccccucccaaaucucauguccucacauuucaaaaccaaucaugccuucucaacagucccccaaagucuuaacucauuucagcauuaacucaaaaguccacaguccaaagucucaucugagacaaggcaaguccuuucugcuuaugagccuguaaaaucaaaagcaaguuagucauuucccaaauacaguggggguacaggcauuggguaaauacacccauuccaaaggggagaaauuggccaaaacaagagggccacaggucucaugcaaguucagacuccaauaaggcagucauuaaacuuuaaguuccauaaugaucuccuuugacuccaugucuuacauccaggucacaugauacaagaggugugcucccauagccuugggcagcucugccccucuggcauuguaggguacagccccacucccagcugcuuacaugagcuagcauugagugucuguggcuuuuccaggcucacagugcaagcucucaguggaucuaccauucucagauuuggaggacuguggcccucuucucacagcuccauuaggcagugcccuacagagguccuccaugagagcucugccccagcagcaaacuuuugcauggacguccaggugucucaaacauccucugaaaucuaggcagauauuucuaaaccucaauucuugacuucugugcacuucugugcagcacaggcccaacacuacauguaagccaccaaggcuuggggcuugcacccccugaagcaaagccuugagcuguacauuggcccccuuuagccagggcuggagcugaagcaguuguguugcagggcaccaugucaugaggcuucauagagcaguggggcccugggccccacccacaaaaccauuuuuugcuccuaggccuccaggccugugauaggaugggcugccaugaaggucuccuacaugcccuggagacauuuuccccauugucuuggugauuaacauuugguuccucauuaguuaugcaaauuucugcagcuggcuugaauuucuucccagaaaauugguuuuucuuuuaucacauugccaaccuucaaauuuuucaaacuuuuuugcucugcuuccucuugaaugcuuuacaacuuggaaauuucuuccaccagauacccucaaucaucucuaucaaguucaaaguuccacagaucucuagugcaggggcaaaugcugccagucucuuuucauagcaagagugaucuuuacuccagucccaagaaguuccucgucaacaucugagacuaccucagccuggaccuuauuguucauaucacuaucagcauuuuggucaaagccauucauaagucucuaggaaguuccaaacuuucccaccuuuuuccaucuucuucugagcccuccaaacuguuccaacuucugucuguuacucaguuccaaacuugcuuccacauuuuugggcaucuuuacagcagcaccacacucuacugguaccaauuugcuguauuuuuauuuauuuauuuuuugagauggaguuuugcuuuuguugcccaggcuggagugcagugaugcgaucuuggcucgcugcaaccuccgccuccuggauucaagcaauucuccugccucagccucccaaguagcugggauuacaggcaugcgccaccaugcccagcuaauuuuugucuuuuuaguagagacgggguuucuccaucuuggucaggcuggucucaaacucccaaccucaggugauccgcccgccuuggccucccagaguucugggauuacaggcaugagccacggcgccuggccuacuguauuaaucucuuuucaugcugcuaauaaugacauacccaaaacuggguaauuuauaaaggaaacauguuuaauugacugacaguuccacauggcucgggaggccugucaugguggaaggcaaaugaggagcaaagucauaucuuacauggcggcaggcaagagcuugugcaggggaacucccauuuacaaacccaucagaucucgugagacuuacucacuaccaugagaacaguaugggagaaaccacccccaugauucaauuaucuccaccuggcccuaucuuugacauguggggauuacuacaguucaaggugagauuugggggggacccagcuaguccauaucaaucugaauuuaaagauaauauuuauuaucuuuuuaacaucucugcauguuuuucagugccagaucuauuaccuauuauaaguauagucaugacuucucauuuggaaagucuuuuuacauugcuguaaacauuucaucagaauuaucuuaaaacaauuagauucauaguuaugaaguauuuaagagaguuuaauaaugcugauugaaaacaaguugcauauuuuuauguuuuuaauuauucaaaaguagcucaucauuaaugaauaaaaccuaaacacagaaaaucaggaagaacaaaaauaaaauuaauuccacuacucagaaauaaccacuuuugcaguuucugugugguguguguguguguguguguguguguguguguguguguguauuuagcgcaaaagugguccauaauuaauuuauaguauuacagggucuuuuuucccuugauaauauauaauauccccuuaauaauauauccugaacauuuucuucauuaggaaauauuuuuuguaaacauaguuuuaauuggugaaugggauuucuuuacaugaguucagugcuauuuauuuguucuauccucuuuuauuguguauuaacauuauuuuuguuuuucacaauuuaagaaaaacaguauguuugauaaauguuuuuucugugcaacuuuuuauaaucugugacuguccauagaacaaauuucuaagaaauuucuagauuaaaagaugugcauauuuuaauacauauuacacauuuuucuccagaaguuaauguugauuuauacauucacuagguaucucuuuccaucaccaauaauuaguacccucaaauuaggacacuuaaaaugaauuuauuuagagaugguaauuacaagaugguacuuuggggggaaaugaaagcaguaauggaguaaauuauggauauuagcuacagaccuguuaccaccccuaguuaagggaauaagugguuaccagaagauagauaagagaggcaaguagagagcacugucuucagaagcacagugaccuuuggucaagggacacagccaagccaauauacuaggggaaugaauacugugaccucacucuuccuauugucuguacccauuuuaaagcagaggauugaaagucccucuugacgcagucuaaacagguugccacauagggcagaaagcaagguggagaccaguggagagugaaucuggagggacaaacagaagauaaccagaauacuuaccuacuuuuuguauuucuaugacuguaaauacuucuuuauauuucugugauuauuaaugacguaaaacauuuuuauuaccuauuuguguuucuucuuuugucaaguauauguuuauaucuccccuuuuuuuugacaaagcaggauuuuuauuuguuacaagaaggacaucuuaaauuuguauucuucacauacauuacucuucuuuaagaauucaucuuugcuauacacguaaauguuucaagucaucaauacuuuuucuuguucuuuuguaauuucauuucuuuauacuuaagaagugcuucaucuagcuguaagccauuauccucagcaaacuaacgcaggaacagaaaaccaaacaccgcauguucacuuauaagugggagcugaacaaugagaacacaugggcacagggaggggaacaacacacacuggggccuguccagggggcggagagagggagagcaucaggauaaauagcuaaugcauauggggcuuaauaccuaggugaugggucaauaggugcagcaaaccaccauggcccucuuuccuauguaacaaaccugcacguccugcacauguauccuggaaauugaaauaaaauaagugcuuagucuauauaaaucauuuuucuguauuauguaagauagaaacacaguuuuacuuucuuccaguuaacaaguuaucccaguacuauauucuaaauaauaaagaacaaaauaaaagaauagaaugaugccauuucaaaucaucacccagugauuugacaugacauccuuuucuuuuccaaauauuuauauguauuugagucugcuucugugcauuccauuauauccaauuaaucuuuuggucuuuccugaugcaauaucauacgauguuaacuuuguacauuuuuaauauaugacaguguguuuuauuuauuauuuuccaauauuuucuuggcauuuuugucuaguuugucaaauaaacuucaaaauuuaaguuucaaaauagaaaauaugauuuauuuuaggauuuugauuauacuuauauacauuacccuaaggaaaaauaaaguuuuuauaauauugaaucuuucuagaaagcaucuaauauccccucuccuuauuuuuucaaaugucuugccugaaacuauuucauuuucuuuaaauauaagguuaauucuagguaguuuauuuuggaugaauauugugauaucaugaauguaagcuuuugucuauuauauuuucugccuacugcugcuguauagaaaagcuaaucauuuuguuguguguauguuguaacuaaacccuaaugaaauucuuugcaguuuuauuggauuuuccucggauuauucuggguuuucuaggacuauaugcaucuugauuucaguaacucugcuucuagugauucauugauaaguagaaugucaaauguuuaagauaaagaauagcugucucaaaaaacauguuucauucuaauuaaguguucuucugguaugcucuacaaugggguuuucuuuuucuaaaauugggagucgaugugaauuuguaucacaucuggccuuauguaacuuauaguguugauuacauauuuguauccuuugaccaauuaaguugaugagcuauauuuaaaauuuuccuaauauugaaucaucuuucauuccugaaauauguccuaagucauuuuuauggaaguauuaaaaacugcuauugcauucagccucuagaguuuuuagaguuuuaaaaucuguuuuucuaaggaauacuggguggggguggugugugcacgcauguguguguacgcguguguguguguguagugcuauccuugucagauuuaaauauuagcuuaaggcagcuucauaaauaaaauggccuggggcacuuuuucaauuuuuuuugccuuugagcaguuauuauaucaugagaauucccuauacuuugaaaauaagauagaauuguuuggaaaaaaauugugcuuggcaucuuucuucagcguaaucauuugaaaacuuuaaaauuuuagcuauauuuaaaaaggccuauugagguuuucuaugacuuucugacuuuugaacacauacacacacacacacaaacaugcacacacacacaugaacacaccccaguugauucagguguacuuaggccuaugaacauguagguuuucugagguuuucuacuauuuggggaauauuuggaucaauauuuuuuaauguauuauagaauuguacagaguauuguauuuuuuaaauauuucuguaugcuuauauauguucucauaauaugauuaaaaaugagaaagaaaaagaauauaaaaacacaguuuuucugauuuguaauuucucucccucucagacacaugcacgcacucaguccauuuacagauuuuugaacuuuguuuaccccaaaaugucaacacuaauauuugucuguuuuucucuucguugauauauuuauuaaauuauuuugccuauuuuccuaaagaugguuuaggauuuuuuguuuauuuuuggucuccuuuauauucaccuaacuucuuuuuuuuuuuuuuuuuuuuuugagacggagucuugcucugucaccaggcuggagugcaguggcacgaucucagcucacugcaauauccgccuccuggguucaagcgauucuccugccucagccucccgaguagcugggauuacaggcacaugccaccacacccagcuaauuuuuguauuuuugguagagaugggguuucaccacguuggccagaauagucucgaucuccucaccuugugaucugcccgccucggccucccaaagagcuggggaauacaggcaugagccaccacacccagccaacuucuuucaguuaauuagagcacaguuuugaaagcuuuaaaugguagcaacugucaucuccaguuuuucaguugaggaaacaaaagaugacuuuguugacaaauuauugaggcagacauacauuuuaguguucuuuauuaaccaucauggugcucagaugccagagagcaugugaugacuuugccaucccugaagaguuugucugauaauccagacauaagaauugauucugcucugcagaaucauuuaaucauauuuuuauucacucauucauucauucaucaaauauccauugaguuuuuuuguugcagaccuugugcuagcuuuucgagauacaaauaugaaaacacguggaaccuccauucaaggagacuguaagucaaguggagaaauagacaauaucucacaaauaguaauuacuauaauagagguacuugcacaguuuucguuacauauacauaccucauagcacaauguuacucaugaacaguagaugauuuggaaauacuauuuuauuccuuuauaaucaauauauauauaucuuaauacuuucugugugucagauaauacacuggguccugaggaaaauaagguauaaaaauaauuuuuucaugcuugagaagcuuuuagucuagugggaaaugacucaucucauuauaauaaagauguauaccagauaccugugaagacauagaagagaaacuuugucagucaggaguuaaaaagaaaggccuucuucacagagaaaguaguguuugaacugagauuugaaaggcaagcagggauuuauuaaaugcacagguuguggcuuucuaagcgaaggaacaacaugugcaaaggcacaguggcgugaaaaggcaaguagugugcuaaugcuaaagcauaagggacaagauggugaggggugagaaaagagguauaagauaaaaauuuauagagcacauaucuugccagacgccauucuaaauacuuuauauagauuuacuccauaagucuuuaucguugcuuuguguuggaaauauuucaaaucuagcucuuuugaaauacacaauaaauuauuguuaacuauagucacucuucugugcuauugaguacuagaacuuauuccuucuaucuaacuguauuuccauauucauuaaccagccucucuucauccccaucucccacaacaccaccaccuccaccccaccacucucccccuaugucccaaacccacccuguccaccuuucccagcaacuacuguucuacucucuacuuccaugagaucaacuuauuuaguuuccacauacgagucagaacaugcaauauuugccuuucugugccuggcuuauuucacuuaacaugaugaccuccaauuccauccauuuugcugaaaaugauaggauuucauucuuuuauuuuauucauuuauuuauuuauuuuugagauggaguuucgaucuguuauccaggcuggagugcaguggcacaauaaaauaaugggauuacaagcaugggccaccucacucggcaggauuucauucuuuuuuaauggcugaauaguaauucauuguguauauuaauaaauauauauuuucuuuauucauccauugauagacauuuagguuaguucuguaucuuggcuauugugaauagcgcuguaaugaacaugggagugcauauuucuucgauauccucauuuccuuucuuuuggguauauacccagcagugggauugcuggaucauauggugcaacugcuuuuaguuuuuugaggaaccuccaugcuguuuuccauaguggcuauacuaauuuacauucccaccaacaguguacuagcauucuccuuucuccacauccuuacuaacguccaugcuuuuugccuuuuugauaacggcaauuuuaacccaggugagaugauaucacauuguguuuuuuuuuuuuuuuuuauacuuuaaguuuuaggguacaugugcacauugugcagguuaguuacauauguauacaugugccaugcuggugcgcugcacccacuaacucgucaucuagcauuagguauaucucccaaugcuaucccuucccccuccccccagcccacaacaguccccagagugugauauuccccuuccuauguccaugugauuucauuguucaguucccaccuaugagugagaauaugcgguguuugguuuuuuguucuugcgauaguuuacugaaaaugaugauuuccaauuucauccaugucccuacaaaggacaugaacucaucauuuuuuauggcugcauaguauuccaugguguauaugugccacauuuucuuaauccagucuaucauuguuggacauuuggguuggcuccaagucuuugcuauugugaauaaugccgcaauaaacauacgugugcaugugucuuuauagcagcaugauuuauaauccuuuggguauauacccaguaaugggauggcugggucaaaugguauuucuaguucuagaucccugaggaaucgccacacugacuuccacaaugguugaacuaguuuacaguuccaccaacaguguaaaaaugucccuauuucuccacauccucuccagcaccuguuguuuccugacuuuuuaaugauugccauucuaacuggugugagaugguaucucauugugguuuugauuugcauuucucugauggccagugauaaugagcaauuuuucauguguuuuuuggcugcauaaaugucuucuuuugagaagugucuguucauguccuucgcccacuuguugaugggguuguuuguuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccguuugucaauuuugucuuuuguugccauugcuuuugguguuuuggacaugaaguccuugcccaugccuauguccugaaugguaaugccuagguuuucuucuaggguuuuuaugguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagguaguuguagauaugcgacguuauuucugagggcucuguucuguuccauugaucuauaucucucuuuugguuacuguagccuuguaguauaguuugaagucagguagugugaugccuccagcuuuguucuuuuggcuuaggauugccuuggcgaugugggcucuuuuuugguuccauaugaacuugaaaguaguuuuuuccaauucugugaagaaagucauugguagcuuuauggggauggcauugaaucuguaaauuaccuugggcaguauggccauuuucaugauauugauucuuccuacccaugagcaugaaauguucuuccauuuguuuguauccucuuuuauuuccuugagcagugauuuguaguucuccuugaagagguccuucacaugccuuguaaguuggauuccuagauguuuuauucucuuugaagcaauugugaaugggaguucacucaugauuuggcucucuguuuguuguugguguauaagaaugcuugugauuuuucuacauugauuuuguauccugagacuuugcugaaguugcuuaucagcugaaggagauuuugggcugagacaaugggguuuucuagauauacacucaugucaucugcaaacagggacaaugugacuuccucuuuuccuaauugaauacccuuuauuucuuucuccugccuaauugcccuggccagaacuuccaacacuauguugaauaggaguggugagagaaggcaucccugucuugugccaguuuucaaaggaaaugcuuccaguuuuugcccauucaguaugauauuggcuguggguuugucauagauagcucuuauuauuuugaaauacgucccaucaauaccucauuuauugagaguuuuuagcaugaaggguuguugaauuuugucaaaggcuuuuucugcaucuauugagauaaucaugugguuuuugucuuuggcucuguuuauaugcuggauuacauuuauugauuuguguauauugaaccagccuugcaucccagggaugaagcccacuugaugauaguggauaagcuuuuugaugugcugcuggauucguuuugccaguauuuuauugaggauuuuugcaucaauguucaucagggauguuggucuaaaauucgcuuuuuuugcugugucucugccaggcuuugguaucaggaugaugcuggccucauaaaaugaguuagggaggauucccucuuuuucuauugauuggaauaguuucagaaggaaugguaccaguuccuccuuguaccucugguagaauucaacugugaauccaucugguccuggacucuucuugguugguaaacuauugauuauugccacaauuucagcuccuguuauuggucuauucagagauucaacuucuuccugguuuagucuugggagaguguaugugucgaggaauuuauccauuucuuuuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccagcuccuggauucaguaauuuuuugaaggguuuuuucugucucuauuuccuucaguucugcucugauuuuaguuauuucuugccuucugcuagcuuuugaauguguuugcucuugcuuuucuaguucuuuuaauugugauguuagggugugaauuuuagaucuuuccugcuuucucuugugggcauuuagugcuauaaauuucccucuacacacugcuuugaaugugucccagagauucugguauguugugucuuuguucucguugguuucaaagaacaucuuuauuucugccuucauuucgucauguauccaguagucauucaggagcagguuguucaguuuccauguaguugagugguuuugaguaagauucuuaauccugaguucuaguuugauugcacuguggucugagagauaguuuguuauaaucucuauucuuuuacauuugcugaggagagcuuuacuuccaaguauguggucaauuuuggaauaggugugguguggugcugaaaaaaauguauauucuguugauuuaggguggagaguucuguagaugucuauuaggucugcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcucuucuuguugaauugaucccuuuaccauuauguaauggccuucuuugucucuuuugaucuuuguuuguuuaaagucuguuuuaucagagacuaggauugcaaccccugccuuuuuuuguuuuccauuugcuugguagaucuuccuccauccuuuuauuuugagccuaugugugucucugcacgugagauggguuuccugaauacagcacacugauggguuauucuaguuauacauucuucuaacuuuuuuucaaaguuuucaacuucuuugccuuugguuugaauguccucccguagcucagaguaauuugaucgucugaagccuucuucucucagcuugucaaagucauucuccauccagcuuuguuccguugcuggugaggaacugcguuccuuuggaggaggagaggagcucugcguuuuagaguuuccaguuuuucuguucuguuuuuuucccaucuuugugguuuuaucugcuuuuggucuuugaugauggugauguacagauggguuuuugguguggauguccuuucuguuuguuaguuuuccuucuaacagacaggacccucagcuacaggucuguuagaauacccugccgugugaggugucagugugccccugcuggggggugccucccaguuaggcugcucgggggucaggggucagggacccaccugaggagacagucugcugguucucagaucuccagcugcgugcugagagaaccacugcucucuucaaagcugucagacagggacauuuaagucugcagagguuacuacugucuuuuuguuugucuguacccugcccccagagguggagccuacagaggcaggcaggccuccuugagcuguggugggcuccacccaguucaagcuucccagcugcuuuguuuaccuaagcaagccugggcaauggugggcgccccucccccagccucgcugccgccuugcaguuugaucucagacugcugugcuagcaaucagcgagacucugugggcguaagacccuccgagccaggugcgggauauaaucucguggugcgccguuuuuuaaggggguccgaaaagcgcaauauucgggugggagugacccgauuuuccaggugcaucagucaccccuuucuuugacucggaaagggaacucccugaccccuugcgcuuccccagugaggcaaugccuugcccugcuucggcucgcgcacggugcgcgcacccauuuaccugcgcccacugucuggcacucucuagugagaugaacccgguaccucagauggaaaugcagaaaucacccaucuucugcgucgcucaggcugggagcuguagacccgagcuguuccuauucggccaucuuggcuccucucacauugugguuuugauuugcauuucucucuuuauuagugguguugaccauuuuuuuuuccauguaccuuuuggccauuuguauguuuucucuugagaaauguuuauucagaucauuugcccguuaguaaauuagauuauuuuauuauugcuauugaguuccuuauauauucugguuauuaaucccuugucugauggagaguuugcacauauuuucucccauucugcaaguugucucuuuacugaguuuauuguuuucuuugcugugaagaagcuuuuuagaauguuguaauucuaugucuaguuuugcuucuguugccugugcuuuugaggucuuauccaaacaaucauuucccagaccaguguccugaagcauuuccacaauguuuucuccuaguagcuuuauaguuucaggucuuauauucaagucuuuaauucaucuuuaucugauuuuugcauauaguaagagauaggggucuaguuucauuuuucugcauauagauauucaguuuuucuagcaccauuuauugaaaagacuguccuuuccccuacugaaaguucuugguggcuuugucaagaaucaguuggcuguaaauacauugauuuauuucuggguggacaucuaaguuuaacaugcaguguauguaaaggcuuuugggcagaaaugauaaauugauggacauuuccaguguuguuuuauaauuauccuaaaucuuguccauuaccuguaaacaaagucucaugaauuugaaacccccauucacauaaggaaaaugugauauagacacacaauaucuauaauacuaaauaagacaaaaguuguacaguuuuacuuuuaugccucuaaguggaaauuuuaaaugacuaguaaauuugcuuauaaaaguaugaaaaacuaaauucucuguuuuuaauauuguaauuauuuucuucauaaagcaaaguaguauaauuuuuucuaaauuuaauuuacuaaucuccuaaaauucauuugcagaagaacuuguauacauuaaaguucuuuacacauacacauucacagaaguuuagaacauuuaaauuugucagcaauuccucuccuucucuucuuaccauuucauauagcaauacucuuuccuuugaaaaacuccucccauaugauacauuugauuggaacuaaugcuuaggucaaaucuuuauuuaaaccacucaguucuucauaaagaauacuuuggacaaauccucuucuuagucagggcacucuuuucacucaggugaaacuucaguuugaaaugccgcauucaucacaaaaugacuaaaaguggaacugggcuaaucaaaaaguucuuuauuuuaucuucauaaauguaugacuucaugugaaggcuggaaaaaauaccuguagagauugcaaucuaaugaaaaaggagauggaagcauugauuguauggcuugcugauuucaaaacccuuuaaucuuucugaagcacuuuuaauuucaggauguuuaaguagcuuuaauucuuaauauuaaaaaauuaagauucuuaaugccuauuuuuuauuaaaagcuauaaacccauaaagcuuagcaauuuccauuucuauuuaaaaguuaaugaaguaagagaacaagugcuuuaccacugaaaaauucagaguacaacuggggaaacccaaggggugagagcugacaugaaacuccaauugaaaaccauuuuuuuaaauaaaucuaucugguaaaugauuuauaugguuuauuuuuuguuaccuacaaauucuaaauuggauauucuaaguguagaauuccacaauguaacugagaaaaaagagaaaaugaguaaacgagauaauuauuagacucuauuuugauaacuuaugaaacauaaauuaaaaauuuuuugaauccucauauguuaaucacuugauuuuuuaaaguguuuguguguuuuuuuguuuuuuuuuuuuuugagacggagucucacucuaucacccaggcuggagugcaguggcacuauguuggcucacugcaagcuccgccucccggguucacgccauucuccugucucagccucccaaguagcugggacuacaggcgcccacugccacgcccggcuaauuuuuuguauuuuuaguagagacaggguuucaccgguuuagccaggauggucuccauuuccugaccucguaauccacccacuucagccucccaaagugcugggauuacaggugugagccaccgcgcccagccuaaaguguuuaaauucucaagucaugucacauaagauuucaagagaucacuagugcucaauaaauuuauguugaauuuaguuguguuguauugcauugccuauuauggggaaaggcucauccuucuucuacuaagaaacauagagaauaauuguaaauagcccuuagucugaaucauuuuuaugcaauaucauagacacaaaccaauggauggguuugauagccuggagucuuaaguuaccuccuucacaguuaagacacauuguuaguuugguuuacuauuuaagaaagcauuagggugcucuuuauucaucucugagaaucaaguuuccacucaaccauuuauauauaacauaaauuauauuauaaaaguccaacacauauauuagaaccaguuucuuuaauuacuauguaugccuaauuacagugcaauuucucauauuaccugaguuaaaauuaaugcaauucaaaacaacaguaguuuauauuuaaagaaaagugaaauguacuuaaaggagcuguuuuuuuuaaagcacucucauaaggaaaucuuugccucaucucuuucuacauguuugacccaggagcuugcagucaaucaaaacaauaaugcuuuccuauaaguguaaauaacaaagaaguaaaccucaauaguaagguaucaguuacaccagcgguccccagccguuuuggcaccagggacugguuuccuagaagacaguguuuccauggacuggguuugagaugggggggggaugauuucaggaugaaucaagcacguuacauuuauugugcacuuuauuuauauuauuauuacauuguaauauaaaaugaaauaauuauacaacuuaccauaagcuagaaucagugagagcccugagguuguuuuccugcaacuagaugauccuaucuagaggugaugggagacaaugacagaucaucaggcauuagauucucauaaagagcuugcaaccuagaucccucacauacauaguucacaacaggguuuguacuccuaugagaaucuaauuccaccacugaucugacaggaggcggagcucggacuauaacggagcaauggggaacaacuguaaauacagcugaagcuuugcugacuugcuuaccauucacuuccugcuguguggcccaguuccuaacaagccauggaccaguaccaguccauggccuggggguuggagaccacugaauuacacaauagacugugaaaauuagauaguuuccucuucucuuauaugcuguauuguuugguaucaagauauucuauuacuggggauaauuuguuuuucuauaauauucucaauauuuuuuuuuguacauuuuuuuuuucagucaagagaauccaucccauuaaaugaccugaagucagaaguaucaccacggauuucagcagaggaccugauugacuugugugagcucacagugacaggccacuucaaaacacccagcaagaaaacaaaguccaguaaaccaaagcuccuggugguugacauccggaauagugaagaguauccuuugcauaugcuguuuuaaagggugguacugcuuauuuguauugcauccuuucauuuaaguguugugugguuaaaaaaaaaaaauucugggauucuucugaauucaaguaguuaaauuacucucaaacuggaugccagaauggucuugcauaagguuuuauaagauaacauuacauaccagagaccugaugauauuuuccaaacaaugccagaauauugggauauuuuguuguuuuuuguguuucucugguguauauugcuauucuugaaggcauuugaauccuucaugcuguagauaggaauuguggcaaagauaaagaguaaguauacaccuguuuuaccucauagccuagagaaaaaguuugcuacaucucaacacugaccuuguguucauuauaauuuucaaaacacuggcuuacauagaacauguauuuucacuaacuacaaaauguuauuuacgaagauuuuacuauugaacauacuguaacauccaguggguuugauuggcauuagaguaugaagaguuacaaaauaguaacaguucagucucuucuccuucuauuuucauuaucuucagauucuuugauuguguauuuucuagaaucuagauaaaugguuuucacuuuguuuaaaaacagagcaacuuuuaaaaucuuucuuagaaacucaauauauaaaauauaaaugaauguuauaacuaauuugcuucauaaguucagauuuauaacauuuacuaacuauaaaugcuauaaaugaggguuagcagguuaaugguuucuuauaugcuaaaauuggcauauacagguugaguauccuguguccaaaauguuugugacaguauuucagguuucauauuuuguaggauuuuggaauauuuccauuauauguauauacuuaccaguucagaauaucuaauccaaaaggcucuaaugaguauuuccuuugauccugauguuguugcucaaaaaguuugauuuuggagcauuucagauuuuagauuuuuggauuaaggauacucaaucagcaauaaguuuucauguuaauauuuucaauuccaauuuuugaaaugaaauucaaauuacacauuuacagacuuuauuaaguaauucauagaaucuuagguuucugacaguacaauuggagagcucacaauuucaaaugauauauucuuaucauuuugugaaaaguugcuacuuucuauuuuucugaguuuggagagaguauaaauguugauaucccugguuguuaggguuucagcaauacuagaaacucuuugcagaguggaugaguggacucccgaaugaggcauuaaauucuauuuaacuggucaagaaccccuagucuggaaguucuucugaucuuauacuucaggaguuuagaaucuguuuaauguuuuuaacuuuuuaauuuguauuucuuuugcuugagucuuuauucauagcaauucucccauaaaaccauaaaaaauaacauuauaacacccuauuuuaaucuuaaagauauuucuuccauucuguagguugucuguugccagguccaaucugcagacccuggccgaacaacggauguaagaaugcagucagacgcagguauccagugaaaaagcgggcuagaggaccuggcugcuuauagaccccgagcagggugcuguaaagagucagcagcuguagcccugacaagcuggugcugcaggcauuuauuuaguuacagauuuaaugacaaaggcuuugagucaacacacuuuugcguaauuaacauagucacccugcccggagauagcagucaugcauggggaugauuaaaggccagguuccaaguuaaacuaacuuaccuagaucaauuccuuuauaucucuuugcuaucuaaccuuugcucucaagguccagauaagaggguuuggcuaccuucagccaaauccauuuccgaagcuguuguaaaaccuccccgccuuccaagaagguuugcaucuuucuacaauuuuucccaccacccugacugaucuccuacaucucccccuuuucuguuuuuagcaucagguuuuguugauugaagaguacagaugugugcagcagcagguuugucagguguggcgggcacugcucgcauuccggcuuugcauccuagaauuaguaaauaauagaagacaaauaugaguauaauuagccacauucuuuuccaauuaaggagugacauguaguguuacuuggcaucuuaguccaaugugugccguuauugaggaaccccacuuggggcaugucauucccucuuagccaagcagucguguuguuagaagcugagaaggggguguuuguuuaaauaauagggcugaagaaaggcguaucuaagagaugggcccaauagagaguagcaggugaggguugcagguaaagugaaagaauuaaaaagguuaauaaagcauaggaaggaacaaauuaucuggagugaauggugucuguguccagagcagauucgcucagucuucugacuucucuucuucagcguccuguccagggccuaugucguccgaggaagccacauuuucuggggcuguagguccuauagggucauuuucuuuauuucugguaccagguuggguccuagccaugcuaugguaagguuugauggaucgugcuggaauccaaagaggaccugagggggugugaacacaagcauauccucucccacauguuaacaauucauuuggaccacaccguacauuacuguuuacaucuuuccauaaaacugcagguuuuaugucuugagagguuuuagcaaagugcuuuucuacagcuaauugaaauuuaucaucuaaauuuucaaaauuaaggguaaauaaggcuugugcuaguaguguugcaggguccuuacucauauucccccuuuuuuguuuucugagcauauuuuuaaggauagagugaguauguucuacuauggccucuccuuggagguuauaagggaugccuguggaauguuggauauuccacugugacaaaauuguugaaauugugagcuggcauaagccagaccauuauuaguuuuaauuuuuguaggccaccccauaaaugcaaaaguuaaaagacgauguuuaaugacauaucggguggacucuccaggaaaggcaugagcgcuaauugagaauuguuauuaauggauacauguacauaucuuaguuuuucaaauucaggcacauguguaacaugguguuugccauaacugauuagguucuaguccucuaggguuaacaccuguauaaggagggaacgugccugugagcuggcaaucugggcauugccgguuaauuuguuuagcuagucucuggguaaguugaaauuguucagauaaguuucuccaguuuugguggaaaaauugaugugacuggguggcuuggucaaacagugauguucuaacuuguacgucugcuugaucauggucauaagccagugggccaggcagugagcugugggcucaaauauguaugauaaaaauaggauguguauguugaucuagcaaaugcugaagucggagaaaaagugcauacagggugggcuccagaguggacuuaaugagggcccucucaagguucugcaauaaauaaacagaguaagcagacucacuaacaauauugaugagcugaauggaaaaaguuuccaaggccaauaguaaggcuccaaucucagcccucugagcgcuaguaaauccagaacaagugagggaauuacgugauuuccaccagaaagugacuuuuccauguuuaccagagccaucaguaaacacuguuaaagcauuagauaugggggauugaacuguuuuaguaggcaaaaccacagaaguacaagauaagaacugaaggaguuugucagcaggaagggcaugcucuauauggccuuuguaaucagagagugcuauuugcagguccauagauaaggcaauacugccuugaauugcuuuuuacuuaaaggaauccugaugauaucagggucauaaccuagcaacugauugcaucaucugcauccugaauaaaugacuuuacugacuaacuggauauagggaaagaguguuuuagucccgguaugugagcaaaaaacccauucuaggaagcguagcccuggggucaucuguaggggaguguuuagugggaaaaacaaauaauugaacugaauaccauguaucaaugcaaucuaguugucucugagaaauagcuugcucuaucucuucaauuucccuuugugcugcaggaguuaaauaccuaggagagucuagggcagcauugccuuuuaagauggaaaacaaguucuguaacuuaucaguaguuauguccaagguggggcaaauccaguuaauauuaccuaguaauuucugaucaucauuuaagguauguaaguugcuaguauuuaauuuaaccuuuugaggucuuacugacugggaaauuaguauguacccaagauauuuccaaggagaaagacaucuguacuuuuccagguucuaugauuaaaccucuuaacuguguauucuuuacgacagaggcaugugacuugaaaaguacuagcucuguuggggcugcuaguaaaauaucaucuguaaaaugaguaauccugcaauuaggaaauucuuuucuacuggggagccaagcuugauuuacaugauacugacacaugguaggacuguucagcauuccuugaggaagcacuuuccaaugaaaucagugagcuggccuuucauuauugauagcugguauuguaaaugcaaauuuuucucugucccguucugcaaggggaauaguauaagagcagccuuuuaagucaauaaugauuauaggccagucucgaggaauugccacgugggaggggagccccugcugaaggggccccauagguugcaaauuagcaucaauagcacguaagucaugcaaaagucuccauuuaccagacuuuuggggaaugaugaaaaugggcaaauuacaaggacuguaugacgguucuauauggucagcuuuuaauugcuccucggcuaauucaugggcucuuuauaauuucucucccuuuaaaggcuacuguucuacccaaauaggauuuugagagagccacguuagggguaggggagaaauaacaguggccauuguuagaaagaggucugcagaguggccucaguuaacccucuuguaaaugggcuaguggcuccguuuucuuuaaugcuuuuuuuuuuuuagcucuuuauaagcauuaaaagaaaugauugccuuguugaucuugcauuaccaggcaggcuaagagcuccccaucuaaugcugcuugcguaagacagcauaucccuugucuuuuuuccaauuuuuuggaugaggggccucaggcaaaaccuccauuuccucuuuguuauuuuuuccuggagacagcggggcugagggagauggaggcaguaagguaggugacaguucuuccucccuucccuuuuuaggcucuucuguguagaguaggaccagagccacccuaacuaaagcccauaacguuaaagauguuauugggacccauugcccuuguacaucauguuguuuaagauuucuacccacuuguucccagaucuccaaguuuagugcaccuucuuucagaaaccauggguuaugggaaacaguaguuugcauuaggucucuuaauugagccugcgaaaccaaggcucugcuaccuuuaagcagcuguuucaaugcuuuuauauacuguugcuguugagcugauaacuguuguccuaugaugaaacccuagccugaacaguucucuccaacuuggaaauccugagugggcaccaaugacuuacugacuuacugacugcgcagucuuuucaccuucauuuuugaggguucuaucgcaguccauugcagcauuccucauguggagcaccaccugcugggucugacccauagacccuggcugaaugauggaugaaagaauguacuuagacacaaguauugagugaaagaguaggcuaagggaccagaccgcugacagaaagaguuguagcagccgcagcccugacaagcuggugcugcuggcauuuauuuaguacagauuuaaugacaaaggcuuugagucaacacacuuguggguaauuaacauggucacccucccuggagagagcaguccugcacguggaugauuaaaggccagguuccaaggccuaaauaaacuaacuuaucuagaucaauuccuuuauauccccuuguuauguaaccuucgcucucgggcuccggauaagaggguuuggcugccuucagccaaaugcuuuuccaaagcuuuuauaaaaccuccuggacguccaagaagguuugugucuuucuacaauuuuuuccaccacccugaccaaucuccuacagucuguuuacucuguugauaguuucuuuugcugugcagaagcucuuaaguuuaauuaggccccauuugucaauuuuugcuuuuguugugauugcuuuugguuucuuucaugaaaucuaaacccauuccuagguuuaggaugguauugccuagguugucuuccaggguuuuuauaguuuuggguuuuacauuaaagucuuuaacccaccuugaguagauuuuuguauaugguguaaggaagggguccaucuucaaucuuccgcauaugacuagccaguuauuccaucaccauuuauugaauagggagucuuuuucccauuucuuguuuucugucagcuuugucagagaucagauggucauagauguguggccuuauuucuaggcucucuauucuguuccauuagucuaugugccuguuucuguacuacugccaugcuguuuugguuacuguggccuuauaguguaguuugaaguuggguagcaugaugucuccagcuuucuucuuuuugcuuagcaucgucuuggauauucgggcccuuuuuugguuccauaugaauuuuaaaauaguuuuuucuuguucuguuaaugucacugguaguuugauaggaguagcauugaaacuguauauugcuuugggcaguacagccauuuucaugauauugauccuuccgauccauagcaugggaugucuuuccauuuguuugugucuucucugauuucuuugaguaguguuuuguaauucucauuguagggguccuucaccucccuggugugcuguauuccuagggaguguguguguguguguguguguguguguguaugugugugucaguugugaaugggauugccuuucugauuuugcuuucagguugguugucguugguguauaggaaugcuagugauuuuuguacauugcuuuuguauccugcaaccucacugaaguuguuuaucagcugaaggagcuuuugggucaagacugcauguuuuucuagauauagaaucaugucaucuacagagauaguuugacuucuucccuuccuauucgaaugagcuuuauuucuuucucuugccucauugcucugacuaggacuuucaauaguauguugcauagaaguggugagagagggcauccuugucuugugccaguuuucaaggggaaugcuuccagcuuuugccccuucaguauaauguugacugugguuuugucauagauagcucuuauuauuuugaaguauauuccuucaauagcugguuuauugagaguugucaacgugaacagauguugaauuuuaucaaaagucuuuucuggaucuguugaguuaauuauguaguuucugucuuuaguucugcuuauguaaugaaucacauuuauugauuuuuugcauguugagccaaucuugcaucccggggaugaagccuacuugaucauggugaagcagcuuuuugaugugcugcuggauucaguuuacaaguauuucauugaggauuuuugcaucgacauucaucaaggauauuggccugaaguuuuccuuuuuuacugugucucugccaggcuuugguaugaagaugaugcuggccucauagaaugaguuagguauaagucccuucuucucaauuuuuuuggaauagucacaguaggaaugguaccagcucuuccuuguacaucugguagaauuugguuaugaauccaucagguccuggguuuuuuuugguugguaggcuauuuauuacugauugaacuucagagaucauuauuggucuguucagggaaucaguuucuuucuggcucagucuucggaggguguauauguccaggaauuuuuccaucucuucuagguuuucuauuuguguacauagagcauaugguuauuuucauuucuguggggucagugguuacauuucauuagucauuucuaauuguguuuauuuggaucuucuuucuucuuagucuagcuaguggccuaucuuguuaauuuuuucaaaaaaccaacuccugaauuuauugcucuuuugaauaguuuuucaugccuugauuuccuucacuucacccugauuuuuguaauuauuucucaguucuauuagcuuugagguuguuuuguucucacuucucuaauucuuuccauugugaaguuagguuguuaauuuaacaucuuucuaacuuuuugauguggacauuuggugauauuguauuucccucuuaacacugccuuagcugugucccagagauucugguauguuguaucuuuguucucuuuacuuuaaaagaacuucuugauuucugccuuuuauuuuuuacccaaaagucaaucgggagcauguuguuuaauuucuauguaauuguaugauuuugagugauuuuuauuguguugacuucuauuuuuauuuugcuguggucugagagaguguuuggaaugacuucaguucuuauacauuuauugaggauuguuuuauguccaguuauguggucgauuuuagaguaugugccaugugguaaugagaagaauguauauucuguugguuugggguggagacgucuguaaaggugugucagauucauuugguccaaugcugaguuuagguccugaauaucuuuguuaauuuucugcuucagugaucuguauaauacugucauuggaguguugaaguuucccacuauuauugugugggagucgaugucucuuuguaggucucuaagaacuugcuuuaugaaucugggugcuccuguauuggguucauauauauuuagaauaguuaggucuuauuaaauugaacccuuuaccauuauauaaugcccuugucuuuuuuuuuaaaucguuguugguuugaaaucuguuuuaucugaaauuaggauugcaaucccugcuuuuuucuguuuuuuauuuuuuugguagauuuuucuccaucccuuuauuuugagcuuauaagugugucauuaugugugagauagucucuugaagagagcauauuauugggucuuacuuuuuuauccuguuugccacucuaccuuuuaagugggguauuuucacccuuuacauucaagguucauauugauauguguggauuggguuuugucauugugcuguuagcuggugguuauguuggcuuguuugugugguugcuuuacagugacgucggucuguguguuuaagugugcuuuuguauucacugguagugaucuuucuauauucagugcugcuuucaagaucucuuguaaggcaggucugguaguaaugaagucccuuaacauuugcuuaucugaaaaggaucuuauuucuucuucacuuagagaguuuaguuuagcuagauaugaaauucuugguuaaagauuuuuuuucuuucagaacauucaauauaggccccuaaucucuucuggcuuuuaggguuucagcugagaggucugcuguuagccugaugggaaucccuuuguaggugaccugcccgaguucucucuagaugccuuuaaccuucuuucucucauuucgaccuuggaaaauuugacaauuaugugucucauguaugaucuugcguagaaucuugcaggaguucucuguauuuccugaauuugacucuuggccucuuuagcaagguuagggaaguuuucauggaagauauccugaaauacauuuuccaaguuguuugcuuucuuccccucucuuucagggaugccaaugauucauauauucagucucuuuacauaaucccauaauuuucagaggcuuuguucauuccuuuuuauucuuuuuuuuuuuauuuuagucugacugccuuacuucaaagaaccagucuucgaauugugagauucuuucaucggcuugguuuauucugcuguuaauacuggagauuguauugugaaauuccuguguuuuucauuucgauuaucuuuguuccuguccauauucugaauucuguuucugucauuccagccaguucggcaugauuaagaacucuuguuggaggacugaugcagucauuuggaggacacaugauacucuggccacuuuaguuacuggaguucuugcauugguucuuucucaucucugcauguggguguuccuuuaacugugguguagauugaguacagucaauagacuuauuuucuggauauuuucacugggaugaguauuuguauagagucuuuauuggaagcugacugacugucucuggcuuuagaguggguuacguuagugagguauuuuuuguguugaagcuuugggguuuauccagcaggugacacuuagccuuauuugucaguugguagacuuuuguucaguaguguggcucccuuauguuuccucauaguugcagccauguucccucucagugcucugaaagugugggcuccucucccccuugagugccugcuauaguucaugacuuggcacuccugggcugcccacugcagcucugggaugaucucagaguuuauauuccuuccccagcuuagaggcaguagaggaagagaucuuaguagugguuguggccaagggucauuuuuuuuugacuccugggggcuccgccccagagagaugcaggucaucaaucacucagcgaagucagcccaaaauggagguuuguucugugggcccaagccaggaguuuccugucuggugaugaguuuuggggagugugugggaccugugggagauggacuggccuccucuccuugguucaacugcagcuuguuggagguauggauaagacaguuaaggucuuugcuucuucauuaguucaaggguggcuagggcaguuccacugcagagacaguggcagagaggcuuuuauuugccccuguaggcucugggcagggaguugcugaguucgcacuggcucgauagcucugguugggguggcuggaaccccaggccuggaggaucugcccaguaaggagaugugggaacaggaacccauguaauagucugcccacuuuucuguagggcugcugcaguaugcuuggggcccacucuaggcccuagucaucucggauuuuccagaaccuggaggugucaccagugaaagcugugaaacagcaaagauggcggccuguuccucccucugggagcuuugucccagggagguauggaccuguuggugguuuaaaggcaccuauaccaagugucuggagacccugguugggagguccugcccagugaggaggaacaggaucagaacccgcuuaaaaaagcaguuuguauucuggccacauuuugguagagcaucuaugcugugcugugggauuccuucugccuugagucagcucagacugugguuuaaaggcacuuguacaaaguggcuggagacccugguugggagguccugcccagugaggaggaacaggaucagaaccugcuuaaaaaagcaguuugcauucuggccacauuuugguagagcaucuaugcugugcugugggauuccuucugcucugagucagcucagacuguccaaagccugaaggcuggaauggcuaaggugucugaacagcaaagauggcaacccacccaucucccugggaacuccuucuuagggaggugcagugccacugcugguagcuggcuggaucccaagccaguaggucuuaucuugugaggugccauggaaguggggccuauggguuguugcuacucagccuucuggauucggccucuuuccuacggguauguacaggagucuaaccuucuacuuugccaaagcugcagcuacuuuugccagaaagcccaauaauaaucuaaggcuucagggucuccaccuaugccugagcaguugcucugccaagacuucauguagcucuguccgucagacugaagacugaaggcccugguggaguggguucacaaggagaucuccugaccugaggguugcaaagaccugugagagaaguguguuuuucuggggccguucauucacucaccacuucccuugggugggggaguauccccugguuccauguuauucccaggugggucguuguccugucuuacuuuucuucauucucuaaaggucaaguuguuuccuugauuagucccacugcaaauaccuggauguuucagcugaaggugugguauuuacuugcccccuucuguuuuucuccaugagagccacacacacuagcugcuucuagccacgcacacuagcugcuucuugaauagauugaaguaaauugacuucuaauaauagcagucuuuaaguucuuacacuguaccaagcauggugcuaguccuaugcuguauauacuguuguuaucucuguuuuacugauaaacugaaguuuaaagagguuaagcaacuuucccaaggccauauaacuaguaauugcagagccagucuugugcuucuaaauuuuacacuauuuuacaggugccuaucuggucucugcauagggacaguuaagcauaaacaagauugaaacaaaugaguuaauagaaauuaaugagucagugagacaugcauugauuccucuacacuagauauauucauucagauguuauacacauuucuucaaaucuuacacacaaaauaagcuauuaccuucagcaccuguguguauaagaggacuaaucccagauaccaacugaacaaaucuaccugugguuaucuuuauacagauguagccacagaaucgaggaaaacugaaguauuucaaauuuuagaaagcaguauugcaacacuuugagggaggaaacaugauagaaagauccuucccuauuauauugacuuaauuuauaauauuuaauucauucaaaaucuuuuuaauaaaaauuucccuaaagcuacuaauaugcugauguuuuuuaaagcccauugaaauuuuaauaauauuuuuaaaguaauuaucuuuguacaguaacucuuaaugcuuaccaagguaaaucuucgcaauuaaagucuaggauuuaugugacuuuaacaaucuguuuaagaagugauuacauauuuaauacuaggauauuuuugaaauaguuuuauuucucucuugccgcaaaaugugacccuguacaauauggaaaaaaaagaaacuuucucuaacaccuuuuccuucccuagaggaagcaaauuauuuuugaaauguuguucaaauuauuuauaaugucccuguaucauguuuaucuucuguuuugcuuuuauacaucauuuaaaugggaagucuuugccuaacacaguucuuacaucuucauuauaggugaaguuuuuuuuuccuaaauugugcuuccaggagauuuaaugucuaaaaauauauuucaucucgucuuuuuuuuuaaccuauguaaaaugauuuaagugguugcuuaugacagggagggaggcaaucuuauccacaggcaaaauaagcugucuaccaauaaauuuaagggacagccucacuacuaccaccaagcccccuucagaaccuucacuugaugccugaaacgcuacuguugaggcuucagucauuuagcuuguguuaugaauagucucaguuaaaauacaaaaagccugcaggugguaauauuuuaaucuauguucaguuuuugugauuguaggagacaagcagcacauuaaggugccagcaaucuuagggaacuacccaaaccccaaugugggccaagggaauggagaauacagaagaagaaagcugaaggacaugaagacaaacuuuacccacuuaacaauaaaaacauaaucccaaaacuuuagaauaagaagaaacccuaauauagucuaaacucuuaauauuaaagccaaaggcucagagaggcaaaacaacaguuuuuguugaaaucacguuuuuuuguuugcuuuuagaagauagaaacaugaaauguuaaucuagguaaaaaucaagucagauauauuuguucuucaguauauuuugagaauuucaaagcaaacaaaaauugcauuuuauaaggaggcaauagaaaauguuuucauguagugacaugaauuucagaagugauguuaauaguuuccaugguaauacacaagcaaacucuuguuuucuuuaauaguuguaaauauuuaggguuucaguuuucuuggaaguucauauuaagagaggucuuagucauguaauuguggauccaauuuauuuuaucuguaaacagcaauacuuuaaaggaauguuacucauuugcuugaaaucaaggcugaguuuuugcucaaggcugagcuuuacuuguaaaacucuuaccuuuugauuuuuaaaaaaaaguuaguaucuaaaacuauaccaaagacaaccucaggcuuaaauuuguuuuuugaaaaacacauaaacccaguuguauucauuauuucauuauggcacauucauccuuagugaacacuaguauuacucuugucucuuuguccuuaauaauugauuuauaaaaacuucuucaaagcaauuuaaagauacucaugagcagagcaggacagauacugaugagaagguuuaguaagguuuuuuucaucucauuugggcuuagguucaaucuaucuaaauuaaaauuuccauccaauuguauucccauauuugagugggcuuuguauaaugugggaguauaugauagcaacugcugagcaaugucuucaugucuggauugcuaguuaugaaagguguauuagcuguuaaagagcuccgauuugcugugagaaccauccaugaccccaguuccuagagugccauacagucucauucaaucagccagccaguccuguuugaggaccugcuuugccaggcaauggggauauagaguuuaguuauagcaccccugcccaccagaagcucacagucuuauaacuaaaauagauacaugaaauagauaauugcaguauaauaugaaauggccuaugucugaagcauacccaaaugucauggaaauauaggaugggcaccuaaaccaggugaugucugacaugauucuuaaaaaacaaguagaaguuaguaaccuaacaaagaaaagagagaaagcauugaaaaaucacauuguuugaggcccagagaaggugagacagacacauuuaggaaguuacaagaauuguggaugagcaugucuggaauauaugagaauuaguaaugaaacuagaguagguaaaaguagccucauugaaaaugucucauaacaugcuaagaaauuuggguuuuauuccaaaggcaguaagaaacuuaaaaaauucuaaacagguaggugccaugcucagauuuuuauuucagaaaaauuacuuuaaugcauuguagaggauggaugaggguagagauaaucuugcaggcaaaauuaggauugaauuauccagaaauuugauguguauaaucauucauucauauccugucauaaagagugaggucccuagcuuuucccuaaauaaaccgguuuuagugagccuaugcugaagaagauugagagaaauuacuuuuguugcuguuucuuucccuuuucucaaagugugugcugacaaagggaaauucuauaucguugacacuugcaagcauuguuagauacuggugccacugguugggguggccagaaggcaccuuagcauauuugcugccgauacuaguuacuccagguuuggcaaaauucugaaauucauuuacucaccaaauauguaagugauguucuaagcauucuauuaauccuugcaagagauucaaagacgaaauaaauauaauacacauuguuccuaucaguuguuuagauagaagucauuuucauuagaaaauuuuauauaaaaucaaauugcuguuauaagauauguacagauacugugggaagggaaacuuucauggaugaaacauuugaaggauggauguuugaaugcgcaaaaaugagaaaaagauauuugggcagagaaaacuacaggagauagaaaacauauugguaacagugcaugauuuaguuugguuggaauuaaaguaguuagguucuauucaugaggacugaacugagaaauaugggcuuuguccuauaggcagucauagaaaguuucucagaaaggauacaauaaucagaacacuuugcuuuuaaauuuuuucucugucaauauuguaaaucaaguguauuuccaagagaaaagacaaaaguuggagaaaacaguuacuacaguaguuuaagcucaagacaaaucaauaucugaaauaggcaagggguaaugggaauaaaaaugugaguacaagauuuauuagagcuguagaauauuggauguugcuacugauaagauguuggaaaugagauuuuugacugguugauuugggggauggugaugccauucagacuaucaauagauuuagcaaagaaaaucaugauaucuaaacaucauuuuuauaucaguuaaugcuauuuaguuaugguauauaugagagaacuguggguuuaauuucauauuucuuuuucgcuguugauauacuaaagguaaaacuuucaguuugggcugaaaggucuauaauacuaauuauaauuaguuaacccagcagacaaacagccaaaaaacaaagguagguagaucuucuugaaugguuuggugaaauauugguguguguugucuuuaaagauacgaugucacuaaguguggcauccagcaaaaaugcugugcucuuuuaggauguaaaaaaacaugagcugguuucugugcugaauuuuaaacaauauuuuaaaggaauuuucaaaucuuuuuguaaauugaagagucuuucugaacauacuugguuaacuaccauguaauuuaccuauacacuguaccuauauucuuauaccugauuuuuuucuguuugauugaaguacagcauaucuacuuacagcauuguuuuguagacugaauuaugaauacaggaaaguuuuaauaucuuagaaaccuagaagauaauauacaucaucccuaccuguuaaugcuauucugauaauccaacuuauuuaucagaaguuuacaguaauuuuuuaaaucugucugugcauugggcuaucaaauucuguuuaaugcaaauuuuugauuuuguucuuagcacacauucaaauacuuuugguaguaucugccaaauggaauauugagcugaauggcuuauuugcagggagggguacaacuuacuccaagacaggguaagauauauaguguaaggucaccauaugccaaagaaaauucauauguuuacuggaauauauccuguagugcauucagcauaguaaacaaccauauccaaacacgugguaaagugacugcuacaauaacuggaugcuuuuaugcuuucauaacuauuauuauuccagucuagagauuucauuguaauuacugcugacuucuguaaugauguuuuuuaucuuuuaacgcuuucaaguaugucauaaaaaauucuaauuuccuaugaacacuggaaguuaaaaauuaguguuuauggauaccauugccacuuuugccaaaaccuaaccaaaaauuguaaugucauuguugggauuacaguaucaugauauauaugugauuggggcuaaucaccccauaaguacuuuggcuacuauuuccuuaauaguaauauuuccucugaacuggguucuuugaagcuguagcuuuuuaaacucuuaguuuauaaaauagcauagugacugacuguugaguauuacacucauuauagaaccucuuuaagugugguuauuguuuaccccauaucuguguuuauguaaugagaaaggccuuuuuaaaauguaaaacauuaguguagaggauucagauuuuuaucuauauuauacagaaagcaguaaagugacagucauacuucaaaaauauguaguguugcguguucaucucuaacccuaccuuugugugaagguccuauguauacuuguuuuccacuguaauacagugaaauaaaaccaaaguucuuagagcauggaaaaaugugcuuaucucaacauauucucuaucaugucucuuuccuugccagauuuuacucaugacugaugauagucaacuauggucauucagagucaccauaugucaaaaauuuucuucuauuuuccucuuuauuuauuuauucuuucuaauaaaaaauauacagaaaucuguuguuugcucauuuuccaaauaccucauauuuuauucugauuaugaaguacucaacaagugaaaaaaguauucaccuaccuagauuuacaauauaaucugaccaccucucaaaugucuagaaguugccuaaagcaguucuauuucaccuaaugcugucugugucacaugggaaauuguauuguaggccauguaaauacuuuccaaggaaacaagaagagauuucuaaauaaccaaaguugucuucauuauccaacuuauauaaacaacaggcuauucauuauaaauauacuuauuuauaacuaggccaaucucauucuccucuguuuuuugccaguaauacauucuccucugcuguuuuccaguaaugauagacgauuuagagguuugaccaccaugucuacagacauucaugcuuacccaaucauuuuugugcuauaaguuucaugacaagaguguucuuggaugaguguucuuagauauuauccaggacauuuugguugaaguagauuaagaauaaggaaagugugguuuaaaacucuguuucuuuugugccuuauuuuccaaaguguagccuaaaaaagguuuggaaucauuuuguauuuugaaaaacuuucucuuucaaaaaagacucuguugccgucauauuuugugaagcauuuuaauauuuaaucuagauuuuuuaaacaaauaauaaaucacaaggauaauaggauaauaacuuuaugacauacuuuuaguaacugaaaggaguuuagauuaaaaucuucuuuaaaggcacauaauaaauaggugauaucgagccuacaaaaucaccuuaauacuuaucuaugauuauagauauaguuacuagguaugguuauuuagauauagauggguacuuuuuuaaccaaauacaguauucacugaauguaucuauuaaacaguucuucuuuuagagucagggucuucuaauuuucuaauacguggcugaacaaauuuuauggauggcugaacaaauuuuauggaagaggcacuuaaaggugauuuuacauguaaagcuuaacacagucugagcauuaucuuuuaugucuuuuauuucugauuuucaagggagagaaucucauuggcucagccugcaucauauauccaccaucacccuccccuccaccauccugucagucaugguuguagcagggucaucugauaccaacacgacaaccuaggcucacccuuuccucagggucagugguuggugcucuuccaaacaagaaaacagcaggugggcaggcagcccaaacaugucugcuacagcauuucaccaggauagauuuguauugcuuuugcuacucuaaacacacuaaaaaaaggaaagauguucauaguugaaaagguuguuugauaaauauggaaacacucucuggcaacugauucaggccucacagauguagauauaggugcugagaauauaugaguuguuuguuagguucuuaguauguguuauaaaaaauuuucauuuuaaguagaucuuuacugaaaauaaaaguacuuucaguuuuuuaaaaaaguaccaucagaguaauuauauucugagagaaaagucauuacucuucaggaaaacugcaauugggaauauugaauaauuagaaauguuugagaaacuaaugcugaugaaguucaaagguaaucuacccaugaucauaaauucucugcccauucuagaaaacuucaacuaaacaaugccuacuggaauguuaauguugauucucucuccuuucauuuuucagaacuuauuuacaguucuuucucucauuauuaaugucauacccuuuucuuuaaaaaaaaagaugaagcagcagcugacuagaaaauuuaaauuguaagauauguaguccaucuccaccaucuccacucuuuauagaaccucuuuaaguguaguuauuguuuacccauaucuguguuuauguaaugagagaugcuuuugauguaagauccuuuuauaucuuuggcuagucaucuuccuuucucuuuucuacuucauuuucaaauuuaacuuuuuuuuuucuccuggaggugccuuacuucauuuagauaaaauacucacauaagcuggaagauguuuaguacuaucuucugggagucacuuagcucugugaguuucccucagacacucaggauugcacacaaauaaauguuuuccuuaaacuuuccuucucagcuuuauucguggucacauuucaggaagcaucaacauuccauucagugcugccuucacugcagaaggggagcuuacccagggcccuuacacugcuaugcuccagaacuucaaagggaaggucauugucaucguggggcauguggcaaaacacacagcugagguaaguauauucagaaaugucauauguacauaugaugagugauuuaccugccuucuauaugaagguuaucuaaaaguauauuucuucaggaguuggucacaaauacuaugagcuuugaagauuugucuguguucuuauauggaagaguuugucugccuuuaauugaagcauuuuuccuucaguguucagcaucagaaucaacaguaaccuuaaaaaaucaaaauagccuaaggcuguuuuuuucuaacugcuuucugaaauuguaaagaaguagcuugaauucccuccacuggagaaaaacaguaguguucaaguguaggcucugagagcuggucaugaugagauuuguuagauuuagaaauuguguuuacuagagacucaaagcuuuuuaaugauagagaauucagggagaaugucaacugucagacaugagaaguacaugaaacaauaaaauggcuuccuucuuccauggcuauguucuaagcaaauugaaaaauaaaacaaagaguagcauaugaaggccaaaaauaucuuuauuuuuuaauaaaagacaaguugaagacuguagcuuaguaugagagccaaauggacuuacuuaaaaacaagcagccagagaagguaucuagauauaggcaacguugaacgaguacaggaucuuucucuaaaagggaagaaucugcuccuagaaaaguagcagagguaacuugcucccugcagacagcuuuuuucuaaaaggaagauaagcaggacugagccuucccaaauuuaccaaucaaauaaauccuucaaccucccagggcacagagaauagagggacaaagagaaaggccaggaauaugcuuaggaaaauucugucaucagggaaaucaggaguggagacaaaauauuugccuugauuguacauauuccuuugagcacuccugaaauguggucacugaaaauuucagauuagaacuuuaaaacuuuauuuuuuuuuuacucuuaguaaucagagaaauaaccuaaaaugucuuuuauuauaaaaacuaauaaccacacuuuguugaacacuuggaaaauauagagagaccaaaaaaggaaauaaaaaguaugcaugauuuuaccaccugggaggcaaaaaacacuucuugaauuuuuuuauuggaaaauuauaauuccuccauucaauucaauucugauauuggcuaaagguaacccucccauccccaccugcacauaccccauacugauacaaacucagaaaaaaggaaacaugaaaauacuuugcucuuuuauuccuagagcgaguguguaugaaguccaugaaaacaacauguaaggguuacauuuagagaacuaugccauaugauuucauaguaaggaacuaggcuauugauuuuuccaaauuugaugccuucacuauaauuuuuaagucuuuuaaguuuuugcuuuucacagagcaaaaucgagaggaauagaaauuucccauauaccacuaccccacacaugcacaaccuuucccauuaucagccucccccaucagagugguacauuuguuacaacuaaugaaccuucauugacacaucauuaucaucccaaguccacaguuuacaucagggcucacucuugguguuguauauuauuuuuaauuuguaauaaauuuuuauuaacuuuuauuuuagguucagggauacaugugcagguauguuauauagguaaacaugucauaggcauuuguuguacagguuauuuuaucaccgagguacuaagccuaguacccaauaguuauuuuuucugcuucucuuccuccucccacccuccagccucaaguagggcccagugucuguuuuuuccaucuuuguuagaaauuuaaaacuguaaaagucagauuagaacuuuaagacuauugaucauaaaccauuuuaagcauccaacaauccaugucucagaaguacaggacugauagcagcauuaacuuuuuguuuguuuguuuguuugagacgagucucgcccuuucgcccaggcuggagugcaguggugcaaucucagcucacuacaagcuccaucucccagauucacaccauucuccugccucagccucccgaguagcuggcacuacaggcacccaccaccacgcccagcuaauuuuuucguauuuuuaguagagacgggguuucaccauguuagacaggguggucucaaucuccugaccuagugaucugcccgccucggccucccaaagugcugggauuacaggcgugagccuccgcaccuggccaggauuaacuuuugacacuaaaugaaagucauucuuaaugaugaaacuuaacuaaccauacuaaagaaguaugcaaguggauauuacuucuaaguuauaaaucacucaccuaucuuuuauauaacuguaucuaccauccaacagagaacaaucucaauacaccuauuucagagaaagucagaaaauaguaacacacaugguuuggcuauuuguccccuccaaaucucauguugaaauguaaucuccaauguuggaggcuggccugguggugagaggugacagcaugcuggcagcccuugcagcccucgcucacucuuggcaccuccucggccucagcacccacucuggcugcacuugaggagcccuucagcucgccacugcacugugggagccccuuccugggauggccgaggcuggagccagcucccucagccugcggggagguguggaggaagaggcacaggcgggaaccgggacugcgcacauugcuugcaggccaguuagaguuccaggugggcgugggcuugacggccccgcacugggagcagccggccggcucugggcagugaggggcuuagcacucaggccagcagcugcggagggugcgccaggucccccagcagugcuggcccaccagcgcugcacuugauuucucaccgggccuuagcugccugcccgcagggcagggcucgggaccugcagcccaccaugccugagccuccccccaacccaccgugggcuccugcccggcccaagacuccccaacgagugcugcccccugcuucacagcaccuggucccaucgacugcccaagggcugaggagugugggugcacggugugggacuggcaggcagcuccaccugcggccccagugugggauccacugggugaagccagcugggcuccugagucuaguggggacuuggagaaccuuuaugucuagcuaagggauuguaaauacaccaaucagcacucuguaucuagcucaagguuuguaaacauaccagucagcacccugugucuagcucaggguuuguggaugcaccaaucagcacucuguaucuagcuaaucugguggggacuuggagaaucuuuaugucuagcuaagggauugugaauacaccaaucggcacucuguaucuagcucaagguuuguaaaugcaccagucagcacucugugucuagcucaggguuuguaaauacaccaaucagcacucuguaucuagcuaaucuaguggggagguggagaacuuuugugucuagcucagggauuguaaaugcacuaaucagcacccugucaaaacagaccaaucagcucucuguaaaacagaccaauuagcucucuguaaaauggaccaaucagcaggaugugguuggggccagauaagagaauaaaagcaggcugccccagccagcaguggcaaccugcucagguccccuuccacacuguggaagcuuuguucuuuugcucuuugcaguaaaucuugcuacugcucauucuuuggguccacacugccuuuaugagcuguaacacucaccacgaaggucugcagcuucacuccugaacccaucaagaccacgaacccaccgggaggaacgaacaacuccagaugugccgccuuaagagcuguaacacucacugcaaaggucugcagcuucacucaugagccagcgagaccacgaacccaccagaaggaagaaacuccaaacacauccgaauaucagaaggaacaaacucuggacgcgcugccuuuaagaacuguaacacucaccacaaggguccguggcugcauucuugaagucagugagaccaagaacccaccaguuccggacacagugggagguguuuggucaugggggcagauccuucgugaauggcuugauguccucuccaugguaauaagugaguucucacucuguuaguucacaugagagcucguuguuuaaaagucuggcucuuccuccuuucucuuguuccugcucaugccaugugacaugcuggcucccuguuaccuuccaccaugauuguaagcuuugugagguuucaucagagauagaugucagcaccaugcuuucuguaaaaccugcaaaacugugagccaguuaaccaucuuuuuuuaauagauugcccagucucagguacuucuuuauagcaacacaagaacaaacuaacacagauaauugguaccaggagugggguguugcuguuaaauaccugaaaauguggaaacagcuuuggaacuggguaauaggcagagguugaaagaguuuggaaggcucagaagaagacaggaaaaugaguaaaaguuugaaacuucuuagagacugauuaaauaguuauaaccaaaaugcugauagcuguauggacaauaaaguccaggcugauuaagucuuagguggaaaugagagaguuauugggaccuggaguuaagauuacccauguuacacccuggcaaagaacuugacaacaguguguucaugucauagggaucugaguuuaaacuuaauuaugaugacaagauaccuggcagaaaaaaaaaaucuaagcagcaaagcauucaagaagugguauggcuucuucuaacacccuaagucauauauggaagcaaauaaaagacuuaaaguuauauuuaaaagggaagcagagcauaaaaauuuggaaaacuuguagcccagcccuaugguagaaaaaauccaagcaggcuacagagcaaccauuugcuagagagauuagcgugacuaaaagggagccaagugcuaauagccaagacaauggguaaaaggccuugaaggcauuucagaguucuuagggacagcccuugucaucacaggccuagaggccuagggaagaagaaugguuucaguggucaggcccaggaccccacuucccugcacagccucaggacagugcucccugcaucgugaccacucaggcuccggccacagcuuaacugggccaagguaaagcucaggcugccacccuagagggagcaagccguaaucccuggcagcuuucaugugauguucagccugcagaugcacagaaugcaaaugugaaggaagcuucgcaacucccaccuggauuccagagcacguguggggaagucuggauacccaggcagaagccuacuacaggagcagagcccccacagagaaacuauacuagggcagugccaaugggaaacguagaguggagccccugcagaguccccaccagggaaccggcuaguggagcuuugggaagugggaugccacccuccagaccugagacugguagagccauuggaagcuugcaaccgcaguauggaaaagccauagguacucaacuccaaccugugacagcagccaugagggcugcaccuuggaaagccacagggacaaaccuguccaaggccuucauagccuacaucucacaccauucugcccaggauguaggacaugucaaaggagauuguuuuggagcuuuaagauuuaaugaguguccugcugaguuucagacuugugugggcguauugccucucuuuuggccaauuucucccuuuucaaaugauaaugcauacccaauaucuguagcaccauuguauauuggcaguaaauaacuuguuuuugaucucacaggcucauaggaucaauggacucaucuccagaugauacgugagacuugacacuuggcacuugagacuugaguuaaugcugaagcagguuaagaauuugguggacuauugcagaggcuugguuguauucugauaugugaggaggacauaagacuuaggggaucagaggcagaaugaugugguuuggauguuuguccccuccaaaucucauuucaaaugagauaacauaaucccuauguucaauguggagccuuuuaaggagguguuuggauuaugggggaagaucgcucaugaaugguuuggugcccucccagugguaauaagugaguucuugcucugcuaauucaugugagaguuguuaugagaguugaugguuuaaaggagccuggcuccaccuccucucucucuuguucccacucuggccaugugacaugcuaacucccuguugccuucugucaggauuguaagcuuccugaggccucaccagaagauguugguaccacacuuccuguaaagccuacagaaccaugagccaauuaaaccucuuuaauuucuucuauuaaaaaaaaaaaggauacauguacagaacaugcagguuuguuacauaguuauaugugugccauggugguuugcuggaccuacugaccuguccucuaagaucccuucccucgcccaccagcacccaacagccaugggguguauuguuccccucucuguguccauguguucucaauguucaacucgcauuugugagcgagaacaugcgguguuugguuuucugcuccucuauuaguuugcugaggaugauggcuuccagcuucauccaugucccugcaaaggacaugaugucauuccuuuuuauggcuucauaguauuccaugguuuucuuuauccaguuuuauuccagauuuucuuuauccagucuaucauugaugggcauaaauagugcugcaauaaauauacaugaguaugugucuuuauaauagaaugauuucuauuccuuggguauauacccaguagugggauugcuggguccagaugguuuuucugguucuagauccuugaggaaucaccauacugucuucuacaaugguugaacuaauuuacauuccuaccaacaguguaaguguuccuauuucuccacaccuucagcagcaucuauaguuuccugacuuuuuaauaaucaccauuuugacuggcgugaaauaguaucucauugugguuuugauuugcucugaugaccagugauguugagcuuuuuuucauguuuguugacuguguaaacgucuucuuuugaggaggagcuguucauauaugcuuugccuacuuuuugaugggaugguuuguuuuuuucuuguaaauauguuuaaguuccuuguaaauucuggauguuagaccuucgucagauagguagauugcaagaauuuucucccauucuguaguugccuguucacucugaugacaguuuauuuugcugugcaggagcucuucaguuuaauuagaucccauuugucaauuuuggcuuuuguuacaauugcuuuuggcauuuuugucaugaagucuuugcccaugccuaugugugaaugcuauugccuagguuuucuucuaggguuuguaugguuuuggguuuuaccuuuaagucuuuaauccaucuugaguuaauuuuuguauaagacauaagguagggcuccaggccaguuccaguuuccugcauauggcuagccagucuucccagcaccauuuacugaauaggagauccuuuccccacugcucguuuuugucagguuuguugaagaucagaugguuguagacaugugguauuauuucugagaucucuguucugcuccauuggucuguauguugguccugcuccguuggucuauauguacaaauaccaugcuguuuuggucacuguagccauguaguauaguuugaagucaucuagcaugaugccuccaauuuuguucuuguuugcuuaggauugucuugccuauauggggucuucuuugauuucauaugaaauuuaaaauaguuuuuucuaauucugugaagaaugucacugguagugugaugggaauagcacugaaucuguaacuuacuuugggcaguauggccauuuucaugauauugauucuuccuauccaugaggauggaauguuuuuucauuuguuuguguccugucuuauuugcuugagcagugguuuguaguuuuccuuaaagaggcauucacaucccuuguuagcuguauuccuagguauuuuauucuguuuuagugauuuucaaugggaguucacucaugauuuagcuuucugccugccuauuguugguguaaaggaaugcuugugauuuuugcacauugauuuuuuauucugagacuuuacugaaguugccuaucaguucaagaaguuuuggggcugagaugaugugguuuuauaaauauaaaaucauguuaucugcaaacagagacaacuugacuuccucucuuccuauuugaauacccuuuauuucuuucucuugccugauuucccuggccagaacuuccuauacuguguugaauaggaguggugagagagggcauccuuguauuguaccaguuuuuaaagggaaugcuuccagcuuuugcccauucaauaugaaauuggcugugaguuugucauaaauaacucuuauuauuuugagauauguuccaucaauaccgaguuuauugagaguuuuuaacaugaauggaugcugaauuuuaucaaaggccuuuucugcaucuguugacauaaucaugugauuuuugucuuugguuugguuuaugugauggauuacauuuaucgauuugcaucuguugagccagcuuuacaucgcagggaugaagcugacuugaucgugauggauaaguuuuuugaugugccacuggauuggguuugccaguauuuuauugaggauuuucucaucaauguucaucagggauauugacaugagauuuucuuuguuuguugugucucuucccgguuuugauaucaggaugaugcuggcuucauaaaauuaguuagggaggagucccuccuuuucaguugucuggaauaguuucagaaggaaugguaccagcuccucuuuguauuucugguagaauucagcugugaauccaucugguccugggcuuuuuuugguugguaggcuauuaauuacugccucaguuucagagcuuguuauugguauauucagggauucaacuucuuccugguuuagucuugguaggguguaugcaucccagaauguauccauuucuucuagauuuucuaguuucuuugcauagagauguuuauaguauucucugaugguaguuuguauuuccguggcaucaaugguuauauccuguuuaucauuuuuauccugucuauuugauucuucucucuuuuucuucauuagucuaguuaacagucuauuuuguuaauuuuuucaaaaaaaagcuccuggauugauuuuuuuggaggguuuuucaugucucuaucuccuucaauucuucuuuuaguuauuucuugucuucugcuagcuuuuggauaaguuugcucuugccucuuuugcucuuuuaauugugauguuagggugucgauuugagaucuuuuuagcuuucugauguggacauuuagggcuaaaacuucccucuuaacaguucuuuaacugugucucagggauucuggugcauugucucuuuguucucauugauuucaaggaacuugauuucugccuuaauuuuguuauuuacccaggagucauuaaggaacagguuguucaauuuccaugaaacuaugugguuuugagugaguuucuuaauccugaguucuaauuugauugaacuguguucugagaaacuguuaugauuucaguucuuuugcauuugcugaggaguguuuuacuuccaauuaugugguugaauuuuagaauaagugccauguggcacugagaagaauguauauucuguuggaguagagaguucuguagauguuuacuagguuuacuugauccagagcugaguucaaguccugaauauccuuaauuuuaugucucauugaucuaauacugacagugggguguugaagucucccacuguuaucgugucagagucuaugucucuuuguaggucuguaagaacuuauuuuaugaaucugggugcuccuauauugggugaauacauauucagaauauagcucuucuugcugaauuguucccuuuaccauuguguaaugcccuucuuugucuuuuaugaucuuuguugguuuaaagucuguuuugucagcgacuaagauugcaacccguuuuguuuuguuuuguuuuguuuuguuuuguuuuucuuuccauuugcuugguaaauuuuccuccaucccuuuauuuugagccuguguaugucugcacauaaaaugagucuccugaauacagcacaccaaugggucuugacuccuuauccaauuugccagucugugucuuuuaauuggggcauuuagcccauugacauuuaaggguaguauuguuaugugugaauuugauccugucaucaugaugcuauuugguuaauuugcauacuaguugaugcaguuucuucauaaugucauuggucuuuauuuuuugguguguuuuugcaguggcuggcacugguuuuguuuuguuuuguuuuuuccauuuuuagugcuucuuucaggagcucuugcaggacugaccuggugguaaugaaauuccucagcauuugcuugucuguaaaggauuuuaucucuccuccgcuuaugaagcuuaguuuggcuggauaugagauucuggguugaaaauucuuuaagaauguuaaauauuagcccccagucucuucuggcuuguagaguuucuccugagaaguccgcuguuagucugaugggcuucccuuuguagguuaccuggccuuuuucccuggcugcucuuaacaguuuuuccuucauuucaaccuuggagaaucuaaugauuaugugucuugggguugaucuucucguggaguaucuuaacggugguguucucuguauuuccugauuugcauguuggucuguuuugcuagguuggggaaguucuccuggcuaauauccugaaguguguuuuccagcuuguuuccauuuucccugucuccuucugguacuccggucgaucauagguucagucuuuuuauuaagucccauauuucuuggagguuuuguucauuccuuuucauucuuuuuucucuauacuugucucugugucuuauuucaguaagguggucuucaaacuccaauauccuuucuuccauguggucaguuuggcuguugauacucauguauucuucacaaaguucucaugcuguguuuuccagccccuucaggucguuuauguuccucucuacacuaguuauucuaguuagcaauuccucuaaccuuucaucagucuucuuagcuucuuugcauuggguuagaacauguuccuuuaccucgucauaguuuuuuauuacccaucuucuggagccuucuucugucacuuuguccauuugauccuccauccaguucugcaccuuggagagacacugcgaucauuuggaggagaggaggcacucuggcuuuugggguuuucagcauuuuuuuguugauucuuucccaucuucaugaguuugucuaguuuuggucuuugaggcugcugacccuugcaugggguuuuuaugggggucuuuuuguuguuuuuggugcuguugucacuuuguacuuguuuuuguuucaauagucaagucccucuucuguagggcugcugcaguuuccuggggguucacuucccuauucaucuuauuugcuccugugccuggagaugucacucaaggaggcuggagaccagcaaagaugggugccugcuccaucuucugggaccucugaccuugaggggcaccaaccugaugccaguaggaucacuccuguauaaggugucugauaaccccuguuggauggucucacccaguuggguggcacagggagcaggaccuguuuaaugaaguacuuuauuccuuguucuagaggguguguuucacuggggggaaacccacucgucugagcugccuggauuccucagaacuaccaggaggagaggcuaaguuggcuggucugcagagacugaggccaccuccccgaucccccaggggcucuggcccagggagaucugaauucugucccugagccucuggcuggaguuauuggagauuguucagggaagccccgcccacugaggaaggugggucaggguuagaccugaaaaggcacuuuggccgcagacugccacagccgguguuuugggcuguggggacaagucuugggaccaagugguccagccucccuugcuccagcagggaaaaagcccagccuggagcuauacaaaugggugccacgcuuccccugcccagggagcuuagaguguuagguaguugcuagucccagggcuggcugcugccccuuccccaaggagcucaaauggcuuagacagcagguagccgcagccagugcuggucgccucuccccgcaagaguuaggugggcuuaagcagauuccagcugagaggcugugagaaucugcacauucuaggguugggacgcuaggcccugguggaauggguucgcaaguguaucuuccaauccauggguugcacaguucaauuugaaaagcacaguuuccccuggcuggguagugugcucacucacugccucccuuggcuugagggaaguuccccuucccuguguggaucacagguggaccgccacaccacacugcucuuccuucucucagucagucaugccagccuucuagucaauuuugaugagagaaccuggauaccuugguugccagugaaggauucacaggcuuauuaugguuucuuuccuaugcgagccucggaaugcugcugcuucuagucagccaucuuggcccugcccccugaacuucuuuucuuuauaaauuacccagucucaaguauuuuuauuuuuuucuauuuuuuuuucuauuuuuuuaaguugaaguucuagagguacauguacagguuuguuaauaaauuuuauguugcugauccuucguguacaaaugacccccucauccuguguagugagcauaguaccugacagguagcccuaaaaaccaugucucucuccccaccauucuuccucaagcagucuuuaauaucuauuauucccuucuguguguccaugaguacccauuguuuagcucccacuuauaagugacaacauguagcguuugguuuucuguuccugcauuaguucacuuaggauaauggcguccagcugcuuccauguuucugcaaaagauaugacuucauucuuucuguggcugcaugguauuccaugguauauauguacuauucaguccacuguugaugggcaucuuuguugacuccaugucuuugcuauugugaauagugcuacaauauauauccacaugcauauguauuuuuggcagaagaauuuauuauccuuuggguauauaucauauaguaggauugcuaggucaaaugguaguuuuaaguucucugagaaaucuccacacugcuuuucacaaugacugaacugauuuacauuuccaccagcaguguauaagugcucccuuuucuaugcaaccucaccagcauuucuuguguuuugacauuuugguaauagccauuuugacugaugugagaugguaucucauugugguuuugauuugcauuucacugacgauuagugaugaugagcauuuuuucauauauuuguuaguggcauauauuucuuauuuugagauguauuuguucaugucuuuugccaguuuuaaaacugggauauuuguuuuuugcuuuuugauuuaaguuucuuauagauucuggauacuagaccuuuguuggaggcauaguuugcaaauauauucucccauucuguagauuaaguuccagguuacauacaggaugugcagguuuguuacacagguaagugugugccaucguuguuuccugcauagaucaauccaucaccuagguauuaagcccagcauccauuagcuauucuuccugaugcucucccucccccagcucccccaacaggccccaguguguguuguuccccucaccaccauguggccguguguucccaucguucagcucccacuuguaagugagaacauauuugguuuucugugccugcauuaguuugcugaggauaacagcuuccaacuccuuccaugucccugcaaaggacaugaucucauuccuuuuuauggcugcauaguauuccaugguguauauguacuaccagucuaucauugaugugcauuaagguugauuccaugucuuugcuauugugaauagugcugcagugaauauauaugcacauguaucuuuauaacagaaugauuuauauuccuuugggcauauaccaaguaauaggauugcugggucaaaugguauuuuugcuucuagaucuuugaggaaucgccauacugauggcaauuccaguuaguuccacaaugguucaacuaacuuacacuaacaccaauguguaaaaguguuccuuuuucucugcaaccuugccagcauauguuguuugacuuuuuaauaaucuccauucugacuggcaugagaugguaucucauugagguuuuaauuugcauuucucuaaugaucagugauguugagcuuucuuccuuacguucguuggcugugugaauuucuucuuuugagagguaucuguucauguuuuuuguccacuuucuaauggguuuuuuuuuaauugugaauuuguuuuaaguuccuuauagucucuggauauuagaccuuugucagauggauagauugcaaaaauuuucuuccauuuuguagguugucuguacacucugaugauauuuaaauauuugguugugcagaagcucuucaguuuaauuaggucccauuugucaauuuuugcuuuuguugcaauagcuuuugaggaauuagucauaaauccuuuccuggccacugcccagaaugguauugccaagguuuucuucuaggguuuugauugcuuucggucuuacauuuaagucuuuaauccaucuggagucaguuuuuguauaugguaaaaggaggggauccaguuucaaucuucugcauuuggcuagaaugucccagcacuauuuauugaauagagaguccuuuccccauuauguauuauaguugacuuugucaaagaucaacugguugucaguaucuggcuuucuuucugguuucucuauccuuuuccaugagucuaugucuguuucuguaccaguaucaugcuguuuggguuacuauagccuuguaguauaauuugaagucaggaagugugauggcucuuuguuuugcuuaggauuacuuugaugauuuggacuuuuuuuuuuuugguucaugccaacuuuagaauagcuuuuucuaauucugucauaaaugacauugguaguuucacaggaauaauguugaaucuguagauugcuuugggcaguauggccauuuuaucaaucuuaacucuucccaauaugguuugaauuuguguucccagccaaaucucaugucgaauuguuagaggaggggccuggugggaggugauuugaucauggagguggauuuucugcuuguuauucuugugauagugaguucuuagaagaucugguuguuuuaaaaguguguagcaccucucucuuuguugucuuccuccugcugcagccauguacgaugcgccugcuuccuccucaccuuccaucaugauuguacauuuccugaagcuuccucagccaugcuuccuguauagccugcagaacugugagccaaugaaacuuuuuuucuuuaugaauacccagucucaggcaauuauuuauaacaaugcaagaacagacuaauacacuuccuuuucaugagcauggaacauuuuuccauuuguuuauauugucuauaauuucuuucaccagugucucauaacucuccugguagagaucuuucaccuucuuaguuagauauauuccuagauauuuuuguuuguggcuauuguaaauggauuuauguccuugauuugccucucagcuugaaugcuaaugauauauagaaaugcuacuuauuuuuguacauuuauuuuguguccugaaauugcuuauugguuauaaaagccuauuggcagcaucucuaggguuuucuagguauacaaucauaucaucugugaagaaagauuauuugacuuccucuuuuccuauucgaucucuuuucuuucuuucucuugccugauugcccuggcuaagacuuccagugcuauguugaauaccaauguugagaacaggcauccuugucuuguuccaguuuucaaggagaauguguccagcuuuugccuguuuauuaugauauuggcuguggguuuguccuaaaugccucuuuuuauuuugagguauguuuuuuugaugccuaauuuguugaggauguuuaacaugaagggauguuuaauuuuauugaagaccuuuucuacauuuauugagacuuucacauauauuaaagaccuuuucugcauauacugagaugaucaugguuuuuguuuuuaauuuuguuuauguagugaaucauauuuauuuaguugcauauguuaagccaaccuugcaucccaggaauauggccuauuuaaucuuagugcauuaguuuuuugaugcacugcuggauuugguuugcauguauuuuguugaagauuuuugcauguucaucagagauauugaccugaaguuuccuuuuuucauuguaucucugccagauuuugguaugaggaugaugcuggcuucauagaaugagcugcagaagaaucuccucuccuugauuuuuuuuuuuuugaauaguuagaauaggacugacaucagcucuucuuuuuaugucugggagaauuuggcugugaauccaucugguucagggcuuuuuuugguugguaggcuuuuuauuacugauucaauaucagaacuuguuauaggucuguuccaaauuguaauuucuuccugguucaaucuuagaaggcuauguguuuccaggaauuuaucaaugucuucuagauuuccuaauugugugcauagagguguucauaauauucucuggugaacuuuuguauuuuuguaggguugguugaaaugucaccuuugucacuucagauuggguuuauuuggaucuucuuuuuucuuuauuaaucuaauuaauuagcaguuucaaucuuguuucaucuuuugaagaaccaacuuuugggggcauugauacuuugucuggauuuucgcaucucaguuuuauucaguucagcucugauuuugguuauuucuuuucuucugcuagcuuuggguuugguuuguuccuauuuuuauaguuccucgagguauaaugcaagauuguuaauuugagagcuuucuaacuucuucacguaggaguuuagugcuaugaaucuuccucuuaaugcaacuguaacugugucccaaacugguauguugugucuguuuucauucauuucaaauaauguuuugauuucugccuuaauuuuguuauuuacccaaaagucauucaagaguagguuaacauguaauuguaugguuuuaauagaucuuaguauugauugcuguuuuuacuaugcuguggucugagaauguguuugguaugauuucaauuuuuuuaauuuguugaaacuuucuuuaugguuuagcaugucauugaucuuaaaguaugugccaugugcagaugagaagaauauguauucuguuguuggauggaguguucuguagugucuauuaggucuaauuggucaaguauugaguuuaaguccagaaaauauuuguuaguuuucugccuugaugauguaacacugucaaggugguguugaaaucucccauuguuaucguguguuugucuguauuuccucauagaucucuaagaaccuuuuuuauggaucugggaacucuaauuuuggguauguauauauuuagaauaguuaagucuucuugauggauugagccccuuauuauuauguaauauuuuucuuuguucgauuguuguugcuuuaauguuuguuugucugguauaagaauagcaaccccugcuguuucuguuuucuauuuaccuaaucaaucuuucuccauuccuuuacuuuaagccuauugcuguuacuucugagauggaucucuugaagacagcaaacauuugggucuugcuucuuuauccgccuugacacucuauaccauuuaaucgaggcauuuagccuguuuacauucauggucgauauugcuaugugaggauuuggucuuaucaucacgcuuuuagcugguuguuauguagacuuaauuguauaguugcauuauagugucaaugggguauguucuuaaguguguuuuuauggugacaaauauugcucuuucauuuccauguuuagcacuuccuuuaggagcucuuguaaaacaggucuacugcuaucagauucccguagcuuuuuuguuuuuuuaagguacacucuugcucuaucuaucuccccagcuggagugcaguaguacaaucucagcucacugcaaccucugcauccugggcucaaaugaucccaccucagucucuuaaguagcugggacuacaggugcaugucaccacaccuggguaauuuuguauuuuuuuguagggauagggucucucuuugcuucccaggcuuguuucaaacuccuggggcucaagcaaucugcccaccucagccucccaaaaugcuaggauuauaagcaugagccacugcagucagccucccuuagcuuuugcuugucuggaaagaauugcguucucuuuugcuuaugaagcuuaguuggugggcuauaaaauuauugcuugggauuucuuuuauuuaaagauauugaaaauaggcucccagucucuucuggcuuguaaaguuucugcggaaaggucuacugagccugacagaguucccuuuguaagugacccgccgcuucucucuaguuaccuauacgauuuuuucuuucacaucuaccuuggagaaucugaugacugugugucuuggggaugguugucuuacauaguaucucacaaggguucucugcauuucuugaauuuacaugacaaccucucacuaaagccauagugucuauauuauuuugauguaaguuguuaaauuauuauuuuuuacugcuaccacaauacugcugcuguugcugcugcuacauuaauuuauguugcuaugucauuccagugaaaaaucucaacuuucaauuauagugcagauacacuauguaaaaucacauguuuagguuccaaguaauauauggccuaaagaaaucccaaaaaugguaauaaucccagucauggaugccauacacuucuaaccugcagcauccccacucaagaacugccugccuauggugccucccacuggagcacuuccuacccacagcaccugagcugccacugccagggcaccuaccuauggcccccugccauccucuacagagcuauuguuuuauacaucuuacacauuagaaaacuuagacucaaaguuaaucucauuugccugugucagagccaggauugaaacaccagucuguaugacucuauaaaucacacccuuaacucagugagcuccgaaggcuuuugagugugaaugcugccacauauccuguuuucuaaaacaggcuuauucugacuuucacagaucacaguguucucccagugugugaaagcaagaccugaaauaaacuuuuaugcuguaugugcuaacaugcuuagggcucuauuuucauaaaacauuaacaauuuuaaagaugauaucuaauaaacagaccuuguauaauuaucuuuuuaagauugccaaauguuuucuaauaucuuacucauuguacuaaacccuaggcuucuguucauuuuaauuuuaccauaaagguaaaaacauauauauaagucaauagguaacucauuucuuucauuaaauaaucaauuaaauacgucaucuaugauguacaaggcauuguauagaacacuauauugccaaucaaagugcuaguaaaaauaaaaguuuaaaaugugaaggcaaucucgaagcaugacuauucagauuauuuauugcuacuaguaucauauauuuuuauuaaagagccaucacauuccaaauaagucagucaauaucauacuuaucagaaaccagaugcuaugauaaauaauucuuucuucuucacguccuccauacucaggcauacuuauagacaauuacugaacaaauuauaugcucagcuaguaugcuucaauccaacauuaggaaaucguuucaagaaacuguuuuaaacauuuuuauagcaauguaucuuuaauacuuuucucagcauggggcagaagagaacuuuacauauuuacuugcauguacuuuacaucuuuuugucugcuguacagaucuguaggccuauuguuuuuccuucccacuaauuuugaagugucucaguuuaaagcauauuuguuggaauuauauuauguauccaugguuguccuggauaccuuuucuuugccccaccucccaucauagaucuauucuccauccuuuuuuaccuuauucaccccaggaagcuaacuuccaugucuccuggcuuccaguuguuaaccagucgggagcucuggcaagcuauaggagagaauggggacagaauauuucuccugcugugcccuucccuccagaauuaugucagguuggcuugucccucuguugaaggguaacacuucucuccaggaagccuucucuccacaacacauuuaccaacaacuggucccucuggcuguagggauggcaacagcucugcuuuugcuagccccagguaacugcacuaucucuuaugauucucuuauauagcaccuguaccuucauaauuaaugucuuuauaagugagccccccucaguuuauucuuagggcuaauuuguaccuggacuguuauuuggauaaggguaguaucuaaauacaugaaucuuuuagucaaccuacauugguuucuguguucuauuucuuaccagcuguguuaauuugcacaaauuauuuauucuaagucaucauaaaaggggcuaaaaauaccuaccucacagaauucuugugaagauuuuagauuaggcauauaugguucaucacagagccugauacuagugagcacucaguuaacaucaacuauuaauuuuguuuucuaguacuuauuuacauacauguaaauuuaauaaauacuauuuuaucuuauguaugaugauaauaaaaaaguucuagaauuugagccaaucuuccauuccuucauagaaaguuuuuuuaaaaaguagaaaauguacuauguuggaggucuguuccaagauggcugaauaggaacagcucuggucugcagcucccagugugaucaaugaagaagacaggugauuucugcauuuccagcugagguaccugguucaucucauugggacugcuuggacagugggugcagcccaugggcaagcugaagcagggcagggcauugccucaccugggaaacgcaggggguugggggauuucccuuuccuagccaagggaagccaugacagaccguaccaggaaaauugggacauuccagcuuaauacugcacuuuuccaauggucuuagcaaacggcacuccaggagauuauauccugugccuggcucagugggucccaugcccauggaaccuugcucacugcuggcacagcagucugagaucgaacugugaggcggcagccuagcugggggaagaguguccaccauugcuaagacuugaguggguaaacaaagcagccaggaagcucaaacuggguggagcccaccgcagcucaaugaggccuacgugccucuguagacuccagcucuggggcagggcacagcugaacaaaaggcaucagaaacuucugcagacuuaaacgucccagucugacagcucugaagagagcagucguucucccagcaugguauuugagcucugagaauggaaaaacugccucaagugggucccugacacccgugcagccuaacugggagauaccucccaguaggggcugacugacaccucauacacccaggugccccucugauacgaagcuuccagaguaaggaucaggcagcaguauuugcuguucugcaguauuugcuguucuucagccuccgcuggugauacccaggcaaacagggucuggaguggaacucuggcaaacuccaacagaccugcagcugagggaccuguuagaaggaagacuaacaaacagaaaggaauagcaucaacaucaacaaaaagggcauccacaccaaaaccccaucuguaggucaccaucaucaaagaccaaagauagauaaaaccacaaagauagggagaaaccagagcagaaaagcugaaaauucuaaaaaccagagcaccucuccuccugcaaaagauuacagcuucuugccagcaacagaacaaagguggacggagaaugacuuugacaaguugacagaaguagccuucagaaggucaauaauaacaaacuucuccaagcuaaaggaggauguucgaacccaucgcaaggaagcuaaaauccuugaaaaaggauuagacgaauggcuaacuagaauaaacaguguagagaagaccuuaagugaccugauggagcugaaaaccauggcacgagagcuaugugacacaugcacaagcuucaguagcugauucgaucaaguggaaagaagcguaucagugauugaagaucaaauuaaugaaaugaagagagaagagaaguuuagagaaaaaagaauaaaaagaaacgaacaaagccuccaagaaauaugggacucugugaaaagaccaaaucucuguuugauugguguacuugaaagugacagggagaauggaaccaagcuggaaaacacucuucaggcuauuauccaggagaacuuccccaaccuagcaaggcaggccaacauucaaauucagaagauacagagaacacuacaaacauacuccuugagaagagcaaccccaacacacauaauuuucggauuaaccaagguuaaaaugaaggaaaaaauguuaacaggcaccagagagaaagauuggguuacccacaaagggaagcccaucaaacuaacagcagaucucucggcagacacucuaccagccagaagagaguaggggccaauauucaacauucucaaagaaaagaauuuucaacccagaauuucauauccagccaaacuaaguuucauaagugaaggagaaauaaaauccuuuacagacaagcaaaugcugagagauuuugucgccaacaggccuaccuuacaagagccccuaaaggaagcacuaaacauggaaaggaacaaccaguaccagccacugcaaaaacaugccaaauuguaaagacuaucgaugcuaggaagaaacugcaucaaauaaugggcaaaauaaccagcuagcgucauaaugacaggaucaaauucacacauaacaauauuaaucuuaaauguaaaugggcuaaaugcccuaauuaaaagacacagacuggcaaauuggauaaagagucaauacccaucacugcugcauucaggagacccaugucacgugcagagacacacauaggcucaaaauaaagggaaggaggaagaucuaccaagcaaauggaaagcaaaaaaaggaagggguugcaauccuagucucugauaaaacagacuuuaaaccaacaaagaucaaaagagacaauuaaggccauuacauaauaguaaagggaucaauucagcaagaagagcuaacuauccuaaauauauauggacccuauacaggagcacccagauucauaaagcaaguccuagagaccuacaaagagacuuagacucccacacaauaauaaugggagacuucaacaucccacugucaguaugagacagaucaacaagacagaagguuaacaaggauauccaggacuugaacucaccucugcaccaagcacaccuaauagacaucuacagaacucuucagcccaaaucaacagaauauacauucuucuuggcaccacauugccuuuauuccaaaauugaccacauaguugggaguaaagcacuccucagcaaaugcaaaagaacagaaauuauaauaaacugucucucagaccacagugcaaucaaacuagaacucaggauuaagaaauucacucaaaaccacacaacuacauggaaacugaacaaccugcuccugaaugacuacuggguaaauaaugaaaugaaggcagaaauaaagguguucuuugaaaccaaugagaacaaagacgcaacauaccaaaaccucugggacacauuuaaagcaguguguagaaggacauuuauagcacuaaaugcccacaagagaaagcaggaaagaucuaaaaucgacacccuaacaucacaauuagaagaacuagagaagcaagagcaaacaaauucaaaagcuagcagaaggcaagaaauaauuaagauuagagcagaacugaaggagauagagaaacaaaaaaccuuucaaaaaaucacugaauccaagagcugguuuguugaaaaggucaacaaaauagauagaccacuagcaagacuaauaaaagggauaucaccaccgaucccacagaaauacaaacuaccaucagaaaauacuauaaacaccucuacacaaauaaacuagaaaaucuagaagaaauggauaaauuccuggacacauacauccucccaagacuaaaccaggaagaacuugaaucccugaacagaccaauaacaggcucugaaauugaggcaauaauuaauagccuaccaaccaaaaaaagucgaggaccagauggauucacagcccaauucuaccagaauuacaaagacgagcggguaccauuccuucugaaacuauuccaaucaauagaaaaagggggaauccucccuaacucauuuuacgaggccagcaucauccugauaccaaagccuggcagagacacacacacaaaaaagagaauuuuagaccaauauccaugaugaacacccaugcgaaaauccucaauaaaauacuggcaaacugaauccagcagcauaucaaaaagcuuauccaccaagaucaagucggcuucaucccugcaauggaaggcuggcucaacauacacaaaucaauaaacguaauccaucacauaaauagaaccaaagacaaaaaccacaugauuaucucaauagaugcagagaacaccuuugacaaaauucaacagcccuucaugcuaaaagcucucaguaaacuagguauugauggaacguaucucaaaauaauaagagcuauuuaugacaaacccacagccaauaucauacugaaugggcuaaaacuggaagccuucccuuugaaaacuggcacaagacagggaugcccucucucaccacuccuauucaacauaguguuggaaguucuggccagggcaaucaggcaggagaaagaaauaaaggguauucaauuaggaaaagaggaagucaaauugucccuguuugcagaugacaugaauguauauuuagaaaaccccaucgucucagcccaaaaucuccuuaagcugauaagcaacuucagcaaagucucaggauacaaaaucaaugugcaaaaaucacaagcauuccuucacaccaguaacagacaaacaaccaaaucaugagugaacucccauucacaacugcuacaaagagaaugaaauaccuaggaauccaacuuacaagagaugugaaggaccucuucaaggagaacuacaaaccacugcucaacaaaauaaaagaggacacaaacaaaugaaagaacauuccaugcucauggauaggaagaauccauaucgugaaaauggccauacugcccaggguaauuuauagauucaaugccauccccaucaaacuaccaaugacuuucuucacagaauggaaaaaacuacuuuaaaguucauauggaaccaaaaaacaguuggcauugucaagacaauucuaagccaaaagaacaaagcuggaggcaucaugcuaccugacuucaaacuauacuacaaggcuacaguaaccaaaacaucaugguacugguaccaaaacagagauauagacuaacagaacagaacagaggccucagaaauaacaccacacaucuacaacccucugaucuuugauagaccugacaaaaacaagaaauggggaaaggauucccuauuuaauaaaugaugcugggaaaacuggcuagccauauguagaaagcuuaaacuggaucccuuccuuacaccuuauacaaaaauuaauuccagauggaugaaagacuuaaauauuagaccuaaaaccauaaaaacccuagaagaaaaccugggcaauaccauucaggacauaggcaugggcaaggacuucaugucuaaaacaccaaaagcaauggcaacaaaagccaaaauugacaaaugagaucuaauuaaacuaaagagcuucugcacagcaaaagaaacuaccaucagagugaacaggcaaccuauagaaugggagaaaauuuuugcaaucuacucaucugacaaagggcuaauauccggaaucuauaaagaacuuaaacaaauuuacaagaaaaaaucaaacaaccccaucaaaaagugggcgaaggacaugaacagacacuucucaaaagaagacauuuaugcagccaacagacacgugaaaaaaugcucaugaucacuggucaucagaaaugcaaaucaaaaccacaaugagauaccaucucacaccaguuagaauggcgaucauuaaaaagucagaaagcaacaggugcuggagaggacguggagaaauaggaacacuuuuacacuguuggggguguaaacuaguucaaccauuguggaagacaguguggcgauuccucaaggaucuagaaccagaaauaccauuugacccagugaucccauuacuggguauauagccaaaggauuauaaaucaugcuacuauaaagaugcaugcacacguauguuuauuguggcacuauucacaauagcaaagacuuggaaccaacccaaauauccaucaaugauagacuggauuaagaaaauguggcacauauacaccaugaaauauuaugcagccauaaaaaaggaugaguucaugucuucucuagggacauagaugaagcuggaaaucauucugagcaaacuaucacaaggacugcaaaccaaacaccacauguucucacucauaggugggaauugaacaaugagaacacuuggacacagggcagggagcaccacacacuggggccuggugugggguggggggaugggggagggauagcauuaggagaaauaccuaauguaaaugaccaguuaaugaguacagcaaaccaacuugucauguguauacauauguaacaaaccugcacguugugcacauguacccuagaacuuaaacuauaauaaaaaauaaaaaauaaaauaaaaagaaauugaauaucuaaauagauagacaucccauguucauguguuggaauaauuguuuugaugacaauacuacccaaaacaauguguaacuuccaugcaguaccuauaaaaaucccaauugcauuuuuuaauuaaaaaaauccauacuaaaauucauauuaaauuucuagggacccauaauacccaaaacaaucuugaaaaagaacaaagucagaggacucauacuucuugauuugagaauuuacuacaaagcuauaguaaucaaaacgauacaggcauaaugauagacauauagaccaauggaauuaaauugagagcccagaaauaaacccucacgucuauggaaaauugauauuugacaaaggugccaagaccauuuagugagaaaagauagauuauucaacaaauggugcugggaaaacugaauauccacacgcaaaaaaugaaauuggacccuuacauuaaaccauauauaaaauuuaacucaaaauggaccaaagacuaaauuuacaaucuacaacuauaaaacucuuagaggaaaauguggagauaaaucuucauaaccuuggauuugacagugguuucuuacauaugacaccaagagcacagacaacaaacaguaaguuggacuucuaaaaguaagaauuugugcuucaaaggacacuuugaagagagugaaaagacaacccauaaaaugggagaaaauauuuguaaaucauaugccugauaaggacuuaauaccagaauacaaaaucaauaugcaaaaaucaguuguauuucuauucacuaacaacuccuacagcucaacaacagacaacgauauuaagaaaugggcaaaagacuugaguagacauuucucugaggaagauauacaaauggccaauaagcacauggaaaagauaaucaguaucauuagucauuagggaaauaaaaauuaaaaccacagugagauagcucuucacacccaaguguuggcaaggaugaggagaaauuagaacccuggugcauuaauagugggauuguaaaaugauguagcuucuauagaaaauauuuuggcacuugcuugaaaaaguaaauauggaauugccauaugagucaguaauuugacugcuagaugcuuaccaaaaagaauugaaaacagggacucaaacagauauuguacaccaauguucauuguagcauuauugacaagucaaagguggaaacaacccaagugucuaucaacagauaaauuaauaaacaaaagguaguauauacaguguaauguucagccauaaaaagacacgaaguucugauauuugaugcagagugaaugaaccauguaaauauuaugcuaaguauaauccacauauaaaaaggacaaauauuguauaauuucauuuauauaaaauaucaacaaucagcaaauucauggagacaggaaguagauuagugguaccacgggcugggggagggaggaauggaaauuaaugcuuaaugaguccaaaguuucucugagaugaugaaaaaaauuggaaauaacuaguggugaugguuguacaguauugcaagcguacuuaaaaccacugaauucuacacuuaaaaaugguuaaaaggaaaaauuuuauguuauauauguuuuaccucaauuuuuucaaauaagguauagaauuuaauguguucaggcuacccuaauaucacccgcuuaucugagcccuacacuuucugaucaguaguagugaagaaguuuucauaagaguuguucugaugaggucuuuuuuaaccucugaagguauuuuggguuuuuuuuuaagugaaucuucggaaacuaacagcuuuucuucuaagugaaaaucagugugcugcagcuggcagcugacagcauuaaaaucauccauuugacauacaaauuaguacuggagugucuuuugucauacagauaugcagaaauuacuauacagugaccagauguauuggauauauuaucuaaacucacauagaagacagaauggaucugagaaauacagcuuauucaugugccugaauaaguauuauauaaucagaagccaugugauaccauuuuaauauguauucauuaacuauuuccuguaauuacaauugauuagcgguuuauugcuauaagaugguuucuuuacaauuaccacuuccccuuuuguauuuguauuuggcccugcuuccacauuaaauacaucagaaaaccuuuggaaucugccauuuuuuaucuagauaaaacauugcuuuucaccagaacagaguaaagaaggacugcaaagaucuuaguuuacuuaagguaccauguagaggcuucucuaggccagaauuuagucuugcuaaaucccacuugucaguuauuccuuaauucacuuuaucuuaaagguuaaauaaagcaaugagcuauaguguauaguauaaucaaguauagucaaauaugcuguaagcaaagcuauauuacuaagucuuaagaaaaaucagauaaucucuaaugagugaaguggaguccuagaucucugaaauguaugguacuguucacaggguagacccguuuuugugcuaauccuuguugcuguauggaugaguuuaauuugacaagccaaacaaaugucgacugcaucuauugguaggaagaccuuuguaucaaaacaagcaugaagucaauucaagccuuuauugugucacauuuaaaaugaaaaacacggcaaagucucacucuugugcuguugcaaaaauaaucguuuuuuaaaaagucaugugagauauuacaucuuuggcuacuaaacuguaauuagauucucugggcuuagaaacaaaacaugccagcaggauauauacagagagccccagaaagauaccucuuacaaaacugaagcaugcugaauuaaucucagagaacaaguauauaaaucugggaauugaagcaauaacuauucagaucaauagggagagcuagucuaccauaucauguauuaaguaaacaaggauauaaaaagguacauuuuuauauccuugagcagaguguucagauauaaaggagaauuuuuauuuugacauuaaucaaauguuaccuaguggaaaauguauaauuuguuuugauacccauggcaaccauuacccacauuacccuacuucuaacauaaggucaaaguuucagcuuguaaaaacuccauagugaauccaucucuuuccugaaaguaaaucgugauguuuaguaagaauaaugaguugguaccauagcaugcuuaauguguuauugugcuguuuuccucccugugggaaaauaagguaaugggaugcaacucuagagacagugaugggucucagacuggaaaacuggccaacaacauagaauagaagaaauugaaagcuccaauuaguguuuuuauaacuuuaguuuuaagaaaaaguguaaaugucuuauugguauguuagucucugaaacucauaagacuaaaauuaauuauuaacuauaucuagauaauauuuugugauuaugagaccacuaauauuuuauccccaacaguguaucacauucaaaaggauaucuacaaaagaaacuggaggaaucuuugccucucacuuugucuuaucuuuucagaaaauauuagagacaguucaucuuacccuuaaauuguuauauucuuggcacaaaguuaauacuuuucuuuuguuaucaaaagaaauauucaucuaaacauaucuaguugcaggcagaugggcaauuauucuuuaaagcaaaacaaaaaauagaaaagaguaauguauaucugaauaauauuuuauucuugucuagaaaccuagacaagagacaguuuauguggauauucuaucacuaaacagugugaguaacugauacuuucuacauguggcauguaauaauuaaguuuaaaaugugauuucaguuguuuuuaaauaaaaaugaucagauucauaauaagcaagacaugccauugcaucuacuuuuuaaaauaagguaacaacccaauuguguuaauuuacacuccccuguagcccuaguauauuugaucuguagaugauagguuggaaguuaauuuguguugugguaauaugaggcuuuuccccccucucccggcuccccauuacuuccuggauuccuuaaccaagcuaaaccaaguuuuaagauauuguggugaucauugguagccuuuaccuuuugcuagucucuuuguucauucaggcuacaagaacaaaauaccaaagauuggguggcuuauaacaauagaaauuuauuucucacaguucuggagacuaaguccaagauaaaggcucugguaagagcccacuucauaguucauauauggccaucuuuaugcugugucuucauguggaagaaggggcaaggaagcucucucagguccuuuuuaucagguacuaauucuauucaugaagggucuccccucaugaccucaucacccccaaaggcccucccuccuaauaucauuaccuugggguuaagauuuuaacauaugaauuuggggaagacacaaacauucagaccguggcacccuucucucuuuagcccugucaccuuccccccuuugcucaagcucuuccucuagccuuuggucucaggcaccugagauuauccuucuacaauuauguguucaaaagagucaaaauaacuucauaagacacuguaaaccaauucagcauauguguugucccuguauuaaacuucucuagcuccagauaguaucuaucuaguucuucagauuaauaugauacuucuagaacuucuaaacgugucaugggucuuuuuaccuguucuaaaauuuauuagaccucuuuauaccuuaagcauuuaguuaaagaaugagaagugaauauccuuuaucagcuucaaguaugcaaggaauucuuucuugaucuuguuauaccuauaagcacuggcuaugguuaaacuuggcuuucuuccugacauuuuucuugccuugcucgucagcaaauguuuuagucuguagguuuauauuagauuauaagaaaauaguuuauauauuaaugcaccuugaacaugcuggacaucauauaaaaguugggaguaacaguggaaacucuucuacauaacucugauuuguuaagugauaaaagauuacuucgaaagacucaugaacuaaaaacuccuguugaguccuuauucuuauagcuuuucauaaguuuuguguaguaaaaagcaaaguaguagugaagagggccuuaauacaccuaauccagacauugguuuucuugguuuuuuaacauguuuacuagaaauauuauaugguaaaauauaagcaguuuuuaaaaagagagagcaagcuuuuuuccaauuuccaggaaaaacugcaaagucaucaucuuaaucuugugaucuuuggcacucacauuugugaccugacacaggaugaaaguuaucuugucucaauauguguuauucuacauacccacccuguacuccacagcccaccauuuaauuacuccuuaccacaggaaugucuguggcugaauaagaaacuaaccauaguugcccucccauuugacccacagagguuggaacuuggcugugauccaucauaguccuaacuguuuuuugaaucucaguuuuuauuguauacauucuuuucagggcauagcguacuuuguguaauaugaccaguggcuugaacacaguguggguuuacuagucucaguugucuaguguaaacagaagcugauaaaugcuuguugcugaaauucaguucccaaaugucauagaucaaaagaaaauuuaccacaagacuuauuagggcuccugauacaaaaugauauuagaugauggaauuuuaucagaagagccuugucuucucacauaagccagugcauguuuuuaagaacaagaauuguuuucaagcaaacuuuucuaucauaguuugcuuuucaaaaaaauuuccacauagccauuucuggaaggacuuguuuaaaaguagaaacuauuauuaaucacuaaucuauaaaucuauaggaagauccuaauugccauauucacaaacacuaagucacuaacauaauuuuaaaaauuaaaacauaguauaaaagaaaacuuuuuaaccuggaguucaucaugaauuucaggagguuuuugaacuaauugaaauuauguguaaaguguuccacauaaaugccauuuuuugagacacaauauucauagucuuuaucugauugccaaagcguuugugacccaguacauuaagagucacugguaaaaaucacuccuccaucauaaagaguucaccaugaacaccauaaagccguaucucacauuccauuuggggacaaguuugcauuuuacauuugaaucuaugcguuugcaaaguguuguaaauuucucuccuauaaaaggagugauuaaggaaaggauaacggaagaagagaggauagaaggaaaccaucuuguaauaaggaucugccugugaaucgggcauauacacacacacacacacacacucacagaaacacaggcacaccucaaagauacugcaaauucaguuccagaccaacccaaugaggcaaauauggcaauaaaaugcaucacacaauuuuuuugucucccagugcauauaaaagugguuuacacuauacuguagucuaguaaguaugcaacagcauuauaucuaaauuaaguacauacauaccuuaaucaaaaaaugcuuuauugcuaaaaaaaaaaaaaaaaguaugcuaacagucacccaagccuucucuaaaucauaaucuuuucacuggugcaaggucuugccuccacacugauagcuacugacugaugguugcuaaagguuccuaaagggcaaugguggcuaaagauugaaguggcuguggcaauuucuuaacauaagacaacaaugacguuugccguaucaauugacucuucaugaaagauuucucuguagcaugcagugcuauuuaacagcauuuuacucacagaagaacuucuuuccaaaucaagucaauacucuccaauccuguuguugcuuuaucaaauaaauuuauauaauaaaugcuuuguugucaaaaaugacacagcaucuucaccagaaguagauugcaucucaagaaaacacuuuuuuuuuugcacauucauaagaagcaacuccucauccauccaaguuuuaucaugagauugcagcaguucagccacaucucaggcucugcuucuaauucuaguucuuuuacuauuuccaccauaucugcacuuucuaccuccacugaagucuugaacuccucaaagucauccaugaggguuggaaucaacuucuuccaaacuccauuucauguugauauugugaccucccaagagucacaaauguuuugaaaggcaucuagaaugguggauuauuuccagaggauuucaauuuauuuugcccagaugcaucagaggagucacuaucuauagcagcuacagccuuacaaaauguauuucuuaaagaauaagaccugaagguugaaaugacuccuucauccauggauugcaaaauguguuagaaugcaugaagacaacauucaucucuuuguauguucuccgucagagcucuugggugaccaggugcauugucaaugagcaauaauauuuugaaaggaaucuuuuuuucugaguaguaggucacaacaaagaacuuaaaauauucaguaaccaugcugcaaacaggugugcugucguccggacuuuguuguuccauuuauagaacacaggcagaguagauuuggcauaauucuuaagggcccuaggauuuuggaauggucagugaguauuagcuucaacugaaagucaccaucuacauuagccucuaacaggagagucagccuauccuuugaagccuugaagccaggcauugaucucuuaucucuaguuaugaaagcccuagauggcaucuucuuccaaucaaaggcugcuucauuugcauugaaaaucuguuuagugucaucagcaaucuuagcuagauauucuggauaggauaacugcaguuucuccauuaguaccuguugcuucaccuuacacuuuuaguuauggagacagcuucuuuucuuaaagcucaugaaccaaugucugcuagcuuccaacuuuucuucuccagcuuccucaucucucacagccuucauagaauuggagagcuaaggccuggcucugcagauggugauuaagagaaugguguggcuaguuugaucuccuauccagaccacaaaaacuuucccuguaucaguaagaaggcuguuuugcuuucuuaucguuuguguguucacuggaguagcaccuuuaauuucguuuaagaauuuuuccuuugcauucacaacuuggcuguuuggcccaaaaugcccaacuuuugggcuaucuuggcuaucaacaugccuuccucacuaaucuuaaucuuauuucuagauuuuuuauuuaaagugaaaauuaugugacucuuccuuucauuugaacaccaaaggccauuuugagguuauuaauuggccuaauuuuaauauuuuuaauauuuuugugucucaggaaauagggaggcuuaaggagaaggagagaaacagaaauggcuauucaguggagcagucaaaacacauuuauucacuaaguuugccaucuuauauagguauggcucauaucccccaaaguaauuacaauagcagcaucugagaucacuuaucacagaucaucauaacagauauaauaauaaugaaaacguuucaaauauugcaauaauuacuagaauggaacuuagagguaugaagugagcacaugcuauuguaaaaaugguaccaauagacuugcuugacacaggauugccacaacccuucaauugguuaaaaaugcaauaauugugacaugcacuauagcaaagcacaauaaaugagguguuccuguauauacaauuuuuccaacaacccucuaaguguacuguuuaacugaauuauuauuacacauuuaacagguaacaaaacuaaggccaaaaaggcuaagaaacuuggccaagaucccacagcugacaaauggcagaguagugauucagacccagggcuaucugucuacaaaguuccuacacuuuccuccaaaccacccagccuguuuauuugaaguaguauuuuauccuucuugacuaauggcaagaaauuauaugaaaaaguauuauuugacuuauuacucuguuaacuaggucuaaaauuaucuccaucuuuacugcacaacuguuuucacucagguugcugauaucuuguaccugacuuauugaaagacuuacugcagcuccccacuguuccugccugcaacuucccaucccucacuucugcccuacacuagacugagcuuuuugaaauguaaauuugauaguugccaaaauacccuaugacuaguugcuaaaauaucuaugacuuuccguugccuucaaaaugaaguucgaauccuaaucaucuuuuauaaggcucuccaugaucuggauucugcucuguguuccaagguccuuccuggccgcugcucccucacccucuuagguuucagccauaauuaccuacuugcaguuccuuauauucucuuuuuguuuuucuccucauuuggagcauuauucccacuucuguuaaucuagguaacucccauuuguuuugaaaugcuguuuauauagcauuucuucauggaagucuuccuuaacaacucaagucuggaacuaaguaucacucuuaaauccucauagaaaaucuuuuacuuaguuuacauauagagagcaacuuuauuuaugcauuagauaaaucccaugcuuccuucagggaaauacagcaccaugugagggcacaaagcuuagaaaggaagggaugggcaacuuuucaugcuccacuuacucccuuuuucaggcuuucucguacaaggcacaauuugaacaaccauaaaugauggcucuagguagcauuuaucaaaugguauuguaaucaccuguuuacuuauucauauccccaucuaguucauuaaggagagggacuauguugcauuguuauauccccagccccuagcauggugccuuucaaauagaaaacacucaauaaauauuugauaggcaaauugauuaaguuaaugaacaaagcaugugaaaauaauaguuugcaguagacuacaccuuugcacaaguugcccuaaagagaaaggcaaaagaaaaaacacuagugucaaguacuaguuuaauucaggacaaugaacagugaaugccuacaaauggaaacuugugaggcaagagaaaugaaaaagauauagucccuugcucucauaaaacuuucagucuuguuaggaagcuuagacauguauacaaaugauuaaaauugaaggcagaaugcaacauugugacaugugcuauaugagauuuauaauuaaaguucuggaaauaguacugcgaaggaagaaauuucaucuaagugaggaauucugaaagcuuuacagagagggugauaauagaccuagaccuucaacuauggguaggauuucaguaauacaaauuguuggggaggaccacagucaggagggaguauuucaagcaaaggaaacagcacaguagcauuggaaagcacagggcuucuuugaagagcaguuuggcugcugauaaagcuggaaagguacggagaaucugauuaugauagaggaccuugagugcuauguuaaagaguuuucauuuuagcagucgggagcuauuaaagguuuuuagaaaaggaaagugacacuaucagcuauauuuuggaaagucguuuggaaaauaacuuuuuuauuuguauuaagguuugccaaaauuuaagcaucuucccuuucuuuugcccuugaucccaauuaaacaaauuuuaaaacaccaaggaacagagauuuucccuaauacucccagucuaucucaaugcuagauucuuaccuuuacauugacccucucucuuaagcuuucagucucucacuaucuaaauaguugguagcccucagagugaacaaagcucacaaggcugugaggaagagacaauagaaggguuugccugagacucauagccaaagcucugugacuuucaaaaugagacuggggaaauaauccccugcuguuacuaugugauucaaggcaccuggucacuuucuuuccuuacuuucuuuguaacacuaaaggacagucuucucuucuuguuaaccuuucauguaaauauaaguuaauguauguauuuguauuaggaguaagcaaguguguguguaaugaauuugucuuucuugaaaugcaaagggauguuagacuuaacuauuaucaaaauguaacuuccaaaaagaaauuuuaaauaguacacauugucuuuacuaugguaagcaaacuauuucuuggaagggauccauggaucuugacuuacuuugcuuaaggacaauaacccuaguaaggaagaaaucucuguaugauacugacugaagucucaggauuuucugagaaccuuccauaauguuaccaccagucagcagagaacuggaugaggaaaaccuagaagcauuaggaccacuuaggaacuaauccaacaauaauuggacucuaaaaugaaguagaagaagaaugaaaaaaaaaaaaggaauggauacaagacaaguccuaaauugacacagcuuuguaacuaauuaaaugugcagacaaaggagguuuaaaauauauguguauaucuauccacaucuaucuaucuauauuuauauauaaagagagagagagauacuuagagacagauauaagaacuuggcugggugugguggcucacaccuguaauccuagcacuaugggaggcuaaggaggaaggaucacuugaucccaggaguucgauaccagucugggcaacaaagcgagaccuuguuucuacaaaaaaaaaaaaaaaaauuaauuaaaaaaagaccuuaaagucuccagguuggguguuuggggagguugcugauacuguuaccagagauagagaagagaagaauaacguagguuugaaaagaaugugauuaauuuuggacauauugaauuugaagugcuaaugguacaucacuggaaaaauaaucagcugagcauuuggagauucagacuagaauucaaagaagacuucuacuagauguguauugaauccucccacuuauguaauaaacaguauucuacagaacaugaaaaaaagguguagggcuucauuuuccauaauuaucauaauuaugguauaauuuuccauaauuuccauaauuaccuuuaaaagcuuauaaaugaauuauucuagaaagaaagacaaauuccaggugauagucucaauaagagauuguugaaaagacccuuaaaagauauauuaauaacuuguauuuguuucagagauuguugaaaagacccuuaaaagauauauuaauaacuuguauuuguuucaagaaaccauaaaaauugacugucuccauuauaaauuagcuuaaaaauaagaaaaaaauugcauaagugcaagugauuaguagaagaaauuuacaaagaaaauaagaucaaagggaacuagaagagaaaggaaaggaaaagaccauuuugacauguuagaagaaaaaaaauuauauauauguguguguguguguguguguguguauaauugaacuuucaacaaaccaaacuaugaaguugcauugacucacacucaugcuaagauguuaugcaccauaggaaaaauauuuauuugucuugacauuucuauuuaaaacuuauaauuuaaaaauuuuaaauuaucuuucuuuccuuuaauccuuaugagauuuuguuagaauuacauaugaaaguaaaauaggagaggaaaauuuauaauuguucaugaagauauccauuuaucuuuuuuuuucacacuucuauugagugauccacuaaaaauugccaaacucauugagaaaaaaguaacuaagaaagcacggggcuucuuugaacagagcaguuuuggcugcagacaaagguagaaagauauggagaaucugauuaugauagcauggagccuaagaguagaaaguaaaacuuucacugcauccucucuaaacucuucuaucuacuucucuuccuuaacuguggaaaugaagugaggauauugucuaucauggguggauauagaugauauguuacauauaguaacauaugucacaagcauuuauuauuucuauaguuauaaacuucaucaaaauuauuguauaaauauauuuuuguguagaugucuuuuaccuaagauaucauuuuaaaaaaucaucuugccuguucaacucauacaagaguugggugaagacucuauuaguaaaagauaaaagcaacuagcauuugacucuuaccagagccagucagauuccuuacuauuugcucuaaaauccuuucugccuccuccacuggaaguaaaacagcuuaaccagucccuagcauagugccugacacacaguagaugcucagaaaguauuuguugaaugaaugaaucaguuauucaacauauauuagagcaaauacuguguacuagcagucacuguucuaggcauuggagaaacaguaacaaguaaaauuaaguuccuacugucauggaacuuacaauauuugggagagaccaucaauaaacauacauacauauauauaguuuagauauauauauaaagugguuauaaaugaucaaauaagguuaacacgaggaaaaagagugcugauggcuucuuuucuuuguagagugauuaguggagcucuuauucugagauggaaagccaauagaagauguggaacaaaggguguuauaucauccgacucauauuuuaagagaaucauucuuuugaugauugucauguagagaaagauuauacugggcaaggauagaagcagucauucaagaaguucuugcaguaaucuaaguaagagaugauggugguuuggacugggagaugagauuagagagguagaugauggggaguuggggaguugggaaauuguuugcagauuugcagaucauguaagaccucauagacuauggaaaagacuuaggaauguauucugaauaaagcuacaggccguuaaaaugcuuugugacagguuaugugaaaugucugucuuauauuuuaaaaggaucacucacguugugugaggguuagaccauagcggaaagaguggaggcaggggagaccaguugauagguuguuaacaauaaucuagguaagaaauaaccaucacuugagcuaauacaauauuaguacaggcagugagaagugaucagauucugaauauguuuugaaaguuacaggauacauugguaaagaaaaaaagaaacauauccagguuuauuaguuagauaacuagaagacugaaauugccauuuccugagauaaggaagacuucaggagaggauuggguagaggaggguaggaaucaaguguuccccuuugaaacuguuaaguuugugaagccuaguagauaucaaagugucuaauagauguugaggaagcagauucaugaguuuaaauuccagggaagauaguaaagacaaauuuacagucaucaguguauagauaggacuuaaaccugugggacuaaaugaaaucauuuaggggaggaauguagauagagaagaggucagaggacuaagcaauggagcacgaagucaaaaagauaagauaaauccaccaagggagaugagaaggcacagcuagugaaguaguagaaccaggagagauugguguacugaaggcuaauggaagaaaguuuugaagaaaggagggcaugaucaaaugugucauaugaugcugauaggccaagucagauucagaaugaguuuuaaaaauuggauuugacaauguggagauuacugccagucuuaauaagaguauuuugggggagugguagagacaaaaguuuggggagaauuugagagagaauaggcuucuugcaaagaaaugaaaagagauaggacaaaccauuagauuaaaagagccuuaaaagauguccgucagucacagugcguggcccuuguuuggauccugacucaacaaauuuaauuauggaugaacagauggauagacaaagagagggaggggaagagagagagaggacguuuaugaguuaugagcuaauucaaaauuugaacacuugcugaauauuugauuauauuuuacaggaagaguauuauuggggcuuuuuucuaggugugauaguacuauggguauauauuuuuuaaauccuguuauuucagugauacauguuuauguaugaaaugauaaaauaucuggguuugcaucaaaacaguacaaaggugggaagagggcauggaaggaauaaaugauacaauuuagcuacaaguuacaauuguugaagcugaguguuggggaccuagcagcucguuauaccuuucuugucuauauuuauauauuuuuugacuuuuuuuaaaauaaaaauguacagagaaagaaugggaagacaugaaauaaagauaguaacuuuggguaaugggaaauuaaaacaugaaaaugcauugaguuagcacacucuagauauuuauaauaucuccuuauguaacacaaacuauaaaaauauuuuuuaagauaaaaauccuuacacuaucaaauuuccuaaccucaaagauugguuccaaaaaaauuagaaacaacuugguuaaaaguuuauuagaacccuuuuuguggacaauacuaaagaauacuauuaguauggcuucaaaauaucccagauaacauuggaguaguuauuuauaaaauaaacauggaugagaaagcuggaccauguaaugacuauucuucuagacucucccacuuuuuaaaaauacauaauuagcauuuucucauauauaacacacuaauaugcuggaauuaccuguucuucuccuuccuugucacaagugccuaugguaggguauaaaaugauuacuggccugugcauucaccuucuuggcuuugcucugcugcugguuuuauuucugugagugaaauuagaaaauacagcaaccacugccuaauuguuacuagauauuauuacuaugaaaaccaguuuuauaccuuauauaaugcuauuaagaaaauaaacuucaaugaguuaaaaagaucugaauacggaaaacuagcaggacacaaaauauuuaucucaguaugggggaacacaauaaggauugaaacaaaaagugacauucaaaauuauauuuaauuauauaaucaagggaagaaaucagugcaguauuagauaaaucauucccaccucuuuccuacuaauccuugccacagcucuuauguuucucauugagagcacugagaugggcaguucuacugauuaagaacuuuauuaaugagcucagaaauuucuuaaauaauuggaacaagacagcacuucauuuauauucauuccaagaccacacuguacucuagauugagaaaucaccccauauucuguuuuucaucucaaauaugcuuaucugccuugucuagccaagcucuuagaaauaugcaccuaauuugugugaagcaucagccuagccauggucacacagugccagaaauauugaauaugugucauauuaagcauuccagagggucaagaggaggcauaagacuaauagcaucugccucacguccauaagaugaagaaaaacaaauuacuacagcugcuuauuauaggauaauugccaguuucuuuauucaauaccaugcucaaccgaaaguaaaauuuucauaccccaaauguaggauuauuuggagggaaaggaauggccagauaaaauggaagagauaaaagacuucucuguuugagcuuugucagggucuuaguuaguccaugccaauuguccagucuccaguaucaacuucaaacucguaucagguaaccuaauuguccugccauguguuccucccuaaaucuuccagaaccccaaacuuucuuaguuuccugcugcuacugugaguuauucccaaaccuguguccuagagggcccagugagagacaugauucuguucuacauaccucaugaauccuaccuaucaucagcuuuuaauuuuuuggccuuaguucacccacaguacucuguggcugcuuaaaaaucccuuuucuucacuuauucuccugcuacugcacaacuuaacuuucuccgggcaaacaugccagucucuuaauccaaguucagaugcaagauaaagagagaaaacaagauagaguggcacccgcaagaaccuuccauauucagacacugcuguauuaaggugugccugaccacauccuagaaaugaauuccagcaccagauccuaaaaaccagaggaacugugaaaauacaaaagcuuugcccuccccacauggaguacuguccacaaaaaugaggucuggaaguccccagauacugugccaggagauaucauaucuggcccccucacgugggauguugcuauauagaucucagcuaguugugcaauuugaagacccccauucucucuacaugggauguagcccuauagugggccuuaguggcaacccacgaguuuuuauguuauuuucauuauuaaucaguugagaauauuuucuaauuuucauugugaauucuuugaccuguaauguuuagaggcauauugcuuaauuuagaaagaguuagagauuuuucuagucacccuuuuguuacugauuuccagcauaauauuuacugucaucaaagaacauaaucugaauaauuucaauccuuuaaaaaucugaaaguugaguugcuuuuuugaauuggucaauuuuggaaauguuucacauguacucaaaaagaauuuuauucugaaggcauuggguauuaguguucuguaucugucccuuaaguagauuuguuaauugcauuguucaaguauugcaucuuaccguuuuuuuucugguuguuauuucaccuaccaucaugguggauuugucuguuuugccauucagugcuaucacauuuuuauauucugagucuuaguuauugaaugcucacagauuuagaauugucauaucuuuucagcaaauugaauuuuuuaucauuaugaaaucucccuuuuuaucugcaauaaucuguuucacauuaaauucuacuaugucugauaaaguucagcucucacaaauuucagcccuacaaacacagcagccucuucuagugcaaagugacuugcucuccacauauacguauaggaauugcaguuugaggucccagacaaaccugaccugcaaaugaaucccauuaucuaauuaaaugacucucaaugcuaguuacacauuagaaucaccugggaaagggggagccuuuuaaaaacaacugaugucagagaucugucccaagaaacucuacuuauuauuagucugcaacaaaccuuguuauugcuguuuaauaaaagcaaccagaugauucugcugacuuuauaaccacugguucaguaugauauccugccacccccaccaaggauguugcucaguaaguguagauuuguaauuucuggguggagucugcacucuguggaguauacagucaaaagcccugccagaugaaaaaugaaagauggaagaaacccuauacccuagaugccugguucuccccugucccacuguauaucuucuccauguaugaugugacuuauuuaacacuguggaaaucuaccccagcacauucacagccuuuucuuuccucccuaaccugucaagcuauagccacaaagaauauugucugauaaguauagcaacuguggccaucucaucuggauucucauucccuuuaagagucaguaaugaaagagaaauaaaaggaaagaagaaagaaaccagcuccccagccccuguuaaauucagaaacucggcuuauuaucucuggacugcuaagaucccuaaacuucugcuuuuaugcuacccauacuacuucauauuaauugucuaauacuaucucccccacugaacucuaagcacuccaaaaacuggaacagugccugguaccuacuuaguaggugcucagugaaauguuugauaaaugaaugaccgaauaacugagcaaagaaauguuuccauagcaguagaaaagaugcagucgugguuucacugccaggggccaguauuuaacauggauaauugaaaacacagcagagcaucagaggagcauaacucauaaucuuaugugaaaacucaacaguugcucuuuuucuuaaacacagccugcuucuuuucaaggcaucuaaacauuugcuaucuccuugcacuccauuucuacucuucuucuuagaccucccacacagcagcaaccugauuguugcaaagugcucuguucugccugcuuugucuuuaccauuuuccagcucaguagcagccugguuguuagggacuuccuuacaauaacagaacucuuuccagcucuacagcauaguuuaagggagauuaguugcauguacaguccuucguuacucauuuucugauuuccacaauguuuugaaagaacugaaaguuaagacugcuuauccacaaggcuuuuucaguaauguuauguuuaucuuagaauucuggccuaaaugguaauugaauugugcauguaggagaaugcagccaagauguuucaauaaucauaugguaccagggacugugcugccugcacaugacucaggcagaugaaucuggugcuugcuuucuuaaggacugggguucaaagagaaguaagaacaggaugaagaccagcucacaccagcucacuugacaccuuuugaaauacaggagcacuguuucucuucaacauuaguuacuaucaaggauucccaucuguuagcucuaagagaggauaggaugugaaauaugaacagccguuugaaucucuguggagccacugcagagaaucacagagaagauaaguaggguuagcaguacuaagacccauuuaugugaguuauuuuggagauugcuaagaucccaguccagcauuauuuauuccaccuacugaccgagaccuuuauccuuuugacuuaagacaguauuauucaaaaaauuguccaugggccaccugcuuuagaaucaucuacaggugcuuauuuaaaaauaccuaucccugagccccagaucaauaaagcagaaucucugggagugaggccuugaacuuguccuggccaaaccacucagcccauucuuuugaacccuaaaguuuagauugcugccuugagauauuacuaaguauuaagcuucaaauagccccaagaagcaauagcacugugagcagauuagucauuuuuauugaaggaucuaagaucagguuuuaguagagacaguaauugaaaagaacuugaagacacaaauacucaaugaggaggaauaggacacuaucaaagagaaggaacagagauaaaauaggcaaagggccaaagaaaaacuucuuuacuucauaauuuugcccuagguuuuauggucauuuggcauaguuuaguucaauccagcaaacauauauugagccccuaccaucugccagcuaccaagaagaaaacaaaauagaaggaagcucuuaaauggauaauuuaaauaaaugagguaaggccaaagauugagauucauacaagaaacuucgggagcugagaagcagggacccuaauggcaacuuagcuucuagagaaggaagugccugagcaggaaaaugaauagaaguuaggcagguuugagguuauguguggggguuacuauugaggaggcgcuaaagaggggacaggaauuggugggaaauggagcaugugcccaacauuggacaaucugcccaagaaaaggucugagcauaaagcaguaugcuauauugggauugauacgcaguugagggaugcuuuaucauaaagugcaaagaauaaggaaaggcaaucgaugauccuggauagguagauuuuagcuaagucgucuguguauaugucuugauaacuuuuacaaaguccucuugugcuagacaucuagaagucuuccuggaucuguccuucaaauucauuccagguuuguggacucaaaauguuaguugugauugcuccaaaaacauguuacaacugguuuaugggcucucugugggacauugaaguggaccauaauaucaaaauuuuuucaauguacauuugagcuuguuuugacuauuacuggaagaauaccuaaaaauaguaacauuaaugaccucuggagagggaggacugggaacagaaguggaaugaguuuacuucucauuguauacccuuuacuacugaauuugaauuguuuaccauguauauuuaucacauauucaaaaaaaucauaaaagagaacugaagagacauuuauuccauaagauaaagaaauugucagcgucagcauauaaaagagugauuuaauuuauauuaauaaccaaguugacaacuuauuauacagugguggcagcaaucauaacauuaaauuaauuuugucuuucaaauucugagaaaaaacaugagguuggagaugucuucuguauauccucuaaaaauuuugccucuuuuuuuuuccaguuugcagcucaccuugugaagaugaaauauccaagaaucuguauucuagaugguggcauuaauaaaauaaagccaacaggccuccucaccaucccaucuccucaaauaugaagaaccaagagugugacugccaaaacuuaguguggcaucagcaccaacagcacaguucuucauauccacgccacucucagacaaaacuagauguccagauuguugcauuuccguaaaguuugucacgagacauuuuuuaaaaucucauaacccacauguucaguuauccaugcaagaaacuugacucuacauguauugcugaaagaauuuucuuaacagugaaaucugaucauauauuuuuaccacacugccacauaaagcccaagaaauucagcugacaagacagauuuagcauuaucaagaaaucccauuugcccugaaaaagcuguccuccauuguacugaacagacaguccugucgauuguguuauuuagaaacauacacugaaugugggcugaaaucaucaucuuuccauaaugaaaacugagaaacuauucacaaugcauuccuuauaaauaaaugcuacauuuaguaacucauuucacccaaacaag

SEQ ID NO: 191339 - RNA, 133119 nt, Homo sapiens
uuagagugcauuaaauaaauauaaauuuuauuaaaaacacucacauagcauuaucaggaaugauauaauaauaaacagcuuucaaauaaccugcauucauaacauuacaauacuuacaguauuuauaaccauccucagaucuuauaaaccaaacaucucaugaaaaugaaaugaaacuaguuuuuaaaaaagcauagaaaaaugcacacagaaguuaucuuagugucaaacugcaaaaguuuccuacacaaguuaaccacuagcuucagaagugaacuguacaucacugugcgucaaucaagaugaaaaauucauucaaguaaaguugacaccacucagaagcauuuucaaguauggcuauauagucaaccugauauuccuauauuagcaaauuguagaucugcuuuccauucauucuaacugaggcagguuuuauauuuacaauuauagaucugauauuuacaauaugccacucaauuucuucucuuccuuauguaaacucuccccaaccccccaaacuauacuuccuguucuuguuggccagcaguuuaacaaaugacaguaggugacacagaaaucaaauauuaagaauggaugaucaaaaucaccaaugcacauguaguaaucaaauguuuggggcuagauauuaugguauacaaaaaacauuaaaaucaugugguuuguaagcaaagcaaacauuuuuggaaauguuugcaaauuggacacaaccacaaauucaagaaauuuuuuaaaaagacaaaagccagcuuacaaagauuugaccaauaaaacccaaaggccuccucugauuaagaauuuauuuuaaauacuaguaagcaaaaauguauuuaggccaaaauguaauuguacaaucuguugcacaccauaccuguagguguuugccuguuuaagggaaguccacauggaguauguaccuucagugauuacaggaucaaaaaaacuucauuuagagaguuacaaguaagucucuggccaacagccacuugccaaacuccugccuuacaauuuuucccuuuaucaacucagugcauucuauuuucauguaauuuuuuuuuccugcuugaaacagucaaaagauuccucaaacuuuuaaaaugcuuuucuuuacaauaaaaagagccaacagauuuacaaaauuaguuuuaguuacaucagcacauguacaaguaaaauagaagggauucaaaauaaaaggguuaaaucccugacaaagaauauauuuauuaaccuacaacaauuuuacauaaacacaggugacauguuggcauagggagagcaugagcugaaauaucccugaauuuuuagaacaaaaagguugaaguucaaguuauacuugcuaagaaaucaaguauugaaaaaagguaugcuuuuuuuuuuaacaauaaaaaaaaggacuuggaaaaaaaugaugguacacaaugcuuucacucucaguucaauauccuauugccaaacuaguguugagguauaugacaaguaggaacaucacucaaacauuuaaugaauucuuagcucacauuaugauauauuuguagcaggcugaguagcaccaucaugaugugaauucugcuucaaacucauauauauauauauauauauauauauauauauguauauauuuaauuuuuuuacaguacuaaaauacuaaagcauugcauuaaaaaaguuuuguuuacaauuuaauuuacuauacaacucuuucacuucuuuauacaaauuaaugauuuaaaaccaccacagcaaaccagcugccuguuuuuguuucuuuuuaacugacagauucacauggaacuaacccuguuuauucaucuuaugcaggcaucagucugcucaauccucuuguuaaagaggacacuuaagcuaagaaaugacaacgucacaauguacauaauuaucaacacaaaggcagacugccauucaguucucugaagagccuaugauccauaaaauagcauaggcuucagugaacuagcuuuguugagucugcagcaugcagcuaauuauuaccugcaguuaauagaaaauucuuaaaacuguacauuuuugagcaaugaacuugucauacaauuuuguauaaaacuguuuuacaguauagcaugugagaugagcaccagaaaacauguuuuguggacuaacguauucccuugaauccaguaagccccaugguggauuuaacuggcuguguuaaaaauggacacaauugcucaucagcagaugcauggcuaaaagcaaaaauauuuuaaaagcuuucuuuguuuccuuaaaaaaaucaacuuugcauucuaaaaugaaaguaaacuuguuuuuuaaacaucucaguaccuuagcauuguucaaguugucaaagcuuagguagacaaagugcuucuaaaacaccauuuaaaauauuuauacauauacaugugugugcacauauacauguuuguguauauauguacauauauacguuuauuguccuacaaggacuucacuggaugagcaaaauccagaggccuuuaaaauguccacauuuuaaaaacuaagcuuguguaagaauagguaauuaugauaaaaacuugaaugaaaagguaccccuauuauucaagggcacuggaguacacugauagcaucuugaugauauaaaggcauuaaauuuuuagcuauuaaagacaccauuuucuuagcaccauuucuuagaacauccaaacaaauucaguguuuuccugcuauucauguuuccuguagcuauuuugauaaauaaaaguuaagauuacaguaaaaacugcauuucaaaaagccauaauuccaguauuucaguacaucauauauucagcaccagaugguauuuuaagauuccugucacuguaauacuacaguacuuguuugauuuguguuccaugacuaugcaaacuugauauuauuaaaaguggucacagauguguagaguuguaagcgggggggggggaucacauuuacauaucaucucguccaauaauagaaccaguguuuaaaaauguaaauugcggaacacuuucuuccccaccuucuuuuugcauagaaugcuuuggucuuuuccuagaugccaucugugaccacuugggagccagugaaaauuaagugcuaugguaagauaaccucuuuuguugcuggugagcugagguuuuucccaccacauuugucaugaauacugugaccuuuccccacugcccacgucaugagaacuauacuacugacagguugguuguggucuuuucaagugagguaaccaacaaaagggggugauaucauauauaucuguuguaaggcccugugacccgagugaaggcauauggagauguaguuacuguggagucuguggucacggacaugguccuuucggcaagagacuugaugaaacgcagguaagugggcucugaaguuucauguggcucagcaggcucccguuucacuuuuuugccaugggauuucugaggcacauagucugggccauacuuuucacacucuuccucuuucucacgggcuuuuucagccauuuuggcuucccaaagagccaagccauguuuuggcucauucaugcucuuaugcugguaaaagacgagggagauccugguggggugauuccuauugggauucuuuaaagggguuguggcaugcagcucacgcuuugcacacucaaugagaauugacccaugaguuggagccacggccacucccccaaugucaggauccagaaagcucugcucgcugucugaccagaccucaucguuguccucugcaccagaagccacacccuggacuagugccaauggcugcuuuuccugaccauuagcaucacuuaauuuguguaagccuccuuggacacaagcaguucuaucaugguuaagagcuggaagcaucuuugauaacccauuagcugugugggaaagcaugucauucuccuuguuuuggagaugcagggcaugaagagagcuguugaacaugcccggagcugcacuguaguuauggauuaugugagaaggugaaugauguucaccauuuuuauaguccauguuuggauugcucagauugggugguaaucuagagguggcucccaugaaguggccauccaucucaugagugggauaaggaggcaauuucccuacaugauguacauuuggucuaaugguacaacugcugaaaccaucucccugcauauuuugguuuccauaaccuaaguauuuagauguaaaacucuggcuauuuccaaaccuuggcugguaaaguguauggaugggugguagacugagcuuagacagagggucuuggcuuggauaccuauacagauccaucggcugagacuggggagaauaggaacccagauauggggagcaguuguccacugauagguuuccauugcauugauaugauggauauuggguauucugauucaaaagcccaggguaaggguucaugggauuagaagaauucaaauaugaaccugcagcuugagaugagguggaauagaaguucauagggcuggugcuuccauagauaucugaagugugugaagaguuuggauaaggacuaacuggauugggccgucucauguauggauugguggauccagaagcagaauaagaguugacagacucugucugagggugauguggcugcugcugcuggggucucugcugcugcuggggcugugguggcugcuucuguagaggcuggggcugcugggacugcugcaugacugguccugaaagucgcaaaaguucuguggacaggguaagagagaacagaaacagguaucuuugauguugaugauuauuuuaugaaggcuagugaggauacuuaaauguagguaagaaacuccacuagugauauacgacacccauuaagcaaagauaagagcaaagucaggguucugaucauuguccagcacaauuuuuugucuaaggcauuagaaauacaaaacuuagugaaaaaaaaaauguaauaaacauccaaagccauuccauugagagcaaaauguucuuuggaacuucugaacaugccucugcuugaagugccucccuuuuccucccucucucccuauccuuccuugguguagucaucccuuccucaagggaccgcuuugaccucaucuucuagugcuuuuguaauacucaacugcaaagauagaucugauaaagcaauacucacaauguauuauaguuauguuuuuagcccucucuucacccccacugguaaguaaauuccuaaaugggaaggaaaauguuuuauuuuacuuacuucuucauugccuggcaugcaauggaauuugcuaaauaauuaaaauaagauuuauuauguaagauucgggaauguugugaaaaaaaagaaugacacguauuuaaacacaaaaagcaucuuauauaaucaacaagugcuacuuuauaagcaggcuuuccagaaaggaaguuaacacaguuguagauaacacuuuaaagaaacuuucagcuuuguaaaugaaacuuuuaaaagucauacuucuguuuugaccucacuuuaaaaagucauaugaguuaagaacaaauagaugaaacugcaauggcaguucugagaacagaagggauuauuaccugcagaagccaguuaaaagggagcagagacaagguucuaucuaauuauauuucacagcuaaccuaagugaacaguauuuacuuaguguuaagucaaccagucaauaaacacuuaucaagcaucuuuagcauauucuaaauuauuuaacuuaguuccucugagcuuggaaaugaaucaguagagaaauuugacuucaugaagcagcaaagauggcuaguuuuaagcaaacugguuugcuuuuguuaauggccaggccaauaccaucccaaauuuuggauuuuuuuucuuuuuacaaacugcagacauaaagcaggaggcuauggaaagacaauaacuuaguauucaugaauaauguucuauuguuauuacuacagcuguaaucuauuuugauggguaaaaguuuuguagcauaaucuacauguagaaccccuccuaaaccacagacucaacaugucuaaggaaaaauguuucauucuccccucucucucucucaaucauauuuucaaacuuacuuauuucaauaaauaguacuguuuuagaaaccuaaaacaguagguuaaguuuagguuuaaaacuuuggggucaucuuuaaacuuuucuucucuuucauuccaguguuuugucaccaauguauuuucuuuuucccauuuuggaagagcucauuugcaucauuuugcuauaucuuugcuacuaaccaacaaaauucaaggucuuguuaccucaguucugguuuacuguguuuaucuccaaacuauuagcuccucuacuaauuuggccuacugccaaauuacaaugaauuucaucguaucacuuaccuguuaaaaaaaguugcuguuuauuauagaauaaaauccagacuuuuccauguuuuccauguugauggugcaauaucucauuaccaucucugagaacaaagccuggcccuugcuacuuuagagaagacucuggcacagaacuaagaccaugauugauauaacuuuccaaaauuaacaauguucauuuuacaauaagagcacauggacacauggugggggaguggggacaacacacacuggcgccuauugguaggggugcaucaggaagaugcugggcuuaauaccuagguaauggguugaucugugcagcaaaucaccauggcacauguuuaccuguauaacaaaccugcacauccugcauguguaccccagaacuuacaaguugaugggggcaaaaccaaaauaauuuucauuuuuaauauaccacacaacacauuuaucuacaaaugcuuuacauuaaauuuaccugccaacuguuuagccuggcuugcguuuucaguuuguuuuguacgugauggggcugacuuuuccuuuucauuuuuauuugagcuguucuccagggaggaaagcuuuucagcugcagcuuucuuggcuucuaguuuccuuugucggcaagucuugacuggcucugcuaacauccugacuuuucgccgaaaagaacucaguaccugaauggcaccacuccguuuuuucuccuccugagcuuccacacucccaaacucauccacgucagagacuuuguauaaaggcagaacgugaagcugcucauccucagguuuuccuccaaauucucgauugucuucucuagugagagugcauaccugguagggaaguaagacauuacagccucaacuacaggucccaaagaaaacguguguguguguguguaucuuucuccucucaguauucagauuuguguugguggccuaguugauccagaucagugacauauauauuaccauaaaaccauccuaccuguuauuaaugaaaauagcaacaaaaugguacagggagauaagacaaauugacauugcccacccacccuuucucugagucuaucaggaacaguuagcuguggugacccuuguucuucacauauguuucugucuaugggaagaagcaacacucccccaaaaugaagcacucucuugcuuuucacacuucaaaaauagaugugcuagaugugaagccucuucaaaaacaggcuaaaaguuuuuucuacgaaaugacuuccucuguuuuugguaguaucacauuugccucaucucauacuucugaacacaaauuucaugucuuuucacauaccugacaccuaacucucucuguuuaagaaauuuccauaagauaacugaaguaaaaauauaaaaaaugaaaagguaaagauuuggcugauacagguaauaugcaacuuaauacuauuuucacucucuugucucuccuccuuuguacucugucaaaccuaacuuucucuuuucuucauuucuuuucugaaauaugaccauauaaguggguacucugaaaaggguaagggguggagggaggaaagcuaccucuguugcuuugauaauuaaaugguacuuuuugcuuuaguuacuacaauuacacuagcuuugguaaaagauuauuugugguuuuuaaauacuaacuuuuuaguauuuaguguuuuugaucaauggagacaaugugaucuaaugugaucuaaaauaaaauuagaagauauucuugagagaaaugugaucacaauggacugacuuuagaaauaacuucaacaugagaugguauuaaugagccugucacuuucugcacagaagucuucaaauucaugucucugagcaccuuguuacuuuucccauacauauuuaacccuauucaguucuuaucuagugcuccuuuccauuuuacuucacagaacccaugcucuaucagaggcaaauucuucuugauucuaaacauccuucucaucaucuuacucucugucaccuuccuggaaugaaacaugguuauauuaggaugcacuauagccccaguuaucauuuacuacuucugcuuuucagaaacuagcauagccuccuaauaaugagcaggugcugaguacaugauuagugaugauuuuagauguuggggugguugguaggccuuguguuuguucuucuggaucagaaguuaggaaaccagaaccuacggcuaaugugccucacagcuuguguuuguauggccaguaaacuaagaaugguuuuuacauuuucaaggaguuuuuaaaaaacaaaauaaacaaaaaaaccccaccaaacaaugugacagaaauccuauguggccugcagucccuaaaauauuuaccaucuugcccuuuauagagaagaguuuuccaaucucugaucuagaacauuaaauuaauaucuucucugcuucucaacaaaaacuucacaccagcuucuucaaauuacuucagcuaucaucuaauaccuccaugaaugcuuuucugcccuagaauaugacuuuaauuccugauaucuguuuccauauucucacugaccaucuucuucaacuacaccuacauccauguugauaauucauuagguugauugauucauaguuuuuucaacagaauauuuuguucuuuaucucuacucugggucaccccuuuacaugcaaaauuauacccugaacccuuuguugguauagaacauauauauauauauauauauauauaacauguaucuauuuuccccucaccacugccuccaauuacaagaccgauccauuuuacccacuguaauauguagucaggcucuuuugcacugugaaucuuuuacaauagguuaccacaguuacugugacaaugaugauguguuucucauuuaugcuucucucucuguaaggugaauaugcuucucucucuguaaggugaauggcuuguauuuggcuuuuugcuuaacugauuacaaucuaccagguaacuggcacugaauuuugagauuuuccuggaaguuaacuguaacuggcaaugcauagucacugguuuagauuaacaccaaggauuuccaugauucucaugugcuugucaacacaauugacaggaaacuaaugugccaaccuaucaugagagugcuaguuaugccaaagcaggucacuuugcaacaggaauucauucaugaaaauauugcuguccagugaaaccugcagacaacauauuacucuaaccgaaugcuacuaaauuccaguguucugcuccucaacaugagaugcugcugauauggucuggcugugucccuaccuaaaucucaucuugaauuguagcucccaaaauucccauguguuuugggaaggacccagugggagguaauugaaucaugggggcagaucuuucccaugcuguucucaggagaguaagucucaugagaucugaugauuuuauaaaggggaguuccccugcacauguucucuugccugccgccauguaagaugugacuuugcuccucauuugccuucagcuaugauugugaggccuccacagccauguggaacugugagucaauuaaaucucuuuccuuuauaaauuacccagucuugcauaugucuuuauuagcagugugagaacagacucaacagcugcuaagcuguccucagcccaacuuaccaaugugcugccauucugcauguugugcaagucucugugggcaugagcacagaaguccaaacaugcagugaccccugagaauggacggccuuccuucagacccagacggcacucuggugcucuguguucauauucaaucugaaaaauaaaagugugugugaaugcgaaaguaguuaguuuuacucuuacaccgaaaacucacuaguauuuagaccauuuagaacuuuaaaaaaauguuuugaacuuaaauauauauccagaaacaaaauggaaugacacaaaauagagcaaauaucuugacaugguaaaauuuuuauuuuauaguguuauugaggccauaaaguaugcuauuugaguuuugauauauauuugucacaaccaaaauaaaguacauauucauuacucuuaaaaauuuccucaugccccuguauaauucaugcuuccugcuuuguucucagacaacuacuaaucuaucacuacagauuuucauuuucuagaauuucauauaaauggauuuauuuggaguuaauuuuuauaaauggugugaaauuaagggucaagauuaccuuuuuucccuuauggcuuuccaacuguucagauacuacuggauaaaaugguuaucccuucccaauugaaucaucuuuguuaaaaaucaauugaccauauuauauauguugggucuacuuaaggauucucuauucugauccacuuguguauaaugguguguauguagguaugucaauaucaaacuuuuuaaaaauuuuauuuauuuauugagacagagucccacucugucacccaggcuggagugcaguggcacgaucugggcucacugcaaccucugccuccuggauucaagcgauucucaggccucaaccucccaagcagcugggacuauaagcacgcgccaccaugccccaguaauuuuuuguauuuuuauuagagauagaguuuugccauguuggccaggcuggucucaaaacuccuggccucaagugauccacccaccucggccuccgaaagugcuggaauuacaggcgugagccacugcgccugggcaauaucaaacugucuugacagacaguagcaauuauagauuucaguaaaucugaaaaccaugcaauauauagucucaaauucugcccuuauuuuaaaauauuauuugacuauuccaaguccuuugcauuuccaaguauauauauuuuacagccaucuuguccaauucuuucaaaaaaccugcugggguuuugaaacaucauguauugaacauauugauuaguuuggggagaacugacaucuuaauaauauuuagucuuuugauccauuaacauaguguaucucuccaguuacugaaguuuucuauaauuuaucucagcaauguuuuaguuuccaguauauaaucuuauacauuuuugucaaauguaugucuaagaauuuuauauuuugaugcuauuuuaaugguuuauuuugauuuauuuauugcuaguauauaaaaauacacuugaauuuuguauuucacaacuuugcuaaauucauauauuaauuucauuuucugguagauuuuuugagacuucuuauguagacaaacaugucaucugcaaauaaguacaguuuuauuuuuuccuacccaaucuugacugcuuuauuuauugccuuacugcacuuucuaaaauuuacaguuugauguugaauagaagcaguugguuaaaaauggacauuguugucuuguuccuuaucuuaggggucaaguauuagucuuucaccacuaaguauagcauuagcuuuuggcuuuccauuuauguauuuaauagguugagaaaguuuccuuuuaugaauguugaauauuaucaaaugguuuuucuguaccuacugcaauaaucauauuuuuuccuguuaugucuuuucaacaucauuuuuuauguuaaaaauaucuuuuuaauuuauuuguaucuuuauauuuaaagugguuuucuugguuuuugcuuuuuuuucaauaucacaagcucugccuuauaauuagggguguuaaaaccauuuacauuuaaugugguuguugauacaguuggguuuaaauaaaccaucuugcuauuuguuuuauuuuuauauuuaucuuuuuuugguccuauauauuuuuaaaaacauuuuuggauugauuucauuuuucugucuuuacuggcugauuagcuauauacuuuuuuuuuuuuuuuuagugguuuaagguacacaguguacucuaacgucucacaguuuacagccaaguaauauacccaguccacauaucguauaaguacuuuacaauaauauacuuucaauuccucagccucugugcuacuucuacguguuauaaaccucauaauacauuguuaauauauuuuuaagauagcaaguuaucauuuuuuuaaaagucuuuuaaccauguuuacuauuuuugauacuguucauuucauuauguugaucuggauuucugucugguaucauguucuuucuuccugaaggauuucguuuaacauuuuuaaagugcuaguuuguugguggugaauucuuucagcuuuuguauguaugucugaaaaaauauucuuuauuuugcugucuuuuuugagaguuguuuucauugguuauauauuucuggguggagagucuuuuuucuuuuaguauguuaaagauguuucucuuacaucuucucucuugccuuuuucugaaugaagucuccugucuuauuuuuucccaccuaguguaauauguccuuuuuucuccauuugccuuucugaguuucucuuuaucacagauuguaagcaaguugauuauaaauuuuugauagucuuuuuuuaugucuuuguuuuuuaaucugggguuugcugagcugcugagaucuguggguucacaguuuugaacaaaucugaaaaaaauuuggccauuguuucuuuaaauauuuuucugucucccaccuccuucugguacuccaauuacacauauauuaguguaacaauauuggcuaauaggucuuuuauauauucauuuuuuucaguuuuuucuuuauacugaaaaauuucuauuacuaugucuucaaguuccuuaaucuguuaauuccgccuaguguauuuuuaaucuagauauauauuuuucacuucuagaaggucauuguaggguauuuuaauaucuucugaucuuuccuuaucacucucaugcuuuccucuggcauuuuaacauaugaaauaugauagccauuuuaaugaacuuauuuacauauuguaucacauaugucaguucugggacuauuuuuauugauugauuucugccuguuccccaguaaagguuauauuuucuuuuuucuuuguaugccuuguauuuucugauggaaugcuagacuauaaauuuuaccuuguugguagauuuuuuuuuuaauuuuuguacugugaugcaguuaaauuacuuagaaucaguuuggcccuucuauguuuucauuuuaagcauuuuuagaugaggucagaacugccaaauuuacuucuacuaccaaggcaauacaauuaugaauaguauuaugaagucuucuccgucuggcugguaugaucaagaacuauuccagguccugugugagaucaagggauuauucugccugcuucuucugaugguucuuucccuaccuagccuuggcaguuuuuucacaugcaugugcuguuuaauacucagcugaagacuggaucagaacccucugcaggucucuggagcuuuucucaauaacacucucuccucucugauauucugaauagugaacucucgucaccuuggccucuccaaauuuugaacuuugucuccuuaauacagagauaaggcuggguguguuuggguuccuacuggcuacacuggagccuaauacucucuucaggaaguaaacugggguauuuauagguucaccuuuuuacuuccuuucucucuggugccacugucucuugaauuucuuauucuaugucuaaaaaccauuguuucauauauuuugucaguuuuuucuuaaauguguaacggcauauguagucucuguuuacuccaucauggcuagaagaugaacuugcauuaggauaaaaguuugugguggcuucauauuauuuacuguuggauucauauauguauuugucuaucuaaccucauaaaacuuuggccaaaggaaaaugaagguaccaacuacucuuuaacauagaugugugcuuuguggccguucaguucaugcuguggucuaguuagcuuuauucuguuucuugaacaaaaacagauauacaaucagcuagaaauuacacuuaugccaucuccuaaaaaauaccaugcaggauuuugugaaugaauuacuggaaauccaucuaaaugucuggaagacaauucuaaaugcauaacuuucucauggucuaagguugugcuguucacuaugguaaccauuauccacauguggcuguuuguguuaauuuuuacauuaauuuaaacucaauuacacuagccacguaucaacuguuaaauaauaaccacauguggcuagugccuauuacacugaacagcauaaauagagaauauuuccaucuucauagaaagcucucuuagaagcauuugucuaaaaugucaucuucauguaugauaaauagcacacgauuuugagauugacaccugcuauuucaggucuacuguuaaauuguaaggcaggcauagaaaagacagagccaaauauaugucuacuggauagacacgaagaaaggacauuuaaguugagaaaacugaagcucuaauuccaugggacugacagaagagaugcuguggagagccaacuaaacuuuagcaauaagacuucaugaaaucaaggaauaaagcaaggaagaauauucagaugugagaaauagagauacgacacucaguuggggaaaggagguaaagaucaaauaguagguuuuaugacagcaucuauaacaucaaauggucuucccguguacuguguggaaacaucacauggcuauuauuuugaucucuaaagcauauuaacauacauggaugaauauuaccaauaguaccuaccaugcaauauaaaaauauuuuauccauucagaagcaucucauccauuuacaacuauuaauugacuuaauuuaucuagacauuacaucaacacauuuucauauauaaauauuaaaacuugaacauauuugauggcuucauauuuuggguacuuaaguuuuaggaaauguauaaaauaguuucaaguaugagacgguccauaauaagaaucaagggagcaaaaagaacaucaaugcuuuguuauucugccucaaguaaagccauuugauuaacagcaccuauuaaaaauucauuuaauagaaaaugacccaacuuuaaaucuagcaacauagacucauucauuuauuuauuuuuauagcuugauuuauuucagaaguucuugcugagaauuaaacuuuuacgacaguaucaaagcacuccuuauacuuugugauacuagcuaaacaaaauaacaguauuaauccaacuauuaauaguguuuaaaaacuuuucauagauauucauacacauuucuaaaaacauaauuugacauaaaauaacuuacaaauagaccaucguuuaauuugccucuauuguucgaaccaaaaaaaaaaaaaaauguuugggacguuaaaguccacaguggaaaagaagaguagcuaaaucauuuuaggauuagucccuuguccaugucugcuguguaaacuaaucuaaucccacgagagucuuuaauauuaucaaguaaaugacagagcacccaucccagagccccauaccuauugcuccuguauacucugcucugggugucuucucaucauuccagcuuuccuccauccauccaucucccucuuucacuuuuccuacuacauuucuucuacucccucccccaguucuuacuucauuggcuucucuuccuccacucaugccuaaaaugauugauggcuccagaaucccaucaucagcccuuuguccucuuuauaaucucuacuuugaaaaccuccuuucauuccuauguauucaacuuuaaguccugccagcauucugacucucaaaucuacagugcuagccugaauuuuucuccugauucuccaucuaauuaaccuagaagccuagcauguccaaaauuuugauaucuucuccccaucccaaaacuuacuauuucuuaccaauuucugauacuaguuaauagaacuaccuguccaaacuggaaauuuguuguaucuccaaauucuuuucucauccauacaucuagucaccaaguucucuaagcuccaccuuaguuaguguacauacuuaauuccugccauuucuuuagguccuuaaaaucucuugcccaaugauugcaauagcuuucuucucucucuaaucuuacauagauuuaaguuauauuucccuuacuuggcuuuuaaguaaauuuuucaaaauacgaauuacaucacuuuacccuuccauccccaacacacacuugaaacagcccaaugguuaccuacagaauaaaguucaaagaucuuuauuuagcgucuaaggcugcuugugacaucuagucuacuuuuggguuuuguuuuuaaauuuuuuuagaaaugugcacauucuucuauuccagcuggaacuguguaauucuaaaauugcuauuuauuuuauaugucucugucuccacuaaagaaggaauucuuuuguuuuuugcuuuuuuuuuagaaucugggucaucuuugucacccaggauggagcacagugaugcaaucauggcucaccgcagccucagacuccuggucuccuggguagcugggauuacaggcauaaacuaccgcacccaguuaaagaugaauuuuuuuuuuuuuuugagauggaguuucgcucuuguugccuaggcuggagugcaaugguuugacuucggcucacugcaaccuccaccucccagguucaagcuauucuccugccuuagccuuccgaguagcugggauuacaggugccugccaccacacccagcuaauuuuguauuuuuaguagagacaggguuucuccauguugaucaggcuggucuagaacuccugaccucaggugauccaccugccuuggccucccaaaguguugggauuaaaggugugagccaccguacccagcaaagacggaauucuuaaagacagacagagauggcacugcucaccuuuauguucccagugacuaaacacaguguuuaguuuguaauagacuuucacuuaaugcuuuuguuguugauguuacugaaacagugaagauuuuaguuuuuugccuucaugaugagagauuucugaccaaaucaucuaccugucuuaacuagcuauaguuuagaauacacauguaaaauagaaaaaaaaaauguuuuugcuugguguaugaagucaaggucaaacaaaaaaggaagaucagcaaaaucugacacaucuggaccgaaauauauauacuuacaauguuaguauaugcauagcuuuaugugaauauuuguaagucuauaaauucuuaugaauacucauuuauacuuauagacuugcaguaaaaauagguaguuagaaccuauagcuugggccacauaauuuugauguaaucuccauagucuguuuacagaaacaaaauuauucauaugagaacaagauuaguagauagaacagccugugacuuuuagaagcgcaugucuuuacagcuaaaagacaaaaaaaauguacuuuuguaugguauaauuuuuauauacucgaaacugaacacugcagugguuucaacaauuaagaggaaaaguuagaauaauauuuaaaaaucauuguuucaaaaauauuuuuggacauaggucauuaguaacaaguaaguuguuacaauugcugccaaugauuauuuaaacuuaccugauuauuauaugcaucaggugcaaguuucuuauauguuggugccauaagaguggacagguuuugcaaaugagacuccaguuucucuuccuguauaaagugaauaauucuacauauuaaauucuaaguccauuuucucuauguaaaagagacuaucaguuagauuauuccccuuacauuuugaaucccaaacacaauauauggugccuuuauuacuaaauaaagcaucuuuaaaacaugacuaucauuuaauuucauaugugcuaguaaauaucuagcuauuuguuuuuuucauaagauugauuuucuaacugcaugcagauauuuugcauuuuauacacacaagccugugccaggaguaggguuaggggaauuaagccguauggucuuaaagaggucacauuuuuuagcuaccaaggaagaugaacuauuaaaagaacuucuuuagcuuaauuugucuauuucuaaucuuuacauuuuauguuuauaaagauaguauuuaaauaauuuggaaugaucucuccauagagcaacuaaaauuuacuggacacuucaaauauggauaaaaugcuucagaacuagaaugcaggauacaugaaaaccuuugcagaauuuacuugaaaggggaaaugcucaguuacacccccaccugcccugcucaugaagaacagauuuuccaaguaauauacuguuaaaaaaugguaggugaucauauuuagcugcuccauuuauacuuagaagucuucauuucagauugauauuucucuaaaaaaaaaaaguugugagacauaaccaccuggcagagauguaaauuuuagaaggugaggagguuucugaacagagcucuccuacccaacagaggcaauaaguuacuugguauccucuggauuugguuuacaugaaaccucgugaaagugauaaacauuuaucacuugauaaaacagugguuaaaaaaaaaguuaucuguagaaaauuaaaaugacagcaagcaaaaucaguacuuuucauuaaguuauuaauauucauauucuugucuuaugaaaugaugucucgcacauuuaaguaaacuuuaauuauugaaaacauccuuuaaaaaacuuauacugugauuucaggaguuuuugcacuugcuuuauuaacugugacuauaauaguaagugaaagcuuaauaagguuaacaaauucuucauuuaaagggacucaucaauguuauaauaucuauaguauggaaauauuuuaauuguauucgaaauucaaaagauaauuguaaguguauagaaugacugaaaauguggucauagcuaaaugcuaaauauacugagguuuucucaucauucaauuaguacggagacagucccugaccuauaauggcuucguuuuuuuuuuacuuuaggauggguuuauuggggguauuaaauggauuuucauuuuacaacggauuuauaggaauguagucuccucauaagucaagaaguaucuauacucuagacuacaugccacccaaaaguuguuaaauuuaucaauuugcaaauuauaagaaauacguauucuacagacaagacaaaaaccaaugacuucagugagaaauuaguguccauuuauuuccauuacagaguuauauuaaaaucuaaauguuuuaguuacuuaaaugcauucauuacagugacuuuauuaaaugcauucauuacagugacuuuaaauuauuugaaucucauugcacauaaaugugacuaaaaauggucuuuucugaauguaguacuuauguaacuuccauaauucagagucaaaauaugaaaaacaucaccaauucucauuuaguuuuaacaaugaagugacaccccuuuaaaacuuuggaauuaacauaaaagaccaaagaggaaguuuuuguugcucaaauuuuaucuauuauuuuggcauaauaugauuauuaugccaacuuaaaaaauaguguguaucuacaguuugggaaaaacuuugauuaauaagagcuuaccaagauaugucauauuguucacuucaucuaagcuaaugaauucucuaugaaaaauaaagcgauuauacaucaggaaguaaacaaaccucuuuugggucauccccaagcagcuuaaacuuccuugggaucuugcuucuggcaaacuuacauccauuguaguacaugcuccaugaacaaccaaaagagaaggaggcaccacagguuucuggauccagccccugacaggcgcaaguucuccugaaaaaucaaaagaccaaauucauugcuauggauagcauuauauaggcugugcagcugauauuauaggugucuauaugcaaaaugaguuugaaaagaagucuaaucuaacucuguauuaagcuguggcauaaccacacacagaacuauuucaauugacuuuuaaacaauuuuauugcaauguaauacacauacagaaaagugcacauaauuuuacaguuuacaaauggaaaauacccaguuaaguagaacccacacuaagaaacaaaauauuuacuauccccuggaauuuccccucauuuugccuuucagucacucacugucugucucccuaacaguaacuucucuaagaauauaguaguucugccuauuuuuauguuaauaaugcuuucuuuuuuacagauggggucuugcuauguugcucagguugaaccugaacuucugggcucaagugaucuucccgccucagccucccaaauagcuggaacuauaggugugugccaccaucaguagcuuguuuugccuacuuuuauacuugauauauacauagguauauggaauuauauaauauaagcuuauuugugugugcuuuuuccauuauguuugggauauccauccaaaucacugcauguaguuguacuuuauucauuuucauugaguaccauauuccaucuuauaaaaaugugaugaauuauucuaccauugaugggcauuugagugcuagguccuaguuucuggcuaaaauauaguauuacagcuuuauagcccuaguuugauacauucuaaugacaauaaacaaacauacaaguaagcaaagagagauaaaacaacuuacaagaaaaaauauucagguagcacuguaaauuauuuuuaaauuaauguauguauauugugauauaaguaaauaauuguuaauaucaaaaaccaagaauuucaguguacaagagaagcagaacaaaagauaauaauacucugucaacuaugaauaggaaaaaucaguaugaauuaaugauuugaguuaaucucagauuuucuuucuaaaaaauaauuacuucauguauuugcccauuaaaaaagccuaaaaguaaugacaccuccauagcagggagcacaucuagacacugauugugaucucuaaauauaauuucccaucaaaaucucugaaauuugagaaguaaagauucuugccaugcauuuauucuaucauucuuacaaacuauauuaaaugguaacuaacgguugaugaggaaaaguccuguaaaguauuccagcuaauaaaugcaaaaggaauuuuacaauuagaaaugaucacuuuacacaugucagcaaaaauggcagaauaaggaucucugaaaauuuuauccuccauaaaagcaauaaaaguacugauaaauauugucagaaucagcuuuuucagaucuggaaauuagcaaaaagcuugcagcaauauagggagaauuuguucaagggaaaaaaagacaggauuucagugagaagagugagcucugugguauuuuaacuuuccccacagcucuaugguagccuucaaaucaaaacagcccacauuuauuaugaaaagcagcagccaggcugccacuagaggaggccagauugguuggauauacucuagacugguuggauauacucuaaagucccauucacagagaccuuacauuauuugaccuguuugguaguuuccuggaagaucccacuaguaagguuaucuuuacuuuaucuaacuuggaguucaccuagugugaaccaccuuuuccacagaggcauuugucaaauaaucauaggcagcuguugaauauugucacugacucagguguagcuaauaacuggagcaaaacauaagauaacuaaaaaagcuuaaaaguaaauuaccugggaaaugagaugauccacaggaggcuuugaaaauauauuccugggaauuuagaaagccacaugcaacuguagggcccacaaaagaccucagaaagcccuaaacucucaccacagucuaaccuugagacucugcacaagcagggaauaaaggcuaauccagagcugcaaauagccuggcugaguguugaaugcaugccccaacacacauacagaccccuuugucaaagacugacuuauugaucucaggcaccuaaggaauucugucuaauccuuagcugaccucuaaguuaaccaagcaaagacuucgauggcuaucuaugagaaacaauacaaacuuuauaggaguaguuaaaaagaaauaaacaacaaccaccagaaacaguaacauauucugggcaggggguagaaucugauuuucagauuuaccagauuauauuauuuuauuuauuuuuauuuuuguagagacagggucucacuaugcugcccaggcuagucuugaacuccugggcuuaagugaugcuccugcuuuggccucucaacgugcugggauuacaggcacgagccacugcucucagccauuacauuaguuuaaaaugucuaaacaauuaagagaaacagaaacaaaguauggccccuauaaaguagucaauagaggcuauuccugaaaaaguccagauguuaggccacuggacaaagacuuuaagucagcuauuucauguaugcccaaauaaugaaagaaaacuguauuuaaauaacuaaaguaagacuacagcauuuuauuaaauacaugagauaaacucaagaaaaagauauuauuaaauagaauucuaaagcugaaaguguaauaacugcaguaaaaauuagagggguucaauagcagaguugaaaaggaggggaaaaagggacuugaagauaagucaauugagauuauucagucugaaaaaugaaaacauaaacagaaccucagagaucuguggaagaccauaaagcauaccaacauagacauaaugcagguccccaaaguagaggaugaagaauaaagaauaggaagaauauuugaaaaauaauggccgaaaacuucucaaauuugaugaacaacaucaaucuacauguccaagaagcucaacuaacuccauguaacauaaacccaaagauaugcauacauauaaacaucauaaccaaacugcugaaagccaacacaagaaaaucaugaaaacuguaugauuaucauguaugcaggauucccaauaagauuaauagcugaucucugaucagaaacaaugaagaccagaaggcaguagaaugacauagaaccacaagaaaaagacugccaaccaagaauucuguauuuugcaaaacuaucuuucagaaauguauuauauaauaaauuaggacauucucugauaaauaagaguuuauuguuuucaggcauguccuacaaaaaauacuaaauguauacuucaggcugaaaggaaaggacacuagacaguaccucaaauacaccuaagaacuuaaagagcaccaguaaagauaauuacauagguaaauaugaaaucauauauguauuuuuuuguaacuauuuuucucauauuugauuuaaaugacaauaucaaucugauuuaaaagaaaaaacauaaucuguguuaaugggcauaaaauaaaauguaauuuguauaauagcacagaguaaaaagagggaauguagcuauaugggaacaaaguuuccuuauauuguaaugaaauugguauuacuucagacuagcuguuauaaguuaguuguaauccccagggaaaccauuaagaacaucaaaaaauuuaguaaaagacaagggaauuaaaacaguacacuagaaaauaucuauugaacacaaaaaaagacaagauacagacaaaauggcagacaaauccuaccuuaucaauaauuauguuaaauguauauaaauugaaaaauuaaaaggcaaagacuagcaauaucaauuuuuaaaaagauuuaacuauacgauaucuacaagauauacacauuuuauaauaaaaaguucaagccauuaaaaugauguaacaaauguaaacauacauguaauaagcaacagagcaccaaaauacaugaagcaaaaaauggcagaauuaaaggaauaaauagauaauuuacuaauccacuuucaauaauggcuaaaaguagauagaagauuaaaaagaaaacagaaguuguaaaaaacacuauaaaccaacuaggucuaacagacaucuauaaaacaugccacccaccaacagcugaauauacacauucuucucaagcacacgugaaacauucuccaggauggacuguaugucaaguuauaaaacaagucuaaauaaauguaacacugcaaaaauugugcaaaguguguuuucugauaaaauuauacaugaauaacaagcaaauuuggguaauagguaaaaauauacuccuauacagucaggaaucaaaaaaacaugauagaaauuagaaaauaccuuguuguaaaugaaaacucgacauacucauauuuuauuggauggagcuaaagcagagcuagagaacaaacuucuagaaaaacacaaacuacuaaaauugacugaagaagaaauagaaaaucugaauauaccuacaacagguuaaaagauguaaucaagacuacuuagaucugucagagaaaugaggucacagggaaaaucacugcccucacaaccaaggaagcagauggauaaaaagaauuacagcuuacuggagcagaaaccucuguaggaaccaguguugggauaggaaaaucugaaauauaauugaugaauugcuggagguucagugugaacaacuccaaaggcauccagucauaauagguuccucacaguuuugugaguuuucuacauucaggagccagaugagguucucacaaugaauacuagagaaaaaucccuucaugcuuccauaggaggaggggaaaacaauuuuugaaaaugccauauaccauucuauuguuccuaaaaaguucugccaucaggcuaggugugauggcucaugccugcaaucccaucacucuuuggaggcugaggcaggcagauugcuugaguccaggaguucaagaccacacugggcaacauaggaaaacuccaucucuaauaauaauaaaaaaauuagccaggcaugguggcaugugccuguaguccgagcuacuugggaggcugagguggguaaaucacuugagcccaggaagucaaggcugcagugagcugagaucauacuacugcacuccagccugggcaaccagagugagacccugucucaaaaacaaaggauaauaaagaaauauuaugaacaaaugugcccacacauuuaauaaucaaggugaaauggaccaauuccuugaaggacacaacuaccaauauuuaugcaaaauaauaaucuaaauaggccuauaucuaugaaagaaauugaaucagcaauaacuuuucaaaacaaaguaccagacacagaugguucauucugauuucuaccaaaguuuuaaggaagaaauuauaugaauucucuacaaucucaauuaagacagaagcagagaaaauacuucauaacuuauucuaugagggcagcauuaccuuaauaccaacaccaaagucuuuacaauaaaagauaacuacagacuaauagcaaccaugaccaugaaugcauucauaaauaauguaucacaaccaugugggauuugcuccagguaugccagucuaguucaaaauuugaaaaucaauuaauguaauccauuucguuaauaagcuaaagaaaaaucauaugguaauaucaauagguggaaaaaaaguauuuacaaaauccaacacugauuaaugauuuucaaaagccucucaguaaacuaggaaaagaggggaacuaccugaaccugauaaagaauauauacaaaaccauacagcuaacauauuuaauguaaauaaagaauaucuacaaaaccauagagcuaacauaaaauugaagauuuccugcugagaucaggaacaaggcaaguauguugccucucaccaaugccuuucaacaucauacuggaaaugcuagcuaauacauuaagacaagaaaauaaaagguauacagauuagaaagaaguugucuuugcuagaugacaugaucaccuagaaaauaugaaagaaugaccaaaaaaaaaaaaacuggaucuaaagugauuauauaacaugguugcaggaaacaaguuuaauauacaaaaguugaucacuuuucugcauaccagcaauguacaagcagaaucugagauaaaaauacauuaccauuagcacccccccaaaugaaauauuuauguauaaaucuaauauguacauggucuauauggggaaaaugcaaaauucuaaugaaggauauccaagaaagagauguuccauguucauggauaggaagauguguauugucaagauggcaguauuucuaacucaaucuagaaaugcagugcaaucuaucaaaauuccugcaagauuuugaggauacugacaaaguaauuuuaaaguuuauaucaagaggcaaaagaccaauaaaugacuguauauauagccuuuucagacugcuuuuuuuacuuaguaauaggcaaaagaauagccaacucaauacugaaggagaaaaacaaugucagaggacugacacuacaugauugcaagacuuacucuaaagccuaaguuaacaagauagugugguauuggugaaagucuagacaaauauaucaauggaacagaauaaagaguccagaaacagaccacuuaauuauaaucaacugaucuuugacaaaguagcaaagguaauacaauaaagcaaagauagucuuuaagaaaugguacgggaacaacuggacaacuccacaugcaaacaagugaaucuauacauagucuuuauagcuuuugcaaaauuaaugcaaaaugggucacagcccuaaauguaaaaugcagaacuauaaaauuucuggaagauaacacagaacauauagaugaccuugguguugacuuuuuagauacaauaccaaaaacauuauucaugaauuaacugauaaccuagacuucauuaaaauuaaaacuuucuguuuguucugcaaauggcacugucaagugaaugaaaaaauaagacacagacugagaaaaaauauuucuuacucuuacugucaaucaagcuacugugcucuguguuauuuacucaaaggagcugaaaacuuuuguccacacaaaaaccuacauacuuuuauaacagcuuuauucauaauugucaaaacuuggaagcaacuaagaugucuuucacuaugugaauggauaaaucaacugugauaaaccagacaauggaauauuauucaaugcugaaaagaaaugaacgaucaugacaugguggaaaauuuaaaagcuuauuacuaagugacaaaaaccagucugaaaaggcuccauauacuguaucauuccaacuauaugacauucuggaauaggcaaaauuauugagauaaaaagaucauugguugcuaaggguuagugggguaggagagaaaaauagguaggguacagaggacuuuuaaggcagugaaauuacucugaaugauacuguaauggugaaugaguaucauuaaacauggauccagacucacagaauacauaacaccaaaggugaacucuaaacuaugaacuuucaucgacaauugucaaugcagguucauugacugcaacaaauguaccauucugguaaaggauguugauaaugagggaggcuaugcacauacaggggcagcauguacuuaaggaagcucugugccuuucauucaaugugcuuuuacccuaaaauugcuuuaaaaauaaucuauuuuaaaaauguuuaaaaauucccacaaaggaaagcccagggguagagaauuuccucaaacauuuaaaaaagaguuaaaccaauccuuuguaaacucuuccaaaagauagagaagggaacauuucccaaugcauuuugugaacucagaauuacucugacaccaaaaccaaagauaucacaagagaacuaaagaucaguauaccuuaucaacagagaugcgaaaguccucaaugaaauaccugcaaacagacuccagcaauauauaaaaaguaauacacacugaggccaagugggauuuauuccagaaauauaauguuaaucuaauguauaaaaaugaaucaauauaauauaccauauuaauagaauaaaggagaagaacgcaugaucauuucauuagauguagccacagcauuugagaaaaguucaacacccuuucgugauaaaauuauucaacaaacuagcaacagaagggaacuucugaacuugacacagucuuuuuuuaaacaaaaccuacaacuaguaucauacuuaauggugaaaaacuaaaaauuucuuucuaaaaugaauaagacaaggauguuugcaguuguuaauuguaccugacauuuucuggaaguucuaacuggguaaucaggcaagaaaaaaacauaaagccacccagauuggaagugaagaaacaaaacuaucucuacuuguagaugacauaaucuuguaugcagcaaauccuaaggaaucuaccaaaaaaaguuagugcuaauaagcuaguucagcaaguugguaggauaugagaccaauauauaaaaaugaaauuuaugaccauauauuaucaacaaaaaauuugauuuugcaauaggauaaaaaaaauacauagaaaaaauuuuaacagaaguacaggccaggcgugguggcucaugccuguaaucccaguacuuugggaggccaaggcagucaggucacuugaggccagguguuugagaccagccuggccaacauggugaaacccugucuccaccaaaaacacaaaacaauuagccaggcaugguggcgcgcaccuguaguuccagcugaggcaggagaaucacuugaacccggagguggagguugcagugagcugagauggcagcacugcacucuggacugggcagcagagcaagacucugucuuaaaaaaaauaaaaagugcaggacuuuguacauguuucauccaaaacauuacugaaagaaauuuaagaauaaauggaaaaauagccuguguucauaaauuggaagcuuuaauguuaagauaucaauacucuccaaauugaccaacagauucaacagaaccccagucaaagucccagaaggggguuggaugugguggcucaugccuguaaccccagcucucugggaagccuaggagggaggaucucuuuagccaggaguucaaaaccagcuuggguaauauaguaagacuccagcuccaccaaaaaaaaaaaaaaaaaaaaaaaaaaaaaaauccagaaaggaaacggagaagcugaucuuaaaaugcauauggaaacccaagaaacaugguaggcaaaaguacaaaguuggaagacuuaccugucuugauuucaaaauuuacuacaaaacuacaggaaucagcacagugugguacuggcauaagaaaagucaugcagauuaacagaauuaagaguccagaaauaaacccauacaucuuggucaguuaauugaaaaaaaacagucuuuuaacaaauggugcugagaaaacuggacagcuacuugcaaaggaaugaaguuggacucuuaucucucaccaucaaauuaacucaacauuaauuaaaaaucuaaauguaagaacuaaaguuauaauacucugagaagaaagcauagguguaaaucuuucagaucuugaaugaggcaaugauuucuuaaauaugaccccaaaugcacaagcugccaauuaaaaagaaauugaguuucaucaaaaucaauuuaaaacuuuuguacuuuaaggacauuaucaaagugaagcgacaaccugugggauaggagaaaauaucugcaaaccaggcauuugacaaaguucaaguaucaacauaacauauucuuacaacucuaaaaauaauacaauuaaaaacauauaaguagacuuuucucaaaaaaauacauggucaauacacacgugaaaagaugcccaauaucagccauuaggaaaaugcaaaucaaaaucacgagauaaacuucauacccacuuggaugguuacaauuaaaaagacaauaacauuuucuugaggauguggagauacacuggaaccuucauacauuguuggcagaaauguaaaagcauaaagcuacuuuggaaaacaguuuggcaguucuucaaaaaguuaaacauaaaguuaccauauuacuaacaaugucacuccuagguguauaucccaagguaacugaaaacauguucacacaaaaacuuguacaccgauguucauugcagcauaauuuauaaucgccaaaaaguagaaacgauccaaaugucaauuaacuaauaaauggaaaaagaaaauguggcugggcacaguggcucaugcuuguaaucccagcacuuuaggaggcuaagguagaaggaucacuugaggcugaguuugagaccagccuagccaacauggugaaacccugucucuacuaaaaauacaaaaauuagcugggugugguggugcacaacuguaaucccaacuacuugggggcugaggcaugagaaucacuugaacccgggagacagagguugcagugagcugagguugcaccauugcacccuagccugggcaacagagcgagacucugucucaaaaaauguggugugaauauauacguggacaaaaaaaaaaaaaagaaaaagaaaaaagguacuuuuuuuuuuuaauaaaaugaaugagacuugaaaacauugagguacaugaaagaagccagagagaaaggccaaauacaugauuucacuaauacaaaaugcccagaauagguaaauccagagaaacugaauguuuauuugugguugccacuuagaggaaggaagaaggggagaaggggaagugacugccuaauaaauacaggguuuccuucugggaaugaugaaaacguucugaaacuagguagaggugacauuugcauagcuuugugaauguacugaaacaacugaauuguauacuuuaaaaggguaaauuuuaugguaugugaauuauaucucaauuagaaaaaaacaugggggaauaacuuaaaguugauuuucuaauaaaguggcuacuaaaagguauauuuauuuugauaggggucuuucaaauauuguuagaauuagcacaugacagucauuuuaauaugacuugaaauuuggcucaugguaaaugauauaaagggcaaauauuaaaaugucaucuauauaacagauuucugcaaaaauucuuaaccuuugauuuacuauuuggacuucuaauuguaaaauauuuuuaaaguaaaaauuaggucaguuauucaaauguauacagcauagaaaaaauagcaaaauaauuuaacuuuauauaacuaaauuuacacaacaucaagugagagaaaacugucaacuugaaaacaaaauaauagaaacaggcaaugaucaucaauugaugugaaacuaucuggugaaaguuugaugaagaacauaaugauggaucaggcugacaacuaaacaugcuaaacacucuuaauaucacuaaaaugggaaacaaacagacauuaugugucuccugauguauauaaauaagaugauuuuagcacuacuuaugaaguguuuuugccaauguauacuauacaugcacacauacuuauauuacuuaaaaaucagcugggcgugauagcucaugccuguaaucccagcacuuugggaggccaaggugggcggaucacuugaggccaggaguuccagaccagccuggccaacauggcgaaaccccgucucuacuaaaaguacaaaaaucagcaggaugagguggcacaugcuugcagucccaguuacucaggaggcugaggcaugagaauagcuugaaccugggagguggagguugcagugagcugagauugggccacugcacuccagccuaagcgacagagcgagagccugucucaaaaaaaaaaaaaaaaaaaaaaaaagaaaagaaaaagaaccagucaaacuaccaguccacagaagauacuggggauagaggaauagguuaaaguaaacaaaagaaccaagaugaaaucggccaaauccagaauguggggaauuuuacagagaaaaucacaguuucuuuaaaaaacaaauucaaauucauaaagaaaggggaagggcuauuauaaauaaaaagaggcuugugaaucacagaauuuaucuucuaaauggagagaauuuuaugagaggaaguuuuauuuaauagcuaucccagacaauggacaugaacugggaucacacuacucagaagugucaaucauguggaagggcuuucuuuuucucauuaucauuuuuguuuauguguguguuuucugaaauagaaucuaaucagauaauuugaacaaacacagucuaaauauuaaaugauaaagucuuuaccuguuagaaauacauccugaaauguuaacagguaagaugguaaguuaucugucuucugcuuucaaacacuagugggaguggaugugggaaaaauauaugaaaaaauauugauaaaauguugauaaauauugaugcugugugauggguccauggaauucauuauauugcacuuuuccuuuuauguuugacaauuuuuauaauauaaaguuccuugaaauguuuaacaucacccaccauggcagaaggcauuucuggcuuugauuuccuuaugaugacagauacacucccacaacucuuacuugccaaaaaaauacugguuagacuuagucauaaaauggaaaucucaaagggaaaucuuuaaagaagaaacagcugguuuggcucaaaggaaauguaaaaaucaguuuuuacuuuccuacugaaagaugcacucagaguucuuuucugaacucacagugggugguuuggagcauguggacacagggauuuguaagaacucagugaugagguucacacagcuuugaacauaaaacugaguccgcagccccaauuugagauuauucuauucucuguucuuggcaaaaaguuguaauuuucauuucugccagccauaaaauaaaaucuauuuaugggguagaagaaacuucaaaagcuauuucugaguaaagucuguauugacauuggauacgugucuauuuuaaucauguauuuaaguauuaaaauuuuuuauuuuggagaauugcucuaaguaugcauaagcauagcuuaagcauuaucuaaaugauuauucaucuuuaccuugaaacuagacaaaaagcaaaaguguacagcugugcuuuuaaauugucuucauauuugaagcaugucuuuuaauaguuuuguaucugccugacauuuagagcaguuaaacuaacaaacuacaagcuuucugagacucugguccaacuauuuuucaugguuuucaaaugcaaaauaauaaaaguucuucauguaauuuuuuauaugucagauuccauuucaggcauuggcauuuauaagaauuauggaaaagcuggcugggcaugguggccuacaccuguaaucccagcacuuugggaggccaggguggguggguuaccugaagccaggaguucgagaucaaucuggccaacauggugaaacccugucucuacuaaaaauacaaaaaugagccgggugggugccuguaauucuagcuacucgggaggcuguggcaugagaaucacuugaacccgggagguggagguuguggugagcugagaaaaauauuagagaucuauguuaaugaaaauuaaauucauuacaaugaaugaaauauaguuuccaggaaacuucaagaaaaucaaacauuuugcaauaggacuauuuuugaaaagaaauuuuaaaacuaucauuuucacaagagguucuucagugauuuagaaucucaaaccgucaagucuaagagauauuaugcuuuaaagacaaugcaguauuacugaguucuugaaagaaaugcuauuaccaauaugagcacaaguugccuuaauuuuuaauuuuuuuucuaauuaaaggcaccuacauacauuuuuaaaaauuuuucuucagaaagagcaagaggagucaggguagauuaaaaaaauauuucaggcugggcacaguggcucaugccuguaaucccagcacucugggaggccgaggcgggcggaucacccgaggucaggaguuccagaccagccugaucaacauggagaaacccugucucuacuaaaaauacaaaauuagcugggugugguagugcaugccuguaaucccagcuauucgggaggcugaggcaggagaauugcuugaacccaggagauggagguugcagugagccgagaucgcaccauugcacuccagccugggugacagagugaaacucugucuuaaaaaaaaaaaaaaaauuuaugcuuaaaguaguccaucauaaguuuauaaguuacauguuaugaaucagcaauuucuaccuuccaauuaaucauuuguaaaaguggucagguacacaccauaaaauuuuuggaucauaauuaucauagaaagucaagucacacuuucauauagaaagaguaacuuuucuaaagagauuauuuauaauugauuugucuccccacaacccagagagagaaacuguguuaacauaaauuuaguaaaaccaugcuaguuagaguuuuaaacagcaaaggacaaauuuggcuagcuguugcaaugagcaguaugagcauuucuuauaagcucagcaaaugauucuauaguuugguggaugcagagaaaaagacacuaaaggaaauagugcaaaauuaaaauuauuuuaaaaccaaucgugggcaaaauaacuuguaagauuucuggccaggcgcggcggcucaugccuguaaggcacuuugggaggccgaggugggcaaucaccugaggucgggaguucgagaccagccugaccaacauggagaaacccugucucuacuaaaaauacaaaauuagccgggugugguggcacaugccuguaaucccagcuacuagggaggcugaggcaggagaaucucuugaaccugggagguggaggucgcggugaaccaagaucgcgccauugcacuccagccugggcaacaagagcgaaacuccaucucaaaaaaaaaaaaaaaaaaaaaaaaaacauuucuguguagcaccgugaacauucaucuauucuuuuaguguuauacaggauuaucagcacaguagaggaauauuaaaaaugaggcuuuuuccaacugaagguuuagacuucaugcaaaguggaugguguuuaaaacaaaacauuagcaacuggaugcacuaaauauauuuaagugcauacucuugcaguucuauucuaaauucuuauauuccuggaaaauaauauauauccauauccaguaauuugcugaucauuuagcagcaguaaaaguagaagcaguuuugauuacuauuguggaaauaaugaauaguuugaaugaaaguaaaaaucaguucuauuucuacagaacuucuaggcuuuguauuuuguuuuugcuacauacauauggaagguauuugaccugggaaucccaaaguuucucauuagacuuacuuucuguuucagauacugcaacauggaaguggagucaauacauacuaauauaguggccaggcacacaggagccgucacuuguagcaugugagcacauaaacaauuucaaguuuaugguauaacugaggccaugugguuacagacacucugacugcuccuaauuaauggcuaaacuguacaauucagauaaugaaaucaucucaaguuauucacauuagcaaauacaacuucuuaucgcaugacugccaaacaggcauuuugaugcccauuuuauaaauguaaaagugcacgcugaacucucuuccuuucaaccaaagauugggcuuuccuaucaguggccgcaaagaggggagaggcccugggcuucacuuacucuucauucaaggcacaccggcgauuggugagcgugccguauuuccucagcgucucgguaagcuccgaguagaguuugucagccagagacagcgggauuccuucccacaccaggaugagaaucacaaucacugcagccucacagguguggccagcucgcucccgcaccaaacacaguagcuucucuucacugcugcuucugcgaaccaccugcguggaucaccauuccaucccaaacaccccccaccccaaccaaaacaaaacaagggucacuugcagcagauaagggcacuuauguauguauauuuuaucauguuuagaucacaauuagggcaacauuuaucagcauguccaaugugccuuuugcugcccaucuauaaaaagugggcuuugacccuaguaucagaacaaggagagaugcaaaacuacuccuuaauguuuagcagacuauacccaguacaguggggacaauuaaaugcuaccugcauuaaaaccagagcuagaugaaagauacauaagucuuaguucaagguuuucauaaaugacaauauaaagauuaacugaagguauuuaaaaguuuaaggacaacuucacauucuaagaaggauuauacauuuagcaggcacuagaauggaccucuuccucaucacuaaauuauuucaauuaaauacaauuuguugauuuuagaacuaaucugccucuucuuaagagauaacacaugauaaaaaauacagguaauguucuuuuuaacuggcaugagucuuugaucuggguaacccaauucucagggucagauuuacaaaucaaaaugcccaagauuuaagaccaaaggcuuuaucaagucacacuuacccacuuagcaauaggacaucccugagaacuuuugccuucuuuaccaguauagaugacucuuucaauccuaauagcuuuacccuucuguccaaaccuuaaagaaacccacagaaacacacacacauacaauuagcaaaugaauucaagaggcaaucaaaauauuugaacauuugagcauaacuuuauucuaugaccacauccugagaaaugaacgguuuauuauuuuuuaaacaggucuacgccaagcaaacuggauaaugguuuuuaagccuuguuuuuccucaauaucaaaauguacagauaauuguaaugaacuauuuuguaaauuacaugugggugaaaaugggaaagcucauuucgauauaaaauuucacaaagcacaaaauucagguuaguuugcuaaguucagucuucuaaaacauaaacuauuuuuucccuuacuaaauuuagcuauuuuaaaacuuggggagucauaauagauuuuaguuagaacuguuccuccaagaaugucucacaauuuagaaaaggaggcuggcaaauaguuaguauccagccacauggaaaauauggaauaguccuagaaauagacuauaucuucccuuaugaccaaagcaccaccuacugcuuguuuaaaaaacaaaacaaaaaaacaacaaaaaaaaggcacuuagggaaauucacuauuucugccaggccacuagaugauuauuuagugaacuucuacaugcuaauuuagaaaugaauaauuuggaaauggagcaagaaugauacugaauauguccuagcugccccaauguauccuaaguacuuuaauaauaauacugccuaccucuuaaugaaaaggcacccuagaagaagaacagcucagagcuguauaaauuuauaugaaaggccuucucugcauuaucucgcucauaagagucuucuacaugcaggaguaaaggcaaguacuuguauaccugugauugauagcgaaaaaaaaaaaaaaaggcagcuguaaauaguauguuucucuuucuauucaacauaucacacuugcucucuuuuuaugguaaaagaaaacuuagagauaaguacucauuugcaacacuaggugaauuuaauucagugguucuuuucuuauaccacacuuuaccagucuuucugcuuugacacuuuauuaucaggugggaaagccagagugggaccucucguuggagccugugccaguaccuuguggcuggcagccuggcuggccgauuccuguucaugccuggguuuucuggcauccaucgcaaagugggcagccugugccagcuagcagacuauuaguccugucaaauauugugacucucuggugaauagcacaguguguaguguuggcaacccuagaauagcuaagccuacuaauaauuacucaauuuacaauuguuuacugcuuugugugugaaggcuggaaaaauucugacauauacaaaaggauaaacguuaaucugcccugugccuuugcguuaauuaccuuucuuccaugauuucucuaauagcugccacauuaggaccugcuccuagauggguauaaaaaggaccuucaucuuuuucaauaauuugcucuguugagauaauagaagauuauuauuuuagaccucaauuauacuaaauauaaaggcuacauccacaaagcuuaacccccaacuacacauuaagggcucuaaaagugacuuuaaaauuuuuuuuucuuuaaaaugaguagauugauggacugaucuauuagaaaaugugccacauaauuaaguauauguacaugcugguuguuggauaaaaauauauuacauuucagauaugggauaaaaaauuauuuuaaaccaaauaaaugaaacuaaacaaagaauacagugagggaauuagaauguauuauauguaguaucaacuacaauccaauuuuuugagcuggaaaaaaaaaacauuuaaagcuaacuggaagccuaccuauuacuuggauuuuaaaagauuaaaaauaaaauuuccugcucuaucccacccccagaauauugcuugguuuauugucaaggauaccccuuuuucuuccuacuucccuauaacauuuaauugcuguuuugcaaauaagaauagucaauccagacccauauuaguauguacuuuagaacaauuuaugaugagagaaaauccuggagagucaggcaaaaagaaggggcuguugcaaaccaacaaagauggaaaagugggaagauaggggugggugauaagagaagagugaagacgauuacaacuuaccaaauauuaucuaugagaugugugguguuuuagcccagugaggcaacuuaauaaccacacgcaaagagggacaguaggaguccucccuccauccuucuacacagugugggguaucucauugcaagagggaaaacauggcacggguaggucauuagccacacuaauuuaacauuugucuuuucaaaugucuuugacuaaaucuaugcugcauagcuauaauuaagaucuucaucucuauccacguauauaucuacauccaucagcaaaaauauuucacuauuccuacagaccuauuacauauccugaauuuuaacaaaaagcuuuuuuuaaaaauacaggcauaccucguuuuauugugcuuuguucuuuugugagucacaguuacugugacuuuuacaaacugaagguuuguggcaaucccacguguuaaguaugucuaucagugucauuuuuuucaacagcaugugcucacuucaugucucuguaucacauuuugguaauucucacaguauuuuaaaguuuauuauuauuuauguuauggcgaucugugaucagugaucuuugauguuacuauucuaauuuuuggggggugccacaaaccguacccauaaucugguaaauggugcaaacauaaucugauaaauguugugugcauucugccugcucuaucaaccagccguuugggcucucucccucucccugggccucucuauucccuaaaacacaacaauauugaaauuaggccaauuaauaacccuacaguggccucuaaguguucaagugaaaggaagaguuguaugccugccacuuuaaaucaaaagcuagauaugacgagcuaagugaggaaggcaugucaaaagccaagacaggcugaaagcuaggccuugcaugccaguuagccaaguugugaauguaaaggaaaaauucuugaaggaaauuacuccagugaacacaugaaagguaagaaagcaaaacggccuuauugcugauauggagagcgcuuuaguggucuggauagaagaucacgucagccacaacauuccuuaagccaaagcuuaauccagagcaaggccuugacucccuucaguucuaugaagagaaugaggaagcugcagaagagaaguuggaagcuagcagaaguugguuuauaaaguuuaagaagcgcagcugucucuauaacauaaaaggacaaggugaggcagcaagugcugauguagaagcugcagcaaguuaugcagaagaucuagcuaagaucacugaugaagguggcuguacuaaacagccuacuauugaaacaaggugccaucuaagacuuucauagauagaagucaaugccuugcuucaaaggacaggcugacucucuuguuacaggcuaaugcaguugaugauuuuaaguugaagcccauacucauuuaccauucugaaaauuccaaggcccuuaagaauuaugcuaaguguacccugcuuguguagaguaauggaacaacaaagucuggaugauaacacaucuuuuuacaacauaguuuacugaauauuuuaagcccaguguugagacuuacugcuaaaaaacaaaaaaaaaaaacaaaaaacaaaaccaaaaccuccuuucaaaauauuacugcucaaggcaccuagucacccaagagcuccgauggagaugcacaagauuaaugcuguuuucgugccuguuaauacaacauugauucugcagccuauggauuaaggaguacuuuugacuuucaagucuuaucauuuaagaaauauauuguuagucuacagcugccaagauagucuucugauggauccgggcaaaguacauugaaagccuucuggaaagguaucaccauuuagaaguuauuaagaacauucauaauucaugggagggggucaauauaucaacauuaacaggaguuuagaaguugauuccaacccucauggauuacuuugaggaguucaagacuuccguggagaggucacugcagaugagggagauguagcaagagaaccagaauuagaaguagagccugaagauggggcugaguuacugcaaugucaugaaaaaacuugauaagaaguugcuucuuauggaugaacaaagaauguuugagauggaauauacuuccaaugaagaugcuguaaacugcugaaaugacaacaaaggauucagaaaauuacaaaaacuuaguugauaaagcagcagcacaguuugagaggacugaguccaauuuucaaagaaauucugcuguggguuaaaugcuaucaaacagcauugcaugcuacagagaaaucuuuugugaauggaaaaaucaauugauacagcacuucacuguugucuuauuuuaagaaauugccacacacacagccaucccagcaaccuucagcaacuaccaccaugaucaguccacagcgaucaauacugaagcacgacccuccaccagcaaaaagauuagcacucacuaaaggcccagauaauuguuggcauuuuuuuaacaauaaauuauuuuuaaaguauauauuuuuuagacacaaugcuauugcacacuuaguauguuacaguauaguauauaaauaacuuuuacauacagugagaaaccaaaaaguccuuacaacuugcuuuauuguaauauucauuuuauugugguauggagccaaacccacaauaucucugagguaugccuguaucauauuuuuuaaucaaaaagaugaaauuuuagagaaaagggaaucaaaaugaauauaaaucacaacauuccaaauguauaaauggagaaaaggaaacuuuaggagcacuaagagugucagcauuaucauuucccccaacucaugaagacugaagauaauaauuucccuauuagccagaaaucuugugaaacuaauauauuuuaccuugaauuaaaaaauauuuaaaguucguacauuagacugccuauggucguuauuuucucauuuuaauagauuguuuuuuugcugccuagcugucucuccaggagauaauauacaaagagcuaaauaggcgaauugaucuaaaacagauacauucaaauuuuacaggaucugaagagagggaaaaauaaacaugcacgauuauuuaauucuuuuggaaaaacugcauguaagugaaguucucuuucacaagacacaagcaucgguaacuugacaaaaaauguaagcuucagauuuuuaugagccuuuacaaauugcugccagacucaagauuuaaaaaaagaaggaaaaucccauaucugaagauaaauuugcuaauucuggauaaacgccaugugucucaguacauuucuggcacuuaccuacacaucugcaagaugggaaaucauauugagucuugacagguguauccaauaaauuuuuuauaggaguaucuaguaauuuggaaggugacucuauaaaauuauugagaacagaagcagcuguucuuuugguuggugucuuuucugaagaaguuguuugcugcucuaaagcugggguguggcuaucaaguucugcagcagugguuugucuagucaaaacugugacuggcccugacauuucaacuuuuacuugcuucugugauuugagaguaagagccuuauggucaaauaacgacuuggcgugaaacugcuucagaugcugcuccauggucucaaugaugcucuuuugcugcacauuaucacagcuugcagguggauucucuugcuuaguuaccuuuuuccauguuuuguuuucugguggugcugugugcauacaggcauguggcuugcauccagguuccaccuuaauuggccugugcaucugacuauggcaagacucaguuugggguugcuguguuugcugcuguucuugcuucuguaagagaugccaccuuagagcagcaugcuuuugaguguccuucuggggaggggucugagugugacuuccucccuggucaggcacaggaaaaacauuugcaugguuauguaucaaguaccuuugcugagcaaguugcgcagcuuguugaccagacauaucuugguuucuauuuuuauaucccuguagaacugaagcuuguugugacuucugcuccuguucuugaaagcaccugugaagaagaucuugcuuugggaucacauuauuuggaaaauauugcaugugaugcaaguuuugggucuuguuuccugcaaaaaguucaggauguguagucuguucuuuauucucugaaacuagguguguauuguuugaacaagaaaccuguauuuugcaugcacuugauuucauggucugacuauaaggggaauuucuacgauuuauauucuguacuuccuccagucccauuuggacauuaugagucucgaacucgcuugauuuugaauacugauuuucaccaugaaaacauucuuccacuuuagucuggccaaagaaugauccuucucuuugcugaucauuguugcuuugggggugaggaaaagucuggaguauuuccucuuuauucuuuauuuguaauuuuugcugcuguugcugguuuugagggagaugugaacucugggaugguuguguuugugcugccuguuuaugaggcuuauguugcaaaaggugugaguuugaaaauggcucagucucugaagccuguugauucaagugcuguuucaacacuggggacauaaguuuuucaguuugggaaucugcucuuuguugaaaaugaaaucuagugccacacagugacugcacaugagcuuuugguaaauggucuguuuuggagaagugcaccuggugugaggguuuuuggaacuggagauguugguccacuguaccuugggacugcccuugauucauuucaacuugguacauuugugacuugugcuccagcuguguuguuuucuggguguaagcuugccuugggagccccccaggcauguuggaauuuccaguguauuguuuggaggucauuugauuggagagauuggguugauacugaagaauugauggcagugaugccucauuacguuuuagaugggauuccgcuuggugaaaacgaggggccuucaauucaauccauccugguuucagauagugcuguguugggggcacaagaucucguguuugcuccuugucucgacccuucagaaucucuugcucuuuguuucucaucaacugcuggcaguuguccuguagcucuccacugcuaccaaaaauugguggguuaugcuugagguguucugacauuggucuuguuuucucagaacacaauggaacagucauugucccugcagucuguaugucauuccuguucacacaauuauucugaggccuuucagaaagcaucggagaagggcugcauacauguguagauggauuaggacucugggaagguggugccucagguuuacccucuauuuucacuucccuuaaaaguguuguguuacuuugguugggguaguggugguguucuucuaaaacuccaccauucagagugcuuuuuccuucugaaggaagcugaggaaccuguggaagaggaggagggggagaaagaagcaauugugaugguggugguggugugguaguggcagaaaaggaauccuuagugaacacugagcuuugcuugaaguaagcaccauucauuucauuuuguuuuaaauaccguucagagcugccaccaggagcuugcaaauugcugcuggaaccugaacagaauucuucaccagacgcuagcuuugugguucccuggauguuauuuucugcaggagaugggcauaucucaaaaacugauuuuuguuguuguaguuguucugguuucugaaaggaacagguauuuagcauugcagcuaguuuacuggcauuaucagcaucaucagcaucacaggccucacucaccacugcagcuggcuuuggaggcagcucagaguuagaggucugugcggaauugaucugcccugagguaugcgaugggugagugaucucacaggacaacucauuaguagccugacuguuaauggcauuuaugugagaugugguuuucugcaccgcaauggaaacacaaucuggauaauauugagacaguguuuuuuccaggaguucaccauguguguguuccacggaagaggcagaaacuguagcaccauuaggcauuagcacugccuuguuuuuaaguaauacaauguucuugucaugguaauuagcacuuuuccccuccugcucauucagaaucugaagcucuggauuuucaggcccacugcaguuauguguugaaaaacuggugaaaucuuuaacugcauuuucuugggcuacagaacucacagauucuuucuuaucacucaaaucggagacauuugguugacugcuuucaccuggauuucuuucuuggcuuaccccgaaguuacgucuuucuccauuagccuuuuggucuuguuucaauuucuugaucugaaggagcccagagagagaagguucacuaacugugcguuuuauuccuccauuuugcaaacacuuggaauacccucuacuuucuuguguaaagucaggacucacacgacuauucuggcuucccuucauacaggguauuccauaauaacuuuugaaagagugccacuuggugucuccauuuacuucuggaugagcucucucaggcagugggcuuccauucuggagcuuuguagccagagguucugucuggcaaaugggaggugaugguaucaggaauggacuuagucuguugcccucaacaugguugguucuauccuguuccaucaggcuugcuucggggccauccacaaggcugcccucuaguugaauucuaaagagcauggaaacaaaaauuaaaauguguuuauuucuaucuaucuaucuaucuaucuauaaaaauacuaauauaucuuaaggaauaauuguggauaaauaucggaauaccuagacauagcaaacugauauuuauuuucauguuucauagugacaacugacagcuacucaggaaauaaacauucuugucuucauagcaacucuaaaauauuuauggucauggagaacaagggugaucaaaauuaccagcuaaugugggaaguucauacucuuaguuacuagcaucaauuucauuccuaaauaauuuuuugccaaaaugcuaaaaacaauugaaaaauauccccuuuauuuucucuagcacuucauuuaccuaaucacuugcuaaguucuaucaacuguacuuccuauauauuccuuuaaucaucuugacugccacuucauagcucagaucuucucuuuaucacugugccuccuccugaucuacugcaguagcuuuuuuuuuuuuuuuuuugagauggagucucacucucuugcccaggcuggagugcagcggcacaaucuuggcucacugcaaccucugccucccagguucaagcaauucuccugccucagccucccaaguagcugagauuacaggugccugcuaccaugccuagcuaauuuuuguauuuuuaguagagaugggguuuuacuauguuggccaggcuggucuugaacuccugaccucaggugaucugccugccuuggccucccaaagugcugggauuacaggugugagccaccgcaccccaccugcaguagcuuuuuaaaaggguucuccuccccuagccccgucugcccuuccccuccagcccuuuaagguucccuuuguuaucaaaaggaagauuguaaaaugcaaaucugaugucauauucucuuuaacacacuggcuuaaacuugccugcaugguucucaaacuauuucauccaaauacaccugagagauaaggcacacucccuucaguguuaucaauauuccaggugacagaauaggggugaugaaaaguguacuuuaugaaaaacccuuucuaggugauucuauguuuuucucuagaggggcuggcugcccaaaucuuuugagaauuucuguuuaaauguuuucuuccccccgcauacaggcuguuuuuucuguccuccuacucucucuuacaguuuauacuccaacaauaacaacagcuuauaaauauccaaacauaguaagcuguuucagagcuucaugccuuugguuuucugucugccuagaaugccuucuuaauccccuuauuugcccaaugacucuaaaccugccucagauaucaucuucccuaggauuccaucuuugacucucuaaaagaauuaaucauuccugcagagaaaagggaacacuuauccccuuauugcuugugggaauguaaacuaguucagcuguuguggaaagcagugcgguaauuucagaggacuuagaauugccaucugaccgagcaaucccauuauucggcauauuacccaaagggauauaaaucauucuaccauaaaggcauauugcacacguauguucaucacagcacuauuaaugauagcgaagacauggaaucaaccuaaauguccguaaguaguagacuggauaaagaaaguguuacauauacaccauggaauacuacacagccauaaagaaacacaaaaucguguucugugcagcaacauggauggagcuggaggccauuauccuaaacaaacuaacaaaggaacagaaaaauaccacauguucucuuaaguggcagcuaaacagcaagaacacauggacacaaagagggggaacaacagacagcagggauacuuugaggaugggagaagggagaggaucaaaaaacuaccuauuaaguacuacgcuuauuaccugggugacaaaauagucuguacaccaaacccccaaggcaugcaauucaccuauauaaccugcacuuguacccuugaaucugauugcauucauucgaacauuuuugagaguaguacuaacgaagauuucagagucccaauaauagagaaagccagaagaaauggcacuaaaaaaauuaauccauuguauaaggugucugcuuuauuuucccacagucuuucucauuacauuuauuuuaaagauauaaguagaaaaagaaagacuauuuucuuuuugggcgaaaaacaacucuauuaaaacagcuauuucuugauaaacaagaaaaaugaaauagaauaagaauauagauguugaaagcaacgcuaaaguuauuguuuacagauaaaaagauuauauacuggucaaccuagagaaucaaguaaaaaaugguuacaguuugugagaauucagcaaaguagcugaagaaaaauuuauagccuugauuuauaagagcaucaaccagucagaaguuuuacuggaauaaaauacuguaguuauaauagaagaaauuaauacacuaggaauaaguuuuuaaaauguggaagaccuauuuuaauauaacuuuaaaacuauacuaauauauaaguacaaaaacaaaacaagggaaaagcuauaauauguucuuagauaguugucaaauuauucacuuaauauacucuuacuaaaaguacuugcagaauauuuugaggaauuaaggaaguugacuccaaaguucauuuggaaaaauaaacaaauuggguagccaggaauauucugaaaaagaauuguauggggccuaguagccaaauuaaaagauauuuaaaagcaacaaagcuacuauacuuaaaauaguuuguguuugcacauauaauauuaauaugaucaauggaauaaaacagaauguucaaaaauagacccaaaccacagaaauaugcuacaagauaaggaugggauuucaaagacauacuugauauuagaacaacuggguaaucuccugaaaaaaugauaaagugggaucauucccuuacacuuuaagauaaauucuagaugaauuuaauauuugaauacaggaaauaaaacccccccaaaaguuaaaaacaaucugagaaaacuuaaaaaaaucuaaugacuggcuaagcucuuuuuuugugaaacaaaaucuagaagucauaaaagaugggaaaguuugcuaaaauuuauaugugccaaaauaaacauguaaaaagaguuaaaaguuguauaaaacuuuucuuaacauauaggacgccuacaaauaaaugaauaaccacauacuaaaaaauggacaagggacauggacaguucauagaaaaugaaaugugaauggcucuuaaguauuuaagaagauaucuacuauugcucauaaaaagaaaugcaaauuaaaacugcaacaagguacaguuuuuuucucuucuccaauuagugaagaucaguaagcuugauacuauacuauguuuggcaagcaugugggaaaacagauacucucucauguggcuuuugagagucaaaacugccacaaauaucauguaggaugacaauuuggcaauauguauaaaauuucagaaacacuuuccuugacccuuuuaagaauuuaucugacaggcugggugugguagcucacgccuauaaucccagcacuuugggaagcuaaggccaguggaucaccugaggccaggaguucuagaccaaccuggccaacauggugaaaucccgucucuccuaaaaagauacaaaaauuagcagggcauggugguaggcaccuguaaucccaguuacuugggaggcugaggaagaagaaucaccugaacccaggagguggacacugcagugaggugagauugugaugcugcacuccagccugggugacagagugagacacugucucaaaaaauauauauauauauaucugacaaauaugcucauauauacauuaaaugauguaggcacaaucuuuugcaguaauaaaagguuagaaacaaccuacaucaauaaggguuauguuaaauaauuuaugguacagccacacaauauaauaccauguagcuauuaaaauuaguaucucuauauuuucagauggaaguaucucccaguaauuaaauggaauaaaggaagcuacacaacaguuuauauaagaaugcuacaaccuauaccuuuguaaaauaaaaaaaaaucaucucuggagaauauauaaugaacuggccauaauaauuugccuccaggaaaaggaauggggcagcuggagaaaagcacugggagggggauuacuuuuaacuauuccuuuuuuuuuuuuuuaaauaacuuccaagcauguguauuacuuaauaaauaaaauaaaaggccaggcacgguggcucacgccuguagucccagcacuuugggaggcugaggcaggcagaucacgaggucaagagaucgagaccaucuuggccaacguggucaaacaccgccacuacuaaaaauacaaaaaguagcugggcaugguggcgcaugccuguagucccaguuacuugggaggcugaggcaggagaaucauuugaacccaggaggcggagguugcagugagccgagaucgcgccacugcacuccagccuggcaacagagcgagacucugucucaaaaaaauaaaguuauaacucauauuggacaaagaaaacaaagugauguuuuuauuucugcuagauuuacuuccuuccauacauuaagagauggucuagauauacaucauccaacagugacuagucacauauagcuauugagcccuuaaaaugugucuaguccaaauugagaugugguaucuaugaaaacauuuaguuuggauuucaaagauuuaguguuaaaaaaacacaaaaauacucaaaaaauauuuaauacauguugaacuauuuuaaauguauuggguuaaaucaaacguaucaucaauuuguuucuuuuucacuuguuuuaaugugaguacuagaaaauguaaaauuccauguggcuuacauuauguuucuauugaacaaguagaaaauuugggugagacaauggcuuuuaaucaucaauaacaccuaauaaagaaacuuuagguuuuaaaaucaugaaaauugauuuguagucuuugauaugagaggcuucuccaaaaucaggacacuaucacuuuucaaaaauuaaggagcauagacauaaaucuaaauaaauccugcagaaagaaagucaauuaccuguccagauacuaccaaaaaaaggcacuuuucuuuugguaacuguaaaacaccaauucauauacagagcaaucaaaagguauuuacauguauauacauguguacauuuaugauaaauuauauaaaauuuguaggaucuguacauaauacauguuuuucuacuuucuaagguauaaaauauuuuaagcauuuaauauauuaucuuuuauuauaauccauuccacauaauuuuggacauucuuuaaagugucaagggcaaauccuuugaguauaauaauagcuacuaagaaaugaaggugacuaaaaaagaaauguauuucaauauggaguuuuaaacacaauggccauuuuuaaacauuauacagaacuauuuugucugugacagcaaguccuuuauacaaccauuugugugaaaaguuuaaugguuaacuuuuucacaagaagggcaggaaaguuauauguuagaaugaggaaaauuuguuauuggucuuuaaaucuuauuucaggaaauuuaaacuaauaaacugccauuuuagaaggagaaaaaugcaauauuuucuuuuacuuuaauaugugcuaaaucacacuuuuuauauacauacccuggaauauuaugauccaguaacccacuugcacaguacucuuucaagcucuuagugcuugcauacugauguugauaaaguauuauuuugcuuaauaaaagagaaggaaaugagaccuaugcauuuugcucauuguagaaauacugaaaaagcuuucaugcuguaguuuuuauggggucauuuacacaguguuuucaagcuugcauaaaaagucuacaugaagucaauaauuuuugcguaagauaaaaaaaucuucaaagaugaauuuuuguagauauugaccugcuauucaccugcuauucagugaaaguagaguuaaugaauuuuuuuuaugaauuuaaaugauugcaaagaaaaguuuuucaaaguuaaacuguuuuucagauaaauauaaauuuuugcuauggagauuauuugugugauuuuugcuucucagagacuaagaacaaaaauauaauuuuaauucauaucugcucuuauaaaugacucaucagaaauauuuugaauuaucaugauugauuuuuuaguugaaauuaaacauccuucuauuuuuucuuacaccagagaacacaaaauuaauaugguauacaauauuaagauacugcucuauugugcaacuaaauauucaaacaccuugcuauugaaggucuacacauuguaauucacuguaugcaaaagaguccaugccaaauaagauucuaccuauaaaaaucauucccuagauggaaacaauucuuauuuuagaaugagaagcaacuuuacaagaggauggcaaugucuuuccuaagaggaugcuggccaaucaaaauuaaggccuuuuuugggguuguuaaacugguuacgaaguuuauauacaagaacagagacagaagaaccuuugggaaaaccuggagugacuaauuguuuacccagggaugauuuucaugaugucaauacuucacucauugcauuuaguuaaaauuuaagaaugaauacaguuuuuaacauauuccucaggagaugcucuuauggguuauagcuggcaucauguuaucaaccuacagcucaugcaauuccugaaaguuucacaaugugcucuugagaacugguucuaagcacuguuagagcuaccaaaauauuaaaaaauuauauuacucuuuuuuccuccuuuugaaaaaaugaaaauucccugagaucaaauacaugccauauuauuuuggcaucuuuauuuccagaauucuggacaaagagaucuugcuucuggaaugacuaaauagcauuuuaaccuuuugaaagguauguuaggcuguuuuugaguugcuauaaagaaauagcugucuggguaauuuauaagaaaauagguuuaauuggcucaugguucugcaggcuguauaggaggcaaagcacuggcaucugcuuugggugaggccuuacaaaacuuauaaucauggcagaaagcaaaaggggagcaggcaucuaacauggcuggagugggagaaaaagagagaggaagagggaggaagagggagggaaggacagagggagggaaggagagagggagggaaggagacagggagggggacgugccacacacccuuaaccagaucucuugagaacucacuaucaggaggacagcaccaugccaugagggaucugccccaauaauccaaacacuucccaccaggcccccaccuccaacacuggggauuauauuucaacaggagauuuagaggagccaacaaccaaaccauaucacacggcuaagaaauucuaaggugacacucaaauauaaguaauaauauguaacaaugguccuaacaauguauaaacauuucagaguagcagcaaggaucuaguaccauuuucucauuuuaaagaugugaaaacugaggaaucugcccauggugaagcaccaaaacagaggcucccacagggacuaggccuaagcacucuggcagcucucuaaagcucuucccaccacacaauacuaagacaagugcauaauuaaaggaguaaguuuuguuauuaaauucacauuuagccaacaauuuaagcuuuuuuuuuaagguuuaggauuaaaaaacaaguauuuuggcuacguaucuguaggucuguaauuauuaagaugauuaagggcauuuugcaugucuuuugccaacaaaucauuucuuuaugugguuugggauagaauaaaaaagaaaacguaaacuuuuaggacauggaauuugaagcugccacagaguuauucugaucccuucuuugccaccuucccagauuaucuuugcaaugcuggacugcugaugauuuuucucuagaauauuugaggaugauuuaugaaucuccccugauaaugucacucagagaauuggagcucaagacacauuaguucauuuauuuuuucaguccugcugcacugaguugaauccucacucagugcaguugccauggcauggagcuaacacaaagaugcaaacauccucuacugcccugaacugugguuauguugaggcaaugagacuacugaagugccaugggaauacaggagaggggaagacuagagcucuugucccugucaaugugggcauaucagccacccaagucacucuuguaaaauuuaacuucauuucuucuugccguaguaugagagaaaaacacuaagucaaagguaaaaggcugacaacgaauguucaucaaagcuaccuacaacauugcugagggaggagaaccagugaccuaaggagaaaugugcaucaguagucagcaaguacagagaacaccacauaaaaaacucauagagcgcaauuucaaaaaaacuagugagaaggcaaaugaguuguagaagcucuucugauuauugaacccuuaaccuaggaaaauacauggcauguuuaucugcuucacuauaaacuuaucuuugcuuaucaaaauauaacacauagcucauuauucaaaucacacacacacacacacacacacacgauuuuuuacuauauggugcagcaugagauuucuucauagguuuaccaaaaaggcaacaaagugaauuaaacuuuaagaaugaacaaaacauaaugcuaaaguuauaagaacuuugguauuuuuuuaagucuaaaaaggcaguuuuagaaauuaucauuugccuaaaugacagacuaauuaaauuacaauuuuaaaagguuauaauuuagaucccacuagucauauuauguaugucuauccuuuuauuccaauaaucuaauguucuuuguaaugcaugggcuuccaaggaaccaaaaagaauauuucuauuuacuauaaauaccaccauuuuuuucagaaauucuaaaggucaaauuauaaccaggcaauuuaacauaaauagaaacaugcaacaauuauauggccacucaauaauuucagcuaaugccccagaauaaauuuucauaagcuacgagacagagagagagagagagagagagagagagagagagagagagagacuggcugauaugucaauuauguuaaccuuuaucuucuaugucagaggcauguauuaaugaagcauguuuaucucaguugaaaauacuggccuuuugacuacuagcuaacauuuugguuuccuaagaccaaaacagguuuuagccacagcaguuuuccuuugauuuuguuccuucucccgccucucugaaaauaauuuauuauaaauucuagucgcauuggcagcaucugugaaacaauuacugcaucuaggacugacucugcagucuaauccaucauaauuaugacaggccucuuugaagaugcuaugaugcaugacuuaaaaauagcacauuagugugcaaauggaucagcaucucauuucaccaauaugcauuuaggacuguaauuuugcuccauaccauuugacucuucggauuacucaagaaugguagcuguaucucucaccacauaaagcuguagauaugcucaaauuugugaagagggcuugauuuuguuuuuguuuuauuuuuugguuuauugcuuuucuagguggggguauaucuuuuauugcucuaagaaaaaauacacaucauuuaaauuuuaugucagcuuuuuuucaaggggacaaaagagucaauuuauagauuuguauaguugccauacuauaagguaguaaauuauuuuuuuccauaaaauaaguuuugcauguccuaauacuacaaguauauauaaauuacucuaccaucaugaauccuguuuauuuauacauucagauuacugaggguaaauacuucagacugcuugcuuaugggaacuauaucugcuaaaggcacuguguuucaggaucaaacuuacgggaaucacuguguaucucucugucacuuccacugacaggcuucaccucuauuaguaauucagaguguuaggaauuaaauauuuauugacaugaaaaacacugaguaaagaugauguauauggccacaccuccugcauagauggcauuauucuccaaaacuauuuuggauucuuccuaucaacaugggacauagcuugugucaauuauacacuuauuucaagaugugugcaaugcuauggacuucauuauugucuacuaaauuucccucuguauaguguucuaaaaucccgagcaaaauguuaguuuaaauucuuaucuucuguaucuauuaaguucucuccauuucguuugacuuuaaaauuacuauguaauauugguaugguugccaagucucacucuugagguaaagaaaguguuuuuuauagggcauuucuuauaaaauuaaaaacuauucuucguuaauuuaaaguuaacauuauuuaauauuuaaauauuaaagcuaaaauuuuaaaaacauaauccaaaacauauauuuuucaacagcaaaauuaauguaagcaagccacauguuagaccuggaauauaauguuuccuauauggauuaaguauggagaauauaaggugaauuaauauuuuuaaggcaaagcuaacuuuuuauuucucauucuguaagaacuuucuaucuaaauauuuaaaaaucugugaagauguacuucacaucucuugaaaaaggacugcugagcaugguccuggugcugguaccaaaacagagauauagaucaauggaacagaacagagcccucagaaauaaggccacauaucuacaacuaucugaucuuugacaaaccugagaaaaacaagaaauggggaaaggauucccuauuuaauaaauggugcugggaaaacuggcuagccauauguggaaagcugaaacuggaucccuuccuuacaccuuauacaaaaaucaauucaagauggauuaaagacuuaaacguuagaccuaaaaccauaaaaacccuagaagaaaaccuaggcaacaccauucacgacauaggcacgggcaaggacuucaugucuaaaacaccaaaagcaauggcaacaaaagccaaaauugacaaaugggaucuaauuaaacuaaagagcuucugcacagcaaaaggaacuaccaucagagugaacaggcaacccacaaaauggcagaaaauuuucgcaaccuacucaucugacaaagggcuaauauccagaaucuacaaagaacucaaacaaauuuacaagaaaaaaacaaacaaucccaucaaaaagugggcgaagcacaugaacagacacuucucaaaagaagacauuuaugcagccaaaagacacaugaaaaaaugcucaccaucacuggccaucagagaaaugaaaaucaaaaccacaaugagauaucaucucacaccaguuagaauggcgaucauuaaaaagugaggacacaacaagugcuggagaggauguggagaaauaggaacacuuuuacgcuguuggugggacuguaaacuaguucaaccauuguggaagucaguguggcgauuccucagggaucuagaacuagaaauaccauuugacugagccaucccauuacuggguuuauacccaaaggacuauaaaucaugcugcuauaaagacacaugcacacguauguuuauugcggcacuauucacaauagcaaagacuuggaaccaacccuaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucacaagaacaaaaaaccaaacaccgcauauucucacucauaggugggaauugaacaaugagaacacauggacacaggaaggggaacaucacacucuggggacuguugugggguggggggacgggggagggauagcauugggagauacaccuaaugcuagaugacgaguuagugggugcagcgcaccagcauggcacauguauacauauguaacuaaccugcacauugugcccauguacccuaaaacuuaaaguauaauaauaaaaaaauaaaaaauaaaaaaaaagaaaaaggacugcugaacacacaaauaugucaaaguccucagagaaaguuccuccauuucugaaaagguguuaauuggacaaguagcugcacauacacauacagcgugugcacugcuccuaaucuaaaucaugugcauaggagguuuugucagguuuuucauaauccucaguagggccuauuuaauucccauguuuaaaguuuuaaaaucuguuucuuaaaauggcaguauaaacaaaauuuaauaauauauagauuauuugagggagaaaaauucagaggaaugccauugaagaugagaggcagauuaacucagagauagagaucugcauuuaagaucuggagacaccugccaguuuaguauaaaucugcuuucaguuugcaacccaaguuaaccaaccaguuucuuauugguaaaaugagcaugaucuuuugucaauucucuauuauccacuuaucuguuaauccuggaauuguuuuuugaauuugggcuuauuccuggccuuucuccaagucucaccaaacuaguguguacugaaggaaacgauaauaauaauaauaaagauaaacauaauuagaaauguacugugucacaaauauuuguuucucauaaauuauuuuaaaaaucuauauuuuucuauuucaguugacucccauuauuagaauggauaauugugagcugguuguccuuacuggaacacugucuaggauacauuuauauuauccaaugcuugaaacuuucaauuaaauaaaaguguacuuagaaaaauugcagaaguuguuuaggcuuggucaugcucuaagaaucuguccagggcaaggaugccccagcagaaagagacugugggguggacucagcaggcaaagcugaaguagcuauggugauagaagaaauaaggacagaucucuccuaucaggguacugugcagugagagcccuuguaggccucucuaaagaacgcuccauauaugucaagaaagccaguauucggaugccugccucacagagggcguccaauagccagucaaugccaggcagaaaaauagcaacauccaaaguccuccagucuuguucaggugcuuaaggagcccugagcuccuuuucauccuuccucaguccugcccaaucuccuaggcacuggugcucacgguagagggggaggggagguaucaggagugaggcuccccuacuuucaacuccaaggguuggagccaguguuuaaguuugugcugggagaagaacacugacucaggcuugaguugggaguuuuaaaaugaauaggacugaguuugaaagacaaauaaaauuguucuaauaaccaaaaggugcuguaaaaauuauguuaccuggucaagaagacauuaauggcugaauggggugaaggagacuauaauaguauauaugaggggcaauuguagaaaaaaaauacuuucauuuuuauauacggagguaugauuuuuccaauagaaccauuacauaaggccaacaaauggguucuaauaauauauaagaacuuuauguaauuucuaggagggcucauaaucauucaguguaguuauauaaugacacugguagaguuauaaaaauaaucugucaagguauucauucuuucaugcaacgaauauuuauugaacauauucuaugugucaggcacucuaguagucaccaguaacacaccacugaacaaaagagauaaauacuccugucuucuuggaccugauauucuaaugaggagaaaaacaauaaacacaauaagaaaguaaauuauguggugugguaagaaaauguugagugcuaagggaaaaacaaagaaauaauagggcagcuaacgaggaaucaagaguaucggggagugguugcccuauuaaauacuauauaaugaggguaaaucucauuaagauagugagaucugaacaaagucuuaaagucgaguuauauaauaaacaucuaauucaccaagaugaucuuaaucaaugcauaauucuuuacuguuugauacauugucucauaucuucagcccuaaaaucaagaauggcaaaacaaaaaacaaacaaacaaaaccccacaaagcuaucaaaagguagaaauuaacuauauuagaguuggucaacuaaauugucacauccccaggggacucuacaauauuaaugugaaacaaacaugacauaccuagcauuuuauuuaaaaacucuguaccaggaauccuuguaacacaagcauuuuggcaauuauguacuguacuguaucccuaaaaucugcuccuucucaaaaauauuuuguucccuaccauugccucaaaaggcaugccaucuauguuuuggagaaguuuuguacagacuugaauaaauucguuuuccuauugaucuagucuuaaucaacugguuaccauaacaaucuggucauuuuuauucuuccuauuuuggaacaacuagcaaugaucauguuuuaguuaauuuguaggauauuacgguuauuuuugagaguaagaugaagaucuucuuaaagauuaauaauggagaugccauuaaaccaacugcacauccaugagcuaucaauuuaagaaauuucaauauguaucaguucuaaugaaaagcugccaacauuauuucauaacauaaacaaaauaaccagucuaucagaagaaagaguaauacagaugcuuuaaaagaguaucauauaaccauguguucaucagaaaaauacaucaauguucccauacaugaugaagauuacucuaauuuucuuugaucugaaaagcucugauaaauagguuaagaucgccuaaaauuauauagcauguuuuagauuaucaaaauaguaauagacuauauauauaauauagacauuauauauauuuuuucauuacaaaagguucuucuggaaacauaauuuaugggauccagaaguugcauaaaauauggucucuaucuuuaagaaucuuuaauuauuuaacugagaagacaagacauauaccuacaggacauagacacagucagaacaagaaugcugaguuuugguucuaaauguggguuugugagcaagucacaaccaccccacaucucaauuuuuaaaaauuuauaauacgaggggaaugaacaugauuacaucuaaggucaucuuguguucuaaaaugcuaugauucucuaaaacuggcaaugauaaauaucuacuggggcuucaauuaaauaacucaucacgaagaccacuuucgguuugaaggguguaauuuuuaccucauuuuacacauaaguaaacaagcuaaaagaacgaaacggcauggcauagccgacaugaggaagaaguagauauaaaaugcagccuuguccaacuucugagccaaacuaugaauagauggagaugaucuguucaggacaaagagguagauuuggugcuccuuaucaguacuguccuuggaaaagaaacacuggauuggccaauaugaucacaucacuaggaacauaaauucuucuauggggcaggaugauuaaaaagcuuucuucauugaggucuagaaaauaaauauuccuaagacucuucaucuucaagaaucacugggugcccuuaaagcaaguacccuggacaguggacauaaauaauauuuugaaaauuaaaaaucagaauucuugauuauuaauugauaaacuuacaauuuuguuuaaacaucaaucucaugugaguuuaauuaaaacaacucaauuuccuucacucgagucaacucugcgggagagauaaaauuggguuucugaauuuuugacauuaagaagcagguccuaggcaaugguguccacccuaaaaugaugucuucuugaugucucuaccaugucucuuuauaagugcaguauuaauaaacuagagauguguccuaauguguagguaccugaacacacauguacaccaacaccauugaaacagauucuuaucauaugugauaucuaucuaugggacugguucuuugggauauuaacguguaauuuuaaaaaaggagaaccagccugagaaaaaauaaaguucugugcucaagcaagaaaacuuauuuuuuuucuaauuuaaaacuuucuuuaaugcauggccucaaagucuuuaauaugaugauaggaugucuggaaaggugcuguguggcauuuccuggacauaaugaaacacaggaucauuguuuauggagcacccugaauaaacaguauuuccauggaauagcauacuuuggaaaacccuaauucagauguaguauaugauaucuuauguaauuuuaaucugugcauagaucuugaggcacugaugagaaccuguggacuaggagaguauaaauucauaaaaccacucagauguagaguucugaguucauuuucaagagcaaaggacacauaccuaugcaaguuuugcuuuagcuucaaauuuaacuuguaaaaacuaaacuaucuucuuccaguuauauugcuguucuaaugauucacgcucuucaccuguacuuugcccaaauacaaaaucauaacuuuuuuuuuucaccaugagcuaaacagaccauccaaguuaugccuuugaaaugaagagaaaggucuguucauaggauauaauuugguugauuguuauuuuaguguugcauagugcugacauguaucuucauagagaaugcagggaggggcaagaacaaagaaagaacacacaaaaaaauuguaaacucaaaaaaucuaaacauuuaggacaaacaaaaaauacacuuccacguauguauugaaaauaacauuugaauucaaaauaagacuuaacuaccugcaaagaaauuuccauauaaccuuaacauuaccuaggaaauaucauaaauucacaucacgcuguaugaugcauuuaagauugaugugaccaacaguuuguccaacagacuuagcuauacaucuguuaucacgauuauaacuaaauccgcuaaaagaugaauuagcuuuuuguuugaaaacagcuucaaauuaauuagugaaugauccaaguuuauggcauuuuucauagaacaaaaacaggauuguagaggaaaacaucuaggaaauaucauauaaauguucugcuuuaaccuguggcaaaucauuacuuuuaaaguuuauauuugaauauaauauauaaauguaaaucagaagcaauaaacacuucaaauaucaccaacaaccuaaaaguuguagcuuacccccuuuccccucuaucguauccaucuuuuaggaguauaaaaaaucugauuuuaguugccaucuuauaaacauaauaccauaaaauaaguccaccaguuaagacaagcacugaauuacgaugaagaaaaagagcauuucagauuaacucacaaagauuauagaacuguuauuaccagaagcaccaacaauuccaugaaagaacuuugauuaaaauucaaagcaauauuuuaacucuccuccccccgaccuguuucaaagaaguacuaugaaauaaacauguauaaaacauuccuuuuguuuuagucagcguggcuuuaaaaauacucauuuguacucuaugucuccucuucuaccucccccagaaauacuagccaaacuccaaguauacuagcucuaauauucacagcauggaaauguuuuacauugucuucuaaagacccacaguuaguaaucaagaucauaaaauauuuugaagcugaauuaacuuuauuuaaggggagaacaaagaguagaaggaaauggugguugaucucuuaauagaaaagguacuuuagucacacauggagaaaauagaacucugaguugucagacaugucucuucaaagguauugacuuacaguuaaaauguuacucaggccgaccauuuaugguaucguauaaaaauucuacacugcucugcuaaaaaagguuaugguuuagaaccccagaaaugaguuggcauucugguugaaaucaaagcaaacucuuucccauguuucaauguucucuuugugguaagauguagcaugaagagaugguaaaaucacugcagauaagggggaaaaaaaaacuggcugaucucaucuguacugcaguuauugcuuugagaugaugcugaagacugcauuauugaagcagugcugggaaaaauguuguauuccuuucuguuucuuuuuucaaaauacuuucaaaacucuaaaucuuuucucagaggcauuucuaacucuggaagcccacacagcuaccaaucuuauaaacauuuacaaguauuucaucucuaauuuaaauuuuaaauaaaauuauaaugugcugaauaauaauucaggcuuuuugguaauaaauauaagucaaaugucacaaaguuuaaaaagcucuuucacugauuuucuagaacauuauuucauggucugacaagugauuguaagauguuauuacagagagacacugaaauaaccuauucuuuuuaguuuaaaugcuacucaguugaagaaaauuagauuuuauaaaaaggucucauguagcauuuucuggaaaaaagcaucauauucuuaucacugccuauggcuguguaggaaaaaaccucuccaaaaugcauuuuuccucugcucucacaucacaacaauauucaaaacagaaaacuucucucuugugaccaaaugugugaggguuucuccccaauaacaagcagcagacacuagcuggguguccuccaauuuaauucccggagacagugucagaccccguagauuaaacgcucaguucccaagaugcuccugccacagacacaagucacaaauccaggccuccagaacuucugaccaaccagcuucgaguugggguucccacaacacccucuuuggguucaauacguuuggucaagcagcucacauaacucaagaaacacuuacuuauauuugcugguuuaucaaaggauacagaugaagagaugcuuagggugaaguauaaggaaagugcacggagcuucuaaguccucccuggaugagccaccuuccaggaaccuccacugguucagcuauccagaagcuccccagacucaauccuccugaguuuuuauggaggcuucaugaucaucagcauuccuuuccccagugcaaagggugggaccuucucugggguuuuaagacucaaaaucagaaggguggggaagauuagaaucucccucaggguuggguguggugguuugagccaagguggguggaucacuugagcccaggagcuggaggccagacugggcaacauggcgaaaccucucuacaaaaaaaaaaaaaaaaaaaaaaaugccaggugugguggcaugugccuguagucccagguacuugggaggcugagaugggaggauugcuugaaccuaggaggcugaggcugcggugagcuaugaucacaccacugcacuccagccugggugacacagggaagucuugucucaaaaaaaaaaaaaaaaaaaaaaaucucccucgggggacaagugaaaggaaggcaggagagauucuguuuucuaaggccugccccgagguccaacacaccccacauucuaacaaaagacuguaaaaagggauauuggagcuaugaaccagaaaccauggacaaaaaccaauauauaucguaacaugacaauggcaaacuuuuguccuagcacuuuaugaggccaaggcagguggaucacuugaggccaggaguuggagaccagccuggccaacauggugaaaccuuguuucuacuaaaaguuagccaggcaugguggcauggugguauagucccagcuacucgggagucugagacaggagaaucacuugaacccagcagcagagguugcagugagcagagauugcaccacuguacuccacccugggcgacagagggagacucugccuuaaaaaaacguagcucaacucauuacuuauugagccugugagcagaguacuguacuaggugccaugggaaacagaaugacaauuggucauaguucucucugagagcuuuuaucuaauuuagaagcagaucauagaguuaaaauaaaugccaucagacaugcaacuauggagacucauaggaaggugggucauccaaaugaagggcuuuugguagugugcuuuaggaauuuuuagaaugucuucacuugcagugaaagaagaacauccuagguaaagggaaaugcuugagaaaauuuguagaaagacuuaaaacacagaaaaauaucuuaaaauagcaggaaguccauuuggucaagcauagguauauguaacaucuuacaaugagaagaauacagaugugguagaaauuagugugucauuuugaauaaggcuacuuuugacgaucauuacaagcuuugaagcauaauccuguaaguuucaaacucaauuugauuaaaauuggcuaaagaaauuuuaguaugcuuccucucaauuuuuccucuucugcauauuugaaaagcugugaauuuuuccaaauucugccuuuaugacuuagaauaacaaaagaacuauacugacgugucaaacuucagcagguuauaucauuaugcuuauaaauauugaguuacagcccuagaaaauagucacuauuagcuauuucauaaugcaccuguauauuucuaugucagaaaaagaauugaggaguuaagauuuaaacucaagcuuguaaaacuaguuuaugcacuuaaaaagaaguagaugagcagaugcauuuguaaaauaaaacuccaauggagucuuuuggugggugggugggggaauggggaaaauuaauuuuuuuuuuuccucugagacagauucucacucugucgaccaggcuagagugcaguggcacaaucucagcucacugcaaccuccgccuccuggguucaagugauucuccugccucagccauccaaguaucugggacuacaggcacgugccaccaugccuggcuaguuuuuguauuuuuaguagagacaggguuucaccauguuggccaggcugguuuugaacuccugacuucaggugauccacccgccucagccucccaaagugcugggauuacaggcgugagcuaccgcaccuggcuggaaauuaauauuuuuuaaucaugaaaaaaauagaaaauuaaaagagacuaauaucauuaauucaauuuuuaauuucauuuaaaccagaaaggacaguccuagaaaauauagaccagccauacacaauuugaaaauuuugggacucucaaauuugauuuaguaugcauaaaugauuuuacucuaguuuaaggcauguauauauguguguauacccacaaauaaaggcaaauacaggugaauaaucuauuauaacucuguuaaguugccagucauuauauguaaauauuauugacuacauuaaaaacaaaucaacaccugaaacuaacaugagcuuauuauuuuauuaguuggguuucuguaauuaaauguaguguucugaaagucugcuggaccucaaucugaaagguacacugaguaaucuuuauagaucauuuggcaaagcagaacauuaagaagauaaagaggagguauucauuacaacuauggguaaccuggacuucucaaccaucugacuagauaaaaacugcauggcuugaacauuuggaauuucucauguuucaggacagauaaagugcugacaugggaagaguuacuuuauccucaaacucaauuucccuugaagcuaccaaaggaauaaucaaggugagaauauguuucuauuguuacccugcuuauucacgccucauuccuacauuggcauacuguuauaugcagggugaauaugagguggccauaaggaaucucaaugacuuaaguuacaguaaguagucuuugcagucagauagaucuccauuuaaauccauauucuucuguuuacugugugauccugauggagccuuuguuuuuuaaucuagugacaacauuaacacuaaaaggauuaaaugagaaguauuaaaugagauaugugaaagacaaaugggaugacuauuccccaaacaggcaugcaucuucugccucuaugccucuaugccuccauuuacuccuucauacagaauuucccuaucuuucacggcucaauuaaaaauucaccuccaccuuacagccuuucuuguucucuuucagccagcugcagugcccucuucugaacuauccuuucauuuagaccuguguuaggacacucucacuuuagggacaccuuguucuuaguuuuccucuaucucucauugcuccuucuuaauggcccuccucugccucggcuuauucccuaaaugcuggucaccucagggggcuggacuggacccucuucucuucaacauucuuucaucuauuuauuuauuuaucuuuaacauauuguucuagguucuagggauguagggaugaacaagauagucuggauuccuucaccagugaaguuuaucuagacaaacaaguagccaaauaaacaaacaauuucagacugaugagugcuaugagggaaauaaaucugagugaugagauaaagaggacuaaaacaggacuauuuagauagagcagguaaggaaagacucucuugauuugcugauaucuaucugaacugaaugaaaaagccaaugauagaaugaccuggaagaaugauucagcuagagggaacaaaaguacaaaaggcacugaagcauaaauuagcaugauauagcugaggagaagagaaacuggucuaguuaguucucagugaacaagaggaguguuuugaggugcggcuagaaguauguaaaggccauggaggaguaaaguguuaagauuauuauuuaaauccagugggaagccauaggugcauuauauauaaagcagugacaugaacugauuuagaccuuuaaaagaucacucugguagcuguauagacaaugaauuaaaaguauaaaacauagauacaugaaguuuagagaccgcaguaauacaagagaaaggauagaauguccugaacuagagaauagcaguggcagagaaauggauaaauuuaggacacauuuugaaggcagaaacagaacaacuugguaauggauuagaugugagaaaguacaugaaaggaaugaaagcaagauaaugccuagaguuuugucuugagcuaaaagguugaugauggugcuauuuguuaggauggguaaaugggaacaauaugacugacagaaaaauuaaggcuucuauuucgaauaagcucaguuugagauguacauuaucauuaaaguggguauauuaggcaggcaguugaguguacaagucaggaaaucagcaaggggucuaagcuggagaaaauugugaacuguguuaaccuaccaaugguauuuaaugccccaugacuagauaagaucaucccaaguaagaguacaguuggagaagccagccugagauuggggccuuaaaaacaccagaauuuugacauuguaaagagaaugaaaagucaacaaggugacccaagagauggccaggaagauauugagauaacaauuuacugaaugaccuauuuuauucccaugaacucaaguagcaauucaaucucagaucuauacuucuaaccuucagcagaguucacaauuuggauuuucaaucgucuccuagucaucuguaccuguaugucccauaggcacuucaaacucuacuuauccaaaauggaauucauucuuucacuccaaaccugucaucuacauuccccaucagugugagggguacuaucauccacgcaguuacuuaagaagaaaccauggauguuuaauucuuucuucccguuuaaaaaauaaccuaucgguucuauguucuuauugucuguagaacccacaaauuauccauguccuuacuuuuacuaccauggcucaugcugucaccaucucauugcuggauaaccgcaacagccuauugaaugaacuucuugucucuaagccuugcucaucuucuaccuauucauacugaagcccaaugcugaacaccaucucuuccacacuuacuuaucacccuucaguagaucuucacaccucuauacuaauucuguuuaaaauaauucuuucauggcuaccuacaacauuucuuaauuuucuuaaacacguccucuuauaaaagcaucuucaccaaggaagaguaaaauuauguauuuuagcccauucagaaacauacacacaaaaaauuagagaaaucuguugucagauuucuguuuuguucccauugugacaaaccaacuugguauauguacuguuuuaguuaaaagaaaguuguuggaagcacauuacaucagccacugaccuauaucaagagguguagaacauuuugaucucuagucuagaagucaaccccacugacuacuuaacauaaagauccaaaguuggugagcucugaguccaggcucauccagagcaucucagucaacacuggaacugaaauuucagauuuccucccuauuuggauggaaauucauuuugauauagaaaauguuauugcgcuugagucaucuuagaacaaauucaaacuucaaauacuguuaaucagaugugaccuuaaacguuauuaaucagacucaaacuuagugagccugguugaauaacucacagcuggaauacacaccaaaagugaauggauaaaaaaauuuucacgcagacauuuauaccaguguauucaguuuugcuagaagugccccucgcucaaacauauauauauauauauauauauauauauauauauauauauauauauauaccaugccuugaggcaucuauuucauuucugaugugcaaauuguaucuuauuaaaugccaaacuuaauucuacuggcaugcgcuuuguguuccagcagauguuaaaauuuaauagccuugucucuuuauccuuguuucacucuaaaacacuuaucacuuugaauuugagauuguuugcugacaguucguucuuugggggaagaagacuguuuuaauugguaccaaguuuccugcuguuuccuuuuguuauggcagguuaccacgucaaaaagcaggaagacacaaaagaacagaauucacgcuaaauuaauccuaaacuuugagauuaauuggaaacacugacuacucaccacugugccuuuauccacuccuauuuuacucuucuucaugcuauaagcuaguaaguaaagcugcgcaugcucagcaacuuuuugaugacuggaaaagauucaagaaguauaaacugauuaaauggcaaagacgccuaauuaaauuuuuuaacuuguuguacauaaaaaucaaucaagucucuaucccuuauacuuaaaggcaagaaaaauaauuagaugaugaaaauaaaugagaaagcuacaguuuccuaguuugagauauugauccuucagauaacucaaaauguaauucagaggaguauguuggggaguccugcucaaugcuagccauuuggguuguuuacaaaugaauguuugcuaccaguucccaccaaaacagagaagccagcuugagaauggggccuuaaaagcacaaauuuagagacuguaaagagaaugaaaaguuagcaaggugacccaagauaaguuggccuaagaugagagccuuaaaaacaugagaauuuagagauuguaaagagaaugaaaaguuggcaaggugacccaagagauggccaggaagauauugagauaaccauuugcagaaugaccuauuuuauucccaugaacucaaguagcaauuuaaucucagaucuguacuucuaaucuucagcagaguucacaauuuggauuuucaauugucuccuagucaucuguaccuguaugucccauaggcacuucaaauucaacuuauccaaaauggaauucacugucuuucacuccaaaccugucaucuauacuccccauuggugugagggauacuaucauccccccaguuacuuaagaagaaaccauggauguuuaauucuuucuucccuuuuaaaaaauaaccuaucaaucaccaaguauugauucuaucuucuuaucgucuguaggacauaugaaagcauaugaaaauauucuaaaucagaagagugauaaaguuaaauuugguuccuagagcugugaacuuuauuuguucugcuaaugccuaacugcauaaugaaugacuuccacagcaguauagguuaacaaggaaaucgcuaaacucuuuucacauccgaaaucauacagguacagagcugccauugugaccagucuuuccaguuccuuuuaugaucccuuaaauacagacacugaaauggaagccauagccaaaacaagcagaaagggcuuuccacuugucuuuuaaaacucccuccuccuuucuccuucaauguauaucccaaagaaacuaugcaauaaaacucuuguuuaaaaucuguuggcuauucugaaaggacuucaaaucauagcaaauucaauuuucuacauuuccaguuugaguuauucacuuuagucucccuuuguacuucaaaaggagaguucucaugcuuaagguuuucauguuugugcuaaagcaauuucuugugaaauuaaguucauuauccaaacuaaaaacucacaagauaguaaaucuuugucuuaauuuccccguauacuuacaauauuagucccuaagauuugagaucuuuuugagaaucuuauaaaagcaacuggucagucaccucuucuaguaaaauuuauguaaaauuuucagugagcucauacauuuccauauauuaauguuuggaaucuuuaucaguuaaaguuuuuuauaucucugaagcuucacuugaagaguucaacucgaauuugaaauguaaaaacaaguuuacuccaaacuuguuuuauaugacuuggcuuauuuuuguucuugcgagacuggcugauaauuuauucucucuucuugaaagccugcuugcuauuuuaaauuuccuugaaagcaguauccaauauuaaaggcauuuaagaagcuuauuuccaucauguucaugaacaaaaucaggcuggaggacuuguagacuagcaggagcauaugagcagauaucuaagcccucuuuccaguaaaugauuuaaacagucaaagaaaaacaaaaauuagaaaagaucccccauuagcacuaaaauaccauggaauagugccagcugagaggcagagaguuuaaagaauuucuagagaaaaugcagaugaauccacauuaaaagucaucacuaagagcccaaucccagucccucuuuuaaagucaguuguggagugcuacagaaaauaagcagacugcuccaucaucucuuauuuggagggcaugggcugugauagacaaaacuaacaggacaaagguagacugcaguugaagcccuccacguuuguaccauuugagggagacaaagaaacacuaaacagaaacucaacaguaggucacugucugaguuacauaccuguguagcaggcucacccugacauaaggaagcugucuucccaaccaaaagguccccagcaucaaggacuaaaggcgaaggaggcuuuaggaaacauggguaugucuuacuuaaucacaaagcagccaaaggcagcgaagcuggggaaaggaaauauauacaaacucagcaaacagaaugcuuaugggcagcaggacccuggcgucacucaugaggaaagggagaggucccagugggauagagcuguuccccaaccagaugggcugaagcacuaacaaagaaaaucagacauuaccaaacuauaaaucugaacuagaggccaagacaaguaaaagagaaauacaaaggguguggguuguggggugggcaugaccugaucuuuuaagcaguauuuucaauagaaaaaaguuugucagugauaacguucuaaaugcuccauuaagauaauguuuucggcugggugugguggcucacgccuguaauccuagcacuuuaggaggcugaagcagguggaucaccugagguugggaguuugagaccggccugaccaacauggagaaacuccgucucuacuaaaaauagaaaaaaauuagccaggagugguggugcaugccuauaaucccagcuacucgggaggcugaggcaggagaaucucuugaaaccgggaggcggagguugcagugagcugagauccugccauugcacuccagccuaggcaacaagagugaaaaacucaaaaaaaagaaaaauaaaaaagacaauguuuugaauacucugagaaaauuauauuauaauuuuguggguacagauaaaucagcucuccuucaagaaugugugaauaggagaacaaaucagaauaguaccuauuggguugggggggacuucaacuaaaagacaaaaauaaacauguuacuuaauaguagaagaacacacuuucagaaaugauuugcuuacuguucuagaaauaaaucuuagaccucaugugccuuauccugacaaagaaaauuuucuuagguauucauugaaacaacagauaaaugauuaacuuggaaaacaggcuaaaauuaagaaguuaaggaaaauauuguuaggugacauaauuccacaacaaaauauaaagaaguauuagaacaaguaaaaaacagaauacugcaaauaauaaagcuagucaaguggagaauaaguugagauuuuuauuccuuucuuuuccuaaauaacucuuuguucaaagaaagcaaagcuuugaaauaaggaauuucugaaaauaauuguaauauguaagcaccucucaaaaugcauuggcuauagcuauaguauaacuagagucuuaaaacucuuuuauugacaaaacaaaacaaaauaaaaacaauuaaguauuccaaaucacuaauuuaggaaaacaaagcaaauuuaagcaaagaaaggaaaaguaauuuuuaaaaauaagagaauuaguuaauaacaaaauauauauaguaggcuuaauaaaucuaagaguagguuccuuggaaaauaaucuagugaauagcaaaacuaaggcaauuuuaaaaaaauacauacacuaacuuaguguacacagaggugcuguaccuacagauacagagaauauuuacguaguaaaaugccauguauuuuaaaccaauaaauuagaaaaccuagagugcaugguguuccagggaaauauauacugcuaaagucaucucaagaggagacacagagccuaaauaaacuuauaccuauugaaaauauucuuuaaacuuuucaaauuauccugcaauuauacccagagcccauugugccacagauauucuuuucaauuuuccaagaaacguaacucuuaaugucauuuaaauuuuauaaagcaaagaaaaagaagggaaaacuaacaguuuucuccauugguaaauuauucuuaguugagaauacuuuuucuaucaacuguaggccugauauuacaugaugucuaauauuuuuaggcaauaguagcucacuauucauuuaaauaucuauuaaguaccucauaugcacuaaggauucaagauucuuguccuugaggaagagagaugcuuaaaacauuuuaagaaaacaauguaauuaguuuucuaauguauguauguauguguguguguguguguguguguguguguguguguauauauuuuuuuuuuuuuugguuuguuuuuguuuuuugagacggagucucacuccgucgcccaggcuggaaugcagugacgcgaacucaacucacugcaaccucgccucccggguucaagagauucuccugccucagccuccugaguagcugggauuacaggcacuugccacuacgccuggcuaauuuuuguauuuuuaguagagaggguuucgccauauuggcuaggcuggucucaaacuccugaccucagguaaucuacccgccuuggccucccaaagugcugcgauuacaggcaugagccacugcacuuggccaguuuucuaauagauuauacauaacauccuuuagaaacauuaaaaaacaggggugggaggagacuaaauuugccucgaagaguuugggaugacuucacagaggcuguagauuccuuauuauaauuaaacaaaaauuauuuaaauauuucccaagacauuuccucaagguuguuaauaacggcccugauuugucuugguauuaccuaccguauggcagcauugugcuauguuaagaguuuagguagauguguuucccaaagccaggcacucccuucuguguaauguaauguauugguauacaaaacguaauguauuguauacaaagccaggcacucccuucuguguaauguaauguauugguauacaaaauguaauguauuguauacaaagccaggcacucccuucuguguaauguaauguauugguauacaaaauguaauguauuguauacaaagaccuuugucugacacaaagcacauucaauucccaagugauuacaguacuguuuagaacauuuuuaaaaaagaaaacaugacuuuuuuucccaguaaauacauagcuuaaaacccucuccuacuacuacuuccuuuuccaacuuuuggugcuuuguuuauucuaauguaauuauauaggccaaauaugaguccacauggucaauguaggaauggaagcagcucuuaguaaagcauaaucauauggugcucuuuuacuuuucucccaaaucuuacguaaaaaugucuuaaaggaaccaauuugaaauugauagcccuuuccaacucucuuagucacuaauugaaugacaaucauuauucauccaucacacauuuauuaauuaccuaccaugugccaagcacaguguuaggaaucaaaauaagaauaagagacaaauccaaguacuccagucuuuccagugacauuucuuaagacauuuaaaaauauuuggucagguauccaauuauauuugauaccuuauuacucauacucugcccuguuccaggaaauguuuauauuuccuguuuuuauuuugccugauguauaguuaacagccauuucauguuuucacaaugaaaucuuuauaacauagugcauccacuacuuuguugacagcaauucuauuacaaaacuauggaaagagugguacuuucuuuucauuaaauuauaaauaauaaaaggcaagccagauaugaaaaguaggcauauguugcaaaaugagggcucacuguggccacugaaguuaugauguuacuaaaaauacuaagugucauuuagaagagaccaaaaaaugacugccuuuaaggaaaacagaauuucagagaagaaaaauaaucaccaauguauucaagagcaaugaguaauuuaaaacuguuuccuguauuuguucaauaaaaauuuaauaaguuaugaaaaagaucaaaaaauaaauuugcgaauuacagauuuuuuaggguaguauguaguagugggaagcgaccuaggauuuagaggaccugaagcgugaacccagccucuagaaauucgcugcuucacuuuacagcagucaucucacaucucagaggcucaggcuuuucaaaggugagggcuagaaaaaaagagaacuaauuugacauucacauuauuuucagcaucaguuauucauuaacuaagauaaauauauguuauuuauccacaguuuuuguaagccuucuauaauaaguuaaaguauauuuaaguauauuuguaacucagggaacuacuuaauuguauauauaucuguguucacaauaugucaaggauuaggaagaagaugaggaugggucuuaccucuaaaaauaugcauaaauuuccaaggacauaaaaaccuggaagacagaaguugguaaucuaaagauuccggaggggcuggguguggcagcucauucccauaauuccagcacuuugggaagccgaggcagguggauugcuugaggccaggaguuugcgaacagccugggcaacauggcaaaacccugucucuacaaaaaauacaaaaaauuagccaggggugguggcaugccccuguggucucagcuacucuggaagcugaggugggaggaucaccugagccugggaaguugaggcugcagugagccucaaucaggccacugcaccgcagucugggcaacaggagugaaacccugucugaaaaaaaaaaaaaaaaaaaaaaaaaagguccuggaugaagauguucuguuaaugauaccauuuuaacuguauuggcacuaauugaauucuagccucaacuugguaaccuucuauuacuuuauacuuugcuuaguacaaucuauaauuagcaguccuuaaaaccccucaguaagguuaaguuuaaaaaaacacaacucucacaaauaagcaauacuuccacuuguggaacuguuugauuuaaauguuagcaacugauaauuuuauuuauuagaagcuacaguaauugagcacugaaaugggaacaaaaacaagcauagcacaaaugcacccccuauuguauuauuuacuaucauacaugaaaauaaaguuauacuuuccuuaaacuuuuuaggaaacaccuugcauuagagcaacuaaaauauauaagcgugaaccacuccaauagaaaacaauuccuaaauuacacauuugugggggaagugaugccuuuuuuuugaagaagagauaauuuuguuuaauagguuaauuuauccagcuuuaaaaaauguaucaaguauaacauuucuaaauugaacucuugauuuacaaguauuuaaugauucagacagauaauuaaagggaauucucaguccucaagggguugaaggauucaacaacauggauuucaaccgugguauuaucaaguaacucaagauguaauaaucucaagaacauaaauuuaaaacuugaauauaaaacaagacauaagcacuccagugaagucaaucuuuuuucucauuuugauuaaaaguaugaccuggggccaggugugguggcucaagccuguaaucccagcacuuugggaggcugaggcgggcagaucaugaagucaagagauagagaccauccuggccaacauggugaaaccccaucuuuacuaaaaauacaaaaauuagcugggcaugguggugugugccuguagucccagcuacucaggaggcugaggcagaagaauugcuugaacccggaauguggagguugcaaugagccaagauuguaucaccacacuccagacuggugacagcgugagacuccaucuccaaaaaaacaaaaacaaaaacaaaaacaaaaacaaaacaaacaaaaaaaaacagugugaccugggaguuaaaauuaaacauaugcuuauaucagauccaguucauagcaaaaauucacaaaugggaucuaauuaaacuaaagacauucuucauagcaaaauaaacuaucaacagagaaaacagacaaccuacagaaugggagaaaaauuuugcaauuuauguaucugacaauaguauccagcaucuauaaggaucuuaaauuuacaggaaaaacaaacaaacaaacaaacauccccauugaaaaagugggcaaaggacaugaacagacacuuuacaaaagaagacauacaugcggccaacaaacauaugaaauaaagcucaacaucacugaucauuagagaaaugcaaaucaaaaccacaaugagauaccaucucacaccagucaggacggcuauuauuaaaaagucaaaaaauaacacguuagugagguugcggagaaaaaggaacacuuauaugcuauuggugggaauguaaauuaguucaaccauuguggaagacaguguagcgauuccucaaagaccucaagacagaaauacuauucaacccagcaaccccacuacuggguauauaccaaaggaaaaaaaaauuauucuauuauaaagacacaugcacacauauuuucacugcaguccuauucacaauagcaaagacauggaaucaaccuaaaugcccaccaauaauagacuggauaaaaaaaaacuguguuauauauacaccauggaauaacaugcagccauauaagagaauaagaucauguuuuuugcauggacauggauggagcuggaggccauuauccauagcaaacuaacauaggaacagaaaaccaaauacugcauguucucacuuauaagugggagcuaaaugaugaggacauauggacacagaggggaacaacacacaccggggccuaucagaggguggagggugggaggagggagaggaucaggaaaaauaacuaauggguacuaggcuuaauaccugggugaugaaauaaccuguacaacaaacucccaugacccaagguugccuaugcaacaaaccugcacguguacuccugaacuuaaggaaaaaaguuaaaaagaaauaagccacuugaugguauggaaaaagauuuccauaaauuuccuuaaaggagggacuugaagaaacaagauggaaauuaauaaauuguaaguuaaaaucuccaacauuuauuuagaaaaucacagucacaaagugaaggauaguagagauucauucaucagcugcuugccugaaaaaaagacaaaaaccuuugcggacuaacuucaaugugauuaaaucguacgcucuuacuaucaaaaaagcaagugugcuuugagacuguauuaauagaugugcaguauccaggcaauuagaagagagcccuauaaggauguaaucauguuuaagauaccaaacaccaaacuuuaauauuuaagggaccaguaaguuauaaaugaauccaacauucuuuaauaaagaguagaagaccuagagugacagauucuugcucaacuugcucucaaacuucucuuucuacaguaaaacauuuauguucaucaauacuauuggaauuagaacacuaaacauaucccuaaaguuuccaaauagcuaaaaccucacaacucucaacugcaacacauuuaauuuugguaggacacuuuagugaaaaaaaaauguaaguaucaaauguucugcaaguguuaauuauaauuaaguaucucugagguucaagcucuaauauaguguaacuucgcaaaugagacuaucauguuuugacacuugaaguucugacuacucgacucccacacugauguaccagaucagugaguucccaaauauuaccacaaguauccaauuaggugcuagacuaguccucuuaggaaugcaguaaagaagguuccugcaugguauggaaagggaauguucauuuuuucagccuacaaggcauauuuuuuccagaugauaauaauagcaauuuuguaaacauucugauucucauaaauuuagaaaacauuuucuugcccuuauuuucuggcuacugcuucuuucuccauaacuuccuucugucuccuuuaacuggucucaaauauuugauguuagcauuuuauaacauauuuuaguuucugacuuagguuaauuaagagaaauaucuuccauaucauuaucaaaagcuaaguuuuaaaaaauauauuuugauaguuuuccuuuucauaggacaaugacaccuucguuaaaucaaaaagcauuuauuuauguauuuuauuuauuuauuuauuuauugagacagaguuucacucuuguugcucaggcuggagugcaacggcacgaucucggcucacugcaaccuccaccuccugaguucaagcgauuccccugccucagccucccgaguagcugguauuauaggcaugcaccaccacccccagcuaauuuugcauuuuuaguagagaugggguuucaccauacuggucaggcuggucucaaacucuugaccucaggugauccacccgccucggccucccaaauugcugggauuacaggagugagcuaccucaccuggcccaaaaaacauuuauuaaauacuuacuauguaggcauucagagaugcuuuucuacguugcuacucuaggaagacuuacuaauaaaauaaacaucauaguaauucuaauuuuucaaaugucuaaaaggugacucacuuucaaaaaauaaaacuuuuggaaaaacagaaagggacaauuaaaauauaaauuaaaaaacaaaacuacucuuccuugccuuacucugaaagugaguaaagggaaaaaccuuucagagaccaucugguuuuauauuucauuagugaauauaugauuuuauuuuguucuaaaugaaauacacuugaaaugccuaaauauuuaauucuacauuugaugugggaaguguauuuacuuuccucuauagcuauggauauuaagaaucacuuuuuacucuuuggucagggaaccuaaagcuuagaagucuuuccuaaaaugcucucuagagaucuacaguauuaguuuuucccugcaagccugcauccauucucagccacaucacaaagcaccuggacagcacucucaaacauauggccuccuacaagagccuacauucuaaaguccacugaccacuuucugcuucucugacagugaaaaacagaacacaaccaaaaacugcuggauaagaaaaucuauaaucaaugauaaacuucucauaauuuucaaaauauuuucuguauucauguauuucucacuaaggucuugagcauguuuagucaucagaaauuaucaccuaauagacaucaaauaucauucacaacagcucucaaacuucucuuucuacagugaaacauuuauauucaucaauacuauuagaauuagaacacuaaacauaucccuaaagucucuaaauagcuaaaaccucacaaaucucaacugcaacacauuuaauuuugauaggauacuuuagugaaaaaaauguagguaucaaauguuccacaaguguugcuuauaauuaaguaucucugagguucaagcuccgauauaauguaacuuugcaaaugagauuaucauguuuugacacuugaaguuccaacuacucgacucccacaccucuucccuccacuuagugggcaagugcuguaucuauuuuaagaaguaggaagaaguugccaguagggggagagggaaauaaaacauaugaaaaagaucacaaagucaaccucuucuuuuaaauuguaugauugaaugccuacuauguaaccagauacuguguaaaauauuaguaauaagaagacaagaugcagccuuugcccuaggaauuucagaaucugcaaaggagacaagcauaaacaaaugacuacaguaaguaggauguuugaggaacaacagugccacaacaaauaugaagcuucccuuaugagaaaucugagcuguguaguuaagagaaaagggaaguucaucaggagaggaacagcgguacaaagguucaguguguaaaauacgaugucacgguaaagauuuacaaaucugaagggacaauauaguaaggaggaauuugaagaguaaccaggagccagaucaggaauaucaagcauagaguuugaucuacuuucuguaggcugaugguuuucuguacugaguucuucagauuccuggguucacagagcuauucagggccacucugaaaaggggauaaguagguguccccaagaauucuacaucacaucuauuuuugcauuaaccaaauaaacuccauucuaauugcaaaaacuucaaguggugagguggggagggggaagcuuccacuccuuuaauaaagucugaaauggguauccauaaaagaaaggauauuaagaagggguauagauggucagauuugcacuuaagaaugggcauacagagguacuuugaacugaucaucagaaaaaaaaaaaagaacagaggcagagggaacaauuaggaaauaauuuauggaaguggugagaugacucugaagaaugaaaagaauggauaugucuaaacuguguuuugggguagagguggaaaaauaugguagaaguucuuggucuacagguugaaugcucucaaugcaauaggaagcaagcuggugagcaggacuuaaggaaggguauugugugugagugugcacaaguaugugcacguguacaaguggggguaggagucaagaucuugagaagauggucaaaauauuuuaagaaaaguccccaagacuccuaccaagauucaaggacuauacguguccuugguugagaauuacaaaauugcuacgcacauagacaacauuauagucagccccccauggguauucauggauuccagcaucuguggauucaaucaaucacagaucaaaauacucagaaaaaaaauggauugcuguguuuguaaugaacauguacagauuaauuuucuugucacuauucccuaaacaauacaguguaauaacuacuuacauagcauggacauuguaguauuauaaauaaucgagagaugauucgaaguauaugggaggguauauguaaaucaugugcaaauacugcacuauuuuauauaagagacuugaggauccacagauuuugauauccaugggggguccuggaaccaaucucccacagauacugaaggacaacuguaauuauaugaucauagauucuucuagaacaucauuacuuguuuuucuagucuuucaauauuaaaugagcuaagaaaauccauacuauuuucacauuuugagaaaaaugucuggucagauuaacaucuguaaagaugaauaaacguuuuuagugccuguauuuacauugcaauuuucuuucagaauacaaacuguuuucacuaagacucuuccauuucuacuuaaaagauccugagaucaacagaggcagcugauauuucaccuuuugaugaggaaacugaaacacaagaauagugaaaaugacuuucauaaggugcagucuauuuuagcaugcuuuacuuguucuaaaaucaaaggacacaucauauguggauaugcauuaaaugcaaaaaaugcuauacagcuauuugugaauuuagggauugccaagguugucagauaaaugccacaagaaggucaacagucuuguuuaauucagucucuugggacacagagacuacugauaccacucugggccuuaauauauaugcaagacaccauguauaagagugguuuugcuuucacauaguugaguuaugacuuguaucauaccauguggcauguguaauggagagaguaaagaaguguauaaagaauuguaaagcuacuguaaauacaugucugcucacuugcuagguaauuauauuuuauuagaauaaaaaacaacugauaaguaguagaaaaauugaagaguacaguuugaagagcacuguauuaugaucucuaaggucuauuuuuucuuuuauaauccugugacucaaagaauaaacugcucaggcuugcuagaacaaugacuauggauuuuaguucauaagaaugaccuguaaggaaguaacaaugaagucuuaaagucuaaguauuggcuuaaauuugaagagaaaucaguagccagaucaggaaaaucaagcaaagagugugauuuauuuccuguagggugaugguuuuuugggccaauaagaaaagcuauuuuucuucugaaagauaaacagaaaaauaguacaacaguagaaauaucauuccuccuuauacuacugaaaagauaaaaagauaacauuguaaaucaggaaacuucaacaaugacuaaaggugggagaaagugauuaauuaaaucaagaagacugaagcuucuaaacaaguuagaucuguuucaugagaaaggguaaaauguguauguuaauuagaaaaauggcuacaagagagugcuaacaggcaagucaaaccuucuaauccuauucuccacaagcaagccagcaaaauacaaaccacuaauacuuuuuuauuauuuuuuuauuagcaggaggagagucucaguauggagaccugggcuagaccaaguuagauacuagcuagaggcauggcuauaaagucauguaacaucucuggguauccuuuuuccuuccacaaaaugaacuaauuggacuagcugaugucuaaugguuccaaaucaauaauuuuuugauucucugucucuccaacuuauuauaaaaauacaaaauuuggauagcaaacaacuuuuguacuauguuaguauuacacggauuuaaugcauaguaaaaacagcucuuagaaacuuaauucagccuauaugacaaauaucaaaugaacuuuaguugccuuaagaauaucugcaucugauugucuuaacugacucaugcugaauucaaacucauaugucccaacuucccuauuucuuuuaauaccaacacguaauuaaucauuuugaaaauuuuagagaaaucuuugacuccucucuuuuaucucuuacgugcagucagcaaauaaauccucaugauuuuuccuuaaaauauauaaaaucuaucuucccuucucucuuaacaaaauccauuuucaauuuaucuccuaaauuacuccaacuacugccuccauuuccuuauuuguuuaaauuuguaaaaauaaugauauagcuaaauacaagaauucaccuuucuacucaucugcucuaauuauuccccaauauuuucaggauagcaugcaauaaucuuuagcuugacuuuaggauuuuacuaaauuuggccuuacccugcuuucccaucuucucucuauuugccaacaugaacuuuauacaaggucgccuuuuuccugcuucccacuugcccucugccuggcccauuccugcccuaaaggccaacauucuuauuucacuccauuucaugcuguuuccccuccacuucucuccacugggaugucauucuuuguuaucgaucccaauucuuccuguccuucaggauccaggccaugcccugucaccuuccuuugugaagccuccucuguuauaguccagauggaccuugcuauucaacuuccaaaguucuuguccauaucacuuacuuaaguguauguguaaauauuuacugauguauaagauacugugauucuuuuuaaaucacucugcauaaaaccuuuuacuacuccaggucuuuuggcuguucuccacuaccugcaauuccuucagauaacuucauggcuuguuuuuauaucuuuaucagauuuuuauuuaagacauaaucuucucuugaagcugccuuacuugacuacuauaucuucaauuacuaccuaacccugccacucaauuuccuuuuucugcuuuacauuuuuaaaacuuagcacuucuugguauuuacuauauuauacauuuuauuuuguaugugucugucucuuacucuaauggauucuaagcucaacaagggaagagauuuuugccucuuacucauuaaugccacucuaguuccuagaagagugccugguauuuggcaggugcucaagaaauauuuuugaaugaauucauauuucaaaaacuaaaagcaacauuaauaaaagugguuaauaauaaaacaaauaccaauauaaaauugagaacuuacuauauguugggcaauguacagguaaugcauaaaauaauccuguuauuaucuauuauuaccuacuuucuucuuugccauuuaaagcagggcuuacagagguuaaauaauuuucccaagaacacauuccuaauaaauguacuaaaaauaaacucuaggcuuauuugcuauugaaaauaugucaagggcugagcuuauccaacuguaaaaaauuaaaugcaaaacaagauuuuugaggagauaugagggaagaacuccucagagagcuaccuguaaaaccuuuucccucaauggcuaauauuuuaauuuguugucuucguuuuuuuuuuaaguuaucuuauaauuuuccauaaacuucugcacuuuauuccuuacccaggcuuaacguucaagaagagaaaaucuucugacuaauguuaugacuucauuaaggaggaaaauuccaucuuaaaaaugcgcucucaguucucauguaaaagacaagagcagaaugaguagucacaguucucacagagugagguaaagcaaucaucaagggaggaggggaaaaguaaagaaugcuuuauucauaauuaccuaagauuuuccagcaugagaggggaaagaggaagucuauuuucagugacaaugauuacucuaaaaauauuaacaugcaaggggaaaauuuucauucugagaguuacuacuauacugaguucucuuucccucacagagugacuuaaaauucccaagguagagagguaaucuagacagaugcgcuugcccugugucuugaaaauggcaacauccaggaaucaugggaguucaacugaggacacacuggaaaggauuucucagcaccagaacagucucugagaaguaucaaguggcagaguggauacuuauauccucaggugucugcaguaaggcagagauuagagcuauacaggcuuauuagaagauuuguuaugcugaaugcauaaacaagauuuagugaaacugaagcugaauuaccuacuaaaaggauuauagacaaaaaaaaagccuaauucuuccuuuuuucuaucuaauccagagucucuccugcaaugucucuauaauuuuaacugucuuauauaguucaggcaaaauuauauauuguagaauucauucucaucuucaucuuaaacauuuuagacaaaaauauauuaguucccuacuucuauacaugcauauaugagaaaauggucugacaacccuuagguugggacacucagcaggucauggcauucagagcaaauugauuuuuauuaagauaauuauaagaacaugauuaaaaaaguauuuuguaucucccucuuucuuuuguauuuucagaaaaucauaugaacugggccugggggcaugcaccuguaaucccagcuccuuaagaggcuaaggcaggaugauggcuugaacccaggaguuucagagcagccugggcaacauagccagacucugucucuauccauuaaaaacaaaccguauguaaaaucacauagcugcuccugagaucugccauuccauaauuuaguucucugcuaguucuauggcaccaaauugucacaagacugacuagccaggugcaggagguacucacuuuucagaucagcaaguaaccacaaauaccauuuauuugguccuuaacaagauugagacgaaguggcuacaagugaagcaaaauggaggcgauaaauacucuaacaacugguuauagauaucacauuuucuuauguuuauaguuacauuugaauaauccuuaccucuuuuuaaaaacuccauagacauugagaauugauaaaaaucuaucuuucuccagaaaaauacagcuauacauaagucaguacacaacuuuaguaaauucacaaaucuuaacaaucuaauccauguguccuaagcauagacaauaaagaaaaguauuugagagggugcaggguaacuugaaguugaaguuugggagagagauuaccauuacauuaggaauaaauucauacuugacaaacaagugucaacugucuccacugucuuaccagcagcucagucccuuacugcucuuccuggaucauguccuauuggcugcugcugagcccaucuccugcuuccaagcguuguaacucaacaggagcaaaggcaaguaaacaaucuugagagggugugcugcugaauguuugccagccuagagaagacagaguuugaacauuuuuaaguuagcaaaaaggaacaggguauauacaccugauauaaagaguuuaaaagguuuuggauaccuauaauuggauauuuccauuacaguguggcuguuaaaaaacuuagagaaucuuucucaaagcaaugacacucucaaauguaccauaauaacaauucuaauaucuguagaacacuuugccaugcccaaagcaucuuuagucuucacaucuucaccgcaauaaucaaugaggcuuaagagccaguggcuuauauuacuucaucuguugaauccagugguucacaguguggcuuacaagaguaucaccuagguaagaaguugaggauuuugcucagagauucugacuuguugagcuaagaggaaacuuuauucuccaggugacuguaagaugaagucaggauugagaaucauuaagucccuguacuucaugagauguggcacuaacuaaacucauaaauagcaagcauucauucaguauaugccaugucaagguaacaugcuaagugcuauggaaaagguaaaacauuauaacauguggucucugugcucaaggguuuuaauuuagcuggagagacuggacauauacuuuaaaaggaccaccuaauaagauaccuacuuuaaaaacauaacccaaguaagacuuaauuggucaaagauguaguaaaaauauugggugcuacaaauaaguggagaugacaugcacugauaaaagggaguagguuaaaaacaugagagaaguccacagaguuccaagggcagagagaaaagaggaauggggagaaagcguuguuuugaggcacagauacagcugcagcaaauuggaggagauuaaaaagcucucucugacugaagagugucuacaaaggagcacaagaagacuuuggaaagaccgauuugaaacagaaucuaaagaguuuugauaaaauggcuaaaggaguugguccauuguccugaauauauggaaacaguauuggaauauccugaaauaguaucuggaauaguaucagaagcaguugaagcucagguucccgggguucuugguaaaugccagacacuaugcuagaugcacuacauauguuaccucauuuaacacucaaaaaaaucugguaagaucauuauuauuaucauuaucaucauuauuauuauucccauuuuacagaguaagaagggaggucucuuaauuuuuucucaaagucacaugccuagaaauaguaagcugagacugggacacguugcuucuuuagaaacauggcaucauaaaagccauacguuaaaauuuaagggguguuuugagauauaauucacauaccauaaaauacauccuuguaaaguauaugagucaguggguuuuaguauauuaaaaaaaauuaugccacucucaccuaucauuacuaucaaauucuacaauauuuucaucacucugucccccucgccccaaaaaacccaguacccauuaggagccaguuuucauucauuccucccccgggccuuggugaccacuaaucaacuuucagucuuuauggguuuuccuauuuugaacgacuuuauauauauaaaaccauacaaaauuuggccuuuuacgucugguuucuuucacuuaguguaauguuuuuaaggugcaucuguauugcagcaugugucuguacuuuauuccuuuguaugacuaauauucuacuguuuugauaugccauguuuccuuuagcuaucaaugaugaacuuuuggguuacuuccacuuuuagccucauaaauaaugcuucuuuggauauucauuucaaacuuuuuaauugugauaaaauguauguaacaaaguuugccauucaaaccauauuuaaguauacuauucuguggcauuaaguacauucacauugcugugcaaccaucacugccacccaucuccagaacuuuuucaucuuccuaaacagaaauucuauacucauuaaacaauaacuucccauuugcuccuccucccagccccuggcaaucauuauucuacuguaugccucuauuaauuugacuauucuaaguaccucauguaaguggaaucauaauauuuuucuuugugugauuggcuuauuccacuuaguagaauguauacaagauccauuuauuuucuagcaugugucagaauuuucuuccucuuuaagguugaauaauaguccauuguaugucuauaccacauucuguuuauccauucauccaucuguaggcauuuggguugcuucuaccuuuaggcuauugugaauaaugcugcaacaaacauggauauacaauguuuauaaguuuuuguaugggcauauguuuucaauucucuugagaguggaaucccuaagagcgaaacuacugggucuuaugguaguuccaugcuuaaucuuuugaugaacugccaaacuguuuugcaaaguggcugcaccuuuuuacauuccacuagcaaugugucaggguuccaauuuuuccauauccgcacuaacaccuguuauuguauguuuuaaaaauuauauccaucccagugagugugaagugguagaagauuuagguguuauaaauaaucauaugcaagauauuggcuuauugcaguacucaaguauaagcaauaguuggaaugagaggguggcagaauaaaugaaauaaaaugaucaaacagaaauauuacugauaaagaaaugaauggcauuuaguaacauuuuaaauguaagaagaaaaaagaaauucaauuauagugauaaagcuuuugaguuugguugucugaaagaaugaugcuacuaaugagauaaauagauaauucuagaaaggaaucugaaaugacaaauucuugacaugaugcauuugaaaaaacuuauguauuccaaauaaauauucaucaggcaggugaaguacaggaggucaggguuggagucaauaggcuauuucauuuuucuuuuuaaagaaaugaucaaagaaacauuauuaagauuagaagaggguuauugccuguauaugauuagacucuuaaaucugaguucagcaacugacaaaccaaauacugaggaaggcagaggaguuuuuaccuucuguuuucuguuuaaaauaguaaaacaaaacuuaaaaaguaaaaaauauaacuuuauuaagcuuuauagaacuuguuuuuaucagaauuugaguugguaucacauuuuuaacuauaccaagguggugcuugugguucuuggaauggugugagcaguucuagggggauuucccucucugagcuggcacaagauugggaguccuggaggacaugagugucacuaccagcaguuaucugguugacugggaaucaagcuggcaaacuaucaaggagaaaccaugaauucuaguuuuauaugcccaaaacaguccccuuuaguaaaaagaggugauccccaacaaauagaauagucucuugcuagaauauaguuccucaguagccaauaauucuggcuuuguucagcuuugcaaagucuccaauaugauaauauucugauaaauacagugaugacucacaggcuuauauacauguuuugaaagagaagcuuaaugaugcuauuuuggaucaugaagccaggccgcgguggcucaugccugcaaucccagcacuuugggaggccaagguggguggaucacuugaggucaggaguuugagaccugccuagacaacaugaugaaaccccgucucuacuaaaaauauaaaaauuauccaggcaugguggugcaagccuguagucccagcuacuggggaggcugaggcgggagaaucgccuccaggaggcggagguugcaauaagcugagaucgcaccacugcacuccagccugggugacagagugagacuccaucucaaaaaaaaaaaaaaaaaaaagaaaaugcaaaauacagucagcuuauacacugaguuuuccuucugccaugauacauugagaguuauaaaaaaaucacuuagaagauaaaacggaacaaacauaugaaggguagugcugaagacagagguuaagauaagggccaugaaggggguuaaagaaaaaucuaagccgaugagcacauuuaaauguucucauucccacacacauaucuacuguuguuuuuguuuuuuuguuuguuuucuugagacagggucuugcucugucacccaggcucaagugcaguggcacgaucucggcucacugcagcacugaccucccagacucaagcuauccuuccaucucagucucccaaguggcuaggacuacaggcauguaccaccacacccagcacauuuuuuguuuauuuuuuguagagaugaggucucacuauguugcccaggcaggucucaaacuccuaaccucaagugauccaccugcgucaaccuuccaaagugcugggauuacaggugugagccaccacgcccagccauaucuacauuuuuaauugaauaaaauacacuucaccaucaaaguugcaaucauuuugagcauaauaucauuccuaaacauauuuuccuuuguucccuaaauugaagccuauucuauuuuaucuuuauaaacuauucacuguucuauuuuuauuuuuuauuuuuuagagacagagucuugcucuguagcccaggcuggagugcaguggugcgaucuuggcucacugcaagcuccgccuccccgguucacgccauucuccugccucagccuccugaguagcugggauuacaggcgcaugcccccacgccuggcuaauuuuuguauuuuuaguagagacgggauuucaccguguuagccaggauggucucgaucuccugaccucgugauccgcauaccucggccuccgaaagugcugggauuacaggcaugagccacugcgccuggucucacuguguuuuagaaagguauuaucuacuuuaucugcaauauuuuccaaauagauuuagaaaaaaaagacaauaaaaauagcuaaaauuuauugaauggauucuaagucaucuaauuuucaaaauacuaucaguuguuuaccuuagcacacccuuuguggguggcagggccuccagagccugugcucuuauucaacaugcuucauggccuccacaagcuuguaggagauucagugaaacauuucauuuuggggaaagguaaauaauucuacauuucaaagccuagagacagacaaguuuucguucaaaaaugaaggaaaaaaaaaaaccucuucucuaaaaaccagucacucuaccuauaaacaugaauauaucauuacaagcuaggcaccuuauauaagaauccuccauuugggguuuaaaugcauuuuccuuucaagagauagauccaccauugaucaaacaucaucaaacacuuccguuacaaaaaagggacuuuguuuaucaugcugaauuuaguccuucccuucccuuugugauauuaguacaccuucauggcauguuucuucaaagccccaguaauagauguuuccuuccuguugaaaugcugcuuuggcugcuucugugcuugaugugguucuccuccagguuuaaaugggaugagacuggaguucacuaaucagcacguuacucaccucagcaggauaugcccacaaaguguuucuccuauucuuauacacaugaguacacacauaaauacacacacacacacacacaccucucugcaaguaaaugauuccaacuguacagugccuaaagggaagugcuauuucagaaugucagcuacuuggcagugauggcuauucuccuguuaaugcuuuaaaaaaccacuacaguagucaaaguuuuaagaagaaaauuaaagaccuuaaauguauucacuuccugcuccuccuaacauagacaaaguggugacucccaguaaagaacucaguguuugcagaacaaauuccaugaagauaaaaacaagcauacaccauaugagguuguuucuaauuaacagucuuuauauaacuacgauagccaaacaaggcugaaauaucaaccaccaguuauaaacaauuuaacauaguauuuccauuauacaaagugauuauuuaagaaccaaacacuggaacaugagagguacagguauaaauucacaaggcauuguguauagauuaucagaucaauuuauauaguuuccgaaaauaaaaagaaguuaugagggaauauuuuuuaaaauaauagauauuuuuaaaaaccaagauggaaaacauuucagaagaaaauacccuauaaacaucacacagaaaaugcaaaaaaaaauucugcaucugaaacacaaacuuuucacgacauucugacacuggcuaauacuugaccucacuggucagagacugggccaaugaaggaugugcucaaaaucuuaacuuugaaaagccucuuaaggguaugguuuauuuuucauccacuaaaauagaaaauauaauucucuacaauagacuuaccauuccuaacauccaggcauuuuagagauccccgcuagaaauuucaaguaguauaggagaagaaaggagugaaaggggaagaaaggggcaaagaaagguaacuugcauugauuuugaugcuuuaauagucauuuucuuuuucuucacacaaggaacuucagguauuugugauuguauuugcgcggcugacuacagggcaauaauucuauugggagcuagguuuuuagcugaaucucagaaugucucuccuguaacuuccauaaacccacaggcaaacuaaggggguaggcuguagaagagauaacaaaguauaaauuaaucuuggguucuaauucugacucuaauccuccauaaauucaugaucuugagccgaucacuuagggaaacugaggacuagagagccuauaagauguuaaauuguauuauuucuguuccaacccagcuuuaagguuuuaugauuccaugauuuagauacuaucgaauuugagauaaaaaauauauauaggaaaaagaguuauugaaaugaauagguauaaaaacacaagcaaaauuauauuaauggaauuauucuaagucuacuugugugauauuaaguuuauaaaaggauaucccuuacauuguaauauauaacuauaauugauagccacaauacuuauuauugauuccaaagcaauuuuuacaauauauauucuauuccuuauauuuaguaauuuaauauuacaaaaugauguaaugguuucuggggaguaaugagucuacuaccaugguucucuuagacugaacugcuaauugcauccauuuaaaacagccacagauugaggaucaauaaacugguagacuuuaagugcuuuuuaaaaacugcuuccaaucuauagcauuaacccagauauuuuaaaaaugauuuuauuuuucguauuuuggggggauaaguauuagguauacaugaacccuaccuuacaauuucuucaaaauggauggaaagaaugaauuuuuaaaucacuuaugucauaaauuauuuauagcccaaauaucuucaucuaaggaugcuuuaagucauaugaccuauaugagcuaagguuuaaagacauuacauuaauaucaugaauauaaacaucaaaggaucaauuauaaaaauucuaaugcuuaaugggauggcaaacuacaaaauaaaauuuuacacuauaguauaaagcugcugacauuugaucagucacuauuuuuaaaaaaauuccuucaguaacaauauucucuaauguucauucuaaaaauugaaacaaggaaauuuuuaucuaaucuauuucuaauagaaaggcaaauaaaaaauacuuuuuuaaagauuucaaaacguauaggaaaacucugcaguuauguuuaccugguuuguuaaaaacaaacuaugcauucugcaaaauugcaagugucuacuuuuaucauaagguaaucuuaaaaguaguuuaguaaacaucaaguuacgacaaguagacgucucccuuaccacacaggagugauaaucaaaauauuuaacagcucauauguccaggcaugagacauagugcuggaggaggauccuagaggaaccuacaugccauuuauuauucuagcugcaggaugguggguagacccagggaguaauggggaaggagcuauaguggcuuaggguagcagaauuacuagcuaccuuggaaaucuuucaguaaccaucagcacagccacacucaugugcaccugcugccuaucagcucugguuguuugcaugauucuuaaauaagggauaaaaaaguauuaagcaacuguuacaagucuuugcaaauuaccauuugucacuggaaaaaaauguaacuauuaacuuugguuguagccagagaacaaaugauagggaaaauuugauaaaagaaauaaaaauuuaaagaugcaauauuuaaaaauguuuucgaauuauacauaaaauuacauaaaauauuuucauaauauuaaaauuauauaaaaaugaaaguaugagguugaacuuucaaguaauaaccgagauaacagaauuuaaauacacuccucccuaaauaaagaaaguaguauaaaaagcuauaaauucaaucauacuuaagguuggaggguaauauaagugaaucagaaauccaaaugaguauuuuuauaacaaauugugacauaguauuuuucaucaaaguaacucauuaucacauuaaacuggauuuucacaucuucgauuuccuagaaggggcuacacuauugcuacuuacaaguugauugccuaugaauaagcauaucauaaugcucaagaaauagcauaaguaaaaaauauuuggggcagggguuacagauguaggagauuguacagaauuacacauuuuaaagaaguuuuaaaccauuuuuuauuugcuagauuuucuaagugaaauaucugaaucuaaagaaagaaggaauuuguuguugauuguccuguguuaaaagggauuaaagucgcuuagcaaccucuguguuguagaaaccaagauaaaagaagagucgguugucuaucaccagcucuucuaagauggaagagugcaaguaaauagaaaagcacuauuucugcaguggugcuuugacauacauucuucaucacaugacaaaauaaaaaucaucaagaaauucccaggaaaaggaaaauccucaaaaagcauauugugacuaaauggagaauuuacaaaccacuacuauacagacacacacaaagacaaacacacacaauaacaaaagacauggccaaggaguauauagaucguagcugagaaagguagacugcauaguagaaacuuuguuacaaaggauuuaaaauauucuagauagaaauauaaaugagcauaagagugaugauuuacagaaucagagacuauuuuuaaacuugguuuuauagaggcaaacaaggaaugaagauuaaacuaggacaguacauaauuagggaaggcaacuucacauggagggauauauuugaggauuugaguuaaaagaaagauaaaagggccagaugcagugccucacgccuguaauuccagcacuuugggaggcugcgguggguggaucaccugaggucaggaguucaagaccagucuggccaacaucgugaaacccugucucuacuaaaaauacagaauuagccaggugugguggcacaugccuguaauucuagcuacccggcaggcugaggcaggagaaucgcuugaacucaggagguggagguugcagugaggcaagaucgugcuucugcaucccagccugggcaacagagugagacugucuccaagaaaaaaaaaaaaaugauaaaauggcaauaucaauuagaacgugaaauacuguuugugaccauggagaucauggagaauauuuacguuuuagaaagguuuuuuaagugucaugagauucuaaaugcaguaaauaagcucugaaauaaacauaauuuugcuuccugguaaaacaaaaaaagauaaaacuuaaaagaacucaauaauuauagaacacaauuguauauauuuuaucuaucuacaacagccgagaagcacaggcauguaauaauuuguauuuuccuccauguauuaaugacugagauuuuggaauaugaggaaguauuuuuagacuaggaaugaaucaaaucaccauuuuaauguuaucacugagcaaaguggaguuuggcaaaaagaagccacugacucugcauuuagagaagcuugucugaaaaguccuuuaugccaaguugacucagguucauaggccaugagaaaucaauacugaaaguuuugucauugauuuuggaugagaaacaaagugaaggcuggaacaucuaauuccuuacacuugaagaugugaaagugucauuucuaugauaggucaacagccagcugaccagaaaggcauaacuacuguaaccuccaagaaaaaaaacagugaaagaagggagacagacaaaugaacaacccuuaguaggcacauuuuauuucagcucaguagccauuaaaaaccagauacucugcaugcuagaaaaacuuuccucuugggcaugacaaguaauacuccagaaccuaauagugggauaaacuuaaucaugccucacuaggaaugcagcugcuuuagaggaucucacuguagauagucuuccagugggaugucaaucuucccucaaacaugugccacugaaaugacuuaauacucuagugguuuaugccaggucaggguacacaggucaccuagagagccaugaaugaagucaugcauuaucagaaagcaggucagaggugacacaaaucaucuaaguguaacagcugacuacaaauuacuuucuauuauaagcacucauuucccaaaugaagaggauauuuuucauuuuuugaggauagauggugaaaaaaauccucacauaaaaugaaacaagauuuuuuaucuugaauaguuugagaaaaaggauggagucugucuguagguacaugaauuugccuuguaggcuuugcaguaucauuggcauugaaugaaggcaacugaauuaugcccauggacacucauggauaucccccaucaccuccccuauuucuuuuaaugaaagauuuguguugauucuucauugcaaacaagguugugggucaauuaaggaggagacaaaguuauuuuuccuaaccagaaauuggaaaauggaggucaaaaagacaacuugaaaugaaacacuauagcaccccauaaaagaaaagacauaguuuuaucacugauaugguuaggcuuuguguccccacccaaaucucaucuugaauuauaauccccauaaucuccauaauacccaugugucaaggcagagaccagguggaaguaauuggaucaugggggcaguugcccccaugcuguucucaucauagggagugaguucucaugagaucugaugguuuuauaaguguuugguaguugcuucugcguucauuucuccuuccugccacuuugugaagucaccugccaugacuguuaaguuuccugagaccuccccagccaugcuaaacugugagucaauuaaaucucuuuccuuuauaaauuacucagucucaggcaguacuuuauagcaguaugaaaaugaacugauacauucaacuaguuuauuuucuuuuuuauuaacauuuuuucagauugccuaaauuuauuuuauuauuauuauacuuuaaguuuuaggguacaugugcauuaaauuuuuuaacauuaauaaacuuuacaguaaaauugauucacaguaaaacaguagaaaguucccauauaccccuguccccacagacccacaaccuuccccauuaucaacaucccauaccagagugguauauuuguuacaacugauaaaccuacauugaugcauuuugauacccaaaccccauaguuuacauuaggguucacuauuggugguuacauccuacguguuuggacaaauguauaaugacauggauccaccacuauaguauuacauagauucauuucacugcacuaaaaauuugccuauacauuccucccucuggaaaacacugcucuuuuuacugucuccauaauuuuggcuuuuccggaaugucauauaguuggaaucauacaguauuuagccuuuucggauuagcuucuuucacuuuauaauaugcauuuaaguuucauccaugucguuuuaugaugugauagcucauuucuuagugcugaauaauauucuuacaucuggauguaccacaguuuauccacucaaauauuaaaggauaucuugauugcacccaaguuuuggcaauuauguaaagcuguuaaacaaugugugcagguuuuuauguggagauaaguuuuguuuguuuguuuuuguuuuugcuuuuuuuuuugagauggaguuuugcucugucacucaggcuggagugcaauggcaugaucucagcucacugcaaccuccgccuccugggcucaagugauucuccugccucagccucccuaguagcugagauuacaggcgcacacugccacacccagcuacuuuuuuguaucuuuaguagagcugggguuucaccaugggauuucaccaggcuggucuugaacuccugaccucaaaugauccaccugccugggccucccaaagugcugcaauuacaggcgugagcuacugugcccggccaggacauaaguuuucaaguccauaccaaggagcgcuauugcugaaucauaugggaagaguauguuuauuuuguaagaaacugccaaacugucuuccaaagugacuaugccauuuugaauucuuaccagcaaugaaugaagguuccuguugcuccacauucucaccagcacuugguuucaucaguguucugacuucagccauucuaacagguauguagcgguaucucauuguuguuuuaauuuucaauacccuaaugacuaugauguuuaacaucuuuuccuaugcuuucuugacacuuguguaucuucuuuggugaguugucuguucagguuuuuugcucauuuuuuaaguugaguuguucauuuucaaacuguugaguuguaagaguuguuugcacauugugaacaauaguccuuuaugagaaguaucuuuugcaaauaauuuuuccaucuguggcuugucuucucauucucuuaauauugucuuucacagagcagaaguuuuaaauuuuaguuaaguccagcuugucaaucauuuccuucauguaucgugccuuuggagcuguaucuaaaaaaugccacugccauaccaaagucaucuaggauuuuuccuguguuaucuucugggaguuuuauaguucugcauuuuacauuuaggucuaugauucaaguuaauuuuugcaaaggguauaagaucuguguuuacacucaauuuggauuuaaaaaauuuuuguuguuguauguuaauguguaguuuuuccagcauuauuuguugaaaagaccaucuuugcuccauuguauugccuuugcucccuugucaaagaucauuugauuauauuuacauggguuuguuugggcucuuuauucuauuccauuggucuauuugaauauucuuucaccaguacccacuacauugauuaucugagcuuuauaguaagcuuuaaagccagguagugucaguccucugacuuuguuguucuccucaaauacugaguuggcuauucugcucuuuugccucuccauauaaacuuuagaauccuuuuguugauauccauaaaauaucgugcuguguuuuuuaauggcauugcacugaaucuauagaucaaguugggaagaacugacaucuugacaaugaacauguaacaucucuucauuauuuaguucacugguauuuuucauuacacuuuuguaguuuucuucauauagaucauguacauauucuguuagauuuauacaaaaguauuucauuucuuggggugcuaauguaaaugguaauguguuuuuaauucaaauuacacuuguuuauugcugguauacaggaaagugauuggcuuucuuuauauuaaguuuguauucuguaaccuuacaauaaucauuuauuaguuccaguuuucuuuuuucugauccuuuggauauuccauauaaacaacugucauccgugaacaaagacaguuugauuucuuccuccggaaucuguaugcuuuucauuuucuuuccuuugucuuauugcauuagguagcacuuccaguaggaaacaaagugguaagaggagacaccuuugucuuguucuugaucuuagcaggaaagcuuugaguuucuaaaaauuaaguaugauguaaacuguagguuuuuuguguauuuucuuuaucaaguuggggaauacuacuauaucccuaauuuuauuuuccuuauguggaucugaguuucuaaccuguaucauuuuaccucucucuaaagaacuuuaaacauuuuuugcaagggugguccacuggcaacaaauuccugaaauuuuuguuucuuuaagacagacuuuauuucuuaacuucugaaggacaauuuugcaagguccagaaucguacacugccggauuuuucuuucaacaucuuaaaugucucacucuacucucuuauuuguaugguuuaugaggauaugucagauaaaauuuauuauuuuugcuccucuauagguguuuuuuccuucuggauucuuucgauauuuuuuuaaucuuugauuuucugaaguuugaauauaauaugcccaugaguaguuuugggacauuuauccugcuugguguucuuugagcucucuggagaaguaguuuggugucugacauuaauugggggagauuuucacacacuauuucuucaaauauugcaucuaauccuuucuuucuuuuucuaguaugcccauugcacguacauuauaccuuuuguaguucuccugcaguucuugaauaaucucuucuguuuuuuucacagucuuuuuucucuuugcauuuuaguuuugaaguuccuauuaucauauccuuaacuucaaagauuuuuuccucggcuauguucaaucuacuuaugagccuaucaaagacauuuuaaucauuucuguacacuaugcuugauacuuggcauuucucuuugguucuuuccuaaaauuuccgucucuauauuuacauuauccaucuguucuuguaugucauuuuuuuaaucccucaccauauuaaccauaguuuuuuauaaaguuucuggucugauaauuccaaugucacugccauauuugacucugcuucugaugcuuauucagugucuucaaacugcauuuccugccuuuuagcaugccuuauaauuuuuugguugaaugacagacaugauauacucaguaaaagaaacugcugcaaauaggcuuuuaguaauaugauaguaaaaggugugggaaagggaagcauucuguagccuuauaauuuggucucccucuuuggugaaacuguacccauggacuaugaacuucaccaguuuucucaguuccccuaggcccccuaacguggacaggaugguuugaguuguccagaguuauauauuuuccuuucccuauguggaaagcuaaaagggggcugaacuuagguauuucccuucccuuugggagguuacacucuuauaaaaucccaaaaguuuaggcucugguaaaauaguuucacuugagagcaggcuugaguccaacaaaaugcucugacauauuucaagaugguuccuuuucuucuccccuuagggaauuuucuccaguagucacugugaacacuccuggagguuaaacucacaaaaguacaggcccuuccguaagugaguccuccuggaguuuuuaacccucagacuugccacacugaacaaccgcccacacugaacaauuuuucaauuacaguucauguuuuccuaccuggcaccgguucccacaaaaauuuuccuuguagguuuuugccccacuaaguugugauucuuucuaucuaccugucugcuucucuaauauuugaugcagugguuugcccuauaaucucauuuuucugacagaucuaagaagauucguuaauuuuccaauucauucagcuuuuuacuuguuguguuuuuaaagaguuuuuuguuuuguuuuguuuuuuacuuuuuaaccauaugucaucccagaaaaauaucgaucuucuauuccaaauaaaucuuaggaaauacuaguggcaagaaaaucugugaucauagucuacuucucaaaaaggguuguuuugcaauguacaaauacauuucuuuagaagaaugcagugauaaaauaucuuuuaagaucuaucaaauuaagggauaggcuuaucaaauucauacauguauuugcucuuuucuaacucucucugauaccccuaaaauuuuacuuauauaugaacaguauagcuauagaacaaauugaggcuuuggguagaaauauaauuagcauacuaagcucauguuucuaauuguuuuguuaauauauauguugauagggacagcuaugguccuuugaagucauugcuaccuacucuuuuaagaaauacauacaucauuuuugcaugcauggguaaaauauauauuuccucacauauaucuaccuaagucaauauuuuauuaaacugaagucuuaaagaagucucaagauuuuucucaaccaauauuaaucuccauuagauuauaaucuuguuuauaugucacuuuguuaacaggaauucuaagaauaugagccuaauuuuauaaauguuuuaauuuaccauguaauaaauauuugaauaaauggguuccuggccugcauuugcugaguaguagagaaaacaaaucagcaaaccccuuuuuuccucaugucaucaccuuugcauucuuguagcaaauuaugucauuuucaaaacuagaauuucuuuauuuccuuuauugacuaaaaugacucauucuucucugcaguuuuuuaguaagauugagucuuuuuuguuuguuugagagagagucucccucuuuugcccaggcuggagugcaguggugcaaucuuggcucacugcaaccuccaccuccuggguucaaucgauucuccugccucagccucccaaguagcugggacuacgggagcacaccaccaugccgggcuaguuuuguuuuuuuuuuuuuuuguauuuuuaguagagacggguuuucaccauauuggccaggcuggucucaaacuccugagcucgugaucugcccaccucggccucccaaagugccgggaucacaggcgugagccaccacacccaaccaagauugaguuggaacuuaucguuuugguaacuggcacacagcagauggaaauuuuaugcacauuuuccucuuagaaacuaaggauagguaaacuuuuuauccuuuguguuggcaugcaagaauaaauuuccucuuaagaagaaaauuuauauuguugagaggucugagaagcaaauacuuuuucauauuuucuauucucuaaagggauauuuaaaauuugguuuauaaaaauaaaacuaauuugcuuucugcucugaaaaauaguaucauuguauaauaagagaguagcagcauagccaacuuggaaaaagcuguuaauugcccauaucaauuucauuaccaaaaauaugucaucuacuagaauacuucugaugaauacucuuuccucacugaaagauuuucuuuuuaaguugcuuaaagaguuaaucaguuaaucaguuucaaguuguaagaccauuaguauucucauuauaugacaaacauuacagaaaguauacaaacaaucugcaagaaaccuugaauucaacuuucauaguucugaaauguuucucauaaacauacaggcauuugaauggaacacuauuuuuuucauugaaaaaaauuaacaaggucacuuacaaaaugcaauguaacaaauaccguugaccuuaaaauacagguuugaacugcauggacugcuuauaugugaauuuucuuccacuucugccaccccuggaacagcaagaccaacccauccuuuuccuccucuucuucagcauacucaaggugaagacaacaaaggaugaagaucuuuaugaugaucuacuuccauuuaauaaauaguaaauauauuuucuuuaccuuacgauuuucuuaauaacaguuucuuuucucuagcuuaguuuauuguaagaauauaguacacaauacauaucauagaaaauauguguuagucaacuguguguguuaucagcagggccuccagacaacagcaggcuauuaguaguuaaguuuuuggggagucaaaaauuacauguggauuuuugacagugcaggggguuggugcucuuaaccuccauguuauucaagggucaacuguauuuauuuaaggucugugaugcauugcaaauagacacacacacacgcaucccuacuuugcugagcucaaaguucagugaaauuucacagaauguuaucuugcccagguccuucauuuuauagaugaagaaacaguaggcuuucuccccaguaccacaugaaaaaccaaggauauaaucuaaagacaaccuugacuuuuugcuauaccaaauauauaccaauucuaucuuaccugucugagaaaugcaugcuauggacauaugaaggugaugauaaaucuuggaagauuaggaaauaggcuuccaaagcagauaaaggcaggcauaugaaaaugaauaaugcaaucuggaagaaagagaauagucuguuucuguagguuuacccacagcuauuuuaaauuuguugcuucaccuucuucaccaucccagguacuauauuguacauuccacuguaaaugagcaaacauuacacuggcagcagggaccagcauccuuuaucaagaggcaguuguagcucaagaguugcaucuugguagcaucaauacagaauuuaaggauuacagaagauaucucaguaaguuacacuacugguuugaagaaaacuguuuugaccucuaauuuuuucucuuauucuaaucuuccugucauuuuuuaaagaacaaaagauggccuguguuaucuuauuugguuauaugauuacauauuauuaugaucaauaacauauauuaaaacuuauuaaucaaugcuucuuuaauuucagaaaguucucuauacuuggaagaaaaauaaagaacgauuugcacuucauuuccuuagcauggaguagagcauuaaucauuaucauuuuuucaugccacuaaaucuuugcaaugauaauucuuuaauaguauuggucuacauccacuagauaaacauuauaggcuuauaaugugccaggcacugugcuagacacuggagauaacacuuugaauaaaacagaaauggaacucccaucauggagcucagaaauaacacugaaaugcuccuggauuuugagccagcaauaacagcaggaagaaaacugcacucaaaacacuaugaauuuauuuccgccauuuaaaaaaaaagaaugaagaagguauuucaaauccagaaaagauauuuucucaucaugauagcagauguuaaagauauuggaaacagugcaauuucuccuaguguagaaggaggaggaaguugguagacacacagcugaaauaaaggaagcagaaggaagaacacaggcagugcucaucuugcaggaggcuugagcacccuaagucuauuuauaaaucaguuguucaaaacuaacaaguagugucgcacaucauguuuauauuuugagguagccgcaacagccuuuuaaaugcacaauguaauugaaacacuagcaucggaaaagaguacaguugccaauauaaaugguauuuuagugaccaauguuuccucggcuccagaagcuccuggaagauugucucagcuauuccucauggauccaaaagccuaauuucaccuauaaauaaucaauggauauuuuaucuaucuucaauuuccaaugaggauaaaucagcagagaaaagacaacacuggcagccuuaaagagaaaagcaguaaaaauaagauuauuucauugccauuuuuuuaaagagauggguucucacuguguugaccaggcuacaaugcagcagcuauucacaggcacaaucauagugcacuacaaccccaaacuuuugagacucaggcaaucuuccugccucagccuucagaguagcugggacuauagucauugccauuuuagaaaccauuuucauucacugcaacuuucaccaaauauuuauugagugcucaccaugugcuagccacuguuugguaugcugacaauacaugucagugacccaaacaauguuccucaucucauagaacucacaucuacuggagaaagcagacaauaaaaauuguuuaagaaaagcagaaacacuuugccaaggguugauaaacuaugcaauucccaucaaaauaccaccaucauucuucacagaauuaggaaaaacaauuuuaaaauucauaugaaaacaaaaaagaacccacagagccaaagcaaaacuaagcacaaagaacaaauugggcagaaucacauuaccugacuuuauacuagaaggccauagacaccaaaacagcaugguacugguauaaaaauagguacagagaccaauggggggauagagaaccaagaaagaaacccacauacuuacagccaacugaccuuugacaaagcaaacaaaaacauaaauuaguagguaaaggacacccuauucaacaaauggugcugggauagcugguaagccacauauagaagaaugaaacuagauccucaucucucaccuuauauaaaaaucaacucaagauggaucaaaaacuuaaaucuacgugcugaaacuauaaaaauucuagaagauaacaucagaaaaacccuucuagacauuggcuuagguaaagacuucaugaccaagaacccaaaagcaaaugcaacaaaaacaaagauaaauaggugagacuuaauuaaacaaaagagccucugcacagcaauaggaacagucagcagcguaaacagacaacccacagagugggagaaaaucuucacaaucuaugcauccggcaaaggacuaauaucuagaaucuacaaggaacuccaacaaauuagcaaggaaaaaaacaaacaauccuaucaaaaagugggcuaaggacaugaauagacaauuuuaaaaagaagauauacaaaugaccaacaaacauaugagaaaauguucaauaucacuaaugaucagggaaaugcaaaucaaaaccacaaugcaauacuuuacuccugcaagaacggcaauaaaaaaucaaaaaauaguagacguuggcauggauauggugaacagagaacacuucuacacugcuggugggaauguaaacuaguacagccacuauggaaaacaguguggagauuccuuaaauaacuaaaaguacaacuaccauuugauccagcaaucccacuacuggguaucuacccagaggaaaaaagucauuauaugaaaaagauacuugcacacacauuuauagcagcacaauuugcaauugcaaaaauguggaaccaacccaaaugcucgucaaucggugaguaguuaaagaaacugugguauauuuauaagauggaauacuacucagccauaaaaaggaaugaauuaauggcauuugcagugaccuggauaagacuggagacuauuauucuaagugaaguaacucagggauggaaaaccaaacaucauauguucucacucauaagugggagcuacgcuaugaggaugcaaaggcauaagaaugacacaauggacucuagggacucaggggaaaagggugggaagggggugaggaauaaaagacuacgaauagggugaaguguauacugcucgggugauaggugcaccaagaucucacaaaucaccacuaaagaacuuacccauguaaccaaauaccaccuguuccccaauaaccuaugggaauaaaaaaauaaaauuuuaaaaaaaaagagagaaaauaaagcaaggucaauagucagaguucuguuagauagaaugguuagggaauuuaucucugaaaaaguaacacucaaggagagauuagaaggaaagauagaaacaauaccuguggcucucugaaggaagggugcuccaggaagagggaacagcaagugcaaaggccuggaggaaaaaggaugcucuucuuguugccaggacagcaagaaaaccaaggaaauuagaauagaaugagggagaauaguggcaagaaauggaaucagaaacacaaauagcagccaauucacuugaggacuggugggucaugaaaagggcuuuggcuuauauucugagugaaacagagacccauuaaugguuuuaagcagaggagaggcaugaccugacuuaauuuuuaaaugaucacuugaauuuuuguuuggguaaaaacccacggugagguaagaagggggagcaaagcuagaaacagggaaacccaugacagggaaacugcacuuuucaaaguaacacaugaaggugguuugaauggagauggaaauuggugaaauggugugaaguagucagauccugaauauacuuuacagguagagucaacagaacauguuggaggaucaguuauuccuuuucucucuguuguuucuaguguuuccuucauuccuuaaagcuaggcaagauuacguccuuacggguuucacauuuauuuuuaaagacuguuaagcagugggaaaugaugacauuuaaguuuuaucuccuuuucuauuaccuguuauugaacagcaagauagguaaaagauaugaagacaaccaaagaaucuccaagggcccagaaaugaaaauaguuacaccuuagaucuguacaggaugaacugcuacugcuaggacuauuagcacagucacugacuaugccugggcacuguaauacuaaagcauuauuauugagggcuuaauaaacaaccauacacaccaaguucugaaaauuagucagucaugaacucuagcacuguuauuuuuaaaaggggagcaaauaaaguacagugaaacuauuauauacauauuuuuucuuuguacauauacauguauauagauauacuacauguguauauacauacauacacacauauacuacauguacauauacuacauauacauguauauguagcauauguguacacauauacacgcauauguauauguguacacauauacgcacuuuucuuaaguuuaguuguauuguuuuuagauauaguuagguaaaauuuaauuuucuuuguuugccuaauuuucccacaaaauuuaauacauuuuauaugauuugagccacgaaauaggcuaccauuaaaaagaaucaaucagagaauagaaaauggacuucuuggaaauuaaauuucaauuaacaaaaauaucaaaaguugagaaaauaaaauauacagagauaaacagaugaaaaauaugugauggaauuuaauaaauaagaaaaaucaguucacaaguucuaaugcaccauuaacaugaguuucauaaagauagggugaaaaaaagaaggaagaaauaaucaaagguacaauggaagaaaaguaccuuaagcuaaauaaaggcaguuguuuccagauuguacagaaucaucaagugcugagaagaauacauuuuaacagagccauaucuggaggaauuucagaagugaaaagauaaagauccuaauaaacauaugaauagggaaaaaaguuaucuaaaaaagacagaaucagacuggcaucagauaucuaucucauaagcaauccuagaugaaggguaacaacguaccaauguuucccaagcucugagagaaaauuacuuugaauuuaugguucuaaucacaauaauuuaugaauguacuauaaggaaaaauauaaggcauuuuggacauguaaagacucagcacaauauuuguaaaaaccccuguuuuuuuuucuuuuuuuuucuguaagaagaaaaacaguaguaaaaagaaaaauaauaaucaaauacaaagacaugagacuaaagcaauaauagacauagccaggagaaaaaugagaagaaacucuaaauuagaacagaaaaaucagacuucaagaagaaaguguauuucauucaucaaaugguauaauuaagaaaucugaaaaaaaauugugauaugaugaaaauguuucuucugucaacaagaauaaaaaaaugcaauuaaaauuuucaagaaaaauugaaugcuuacaggaaaaucuaaguccaaaugugaaagaaacaaaaauguggcauaauuuugaggaacugaaagaauuuagcaaaagggaauccauuuuacccuaaugcuuaaaguagcauccuuagaacaagcuaaauuuuagugucacaggaucacuuuuuccuuuucuacauguucaaccauacugcuagguguuacagugaauuuuauuuauuacaaucauggcauuguaagugauguguuuucuuuuucaauuagcacugagaaaugaagcacaagagaauuaacuauagaugcaaaccagaauauaaauauuauaaauuuagcaauaagaaguaaugauauggaauacaggaguugacagaaggcaggaaaagaaaaguagcuggaauugaagaauauuaacuuucacaucuuacauaguagagacucagaaagguauggucugacacugauaaacaauuuuuuaaagcaaugcauuauuguggguaagaauaauaaaggcauacuuaagauuguaguauuuaaaauaguuuuguuaccaugcuccuauacauuuugaaaagucacuguggaaacuaagcaaccaaucaaacauuucauuuuguguucuguauuucccuaaaugcagacuuagaaagguacucaagaguaucccaacuuauacauggcaauaaucaucaguaaguguuauugagggucugcuauucauuugcuugcgugauaauuguugugggaaauucaauagauauacaugauaugauccuaguucucaaagaaacuucaauuucaaugaaagcaguuucugacacauaaauaauguauuuuuaaaccguuaacuauuuugagacacucaaaaacaucuuucacaugggccuaaaauuucaugacacugccauguaaggaauuuccacucucacaggaagcuccugauuagcacaccaagacaauuauuuuuuauuuuuauuuuuugggagacgaagucucccucugucacccaggcuggagugcaauggcacgaucucagcucacugcaaccucugccuccuggguucaagugauucucgugccucagucuccugaguggcuggaauuacaggcgcccaccaccacgccuggcuaauuuuuguauuuuuugguacagacgggguuucucuacguuggccagguugguuucaaacuccugaccucaggugaucugcccgccucggccucccaaagugcuggaauuacaggucugagccaccacacccggcuaucaucuaucuuuaagcaagguaugccaaaauguugucucuucuuccugaaaauaugauacaaaauagaggaaaaacaguaauaucuauaguccuuaguacuuuuuaaaucaugccugcuaucauuuaauauuucuauggacaaauuuguaucuuuucauuguaucuaauaaagacaauaaaggaugaucaugaaaggaugguacuaugagcucauaauauauaucuugauugaaacaauaaaagggauggaaguaauccuucaucucuucccccuugagccaaucuucagaggcugugcuguuacacuugugcaaucucccugucaggucccaauacugagaaagcuaugccaacucuggcgccuauucaggcaacugggaauucacaccuuuugagcagaggcuggaagcauccugggaaauuccucaacugaccagucuaugaguccuauaauuuucaucucauuaugcuuuaaaaaaagaucaaagcauugauuauuuccuaugagccuguauauuccagaaggguaaagaugauggcucucuucuugccugauacauagaugcucaacacaugcuugaagaauaaacaaauauuuauucaaucacuacaauuuugccaaguaacaugcuggauguuuuauuuauguuacuucaucugauccucucaguaauccaugagauaagaauuauuaguuguucucauuuuacagguagagaagcagauucacaaaugcuaaggcaaccugaauaugacauacacagcuaauaaaaaggaaagucaggaugcuaaauuagaucuuccuauugcaugaucucacuuauauguggaaucuaaagaagucgaacucauaaacgcagagaguaacauggugguugccaugggcuggguaguaggggaaauagguuugucaaaggauacacaguuucaguuaugccagaugaauauuuaauacauucuggagaucuaauguacagcauggugacuacaguuaguacuguaugguauccuugacuacauuugaguagcucuuaaguguucucaccguaaacacaaaaaaugacugagaggugauggacaugugaauuagccugauaguaauaaucacuucacaauguauauuaaaacaucacacuguaucucuuaaauguguacaguuuuguggacuguuuacuugucaauuauaccucaacaaagcuggaacacacacacacacacacacacacacacacacacucucucucucucucucucucucucucucucucucucucucucucucucgaaacuuucgagcuccaaacaccagacugcuuguuggcauccaacuguuuaagaguugauuuacauugauuacgaacaaagagacaauggagauuugcaaauagggagaugaugccaaagauaauucaaaauuuauagggaaguuauuuaaccccaugucuugguuucuuccuuaguaaagugaggagaguaauagcaccaacaaaaauauagaugacauaagaauuagauaaucuuuggaaagugcuuagcaugguacuuaacccaacauaagaacuuaaucaauaguagcuauuauuagaaauauacauagcuuguuacgcuauuugaggcaacugacuuuacuuucccaugccuccauuuucucaucuguaaaugcaaggaaugggguuacugagucucuaaaguccuuucagcuuguagcaauccaugauucuauguuugaaaauaaacuauguuuuugaugaaguguuuauugaaauacuggagugaaagugguggcaauccagguggcaaugucuuauaagcaguuagaaacagcucuaguuuacaaaucuagaucuaaaauauaaaaauauauucaaacacacacauacauacacagaauuaaaucuauaauucagggaaaaagaugaaaagcucaaaaaagguagauuaaaaagucugauaauuuguuacaaguaggaaaaaguuuaaaauacauauuuaaaauguucauaauuugugacagaaaauuuauucuucacugaaaaauuuauagucuccugauuuuuacuuuuuuuucucauccuuuuaggcaauuauccaugcuaagcacagcugcugguguuuaguucaauaaauaccacuaguuuaucauugcauauuucccaaaauuacuucucaccuuuucuuucucuuuaucauuaaucuaucacacaaaaggggauuuucuccccguauuauugcagauauaggcucuucaauagaauccuaauguuaagcaaaauaguucuauacaaacagugauuuugggaaguauuucuauauguaauaggaauggcauguuuucaaaaauaaaauguaaauaauaaacacuuaaaaaaaagaaaaugcagcucuugcuccaacuguuucuaugaaggcaugcagcaacauuauuagagaugguuaaguuacuacacuagcuucuaaaagaguuugagucagcuugguuaugaaagagaguaacacuccucagggcuugucaccuucaguucuugaauacuaaagugccuacuugcuugucaggguuaaaagcuacuauuuuaaguucaaagugaaaagcuccuuucaggugauaaugauaguuuaaaauaaacaguguggggcagggaaaagccuccuuuaggcaucuaccauguuuccccugcagucaggccagugcuuucuuauucuguaucaguauucaugauccaggucauuaaacaguuaguaagauagacaccacucuuucucccuguaucccacugauaaacaacugcaggcuucagaauucuggagcuguguguaaauaugaaagcuccauguguuugaccaugugggaaggcauuaggguaaccugggacuccuaugcaagagagaacucccuugcacgaauguuaucaucaccaagcaagcuguuuguuuuguguguguguuuggugccucagcugucuucuacaggaaccauauaaaaacaguuuauacaaaagaccccaaggauucugugcacuuucaacauauuagggaaaaugcaagauaucaguauuuuuucauuuuauauuuauagacagaaacuuuuacuauagucuauuuaaccauuucuaccaaagaggauucagcuuaaauaugaaaaguucaaaacacauacacaccacauacacacacuuaguaguaacugaaaaaagacgaacagccuaaaauuuccacauugcuccuugguaugcaucagauucaaucuaccauucugauauuuuauaauacacagacaacugucacucagucucaucuuuaugaagacagccuaugcauugaauaagucaauguuuauugcaugcuugccccuucaagugaaacuacaguacagccaaaugaaaguucuauuugaaucccuuuuuuaguagaaauuaacuuauagccuuaaucaaauucugagcacuugcagcuuauauccauauaugauuuacugugaaacaaagguccgagaaagagggaaaauauuaauauucuaauauaagauaggaugauuuuuguuaaagcucgagaguguucaguaauggcucugcucugugcaggaaaaguauacucauaaguaauuucacccaagcuuuuacuauuuaggccgaggauaauugagagaaauacaucauuuauaguccgacacuaaaaaagcaaguagauaaaucacgcaaauaagaacuuuuaaaaaucuacaaccuacucucaucgcaucuuaauucaguguaucagaaauguacaauaaauuauaaguaauaaacacuaaagaaguaauaucuuuucauauccagaaggcugcuuuugcucugcaacagaaugaaaaaauaucuauccuuagauuuuauuguuaguuaaauaagucacucuuuugguaauuuccucuaaaugagaacagcuuuagauguuaaauggcuaaaaccugaguuucuauaugugaauaauagauucggucagauaauauuuaaauuauuccagauauaaaguucucuuauaccaaguauuacuuaaagaaaaacaccuguaaucccagcacuuugggaggcugaggcgaguggaucaccaggucaggaguucaaaaccagccugaccaagaugguaaaaccccgccucuacuaaaaauacaaaaauuagccgggcgugguggcgagugccuguaaucccagcuacuccgaagccugaggcagagaauugcuggaacccaggaggcggagguugcggugagcccagaucgcuccgcuucacuccagccugggcgacagagggagacucugucaaaaacaaacaaacaaacaaaccaacaaaccaaaaaacccccaaaaaacagauuuggugcuugguuuagcucuugggaaaagauccuuuauuuuaaaaaauacauauuucacuuauaguauuacauuucagagacucugauuuuuccuaucuuuagaaagguaguguaauuacaaaaacacagucuaugaaagaagcagucaaaugagcuaacuuuucaauuacuauaaauuucaucuuugaugaucuaauuacaauucuuuguuaggcaagaaggcuucuauuuuggaugauaaaugaugacauccaucucaaaugauccuuagaugcaauacaaaaagaacucaaauucuguucauauuuuaaauauucaaaccagucugcuuacagcuaauacauagcaccaguauacauauaccaaauauacgugguuagacauuuaaauuuuugaugccuuuuuuuuuauuucaacuugcuuuguauugauaaaaauaaaugaaaagcucuaaaaaucaauuugggauaggaggcacauucccuaaauauagagacuuaaagcuuuguuguuguuguuuuagcucuaggucuugguaugaaauuaaaaaugagagaagguugagagaauuuacagaggauggggaaaggggagaggcagguauaaugguauacuaaggagcaugauuaaccaagaguuuucuugaguguuuucuggucagaccguuuaguuugggaagucaaucaugaauucucuugcuuuuuaagaugcauacaaauaucaagauuuuuuuuuuuucugagacggagucucguucugucgccaggcuggagugcaguggcgcgaucucggcucacugcaaccuccgccucccggggucaagcgauucuccugccacagucucccaaguagcugggauuacaggcgcccgccaccacgcccagcuaauuuuuguauuuuuagcagagacggguuuucaccguguuggccaggaugaucucgaucucuugccacccgccuuggccucccaaaaugccgggauuacaggcgugagccauccuggccaagauguaauuuuuuaaaggcauuuugugaggcugggaggcagguaugcaaaucucacguaaauuacaagagcacugugaauuauaaucagauccaaagcaucaucugcucauguuuccccaaaucacaaaaaugguuuggcaugacuaguuguuugcugcagggcauaaaaagauuaaucuuagcugggcgcgguggcucaagccuguaaucccagcacuuuggggggccgaagcaagcggaucaccuuaagucgggaguucaacaccaggcugaccaacauggagaaaccccgucuguacuaaaaauacaaaauuagccgggcgugguggcgcaugccuauaaucccagcuacuugggugucugaggcuggagaaucgcuugaaccggugaggcggagguugcagugagccgagaucgcggcgccacugcacuccaaccuuggcagcaagagcgaaacuccgucucaaaaaaaaaaaaaaaaaagaaagaaagaaagaaaaagauuaaucuuguauuuaggcacagcuuuugaggcuuugguaggaaaaccaugcguuagggaauauccugaccuaaacaccuugaucuuugguucaugacccuaucagagccagacaagggcucccggacaaugaauuaaacuguguugauuccuccgcccacagacacucaaagcuuacucucuccacuguuacauaagagucucuggaauccuaggaugguguuuguaaauacugcugccacgugcacgguacccacgugucaaauguugaugugaccgcguguaacuggaaggagagaaagcgucuacaauuuccaaagagaagccuacuauuuuuuggcccuaaaaaugagcauacagaugucaaggaauuaucacuaacuaagggugauuuauuugucuuuucuuucuuuuuuuuuuuccaaaaaagaggaagaacuguaauauuuuuuuccuguugcauuucuuguaaucuaaauuaacugcucuaccuaauucaauuuaggaucaguuuuacaauuucagcaaugcauucugaaugcacuuucuacuuccucuauuugcaggacuuauuccugcuugcuuauuuacuucaguguaaacugagauauuaugggagaugaauuacauaaaaaccagagauauacacuaaguaggcaaaugauuuacaaaguuauaauuuacacccaauuaaauuacaacaugacccauucaguauucaauggcuuuccuugggugaaggaaaaaaaaguagcauuuuaccucucuuccuaucucggauuucaccuucaucuacauucauuauaucuuuuacaauggguuugugaacagaaaacaaguaaacuccauuccuuaaacaccugaauucuuaccaauacugagaaaaauuacaaugucaauaacuaaguuuuuaaccccuaaauauaguuucccaaaaaccccgaggauuaaggcaugacuaauuauaacaaugcaaaaaaaauuaaagaaaaucugucaguaguaaauuaaacucauuguauuuuuaaaaauauucugacuucaacaaaacccaagaagugucuuuaaagucacuuuaaaaugccauacccuagauuucccaugcucuugaaaaauguugguaaaaauguuuuaaaauuacaauauauguuuaaaaaauuaguugauguccauaaaaucuuauuugaaauaagaaccacauuuuuuaacaguaaauaaguuguuucaaaguaaguaaguuguaacaguaaauaaguuggccaggccgauggcucaugccuguaaucccagcacuuuaggaagcagaaggggguggaucacuagaggucaggaguucgagaccagccuagccuacauggcgaaacgcuguuucuacuaaaaaugcaaaaauuagccaggcaugguggcuggugccuauaaucccagcuacucgggaggcugagacaggagaaucgcuugaacccagaaggaggaggcugcagugagccaagaucaugccacugcacuccagccugggcaagagagugagacucuaccaaaaaauaaaaaauaaaaauaaauaaaaauuuuuaguucccacaguuaguaaccaaacgucuuuuucaaguuugcuuuucaguagaaauacauaauuaaaucuuagccauuaauaaggugagccaacagcaaaaugucuauuagcuuugcuuucugccaguguuuuuccacaagcguaauguggcagacaacugcaaaauuaaaauacaaccuuguuuuaaauucaacuuauguagauaauauaacuucacuggagaaaaaaccauuucaguggcuagauuggaagaaagauaaaaucuauaaaacaagguuuaaaguguguuuuuuccugcuaaaauguaucuguuuguacuaaaauaauuauuuacuaaaauaaauaauuuauaugguaagaaucuuuaguugugagauuuuuuuuuccuucauuuuugaaagguacccauuuaugguauucuucuuuucaucaguuacauuugguacauuaaaauaggaauguaaaugaauuaauauuuuaauaauucacuuuuuaagaugcucauucugauuugaugaacuaucagacacuguauuuguagaaaugguuuuuucuucuguuauaauguauauaggagagugcacaguagaacaaacaaaaaagcuaauaaucaucugaauuaauuacagggugcucaaagugauccuuuuaaugcaaauauaaugaaaaguuauaaaagagcugagauaacuuuacagccaauggcaaauauaaaaauucuauaacuucaaagcaagagacuucaaacaaaagcaggaaaagugcuaaaagaacaaacagguuaaaaaaauuaauaagaccaggacaguauguuauggauagaaucuggguguggucucauuguauuacucucacauucuggugcucuacuucagaggcagcacaacuaauaauuaugguauuuaaugggugcccuucuuagugcagacagguaagaaaaacgggaggaauaacucauauaccaugcuauguuaucuggcuuucauuaucccuauugaagcuuuuuuacuuuuuuuuaugcaucaucuauuucaggagaaaauacuauaauaacccauuugagagaugggugaauguucucauuaauguauaaccuggacauagaagcuagauuuaacacugcaucaagaaaauaagugauuugguaaggcagguuuuagcaauggcuaaugaggcacgacaacuguaauuaaaauuaccauuacuuuuacccacccacagaacaaacugugacaaaucucaaaauguuaaaaguagcaaauuaaaaauaucaauacucuguauggcauaccuaaaugucagacugccugcauuucuaugccugaacauaggcaauucccuuugaagagaguaguacaucagcaaaaauucacagcccauuuuucuucuuuugaauaugguguaccuucuguauaaauuacuuauaaaaagcaaagcuaaaaauaaacaacaaaucaaaauguuccuaauaugcgagaacagauuuacauuuuuuggaagugcauuaaaaagcaaagaugaaguacuacacucaaacuugugaacaacuuuuuuaaaauuauggagauacuaguacaaaaauuuauagucagcugaggugguucacaaaguuuugagagaaacaagagagagugaagacaaguaagcuagucauuucuccaguaaggagaacagaaccuaaauucuaucuuacugcuuuccauaaccaucacuacaccaacuucuuaaugggucuaacaugagcaucuaucuugggcuugucaaacauacucaacaaaccuacaaguagaugcuaugaucauacucuuaaaaaguaaaauucuauaguuacucauugaacaagugaucauaacaauuauauaaagccaauauacuuccuuauuggguacaaucacauguguaccuuaaauaagucucugaacccuaaagcucaaccuuuccagaucagugaauuuucuccacuccaguuaucagucauggucccaagguaugggauccaaccggcugcaacccagcauucucaugagaauaaaaagggagagaagcauugcacaacaagaaugucugguaucuagaauuacauaagguuagaaauucaaauacaaucaaccccaaguaauucacccuguguguccaaaacuacaagucauaguuccauagggacuaguguuaaaaaucugcacucauuuuaccuguaagugguuuguagaaguucugcugguauuuguaaauacuugcagccauguguagcaaagauggagagccaucaucauucugacccuguuucucacuuuguccuggcauuaugaagacugcugcaaagcaauuuccuuuucaaccuuauuuuacaucuucaacaugccacaguaucaguuaacaggaaaagagucacuuguuuaaacccuaugagauacuuugucauuuuaacuuuaaaaucugaaacaugacaaguggagauauaaacaguuaacaaacucaaaguuuugaaguuuauucucugcccugcauugcccuucuguuuucacauagauaagacauuaauaaccccccaaaucuaguaauuuguuauuauuucuagauuaaacugcacuuuguaguaauuuaaacaagaacagcaauuuuuauaguuuuuuuuugagagagagggucucauuuugucacccaggcugaagugugggggcaccaacauggcucacugcagccucaacuucccaggcucgagccauccucccgccucagccccacaaguaccuggaacuacagggaugugccaccacacccagcuaauuugugcauuuuuuguagggaugggguuuugccauguugcccaggcuugucuccaacuccugagcucaagagacccacccacuuccgccucgcaaagugcugggauuacaggugugagccaccgcacccagucacauuccuuuuaacacuuggguuacaucuccugaacugaauggcuagguaacuaaagacaucugagaaaguuucuugcaccuauacauuaagcccucuuuaccaagucauauaaccuaucacuaucuauugaaucuucccauaugagcucuaaaggcuauuguuaucacaaaacacaaugccaacuuuugagugauuaaguauccuucucaucuauaagaggauguugcccagacuaaucucaaacuucuggucucccgccuuggccucccaaagugccaggauuacaggcauaauaaaacuccuugaugccaucuuccuagaaagauaugcuuagccucauucaauccaaauaguuccugcauuucuuuugcaugagauguaagacauuuucugacauaaaauaaaccaaauaacucaacuacauucauuuuuauaacaacagcuuuuugaaauauaauucacauacaauaaauucauccuuuuaaagcauauaauucaguggguuucagcauauucaaagaguugggcaaucauuacuaucuaauuauagaacauuuucaucaucaccaaaagaaaucucauacuuauuaggagucaccucccucccaucccuagccccuaguaauaacuagccaacuuucugucuccuuagauuugccuauucuggacguuacuuaaaauugaaagcauaucauauguggccuuucuugugccucucagauucaccuaugugacagcauuuaucaauaauccauuccuuuauacuacuuaauaauauuucacuguauggauauaccacaauuuguuuauucacucaugacaugauagacaucuggguuguuuccauuuuuuaccauuauuaauaaugcuguaaugaacauuuggcuacaaguuuucaugugaacaacuguaugcauuuuaaaucuccuuuuaugacuuucucuacauaguccacauuauacacuuuuacagcuaucaaugauaaugaugaaguauaauauagugauuaaaagauuuggcacuagagacagacugcuuaacucaaaugcuggcuaagccuaagccauguauaggcuguaugaacuuaaggaaguuauuuaaccucacugggcuucaguuuccucacucauaaauagggauaagaauaauaccuaucucuaggguugugaugagaauuaaaugacaucgacuuacacugucacaaaacaacuuaaaauauuuuuaacauaaaggccauucuaucaaaaaaaggacuuuuaagaaaacaaaaacuuacauucugacacacauuuuaauauggcauaacagcacaaucacaagauugauaaauugcuaaacuuuugugcuaaacuucucuguuuugagaaaaaaagguuuaaaaauaugugaucaugugacuaaaugguauaaaacaaaacacacacaaaugaguacaaguuaaacugaggacaucugaauaagauuaguaggccacaucaaugucaguaucaugguugugauaugauauuauaguuuugcaugugaugugauaugauauuauaguuuugcaaaguguugccacugggggaaauugagcaaguauacguggaaucucucuguauuauuucauacaauggcauaugaaucuauaauuaacucaaaaaauauuucaauuaaaaauauaugaucccauauaaguuuacuaaaaaccauucacuuuugugcuuaaaauggguggcuuuuauagggcaauugccauagccuguagaaauuaaauguaaggaaaacacaccauuacuccuaccaucaucaccaucaccaagacacuuaacacuauuuuucucuuauacauugaaaauagauuagaccaggugcaguggcucaugccuguaaucccagcacuuugggagacccgggcaggcagaucaccugagaccaggaguacgagaucagccuggccaacauggugaaacccugucucuaauaaaaauagaaaaauuagccaggugugguggggcacgcuccuagucccagcuacucugggggcugagaaagagaaucacuugaaccuggaaggcagagguugcagugagccgagaucacaccacugcacuccagccuaggugacagagcaagauaccgucucaaaaaaaaaaaaaaaaagaaagaaagaaagaaagaaaaaggaaaagaaaauagauuauacuuuuuuuuucuaguuaaauugcaugguuuuucacuaguucuauaucauccauuaaauauugacugagaggucaacaguagguucuauuagggaauagaaagacauagaaaucagugccuaccuuccaauagacaaaaaagaaauguaauuugaaagaaacauuuguaguauuuuuagucaaacaaccaguucauuuuauauccuagacuguccuucaaaaacacuuuaucccaauuuauucaucuccuauuuauuauuauuauuuuucuuuuuuugaggcagagucucucugccucgcccaggcuggagugcagcagagccaucucggcucaccgcagccucugccucccgggaggguucaagcaauucuccuguaucagccuccagaauagcugagacuacaggcaugugccaccacacccagcuaauuuuguauguuuaguggagaugggguuucaccauguuggccagacuggucucgaauuccugacgucaggugauccaccugccucggccucccaaagugcugggauuauagguaugagccaccaugcccaggcucaagugauucucgggccucagccuccugaguagcugggauuacuggugugugccaccaugcccggcuaauuuuuguauuuuuaguagagacaggguuucaccauguuggccaggcuggucucaaacuccugaccucaggucauccaccugccuugucgucccaaagugcugggauuacaggcaugagccaccacaaccggccucgucucuuacuuuaauucucaguuuauuuggaacaugauuucaagucaguuuagaggaacaacuuucagugaguauaaagcauugaguucugaauuauuuuuauuuuuauuuuuauugaauagagacagguaucucacuauguugcccaggcuggucuagaacuucuggccucaagugauccuccugccuuccccucccagaaugagccaccacaccuggccugaguucugaauucuuaaaacugcagguaggaugauauuaucacugaauuuauuuuuacauauauuauauauugaaaauauauauuaucuauaucuaauauauauuauauugaaaauccaccuacuaucuguuucuucuuuuugaaguaugacacauuuaacuacaugucauuacaaaugaagaaaacauaaaucaaagcugauagaaugugcuuuuuuguuuguuugguuuuguuguugucgcuguuugagauagggucucucccucuugccugggcuggagcgcaguggugugaucagagcucacuauaaguuagaacacuugagcucaauccauccuccuaucucagucuccugaguagcugggacuacaggaauguaccaccaugccccacuaacuuuuuaaauuuuuuguagagacuggggccugacuguguugcccagggugguuucaaacuccuggccucaagugaucucucaccuuggccucccaaagugcuaggauuacaggcaugagucaccacgcccauccaaaauuuguuauuuggaauggacaaccaaauaucuauucuuuugagaaaaagauuauauaucuauuuuaagucagcaagucucugcaauguacaauauaggacaaaaauaaugcuggaaauagcagacauacauaauucuuuuuggauuguagucacagugauucacaugcucugacuuuccccuuucccuccuggaacccuucucuccuacuauauaccaaaccaacagauguacugcauaaccuccuucaauaaugucacaguauucacucaguuuuggcagugaguagaaauagaaauuggagaucuagaccaaguaaauacuguauauuuggcaaaaucauuugugguuguguucuucagcacaguuucccagauaaccaccagcucuacuuggcaacuggucuuucccacagugaaggcuccaauuguaaaguuggcuugggagauauucuauugcugcuggcuuugguaccauuacuauccuuaagaacuacugugcaaugguagaauaaucauugacaaaguguuauucugaugaacaaauacugacagcugguccaaaguuuuagccuguucccaagguaggaaacaauaacauuaaaacagucuacaugguuauuuauauaacaaagaugacucuuuccagcgauuugaaauugcuagauaagacuaugaaauucuauuaaaacaauaacaacaaaaacaauuuaacuugcauuagaagcaauuaaagcauaaaaaguagaucuaagauuuucuaaauauuagauauucuaaaauauugacauuauacaaugucuagcauccguaacuuuugaagauauuuuauuucaagguaauuucauaagaauucauaagaauuuaccuacucagacuuugggcaggauggaaaauagaguuucugugaggugugccuaugaaucauaagaagggcuucuuaaugaggucaguaauuaaggaaauacauuucaauagugacauuugacuuacaacauuguuuggggguggagucuuagaagaauugauagggaacuuuuaacuucaacaagugaaacuaaaacauuaacuccaguuguuguuaccuaauacaagaccagugcccaauaaggacuuuggaauucuuucauaacaacuccuuggcaggugcacuucacuuguucuggaagugauauucacuugccaaugucuaguaggaccaugugccacugccucaaaaucauaucaauuccuccggcuucuggcauaaacuggcacaucagaccuaauuaaagccuuaagaagaguuuggcaaauaugacaauuuaaacaaagcaagggauuucucucacugcaacuuaauuucucauugaugauuaguucaauaagaaaauaagcaaaacaaugucauaguuaagaaaagcuaucuaucuuguuauuguccauuaucauguuccuaaaauucaauaacccaagacaguccuauggaauuuuuggagcaccuagguaguaugaucacauauaugguaaagaaagaacugagguuaugucuuuuauuguaaacuaccccauacuuauuaaaauaauuucucuuuuccaacaaaggauaaagugacuaacauacacaucucuuccuuauaaucacugaaauacuuuauacaguauuaauuagcagcuauuuucaguauaaaaguaggaugcacaaaauaacaagaaucuaaauuugaugacaggaaaaaacaagccuucauaguuguauucaaaauuauuaaccaauguaguuauucuuauuuauugaguggaaaauguuguaucuauuauuaguugaguagccugaagacaguauauaccacaacauuugaaaaguuguccccaaaaaguaaauauuaguuuguuagcaaaaggaauuguuuuuaauucugaauugcuggaauaauuaaccauaguuuucucgauaguuuaccaugaacagcauuaaugguaaaauccuaauuuuuguuuuaauuuuagggcaaauaagaacuaaccaaugaaccguuucuauuccacagagaugaguaaugcuucucccuuguaaucaugugaaagaaccccacguaucaaugauuaaagcaaacuacauuaaauuaacaaagaucaaaauagaaaguuacaaagugaacuaucgaggacaaauaguuuuggaaauucgacuuauggagaaauaucuauuauuguguuuuuccuucuauccauuuuuuaauccuauaaauugucuucuaaacuucaguuugauuauccaacacuucauuaaccguucucugcuuauuaacauuuaaaaaaaucaauauuuauuguguuuaaauuuauauucuauuccaaacauuauuaagcacacauacaaacauguaaaagaacauaacuccccuuaguauuucaacuuuccauuaaaaugcaaauguaaugauuucauuagccaggcaacaauacccacaguaucacaccaaaccaaaccaaugucuuuucucugugaaucccaacuucccuuaagauacaaucuuauuccuaugauggaucauuuguugaugaauaucuuugaauuuggguuucccauuauaaucccugacugaaggggaaaaagcacaaugugugauuugagauauuaaauucaugaauguauuccacucccuagacacguaaauauauaaauauuucacuaaauuuuaugcacuaaauuuuaccgcuggaaaauaagccuuuucucaauucuuaaacauuagaugaagaagggagaacucccucaauguaauuaaaaguauaucaugaggggaauaaccagcaaauaacacuuauauuucauuuucggccuuuccaggagucuauccaggccacacuucauuaugucauagguagaaaacucuccauacaaacccuauuagcuuaauaaaacuagacaagcagucccagugaaaagauucagcaagaugcgagugagguguguguguguguguguguguguauguguaugagagagagagaagaaagaguagagaggagacacagagagaaaggcagagagaugaaagaccaaagagagaagccaaagagaaauuuggaugggacuguuauaaaucugcucuucacuucuuugcugggauuggguuucauuucuuuaggcgccccugaccuugcagucuugcaacuccaacgcugcgcuccccacccccucccgcccccuccccgggccugcgccugccuuugugucugccugucacuuaccaaggaaccaaacgaagcugauucgggagaagcacaaagccgggacacagauuuguccauaaauucucuuacauacauuccccaggcuggaaggcucagcccagcgcugacuuauguaccuugagaaaagugaguucuggucuuguuuggggaaccagagaaacuauucuuuccucuuucacucagcgccgcuaacaaaacgcgcggacuuaaggaaaaaaaaaacccacucaguguacuccaauuccacucccugugacauucacuucguacagcccccuaaagggggauaagaagguaggaggaggcagacacaaacccagacccagacccuacagcugauaaaagggucgaaaaacacccuaucaguguucucucugagguuguucaggauaaacgggagacucguuucacuuacacgaaagaaacaggggaagaggauuaaagggaaaaguagugcccccaaagcugaacuauuuuagaaaggaaagcaaauuuaaaaaucacuuuucugaggauuaaaaaaggccgggaaaccggcucgucggaggcacaaagguaaguuuucugggagaugaggggacgagcauuaggaggagagaagagaacacagaacuacagguuuaaaagggguagagggaauuaaaacuauauuugucagccauguugaagaggcuccaguaauuugugaagcuucccucuucccucuugguauuugugggugacacuacaggguuugcuccccagucccuggaagcccgagaaaaagcgaaggggagaagaaagggagaguuucgcggcauaagagaagcgcucugaccucguucucgucccucagccuugcagcaauccagcaguugcagucgggucuccuuucuaacaaauccuaaagggcagccaucuugcuuccuucugcuucucuacgaaagcagccuagccuccgcaucaauauucauaaggcaguuugacgucuguucucaucacucagcggggccggcgucucggggcggccgcgccgagggggcggacgugacuugcaugcgagcgggacccgggcgcgcggcgcucgcgaggaggcggcggcggccgcccaagcucucgccgcugccacugcc

SEQ ID NO: 191340 - RNA, 31973 nt, Homo sapiens
uccaauagcauugacuuuuauucauucauguuaagucaccugaaaugauaucuguugcauuuaaaugcucauuaauguaaauggcugaacaaauccauuucaauggauacucaauaucccacauagauaagucacuucaacacagccucaugacaacucccacaccaaaacaguacuuuauuuugcaaauuuugacccauuauuacucccauguuguuuuuuuucagcugucaaguguacaaggugaagagaaauuucaguuagacaggggcugcaccuggaaaauaaauuucuuaaacuccauaaacacauuucaaaacugcugggucccaaaaguccaucuaugaacucuagggcugccaguaucaugugcagcacauuaaagcuacacuauccaaauagcuuauuaauucugcauaaaucaggucaagcaaugugucaaccuguaacagacugugcacuuuaacugaacauggcaaaauauucacucuuucgaacuuuacaucaucauuugaugucaaacaaugaagcaaaucccaacaguauauacaaaaaacagcuuugcauuuacaaaagauuguuucccauacugauuaauccaggcagcuaacucauugguuuaugcaacuuuauugaagaaaaauaaaucaauuacuagcagagcuauuaguugaucacucauccauugacaacuugcaucauuuauucagugcuauauuaaacaguguauuggaagauagauuaacuaauagcuccaagccuccuaacaauuuaaaugaaaauuacaaaauguuugagacccuauuuuggaauacaaaggguguuugacuuccaauuuccauucucuguagaacaagaacaggucauuccuuuauugacaugcauaaaauacaucacauuuucuguucugcugaugcuauaaauucaauaccaauucuccagccacaucaguuaugagcauaaagcauaucauguaaccucaaaucucuaacaguggaaggcuuaaacaagaauggaugcugcuagaauaaugcuguauccuuugaugugacaacugagcauccaucucccucccccucagaugauuucuucagcauguuagagcagugaggaaugguuuuagucucauaaccaaguuagagugaagacauuggccacauaauacacaugcuccauuuuuuuuuuuaaaaauucugagucuugggcaacuguucucuuguaacuacuuuacaguuucuaaaagcaguuauuguccaaagcuggaagaacuuaagucuucucagaugagcaugugaaugaauggagggagguaaacaaaaaauaaaauuaaaaaagaugaggucugauaggggagcagccggauaagaaaaucaaaaaaggaacaguaauuuaaaguuuauuccagcuauaaugcagguuauucugacuuuaagguagcaucacauggcauacuucugaguccauucccgagauauucuguuguaccuguaaauaaagauguuauuuuuaaaaguuaaaauaaagaauuccuaauacuuuaaauggaagggaaagauuuccauuuuaucaucuccagacucaucaugaagucaucucuaaugacuaugauuagaauaaaagccaacaagggagaaauagcacugguacucaaagcaaugugggaaaugagagccugaugcucugaaaguaguauuuuaaaaacaacuaagaaagcagcacugaaaauugggaggcuaacaaaaaucaaaagacccuuucuuucucuaccaccgagcucaugcucuaauuuuaacgugaagaaauuuuuacaguucauuauggacaaauguuaaaauaguauacacauucuaucuauccacagaaauuuccaccaaggccagaacuaggcuuuuacuagaacaauuuuaucugaauccuagaguuugggaaauuacuugguccuggauauuacaagaaaaaauggcuuugggacuuagguagaggcagaaggggaagaugacacugggcagaaugacaaagggcaguaauuuucaaaaggggugugugugugagugguuguguucaucagaaucacguguuacuuuuaauaagugugguaacugaggcuaauaagcaccacugagaccuguugaguacaacaagggcaucuucguuuaaaaagaucaacagguaauucacacacaagcaagguuauuacucaggaagacuacuaacauugauaaauacuaucagcuucccccuggauuauacucaugccauagacuacuuacaacaacaaaaaacagugauaaccuuaagaaaugaauauauauauauauauaugcacaggagaauuuuuauauuguuuaaauauuaacuagcuuuauuucaaaccaagaaccaaauaugguccaacaacuuuccuaaacuuuuuaaaaaguucuuucuaccaauucauugucaucuccuaaggauacucucucaaaaagccagcacuuuaaaacaaaggcuuuauuuagcauacagggagccacaaaguacagcugacgcuaaugcaugcuugucaguaaugaacauuuaguuuagaugcuuaggcuuaaaaguguuuuucccuuacauuacuaucucccggcaaaauuugaacuaaaccaccacauucuguauaggauugguacaaagucucaagcuaaaauuuaaacaccaugauaguuugaaaaaaaaaaaagauacuacauaaauucccauuucuuacuagugcuauuguaacugcuuugccaugcaguacuuucaagcaauaacggcuaccagauauuuacuuucacguuaaacagagaccaagcaguuaaauguacaguuuucagaagacugccauauuuguuaccuuuuguuaguuaauacagugccuuaacgcaugcagcacucaagugcuggcaguaccauaauaagcgcaccauagagugcagauccucuuacccuacaacauagcguauuucucuguccacucucuugcuaaccuauuguaccuaauugaacaaguacacuuagcauuaauuauaacauaugaaaguuauaaugguuaaguugaacauaaauauaauucaaauauuugagaaauuuagaccaaauuuuuacaauaguacuaacauuuuuggaaaaacaugcuugggguaaagaaaaauuugcuuucuuccccaaaaguugagaauaaagugauacuguuuaacacgcuaggaaaaaaaaaacaacaauaaaacauuuuagaggggagcauucacugucacauaagcuaaagccuaguuaaguuuuuuuaaauaaccacauuucaauagcuuucuccauauuuuaacuauuaucuuacuaaauaucaagucuucuuggcacugucacaagcaaaguauaagccuaacucauuaaguaaaaccacuuuuauaauaacuuuuuaacauacuuacuuaucucugucuguuuuauagauccgugcaaucucuggcacuagggggucaucuggguuuggaucacauagcagugaacaaauggauaaaagaacugcaagaaaacaaaaacaucuguuacccaguuucaggaguuuggauaaauaaauuuuucuaaaccguguauuacaaaacucaauccucaaaagacuuuuauuaguuuguaucuuuaucucaaugagacacaguuuuacagagauuuuguuucacagaagacaagcuccugguaaguaagaagugcuaaaaacaggguuuuguggcaugaaauucacugcagacuagccauaaaaauaguuucuaagauaggcaacugaugccauauuaauauauauauuuuaaauaggcauaaaugauauuagaacuugaguuucuugguacucaguggcuggggggggggggacuuuagcaagaauaugcagguaacacucaugccauauucauagccauuaggcaugaugaaaaauccauucuuagccguugucuuggcaauuucugagaaaaacccucaagugcuccacuaaaugucuccuugaacuuguaagcaagaaaccauauucccaagaguacuaguuaaauacaaugccaaaaucucuuuaguacuaagugagucaucagcucuaguuuuuaccuuaaccaguucaacauacugauguauaagaugucaagcauuaaggaacauagaucgcauucacuuugagugccugcuaugugccagucaccauauaugguggugcuguuauaaaauguuaagauauaaaugcuugaaaugguucugaccgauuuuuuuuuaaaaaaagcaauaguauaaaaaagacaacacugucacauauuuauugacuacagcaaauuuaauuucaaaccccaaauacagcagaauauaaaauuaccuaauauaggagacuuggcuauacaauaacucacagaaaaaagguagcuucaguugugacugcuaguuuaauaaguuagcaaaguauggcugccaaaaaaguaaguugcuuuaacgacaaaacaauaccaauucaaucugcccuuacaaaaacaguuuucaguguuacuguacacucccagcaguaguagaaaaacuuggaaacugauauuuagguauguagcaugauuugaaaagaaauuagaaagcauccaagaaggugaaaaacagguguaaaauuuuaaaaacacucgaauuauggcagcaucugccuaaguuguuucuuuuucucccuuaagugauucuacucaauaaaguuugggaaaugcuacugcuacagucucucuccaugagauucaagugcaguauauacacauaugaaacuuuuauacaaugccuugccuuuugaaaaagcuuuuuuguacuuacugaacucauaaaaucaaaaaacaauuaauggugaaauaguguuaauuauuacaacuucaccugggauauucaugcggagaccggaaaacuuguuacauauaacguaacagauaccuauuaagagaccagaauugaucuacagaucuuucgaagauuauauaauuuuagacugucauuagguagaaacaaccuaucaugguuacauaaaacaugacugaagauuugucuaaaaauuaacccaggaaagcaaaaucagaauuuuccuagaguggaaaccucaggauucaaaagcucuauuaaguuuagguauaucauaccauucuugguaaaaaggccgcaaguuagugugagauguccaagugguuugggauugaaaaauacagaagucuauuaaaauaaauuuugcuauuauaagaugagaugaagguaacucauuaggcaaauaaugccuacucaccacaauuugaauuuuaacaacuucucacaaaguaucuuuaaucaacaccacuaaaagaacaaaaauuauaaaaguaacuuuauugcuuccccaucucuuaccaaaaagcugccauaauaaaaauacucagauaaguagaucuaagaaugaagcuuuauuagacaaugagaacagcuuauuucacuagaaauauuuaccuuuagaaauuguuaaagcaggcgaccacugugaucuuagaauaucgagacaaaugcugccauuacuguuaauauuuggaugauaaauucuuguuguaaaugcaaccuaaaacaaaaacuuuuaaguauuuuauucaaauaaaaacaaacaucuuuuaaagcaaaacuuaaaauaaucaagccacaauguuaaaaaugucaucuauuagcauagaaguucuaaauauuauagaaacugauuuuuacaaucugaccacaacccccugccuccucuuuuuacaacagaaaccuaaacuuuuggauaaaaauuucauuacucauaugauguaaaguucuaaagguuacuguggcccuaccauaucaugaaucaaagggcaauuuaaagguauuuaacacauucauuuauaaaagcccuaacuuuuggauguaaccaaaauuuguagaccaucucauuuaaaguuucauuaaguuacacagguacaccugagucugcauuuccaccguacauaaaacauaaacuugaaucacaaaaauggaaaccaucacauugcaccuauaacauuacuagagauuguuauagugacauguuuaugaccuuuguauauuaccuuuucuaguuauucauacagguugaauuuauguuaaugacugaaaagugaaggauaauaugcuuuuaauaccuauaaaccagugcacuaagcaacucuaaguuuucacaaauuuacacuuacguauacaaaacuauaagcauaauaagcauaugcuguaacaauacgugcaaauauaaauugaaguuggacauuugaugcuuacaagacaacaaaagcccaaaaaucagaaucuguguaacaauaauacagaugagggcggaagcuuccacauggucugaaucuugcaacauuaaagaaaaggcaaaccuuauuccuauuuacaaagcucaaacugaggucuagcucuuuaaaccaaagguuaagagucagcaucuauacaugagugcaauucaacauauauauacagccuacacagaacccuaucuuccaagaaugcucuauuccuuugaaauaaagcauaaaucuauacuaacagauuuugagggaaaauacuugccuuaggugguuugaagggguagucuguaggaaaaugaauugucaaaaagaauacaccgccuugauaugggcugucauucuguaaaaagaaaaguaugcuuaacucaaauuuaaaauauuauugcuaaauauuccguaacauuuguuuccaagcauuucucuaauaaugaacccaaaucaccuauuuacacugcaauaaauaaucuauuccaugaaaauucagucuauaguaauagaaaaaaacuuaaaacuuauacaguaauaaacccuaauuuaucuagucauuuuacacgucaccaaaauguuuuuuuaaaaaguuauccagaaacgcaaguauucuagaucucaauucucaaaaguacaacacagcaauaaagccuacauaaucauguuucagaauaaucuguaaacaaaauuuuacacauguagauuauuucuuccaauagccagauguguacaaauggcuucacaacaguccauucugcccacuggcaaaccaaauguuagcuauuccagguaacacacacacaccaccuucaagaggagaacagagaaaagccuaagcuucucauuuuaaucaauaccagaaaauacaugcauugccccuauuuuaugcaugagaaaaaugaggcuuaaagaacuuagucuaguguacaaaugguaaaugauagaaccaagauucaaacacaagucuuuugaagaccacuuaaugaucaaagauacugaccuacucaggaauuuaaaguuaaaauguggaaugccuaacugcuucuggguaugcaaagaaccaauccgaagacauguuuuacaacuuacaugaacuggguuuuuaccaacacugacuccccucuauuagaaaggcuuuguauauacagcuauauaugagccuuucacuaugcccauucuggaugucaggcacauaaaaaacaggccugacacuaacacagcucaucuaauuccuacccuucuguaaaauaaauaaacauuaauucaauuaaucuaaccccuugcuauauacuguauguguguuaagggauccaaagaacaauuuuuuuuaucuugaugagcuuacacugauagacauguaaaguaacugcaaugaaauguuauagguaucaugaaauaugaacaagggacacgaguucaaagaagaaaggucaauuuauuaaugaagaaucagguucaaagaaauauacaacuaguaaauggaagagcuuuuauuuauuugagacggagucucacucugucgcucaggcuuaagcgcaguggcacgaucucagcucacugcgaccucugccuccuggguucaagcaacucuccugccucagccucccaaguagcugggauuacacauaugcaccaccacacccagcuaauuuuuguauuuuuaguagagacugaguuucaccauguuggccaggcuagucuugcggccuccugaccuugugauccacccaucucggccucccaaaaugugcugauuauaggugugagcuacuguacccagccagagcuuauuuaaagugaguccuucuccaucucccaagucuucccccuuuuuuuuuguagggguggagggcggggggaaugggaacgggaagggggacaaacaagacgcagaauaucaucuugcuguuuguugcccaagcucgaguaaaauggugcaaccucagcucacugcaagcgccgccuccccagguucaagagauucuccugcuucagcugccucaguagcuuggauuacaggugugcaccaacgugcccagcuaauuuuuuauuuuuaguagagauggggcuucaccauguuggcugaacucuuaacuccugaccccaggugauccgccugccucagccucccaaagugcugggauuacagguaucagccaccgugcccaguccuuuuucauauuuucuacaaaauauggaacuagaaaaacacucaggucacuuagaaugugaccugaguuuauuagauuaacaugucuuuauuaaauaguuauauuaauuuugaauagaugcuucaaauagcauauacuuucaccugauccaauacuauacaagauauguuuuuucuguguaaaauuaacaauuuaaagguaaucccaaacacuaaaguuguuuuuguuuuuuuugagacagggucuugcucugucgcccagacuggagugcaguggcacgaucuuggcucacugcaacccucugccuccugggaucaagugauucucccaccucacccucccgaguagcuggaacuacaggagugaaccaccacaguuggcuaauuuuuuuugucuuuuuaguagagacggaguuuuuguugucuuuuuaguugagaggcuggucucaaacugcugaguuccagugauccacccaccuuggccucccaaaguguugggauuacagucgugagccaccaugcccggccccaaacauugaaguuuuaauaaccuaauuccagaaguucuuuguaagcuuucauuucaauuuucauaaaaucaaaugcugucuaugacugcuucugaauaaaggcaaucugcugaugggauuuaggcaaagccaaauuucguuucguuuguucgaaaaaagaacuuuauaaagaaggcaaaauauuucaauguuacaauuuaacacuaaaguucugccaugccaaaagaggaagaacuacgagguucagagauaaugaaacuaggcaauauaaaaaauugagacccuaugauauuuaaauucuauuaugaaucagcagcaaacuacaccaaaaagaaacaaaauccccaaagaauaaggaacacugugaucagcaaaucgacucaaaucguacaaguccagaauuuauguuagauuuuuucagaaaccuucuacuucuuuugcucucaucagugcaaaguugcucccucacagugccucagcucuucuguggcaauaaaacguugguauucuuuuuuuuuuuuuuuuaaaguggugcugucgcccaggcuggagugcaguggugugaucucggcucacugcaaccuccaccucccagguucaaguaaauucucgggccucagccuccaaagaagcuggaauuacaggcaugugccacuacacccagcuaaaaaugcugguauucuuauagguugauuuucuacucuuaacugcugacccauaaaaauuugaguugcaaaauauaucucuggucaguuauucauuccagggcauauauucaaaugccuacugauauuucuacuuggauaucucuacuuggauaucucaugucaugcguccaaaacugaaacuugucucaaucccuuuuuuccuguuuauuaauagcaagccauaacugaaagccauaaaccaggaucucaucaucaacuucuuccucucuuaucucagaaucaagauaguuaucaaguaagaucuuuaaaauuucuugaauuagcuucuccuuuaugcccacugucacuaccaucuuaguucaugauguuaucuucagccuagauuauggcaauagcuuacuaaugauuaucccuccauccuaaugauaaaguggucuuuuaaaaauguuacuccccugcuugaaaucuaugauaguuuuuaagauaauuccaacuccuaaguacauacggugcuuuaugaucugggugcccaucuaguuucaucuucugucucuucuauagaacauguucucuacugcacauaaaauauuauauggauaacauaucuuuuucucuucccuacuuggaauauucuuccuuauaauauagcccuuccuuugucuuaucugcucccuacccuucuuuuauaccucuuuaagcacauaguuaccauuauccacccauauaucuaacauuuacuuauauuucucuuuuauuagacuacaaagcuccucaacgaguaagguuaaagguggaaaaagucuucagguaucaguaaccuacgugggaaaugacauaauaauacacuugaaaaaaaaguugaaaaaauaauccuuauggaccaaauaaaauaguaccuauggaccaauuauuuuaauucagauaguuuuucugguugacuaugcucaggcugccaaagguuacauuuuucagauacuuucacauuuuucacagguacucucuucuacaucucugucauagauuaggugggaguuaguguuguucucuaaauccacuuuuucuggauuuccaauaaaaaaaaauuuaagcaaguaaauaucagaggcaauagguaaggaagucaauuucuucuaauuacaucaauucuuguuggaaacuaaccuuaauacaguaccccacgccccccuccccaaaaaaacccacgcacacaaaaaacuagcaaugcugucauuucuuucgaagguuuaguuuuuagucaauaguugugcuuccgaaguagcuuaccuucagaaagaauaagccaguacauaugauuauuaaagccaagcaauuuugcugcauaacuaaugaucuaaaggauuucccaacaacucacuaaaaucaaaguuacucuauugaaacucaaaauuagaugguauauucccuacagucaggaaucuucaguucuguggcacuggcaccacuuuaagggaccuaaguaguaguccaaagcaaaagugacguuguuaacuguccaguucucccacuaaaucuguaauuuauggguugcuuuaggucacaacugcuugcuacauagagcaaccauacucacaaaauaagcuacuauuuaucuuauacagugaugcuuugucacaaagaaguauugagaagccaaaagaacaaaaugaguuguuucauuggugcacuccacaguaagcauauaguuaacuauuuaaagcuggcaucuaaauuaugugcuuacuuauguacaagacaauacccguacuuuggguggauuuuuauaaucuuugacuccuucuugaaauuuacccaaccaacagugagaacuaaccuuuuuaacugaaaacauauuucagugaguacugcuaccaaagcaaaacccagcaguugugguuaaucagguuaauauuuaaaugguucugaaaaucacaugcuucuguuuguaaaagcagaaaacugcuagucauuauauuaaaagguugcugaaaaaguucagcaaggaauagccaucaccugaaauauauauuuaaaaaaugaaaaaagguaaauguuuucucaaaauaacagcaaauuaaguaaacugcuaaaaaaucugucagaauaagcaacaccauucucuaaaaaaauuacuaccauacacucaucauucauguuuccuuuugauugucuauagguauguuccuugccuuuugggaaaaacuaguguguuguucaaaauaacaaagucuaaacugucaagcagaaaaaccaacuaguuuuaaagaguuaguuuauucugcacaccauccaauuagaaguuuuaauuaccaacgcuucugugcuuucuuaguauugacaauuuuuauaaugaaacuaucaacuacccucugaaucaaagaugagcuuuauuuuaaggcauuuuauagcauucuuugaaaacugguaauccaaaaugggaaaauucuagagguugcaaaagcaacugcuuuacaaaacacuaggcagauaauauggaauugaccuaguaggcacugugguaaacacauaucccaucuaaaaaagggaggcagcugucauuccaucccaagccauuacugcuuauggaaugugggccuacucagaaggcuuuuauuugaagacugccaacuuucaaaaauaucgugugggccaaacuggguaacucaacauuuaacugcguguauuaaaauuaaacaauauugcuaccaaauuagauaaaaguaaguacuuuuaauaacuacaaagccaggauugugcauuucguuauuacaggacuauuuuuacuguuuuaaauguuacuuuguuuuaaaaugauccaggacguuucaaaguauuaaacuuaauauuugcaccccugccaugucuuacuuugauuuaguuuuucuaccuuuagggcacuaacauuuuaauuacucuaaauuaauccucccugcuucaauuucccauuaauuuauccuacucagcacuucauucaccaaucacuuauuuuccaucuugucacacuucagcacuuguuuuagguaucugucuccucuaauacaguguaaguucccuauaagaucgacagggauguuuauuauguucaauuuguauccuuauuaccuggcacacaguauguacucacauuugagacagaaaaaugacuaaaguuagaaucagaauuacuaaauaaauacuuguugauucgacucaucuacuaacucuaagagcauuuuuuccuuuagaauucuaaauauuacuuacugaccauuaucucaccuaguacauuauugcucuuuauguugcuuauaaaaccaccaaaaagggaagacaguuuucaggaagauacacauguaacuuagaaaacaaauccuuaagcgccuuagcaaguuaaaaaaaaaaaaaaaguuaaauauuuguguaagauacagucuuaccccaggauguuuuagugcgcucuaauucucugaaauucuuagaugguauccauaauucugaauauucaauuauccagcauauaguugcuuaucuacccaggauagaaaggaauuuugcuauauucaaaauaucacuuucugccuaaauauauucaaauuuugcauaaacugaaguucuauaaagaaucaaauaucaaaauacaauuaagcuagauuauuggcagcugcaguaacagaauaagaucucugaguaacacaacgcauggcauaucagagccaguaacuuugucucuauaaauaacaggaaguuccaugacaaugcuuuacacagugcuauguagaaaaacugaacugagauacagagauguuugguaggucauagagauggcuauacucuagaacgugaacacagggauagacacaaaguacacguaacaaaugacuaacucauuauguuuuuucuuucaaaugcaguacaacuauggaauauccaaaauagaauuaacuauaugauaaaauaaaccuacagaccaaguuaaaaauuacaaccaaaucaaugcuggauuuucacuuaaaacuaaauuuaaaaauucuuaauacuuacaggucccauaauuguggcuugccaaugaaacacuagaaaaagaaaaaaaacucugguuaucuaaaaaugcacaagcuuaaaaaaaaauuaggcauaaaaaucaacuugcaaguuacuuacuaucauccccaacuggaccugcagaacauugugcuggagggucacgggccaaaucacuaaguuccuacaccaagacagaaaaugggugagucacauaagcuuaauuuaagaaaacaagcaaaugaguccacugcuuucaguuacuuucacccuauuuuuaaaggcacacuccaucacaauucacauaaauaauauauuccauuaggagagagaacaugccugaacauaugcugagacaaucaucuuagcuagaguucguaaaaauauauaugcaaacacauugauacaaaauuuuuuauuuacauaaaagccaaucucuuacaaaccgaaauagcuauaauuagauauucucauaguuuaagagcuuagaccagagagagcucaacauucacguuauuuguugaacuuccaagaccacuuucagaggcccucaacugucuuaaauucuuuguucuuccugaaccauccuuccuccccaauccacuaacucuauuuucuaccugaaaacaaaccaaaaaaacucucauggggcuaaguaccuuuuuuguuuucuaaucuccuuauucucucaacucaaccuuuuuuuuuuuuuuuaaacucagcauccauuuuuaacuauugaaauuuuuuuuuuuuuugagacggagucuccaggcugcagugcaguggcgcaaucuggggucacugcaagcuccaccucccagguucacgccauucuccugccucaggugcccgccaccaugccaggcuaauuuuuuguauuuuuuaguagagacgggauuucacuguguuaaccaggaugggucucgaucuccugaccucgugauugaaauucugacccugaagagcguacuucuguaaguagaaagacguuugcucuuaacauauagucugcacaauucaauaugaacguuuuauuuccaacaaguauguaguucacuguuccaugacuugugcauaacaauaugaauuaucuacuaugaaaauauaguuuauuagaauauuuuuaagaugguacagcuccaucuuaccaaugauauaaccaaugucuaauaaucacaaguuaaaaaaaaaagacaauaaauagaaccaauguuaauacauuacugccuucaacauuuucaaacuaacaguuucucuuaaguuuagucuauggcauaagucaguacacccauuaagucuagggacuacuauaucuucuauauccccuuucucauauaaacacggaaauaacacagaaggguaagguuugggauuccauuugaacagcagaagaccacuagguacguggcucaugccuguaauccuaacacccugggaggcaaagacagggaucgcuugagcccaggaguuugacugagaccagccugaacaacaaagggagacccccgucucuucgaaaauguuagcuaggcaugguggugcaugccugggguccuagcuacucagaagacugaggugggaggaucacuugagcccaacaagucaaggcugcagugagcugugaucaugccacugcacuccagucugggcaacagagcugucuugagacagaaaaaaaacacaaaauccugucucagaaacaaaaaaacaagaccaaaaaagcuagacugggcacaguggcucacgcccguaaucccagcacuuugggaggcugagaaggguggaucaccuaaggucaggaguucaagaccagugcugcuaacaugguaaaaccccaucucuacuaacaucacaaaaauuagccacgcauagugcacacgccuguaaucccagcuacucgggaggaugauacaggagaaucacuugaaccugggagggagaggcugcagaucgcgccacugcacuccagccuggggaaaagagugagacugucucaaaaacaacaaaaaaaaaaccccagaaaagcugaacguacucauauacaaaagaccaaguacuagaaagcaaaagaaaggaugccuaaauaaaaaagauacaacagagaagcagaggcgagaggacagcuugagcgcaggaguucgagaccagcuuggauaacauagugagaccccauucuccauaaaaagaaaaaaaaauuacgauaaagccaguaucaacugucuaccacaauaucaaugcauccguguauaacuaaaaacauuaaucuucuuuuggucuacuagaacaacuuauucccuauaacuacaggaauuuaaaaauggaaacagauuuucaaaguggguaacuuuuuuuccucaacugugaucuuuugccuuccugugcaaaaucaaggacacaaaaugcagaacuuucaguauaagcucucucagaagggugcagggaaugggaagaagagcuacaaaucuuaauuuaacaaggcauaguggcaugugccuguagucccagcuacucggaaggcugaggcaggauuaagcccagguguuucagguuuuuguguguuaaaugaucaugcugguggagagccacugcacucuagcuuggacaacaauguuuaaugccuauuuuauacuggcuucagaugauuauuuucauucacuacaucaaauuuaaacacagugacaaauuuauguaagggucccacuauggcacugacuugguugggggaaauaaaugaguccucuaaauuuuguucauuuuguuaaauccacuggaaaucuuuaaaauaggcucucaacaaacugaggggccagaacaaaaaacaacccagcuuccaagucuuuuagaaaauuagaaucauugaauagauagcuugaaaaaucagauaauguugacaucuuucccugcaaaacugaggaacugaacaaaucaaacaauguaugcaccaacaguacacaagccuguaacugugcuuuaaauauuucaauuugugggaaagcucuuucaauggagcugcuauuuuuauuggguaaguuuguauucuguagcagcauggaauaaaauugaaauuucgagaaacacugaaaaagaaaagagacuacauaaaguguuuuugucuuauuaaaaaagaauugagacuuugucccauuuaacaggauuugcucuaagcuuuuaagacaccuuagcucccagagggcauuuugccauuuaaaaaauuauaguauuauagacuacagucaauggggguuauuaauuuaaaccuuauuaaccucaaaagugcuacuuucaacaagauuaaguaagacuauuagagauauuagcaaaacagcacugagaaacagggcuaggaaacuagaguacacaaauacggacuaagaauaauuguacuaccuuuaaaaauguuaagaugaucaacacaaaguuuuaacugcucuaauaguaucuuuuuuaaaaaaugaaguuuugauuaaaguuguuuaguuaaaaguccaccaauccucuccccuuuuaaaaaagugaugggaaucucacuauguugcccaagccggacuacaguggcuauucacaggcggaaucacaaucauaaggcacuauagcccagaacuccugggcucaagggauccucuugccucagccucuuaagcagcuggaguugcagguacgcaucacuauguacagcaauuuguugaacaauaaauguacauuuuuaauuguaaaauuaaacaaugaauuuuguugauugacuccaugugggaagaaaaggugacgcuaagauuuuuggccugagcaaagcaugagauuggcauuaaguaaaauggucaacuuacaggugaagcuugugggcagauguagagauaaaguaaguaaaauaggauaauguaaguaaagacucaauuugaaaaguauauauacaaguugagaacaggcugggaacaaauacaaaguaucauuaauaaacaaaugauguuuauagccauucaacuuggugagagcacuccuggaacagaagguccuaggaguuaacacuggacuaauuuaacgcuaagaaagggaaccuuggccaguaaccugaaaaguuaaaaagaaauaaagaaugugaagaaaggcuuugucacaauaaacaacacugcaggaaaauuaagaggcaaauauuugccucuuauauucaaaauacacuucagaaaauggccaguuguucgggaauggucagucuagauuaaugccauaaaacaaacaacaaaaauagaguagacaaggagaauuguccugauaugcugugccaauucacuuuggaaacucaucacaacuacuuacaagguugccagagaucccaagauucacaauuuuaagacuguauaucacacacccuuuauaugcuugucuguauagauauacccucaugucuuccacauauucagaaauggaagaaaauucauuccaaauacuauugauucugaucagugggaauuacagaaauucauaucgcaguucaacaaucuguaaaagaaacuacauggcuuuuggccuucaaaaaauuguaacagaaaauauuaacugaaccaaaucaguauuucagaagcuuuuuuuuuuuugcaacuuaaauuauccacuauuaagaaaaugacuuuuuuuuuugagauggagucucccucugucauccaggcuggagugcaguggugugaucuugguucacugcaaccuccuccucccagguucaagugacucuccugccucagccuccugaguagcuggaauuacaggcacaugccaccacaccuggcuauucuuuuuuuuuuuuuuuuuuuuguaguuuuacuagagaugggguuucaccauggccaggcugaucucgaaauccugaccucaagugauccgccugccucggccucccaaagugcuaggaauacaggugugaaccacugcaccaggccugcagucuuacuuuuaaucuuacacaggccuacuuuuucucaugguucucuucucaucucugaaauaggaaucacuaccuggcacauaauggacugguacuuaacaagcagaccauguguagaccacccauccugaaccaagauuccugggcaaggcucuuaauucaucuguuacugaacaaaagcaaaacugcuccacacaugggccacauaauauagccacuuguuuauuuaaauuuuugaccuaugugauaaauccugaugcucaguugucuaaaaaugucuuuguaagcaucugaauauaccuaauacugaaauaagaguuuaaaaagcugacaacacaauccaaguuuuacauuuauuuacucauaauuaacucaauaaacauacuagauuuuacauuuaauauauguuaaaaugucugaacaaaaauauuuagcguaauuuucuuuuuuuuggagauggaguuucacucuugucgcccaugguggaguacaauggcacaaucuuggcucacugcaaccucugccuccuggguucaagugauucuccugccucagccuuccgaguaacuggaacuagagaugugcgccaccacacccggcuaauuuuuuguauuuuuaguagagacgggguuucaccauguuggccacacuggucucaaacuccugaccucaggugaucaccuuggccucccaaagugcugggauuacaggcgugagccaccgugccuggccagaauaaauauuaagauaaaauauuuuaauuuuaaaauaaaaaucaauguaaucaugguuguucuaaacacaauacccaauaauguuggaauacuucauuauaaauaaaacuaaaggucagaaaacuaugaaguugaccuagaauauaaacaccauacuacuucaacauuacacauuucaauuacaaagaaaguaagaaaguauuucuuauagaauaaaugaguuuucggcacacugauauuuauccaucacuaagccuuuaaaugcuagcauuaucauccuuuuagagugaagguauaauuucagcuaguuaacacuggguuucagcucuucacuccuguaauuucagguucuuguuacucuccuaacauuucuaaaugccuuacuuucgaaguucuccaucaccaagacaucucuuuaguaauaaucaaagagauaaaaucagcccaauacacuuaccuacuuuaaauucaauauagaaaaaugaccuaaguauuuuaacaaucaaaacaaaggucuuuuuuaaagauaaaaaugcuguucuuauuucaccacuuucuuucuugccauuuaaauaguaucuaauauuacuauuuaaaguaccacuuaguacccaauaguaacaaaaccaugcacaagcacuuaccuuugagcuaccaaauaauuuuuguaacauuauaugcccacagaaugagcaagacaguaucguaggaaaaaaaagugagaaaagaguaagucauagcagaugcucuuuguagcuagcagacauuuugucuacucaauaaaccaucuuacucaugaauuccuuuucccuuacuccaaaucaugugacuguaguccugggucagccaucauuaaccaauuauuuggacaugacuaaccacagaauuuuguucccucagcugggacccaacuauuaguccauuguccaucccaaccuaagaguuuccaaaucaaagggacauucuuccuucuauaaucaagagcuauaagaaugugacccauagcuguugacaggcacgugucauggacuuacaugguaaagucaaaagcuaaagagaccauauucaacagcagcaauaacaaagagcugacuuuccauacagaugugcaauuuugguuccugagguuguagcuugcucugguuccuacaccuauuccauucauuguuaacuaucccaguuuccuucuaauaaaucccuuauuuaaucuggauuauauuaaggaguuaaaaaauauauacagcaguagugagagaccaaaucugaauaccaauuauguagauuuuaugccacuucaaacacaauuuaguuuuugaguuuugcugaaaaacauguaagaaaucuaaaugaagcuaagucuuaaaauugaauuaggaguaacaagguuaacuuucacacuggagguuaauuuaaauccauuucuaaaaugaaaauguaauguuaauuucaccaucaaaacauucauucauucauaggaacauugccuuuuuggugccaugcauguuagguauaaaaacaccaagauaauuaagauagaaaugccuccucagacucagcuaacagaaagcaggugcaagacaaaacaaaaauuauacuuuaacaaccuacaugcuuaaaauaaagggacucaaaugcucugagaauccugaaaaaccaaccacuaacuuuuccuggguuuagaggagugccauuugagcuggcucuugauggaaaaauaagcaggcauuuaccaagaacaaggagugagagaagcauucuagguagagaaacucaaagucaggagugucaaagaacacagggcauaaaaauuugccagaacaaauacugcagaguuugguauaccagacagaguacaccaggagaguggcagauuuagcuaaaaaggcagguuaugacuugaucuuuuaaaagagcccuugaauuuagucagacuauuccaaaggcaaugggaaaucacugaugguuucgaaauagaagacaaaugaguuuugauuuuuaaauauacuagcagucguacaccacaaguguuuaacuguacucuuauaaccacuuuacggaaauagagcucaucuucucuguuuuacaguugagucccuuaagagaggggaaagaaaugauuacauucaagcauagaacauguucagcuuuaggauaggugaacuaaguguaccuacuaacaacuuaaaaauuuggacuagggguaaguuucaaaaagguuccuuucucaacaggguguccuugcaaagauaauuuaauguuuggcaaacugagggaaaaaaauucucaacugcaccaaacuauuacucaaugcuccagaaugaacacgauauggaaaacuaauguuuuccuuaguauuuauuuccgcauaaccauccaccguuagucuguaucucauuauucguacguagugugaauccaguacuauuuuucaaguuacauggccugagaaaaugauucuaucccacagcaagacuauuuacuggacuggaaaucaauuuccaacgacacccauacucagcauuuuuaaaaguaauuuugucuacgauagucaccuaacaaaauguuuuuagagccuaaaguuucacaggcuucagggacaaaaacacuaaaaaauuacacaauugaaauuuucagcuuauuccuuccuagcagucuagaggaagaggaacagugccaagaaccagaaggaacagcucucacacggcaccuguaaaauuuuuuuauacugugcugacuaccccucaccuaaggggaacagcauuacucaacuauuaaggccacugaaacaggaaaauguuugguuggggacacugacuuacuuuaggaauugcucaagguuccacucacguugaagggacacuaagaucaagcacauacaaucaggguacaacacuaagaaacuguacuagcuauaaaaagaacaaaagguuggacauuucuuuuccacagagugcucuuuuaggaaacuuucuccuuuuagugucaucuuccucugagcugcuucuccucaaacuuucugcacacuuggcuagugugagaauccagaccuucucacuggaaaaaauacuuguauuuaaaagccuuaaaaaaccuauaggaaaagaagucaaggagaccccucugccuucuuucuaagcuagguaaaugagacccucucaaagcucucacauggucuaguucgccucauuaguuaaaacacuacaaagaaauuugagacagcaacagacuuuacacaacugaguuguuugccuauuuccugaagaccuggugggcaccaugguagaaaauagggcaggauuuuuuucaccaaaaaaaucucucuaaaaggcaaccaacagguacagcuuaagccacuggugaguguucucaucuggaaguacaugauuuaagcaguaauggguuuggucacuauuuuuuuuuuuauucugaaacauuccuuacaugagauuuuuaauacaaagccugcaaaugguuuaucuugaggaagaccuuuacuguagucacuaugggauaugggauuuaacaguugauuguuggagauguuaaacuaugcuuucugcuucucuauucucuaucuuccucauucaaugauaagugguacuagcaguggugaccaaccacaggcuacaaagaacaguaggccaagguauugaaaacauuaaagaccugaaaggaugcuaggagaaacauaagaauguccccucccuugcugggcgugguggcucacgcuuguaauccuagcacuuugggaagccaaggcaggcggaucaccugaggucaggaauucaagaccagccuggccaacaucgugaaaucccaucucuacuaaaauauaaaaauuagccgggcaugauggcgggugccuguaaucccagcuacucgagaggcugagacaggagaauugcuugaacccaggagacggugguugcaguaagccgcaguugcgccacugcacucuagccugggcagcugaccaagacuccgccucaaaaaaaaaaaaaaaaauucccuccuuucaaagagcuuauaaauuggaaauacuaaaaauauuuauucacaaauauuuaugaauauuaugaauauucaugaagcuacagagcagccauguuccaggagcccaauaaguaucugaacauucgguuaacuuucuuucaaugacagccaguaucuguucaucagaucaacauaaccaaaagguagcauuuaugaaaacaagguuuuaagugucaacccuauuaaagcguaacgccauaaauaacuuauucuagguuucauccccccaaggcuugucaaaauucaaaagccuauauaguggcaaggccaaguucauggauucuaccuuuaagacaguaaaauuaucaccacgauguuccacaaaucauuuguuaucccaaucucuaccaucuauuuugcacgucaucacacaaaggucauacagaggacagaacgcaguaguauagauacauuuccucucagcacuuuccggaaaacuaaaagcuuaugccauuacuaaagguuaauuucuuguauucuauuugagagucuauuucuuucagaacuaaagacaagauuuacaugacucaaaagacaagauuuguaugacugugaaucagcauuauaaaaacagcccuugccucaaaaaccuauacugagcaacacaaaacacugcuuuggggacuggaagagaugauaaaaugaggugggaaacaaagggaguaagugccuuaagaaauuuuaagaaucauccucaagaagacuuuacaaccaaccuagaaaaauacaaaggugcgaaccaacaauagaggucgaagugcagugcaauuagcuguccaucaggcagacaguaacuacuguaacuguucauauaaagaucugguuuacuauaaaguuuuauuaacuuuaauguuaugaaaugucuguauaaaauauguagaugcgaauaucaaggcagggaacaacaaacuucagaaacaugguuauuucaagagaaggaugcuuggcaaaaagauaugaacaauuucacaaaacuccaaauagucccuuuaaaacacauuuuaauuugaaauuucuucugagaaauccuuuuuuaucuuaagguuuaacaguaggcacugcacaguaucucacugcaucacugacaagguauuaacuuccuguuuagucguaauuauaggugaaacaagcaugcguguucauuacacaagguacuaagaauggauugaauauuacuaauuuucuuucgaucaccacugaagguaaagucacuuaacauuauucaaagccauucuuuuguaagcauuauuuaaaaaugggcaaagaaacccaaauuuagauuugaagcucugcuccaugaaagcaagaaggguguuuuauggacauuaaaacaaacaaaacaaacaaacaaacaaaaaaaacaaagauuaacagccaaacagcugcccaguaguagaaaacauucaauuacacauuagccaugaaauuacagcaagguuaggauuaauguaaguauuucauacugaaaaagguacaagaaaucaugauucacaauugacaaacauuuaaauacgacaaauucagcuaugaaaaguugaaggucucuuuuacaauagauuauguugaaaguaucauuaggagauaaaaaucagauguuucaacaaaguauaaaaauacuucccuaaacuuuucccuucccuacauaacaagguugaggauacaauucugaauaaaucuuaucuaauaagagaaacugggcaguaagauauuuggugaaugcauucauuuuuaauuaugaaauaacacugcuaugguagcaagcucaagaccacaacauuuccaagaauggagaguuuuauuucauuaauuucaaaauacugguuuuggcaaggggaauuaagucauuauaauaaaagacaaaucacauuguaauaauacuaguacaaaaaauacaguauagaaaauuuauuuuaaauaccuccccuacuagaucuaauauucuugaaagguaaauuacaaagugacaaacaacuauucauguguuuacaugcuuauuuucaccacugaacgcagagauuaccauagauaaggaccaucuuccucauuuauucccugggacuagaauacuacgucuaaugcagauuaggaccuuuacucccuuguaucugugguucuuaaucagagaggagcuucagaaucaccuagaaaauuuucaaaauuauguguuuccagggaaaaugauuuaguaagucuaagacccccaugcagcuguauuuuuuuuuuuaaauucuaaacaaucugacauuuaaaaauaaguaaacaaguauaacuggauuguaacacaaaggauaaaugcucgagguauauaccccauuuacccugaugugauuaugcauugcauaccuguaucaaaauauuucaugcaacccauaaauauauacaccaacuauguacccacaaaauuuuuuuaaaaacuccaaauguucuggaauauaaauguaauucaugucacacccaacaauauauaauauucaguaagcucuucuauacgcuaacagauacaagaaaacugcuauuuaaaaaaagaaugcaaaaaccaaccuagguuugagauuuuaaucugaaacauuuuuuuaucucaguguuacgaaccuaguuucuuuuuuaauagauagauuauagcaacaugcuguggagaauccucaaagauugccugucuuggauaaaaagggucaccuaaacucaggggcaaaguuugacagagcaaucuagugacacaguaguucaucccagugauggagcauucaacuuuuuauuuguauaaauaacaaaaacuagaaucaacacugcagaugagcaugaugaaagaaaaguaugcagugucaguaaugcauccuuuuucaaauuaaacaaauacugagguccuauuauuaucagcauccuucagucacaacuauccuacacagaaagugagcuggcuaucaacaagcuuugaggaccauauaugaaacacaugcaagacaguuuacccagccuauauacuaguuggggacaauaaauauauuuuguucacucuaagacauccuaagcaguuaacuggcacauguuaguuuucagugcuugaagagacuaccccaaaagaauuaaauccacuucuacuuucaaaauauuauuagccaaaaucuuaacucacaaauuagcuauaaccuaagaguaaagcuaacucccaauuacuuagauguauaagugggagagcaaagcagcuuauuucagguaacaaacuaaaaucacauacauuauaaaacaggaauugaagggccaggccacgugguggcucacgccuguaaucccagcacuuugggaggcugaggcggguggaucacgaggucaggagaucaagaccauccugguuaacacggugaaacccugccucuacuaaaaaaacaaaaaaauuagccgggggugguggugggcgccuguagucccagcuacucaggaggcugaggcaggagaauggcgugaacccagaaggcagagcuugcagugagcugagaucgcgccacugcacuccagccuggguaacacagugagacuccgucuccaacaacaacaaaaaaaggaauugaaaugguucaaaaaagagcuugagcuuuuggugccuaucugauuugaaucccagucacuuacuaguugugugacuagacgacuauuucucugagccuguuacuucaucuauaaaauucucacaucuaucccacaugguugucuugaggauuaaaugaguuaggguuuagaugagacugcauugucuuaacuacuguaauagauaauacuauaugcaaaaguaaaccguucugaaugacaaaaaaaaacuaaaggaugauaucaaacuguaguuguuaagagcacauacucuggaccaggcugccuagguucuaaucccaacugucacaacaugaaccugggucaucuucuuaaccucuaugccuaaguuuuucaauuucgagauggagauaaucuugaaauuaucucaguggaaguggugguaggagggaaacgaagaucaaaugagaguuuuuuaacccuuuacccaugguuucccugcuagccgcuugcuuauaaucauauauaaacacuaaagucauacuuccagaaauaaaaacccuuacgaaaacuuaacaggguguauacaaugaaaacaugagcuauucuuuuaggcuugguucacauauuuaucuucaaacgucccuaaaacacauauauuguagucccuguuuaaugggagugguaaaauugucuacagcucucaauaccaaucaacuuggagugccacuuuuaacuccuguuguuuaauagcccuauuuaagaccauauuacagcucguucaaauaaagaauacaggaaaaaaguugauuggucuaacagucaaaaaacuuacuccaagaacacagcugaagcaaaguauaaauucaaaagcucgaucaaauggacuaaagguuaaaacuauuccaauaaucauuucaguaaaauauuaacgaggaauacagauauaucauaauacuugaaaugugggaccuucagacaagaauaaauucgaaauagguacguaacacaagcauaccauacugacaucaauggcuacuugaccccauauuucuagaagaggugccuaaaccgaagagcauuccaguucagagcuguccacucacuaaaauuguuggauguggaauguuugaaaguugccucaugugauuuuaacauuaacagcugaaaaaccaaaccacaugcacacgucaaaguuucuguaaguugaaucaauaauguucacauaaacacugguuuuuccaauaugccaaguuuuuauguugugucuauauuacauaaaucuucaaaauauuuacaaaaggagacaaccugguuaacuaagaguacuaaacuagaaaucaaaguucuuaaacaaaaacgauuuuuaaaaauuauaaauugugauauuaaaauagcaguaauaacuaggagugucaugugccaagagccuguucaaauuugcacauuaauccauuuaaucgucaaaacaaaucuaggaacuuaaaauuuguuuuguucacugcugccaccccaaugucuaaaacagugccugguacauauuaggcacacagucauuuauuguucauauuacaacagauacccuucuuauagaggcacauaaacuugcccagagcuagaauucuaacuggagcauuucugcuccaauguuuacacucuuaaccacuguuauauugucucucuaaagcuuuuaaaucauuuaaguggugucacagcagcuggguaugaccuguaagagaaaaaaaaucagaggccuuccuuuaacguguucuguuccacaugcacaaaaagcuauggaucugguacuauuccacauuuuaguggccugaacuaauuccaacagaaaagauuuuuauuuguacugaauguuaugcucuuuguguaaaccacacuguaacauacaacuaggcuucuccaauauguuccuggccuuuaaaguggucacaaaaagagguaauuauuucaaaauaauuuuuacuuuaauccuuaacuccuaaaaagcguuucuuccucuuuucuuucauuucacaaagauuuaaauuuguauuucgcauaacccaaaaugacgauguuaugaaggcccaaaacaaaauucacgauuucauaucaauacauacuaagagugaagauuuaaaccuuccucuuucaugaaacaccaaucuugccaaauaaacuccagucauaauuaaauacaggcaaauguaguaucaggucuauuuuaguaaaggcaaauucuugccauuccucucagaacucuuuuuaaaaaaguaaucuauuaaaaccaaaguuucuaacacucaccgacacuccacaauuuuucuaguaaggcugaauuuauuccaugacauuuuuuucaaguuagcuguaaacacuccacccucuucgauugugcaacaaccaaacacaucacacaaauacaagucacaaaaaagggaaauacaguuuaagaguuugaauuuagguaaguuuugagcagaggaucuuagagcagugcacaacgcgauauaaaaguuaacauuuaacaaaucauauuaauucacauuauuacgaaaggagaugccggaaagagccugaaccaguuaaagcagccgccaucuuaaaaugcgggauagaaguuagagcaagaaaaugagacuaaaccaccggagguggagguuccgcucacucccagagcuccgaaaaauccuaguuuuuuuucaacuuaaaucgauaauauacuaucaaaccacauuucaaguaacgaaacaaggguguuauuaaauagaaugaggcaaaaauagguacauuagcuuucccuuacugccaucgcaccccuuauccacccccacucuccagccaaaaggaaaagggagcuuccagaaugccuuuuacaucaguucccggugucccucggauaaauagcuucgggugaaaagcugcaacuacaaaauacaggaaguggcaacacugugucauuccaucuccucccaaacccacuuauucgguguaaccugcccagagucgacuaagaguuucuacuagacucacugacugaccuucaauacgcaagacuucuucuacccgacccucagucaaguucgggacucgccagauuuuuuuucucuccuccgaguuuucuuucuuaccccuagaaggccuagauaaccuugaucucacaacuaaacuaaguuuucaagcaccaagaauaggaagcgccaugacaucugcuggagcgucucuccgcaauucggacccccaaaaaaacuccuucuuaagcagcaaaaaaauaaaauaauaaaggcgccuuaagucacucuccuccaccccuaauuugcaccgauuccacugaagcacucaggauaacaccucacuugccacaaguguucuccguuuccuagcuuuaaacuucauuucuucaagaaguauaucugcguucuccauccccccauggaagaagugauccaagagguauuuucagaauuaugcuuccuucccacccccacgcuuuccucuuggcccgagccuuccuuuucuccuaccaccccaugcccuuguccccgcggguuaccuuauuaauccguuucagcgccauagugugugcuugucgucuggcuccucacucucucgguguaugcucaaagguccggccaaaacucuugauuaucccggcggcggggcaggauugucucgucucacaccagcucugccagacacaggcgccuuuugcaaaaacggagcagaucagcacucgcacaggccccgaagagccccugaugaauccaggucccuuaagacagccgcgauccggggugggugggguggcguggcaaagccaccaacagccucuguaccgugcuuucggcccgaagugggggcgagggugacgggaagagcggaggugguggcuacaaguuuaacuucccggccucuagaaaggaagagacccgggugggagaggaagaggcguaggagaaaggggugggugcggggcaggguccggagcccagcagaggaggagccggggccuagucggcgcuauaccggcgucacuagggcaaagaaaggcaaggggggagggggaagcauaagacuccggacggacgccgggcugcuuucgguuucuguccaaaggugcggccgggaaaaggaaggaaauaaaggaagggagacuugauguguauugcuauccucgcagcgagcuauucugugucaccccugacgccaccguacacucacuccgccuuccagcgcgcucccgcgcgcgcccgcccagccaccuccaccacgcgcccgcgcugucccugaggcuccggcuuaggcgcgaggacgcgcccauucccccuccuccuccagcaggagaggccgcggcuuccccaaccuucccacccuaacccaccgcacccaauaggcuggccgcucaagccgcccaggucccgcacugccccucuuacccggccggccacugggccggccucccuucccugcccuagccguccacacccacgcguacagaggggccggggccucccucaagcugcggccucggccuccuccccgcgcggcagcuggugccuccccggcccuacggggcucacgcgcacgacacagccacaagauguccgcucugacggaacuacugccagcugccacgcuccgccccucccccuccuccugccucuucaccgccgcggaucaguccgccaacgccgccgucccgagcacaagaccgaugugaggccgaagccagacggcuugcuucccacguccggggccgagugaauacgugucaagcccuuuuccuucuucucggaacagcaccuucuuacuaaacagaucggagauuggaccaggagggcgggggagggaggaggaucaugagcuggggggagggugaacgaguggcggaaacccuuaggcucagagaagcaucgagaaccggaaggagaccaugggaggaagguaaaggaagcagccgcugcgcgauccagccccacgccccuccccacagcgucccccaguuuccucacuuggu

SEQ ID NO: 191341 - RNA, 63864 nt, Homo sapiens
ggagacaccggaaggagccgcggcugcugcgggaaguggccaguucaggaggcggaccccccgagggcagcgcugcggggccguuuuccggcccuccugacgcgacacugccccucuccgagagcugagaaggaaaagaggagcuugcggaggugcggcugcaggccguuguuggucgagcuggcgggucccgcgggccaggccguggaggugagcgcggcgcugcugggaggggcgcggggcccaagggcguuucgcucgcguccgggguccggucucuguucucgcuuccgcgcgcugggguugcggccgcugcagcagccucuuuuucuugguccuggguggcggcggguucgcgggcgggaagaaggccuuggccccucggugcucugcguugcagagauaaucuaguggucgcccugucaacggucgguggaggaugggaaccggucguugauuugaggaaggguccucagggguucuucccuggaagcgggaggugcaggugagcccgagaagcgggggcucugcucccuuccucggucuccccacucaggcuugccagucccucucagugggugacugaaagcccugcagcgcgccggcuccuggguucugguuucgcuuuucggcgcuguugagggggccggccccguuguuuguuguugugaacggaaaaaccgaggugucaucgucccuggaauuuuucuucgaccaauguuugaucuugacugagagguuaccccuuaccuucuguccaucugcagccuuuguuuggaugaaagauccauagugugugguuucccagaccuuuacuuauauuucucguauacaaaacgcucuucauuugaauauuuacaggguuuuacguugagcucuuggacgaugagauuuuccuggguguuuugcacucaaguaccguuggaguuuacauucucauagaaucaguauuaggccuggaaaauugagccagagggugaaauucuggcaggagcauagacuuaaauugaaggugaauuuuaccguaacgaucucuaggccuuuugcuuaauaacuauguggauguagagaauuuuuaaguuuaaucagauuauuuuuccuuuaagaaaaacguguuacaaaaaguaacaaggccguccuaguuccguuuuuccuacugucuuauuuggaaaggucugaccaagucacauuaucgucauaggcuauuugauuugagcauaauacaaauauuguuagugaauucauacuauuauaaauaagagagaaaauaggaaucuuaaagacaaugcuaguuuuaugaaaaaauaauagaaauaguuacacaaugcuaggagcuuuguauuauuucauuacuuuggcaggauugaaagaaaggucagggcugggcacgguggcucacgccuguaaucccagcacucugggaggccgacgaucacgaggucaggagaucgagaccauccuggguaauacggugaaaccccgucuguacuaaaaauuacaaaaaauuagccgggcaugguggcaggugccuguagucccagcuacuugggaggcugaggcaggagaauggcgugaauccgggaggcagagcuugcaaugagccgagaucaugccacugcacuccagccugggcagcagagcgagacucugucucaaaaaaaaaaaaaaaaaaaaaaaggacaguacaaaaaauauuauuggaauaaaauauuugaccugauaugugcaagagggauagucuacuuaagauugcuuccuauuuaugaucugguuuauggccaguuucacuuuuuuucugucuuuucugaacuuuuuauaacuuaacaguaagcaagucuuuuuauauaacugcaguuuaaugacauuagauuguaguaaauaggugauuuuaaauauuugaaauucagaauugagaugauaauucuuacauuuauguaguaguauuagaauuuucugugaccuuucacuuacacagucuuacuugauccucaugccaguccucugagcuccgaaugccaagaaauaaagucuuuccccaugacagaaacauuucaagauuguguaaggaucagaauuucguaaagccugaaauaauguugccaaagcagcuuuugauacagauugggaauucagauagauuaagauuggagcacugugaacuauaacauaugacaagacuguggacucuucacaagaaaaugaaguacauaaaaugcugaaagauuuuuggugagaaaugugaaauguaaccauuucuaaaaaggaagggaauaaguaacagcucuauuuaguguaguuuuuaaacuuuaaaaguguacaugugucugcaggaacauuuugauaagugggaaaacuccaaagagugugagaugaguacaguugcuuuuaacuaucuauaaaaaggcacaugaauuaugugcuauauuguauacugagaacuagucuuuaagaaacaauauguauaucaaaauaaaucaugcugucaaauguucagaagguuaaguuaggucaauauuuugagucuaccaggacaaggcccuuuggaaaacaaaaagaaugaaacgugguuucugccuucaaagaacuuguagucaagugaggcaauuuuuuacacaacaguaaaugccuuaugaguuuuuauaaaaguuccuuaggaauuuaggugagguagacauuacuugugauuggggcuuggugaagguaguauuugagaugagugagcuuugaaagguaaauauuggaggauauuuguaaugugaacagauuaaugagcuccuugaaggguacaacuuacauuugagaaaacaucgguagaacaauguggcugauauucauaguuuauguaaguuaauaauagauaaagaagacaaauuaugaaagacuucacugaagguguuugaucagaagagguaugugauccacaugaaaggaaaaugagcuguaacuguuagaagauugagacuggaagacugcugggguggcuuuauguuaagcuagauugugaccauuauuuuuguagcccuuaugguuucucugaagugcaucuugaacuuggaccugagaugacaugggugcaggugagaugcuauaaagcacaagugaggaagcagguagaaucagagaaggaggaaaaaagguuaauaguggaaggccaacuggaggcugcuuaagccuuuggagauuuuuguauaacugccucagaguuuuguauaacugccccaaaugaaggggagcugggugguuuuccaucuacagucaauccucacugauaaagauugccuuuaucuaaaaggcucccagaacuucccagguacacugguuagguagggcuuggcaagcuccugaggugcuggagagcugaggagagaaguaguugagaugggaaguugucaguguguuaacugugcauaccagcuacaaguaaacauugaagugagcugaaaggagaugguccagguaucaacucugugucuuaacaggcauucucauugaauaauccagaugugaaauaaaagccucaauuuagauagagaccuagaagaaaugugagaugaaaugugguuaaaaaaaaaaaugccgaauuuagaaacugauagaaagugaggaggggagccaggugcuguggcuugagccuguagucucagucacuugggaggcugaaacaggagauuugcuugagcccagaaguucaaguccaaccugggcaauauagagagccucccauuucaaaaaaaguaaaugaaaaaaguaaggagggaucuaagaugguacugagguuuaaaaguuaguuaacuugugaaaaagaaggguugacagaaggacacugacuuucaaauuaguuuuuuaaggaaagugaaaaaauugcauaguauucaggagagugaugauaagaguguugaugaccagucauucaaaaggaaagcaggguggagacuugaacaaugcugccauccccacaaacuuauaaugucuggcccaugcuggauuauaagcauuuguuaaauuaauuucuaucccccagggcuuaucacaguccugaaauacaguaauguggugaaacuauagggcugaaugugaccuaaaauaagaccauuucccacagguuuuaacuuuuauaaaauccuagaagaggaauuucuuauauauuuuacuuuuuugugaaagggucucacucuugcccagccuggcgugcaguggugcgaucuuggcucacugcaaccuccaccuccugcguucaagcaguucucaccacucagccucuggaguagcugagauuacaggcgcacgccaccauacccagcuaauuuuuguauuuuuugguagaaauggggguuucaccauguuggccaggcuggucucaaacuccugaccucaagugacccucccaccuuggauucccaaagugcugggauuacaggcaugagcugccaugucuggcuggaauuucuuauauuuuuuauggaagcauuacuguguuuagaugaaucaguuuugauuaguuuuaaaaucaauauuauagucugguaaacaauaaaagaauugauaauuuuucuuauggugguucucauuugaauauggugauagcauuuguuuucucauauucuuucuuucuuuuuucuuuuugcucacaagcugaacugaagauuuagguuuuuccauguuucuaugugguuuacaugaauauuuuuaaugacuguuccguaaugccaguauauuaacucuucaucuugcucaaaagugagacuuagagugaaaauuaucaucagcuuauuugagacucuguuagaacucugucauauucauuaauucauuucuauuuccucucucuuccaauauuucucaaaauuauuucaacgagauaaggcuagaauugaccauauuuugccauucauuauuggacagauuuuuaaaaaucuuuauaggaaaugcuaauuaauauuuacaaaucucauuuagaggauguuauuuggaaugaagauugccagauuggagcuauacuuugguauuauuaauagugguaauguuaagaauagauuguagaacacauagguuguagccagagaacucaguuagaagacugcguauuucuuuuaauagccuuaaggcucucauuaauuagacucuuaaggaucaaugagacagauuuucuaguaaaagagaaauaaaaagauuagcacuacauuucuuuuucuguguugugguuuugaaugaaaauuaagaaugauuagguaaguauuauaggacuuugugggaucuucaaauccucacagagguuugaaugauuuuauucucagaauauuuguuuaaagggaaagaaacaguuauuuaaaaugcuugucagcugauuucuuuugugaaaagucucccugagcacuuacuauggauugagaauaaaauaaacuuuucugcuuguuguugcacucuucauugauaacuuccuuccauucaucaguuuuuuuggcuugcuuuuauuggguagcaauuuucuuccaugauaaauauggaaagauaagccauaagcuuauuccuucauuguauuuuugcuaaaguguaauauuucauaugguacugcuggacuaguacucguggaaccauagucuagauugaaacuguugaaagacaaaucaauuuuuuuauaaucauagaaucuuaauucaauucugaguuuuuagugcaaagugcuugcuguccuuugaagcaccucugacaguuacccaaccucuguguaacaauuauggggaacaugcuccuuccaugaaaguucaucuguauuugaaccgaagucuucaccguugauugaauaugcuguucugacuuucucaaguugcacagaaaagaaaggaucccuuuggucaucauguucaauuggaacauguguaucaaguccuggcaucuuuugccuucugcuguuuaaacauccaugcuuucaguucguaaugguugacauuuacugaguacuuacuauaucacccucuucuaaguauuuuauauauacuaauauauaauauguaauuauauauuaacguauuauguguaauuauauaauuaguuuaaaauauuauauauuaaucuucuccaaaacucuagaaaguagauauuuguaauuagaucaguguuuuagaugagggagcuaaggcaaagagaagaaacuuaccacuggucccaaaucuaggagauaguggagccuugcuccagaaacuuuacucuuaguacagugcuaucuuauaagauacaguuuucaaauuauuucuuuuaagguuuucuaugagaggcacucuuauucuguagcuuuuaguauucuucuuaaauaaaauacuguauuccagauauaaucuacuuauuuuaugcgaacauuaagauuggcuauuauuuuuuccccuuuucaccacucuauucaauuaaaaaauuauuauuuuuuuuuuguaaagaugggggguggguaucacucuguugccuaggcuggucuugaacucuuggccucaagcgauccucaugccccugccucccagagugcugggauuacaggugugagccaccauacccagcaagacugguuacucuuuuuauucugaaaccuugaaaccuaguguucuguugauuaauugaguaggaauugcuacuucuucaagggucuagaauccaaauaccugacccccuuuuuuggucucaguuuauaugguugauucuuugaaucccaaugucgaauaucacauccaucauuauuaaauuucguccuguuaauuuuagcuaauuuuuuuuauuuuuuauuuuuugagauggaguuuugcucuugucacccagacuggagugcaguggcaugaucuuggcucacuucgaccuccucuucgcggguuccagcaauucccaugccucagccucccagcuagcuaggacuacagacgcacaccaccacgcccugcuaauuuuuuguguuuuuaguagagacaggguuucaccauguuggcuaggcugguaaugaacuccugaccucaggugauccaccggccucggccucgcaaagugcugggauuacaggugugagccaccacgcccagccaauuuuagcuuauuuuaaaaaauaguuuaauuuuucuuuaaaaacuuauuuuuauaauuuuaaguuuauauuuuacuagccugccuucuguagcuuuauccagguuauuguuaaaaauauugagcaguucugacaccugcuagugaagaccuccugcauucauauuaaucuuauauguaacuauuaaauagcuaccaauccuucugacauaauuuuuuuucucuguaaugugaaucugacuuuuuaugaagagcuuuacuuuuuggaauagacuaggcaauggaauucaggcaguuucucaauauuaaaagcuccuuagguuaccaacuauguccugauguguaauuauuauauuaaggccaggcgcaguggcucacuccuguaaucccagcacuuugggaggccgagguggguggaucacuugaggccagaaguuugagaccagucuggguaacacggugaaacuccgucucuacuaaaaauacaaaaauuuagcuggauguggugacacaugcuuguaaucccagcuacucaagugacugaggcaugagaauugcuugaaccugggagggagaaguugcaagugagccgagauugcgccacugcacuccagccugggcgacagagugaaauucugucucaaaaaaaaaaaaaauuguacuaauaacaugguucccuauacuuuuccuaauauuaaaauuugaauagcugauugauuaucuucuauuaggauaaggggucagaauuucaaccuggaauuuggagauuguacuacgaaaauauucuccccuuaaaaguaauaucuucgggcgcggcgcgguggcucaagccuguaaucccagcacuuugggaggccgaggugggcggaucacgaggucaagagaucgagaccauccuggcuaacacagugaaaccccaucucuacuggaaauacaaaaaauuagcugggugugauggcgggugccuguagucccagcuacucaggaggcugaggcaggagaauggcgugaacccgggagguggagcuugcagugagcugagaucgcgccacugcacucaagccugggcgacagagcaagacuccgucucaaaaaaaaaaagguaauaucuucagaagcaguuuuguuuuguuuuugagacaaggccuagcucugucacucaggcgggagugcaguggugcaaucacagcucacugcaugcaacuucugccuccugggcucaggugauccucccaccucagccuccugaauagcugggacugcaggggcaugccaccaggccuggguaauuuuuguauuuuuuugggguagagacaggguauugccguguugcccaggcuggucuugaacuccuggguucaagcaguccucccgccucagucuccuaaagugcugggauuacaggugcgagccaccaugcccagcccagaagcaguuuugcauuuacuuuaaugcagaugagcaauuuagccaccggagcuguacaucauagagcgugagugcagucguuuucaucuggaaaaauuuucaguugguguugcugccaucauuauuggugagaaaacuuccaguaguccaguuaguguggcagauagaggaaaaagcugccagauacaagauuacaaagauaaggacaaacagauaaaaucuugugcacucuuugugauuuccaacuuguaagucacaagcuucuacaggagucuuaguuuugcaaaaucuacuucuguggauuggacaauagcauuuccauauacaaccauuuucuguuuuuuucuaaugucuaauacucaucuccugugauuaaauuaucagacaagaauggaagcauacaugccuucuuucuuuugguguacaauuugagaagaaauugaaguagcuaagaacucccauugucuuacccuacuauaucugaaugcccuacccucaauaaacauuugucaaauaaaggaauaaaagaaugauuuuauuaccuuaguaaauaaacugaguaaaacuaggcaaagaaaauacuaaggguuuucuauuuugauagcauuguauuauacgggauacuaaauauccuugggacaaauuguuagccuuuguuuacaugcacuaauucuuuuccuuuuucuuucuuucuuucuuucuuucuuucuuucuuucuuucuuucuuucuuucuuucuuucuuuuuuaagucagggucuugcuguguugcacaggcuggagugcaguggugcaaucuuggcucacugcaaccuuugccuccugggcucaagggauucuccugccucaguggaacuacaggugugcaccaccacgcugggcugauuuuucuauuuucuguagagagaugggguuucaccauguugcccaggcuggucuugaacucgucagcucaaaugaucuucccgccuuggccucccaaagugcugggauuacagaccugagcugucaugcguggcugcccagccaauucuuucuuucuuucuuuuuuuggagauggagccuugcucuguugcccaggcuggugugcaguggcgugaucacggcucacugcaaccucugccuccuggguucaagugauucuccugcuucagccucccgaguagcugggauuacaggcacccaccacuaugcacggcuaauuuuuguauuuuuaguaaagaagggguuuugccauguuggccaggcuggucucagacuccugaacucaggugauccaccuacuucggccucccaaaauucuggaauuacagucaucgcaccuggcccugcccagccaauucuuauuaaauuguuuagauaaugcaaaauuaauagcagagcagagagaauguauuuauguuuuauucuuuuuuucaucucagcuaucagcagagagaauuuauuuuaaucuuauuuuuugcuugagauuuuagaaaaaaauauuuaucuuggaaguuucuuuucaauccucugaucccauuucuuuccucugaggcaaaauaguauugccuaaaaagcagugagaagaacaucuacauuucauuggcaaaugcagaauuuuuacuuuagaggaaaauacauagcuuaaauacuuucaguaaacaaagcgcucaguacucaucuuuagggauuaagaaaauaaaaccaggcugggugcagugauucaugccuguaauuccggcacuuugggaggcugaggagaguggaucaccugaggucaggaguuugagaucagccuggccaacauggugaaaucccaucucuacuaauaauacaaaaauuagccagucgugguggcacacgccuguagucccagcuauuugggaggcugagacaagagaaucguacgaaccugggagguggagguugcagugagccaagauuguaccacugcacuccagccugggcagcagagcgagacuccgucuccaaaaaaaaaaacaaacaaaacaaaaaacauaaaaaaauacaaccaaaggcaaguaggauauggauauuaauggaauugaaaacagaucagaacaaaaauaguggagaagauaaauaaaucccaaaucugguucuuugcaaauaccaaugaucuagauaaacaucuuguagaagaaaaagauauggaauaaaaauguacaagauugggaaugaguaaacaccauagaccccaaauacaggagacauuaauggaaucuuuugcagauuuucuugagaauauacauguaaugcuauacugucaaaguuauuucaagagaaaauggauguuguuauagcaaaaugucaaugaguaaaauugacccaagaaguaaaaauguuaauugcccaauccccaugaaagguuugaaaaaaugauggaagauugguucuugacagaggcagcauagcauauaauuucacagcugaguuucauuuaugaagaacaacacaucauuauaauaaaaaggaacucucuuuuccaugaugaagaaugcaaagcuagucaaugcauucugugaagcacacauauuuuaucucugauaaaugcugccaauccugauucaagcacgggggggggggggagggaaggaaugcugccaaaaaagaacagucucacuuaugcccagaaaugcaaaauuucuaaauacaauauuagccauaguucaucaagaccauuucuuuuuuuuuuuuuuugagacggagucucgcugugucgccaggauggagugcagugacgcaaucuuggcucacugcagccucugccucccggguuaaagugauucuccugccucagucuccugaguagcugggacuacaggcgccugccaccaugccuggcuaauuuuuguauuuuuaguagagaugggguuucaccauauugaccaggcuagucuuaaacuccugaucuugugauccacccgccucagccucccaaauugcugggauuacagaugugagcuaccaugcccagcccaucaagaccauuucuaauaaguaaaguaagaauagagggaaguuacagcaaauauccuaaaugucaagagcauuaaaauuagaaacuugauggggacuuggggaugcccaugaucacauuuguauucaguauugucuuaagagguucugguaaaugcauuaaaacaguaaaagugaauaaugguguuaauaucagaaaauaagaacuaaaacuccuccccuugaaauaagaacuaaaacuccuccccuugaaaagaaguaaaacuuuuugaaagguugaaacaaaauaaaaauggaaaacuuauguuuuccauuacagccacaguguagccagggaaaccaugaaaaggauuagugaggaggugugucuuuuguuaccaaaauauuguaucuagccucuguaaucagauuaauaugguauugucauagauugguggaauaaaauagagaauccagaaauccaguauaugugcagauuuaauaaaagauaaagguaguauuacaguucaaugggaaauggggagauuauuuaauaaguggugcugguacaacugucugcccaucuggaagaaaauaaaauuggguuccuaucuuaagauaaauuccagauggaucaaagccuuauagaaauacuuaagguuauucuccagguuuaguuauacaagcuaggguaaaggaaaugugaagauaagaaacucagaagcuauuacaagaggcauauuuaauuuuacaaaaauuaagaccuuuuaaugguaaaggauaccauaagaaaguuaauaacaguauuggcauuaagacagacauauugaccaauggaauagauuaggaauaggcuuggugcaguggcucaugcuuauaaucccagcgcuuugggaguccaagguuaggaggauugcuugaggcuaggaguuugagaccagccuggucaacauagcaagacuuugucuccacaaaagaaaguuaaaaauuagccaggugggguggcucacaccuguaguccuagcugcuuggaaggcugcggcaguggaauuguuugggucuaugaguuggagguugcagugagcuaugaucaugccacugcacuccccugaguaaugaaaguaauggaacaagacaccaucucuuuaaaaaaaaaaaaaaaaaaaaaagcccagaagcccagaaauaaauccuuauguacuauauaugaucaaaugauuuuugacagugaugccaagaccauucaguggggagagggcaaucuuuucagcaugguguuuaccacaauuaaaaagguagguagguaaguuugaaaaaauauuuugcaauauagaggauagaggauuaauuuuaaaagaagagguuauggacccaauaguaaaaagggcaaaagauuuaaagaagcaauuaauaaaagaacaaauccagaaagcuguaacauuuaugaaaagacauucaaacuuacugguugucaggauaacguaaauuaaaguacuagugaaauauuauaacauagcucuuauuauuuugagauaugucccaucaauaccuaguuuauugagaguuuuuagcaugaagggcuguugaauuuuguugaaggccuuuucugcaucuauugagauaaucaugugguuuuugucuuugguucuguuuauaugauggauuauguuuauugauuugcguauguugaaccagccuugcaucccagggaugaagccaacuugaucgugguggauaagcuuuuugauguauugcuggauucgguuugccaguauuuuauugaggauuuuugcaucgauguucaucagggauauuggucuaaaauucucuuuuuuuuguugugucuauaccaggcuuuggugucaggaugaugcuggcuucauaaaaugaguuacggaggauuccuucuuuuuauauugauuggaauaguuucagaaggaaugguaccagcuccucuuuguaccucugguagaauucggcugugaauccgucugguccuggacuuuuuuugguugguaggcuauuauugccucaauuucagagccuguuauuggucuauucagggauucagcuucuuccugguuuagucuugggaggguguauguguccaggaauuuauccauuucgucuagauuuucugguuuauuugcguagagguguuuauaguauucucugaucguagucuguauuucugugggauugguggugauauccccuuuaucauuuuuuauugcaucuguuugauucuucucucuuuucuucuuuauuagucuugcuagcggucuaucaauuuuguugaucuuuucaaaaaaccagcuccuggauucauuaauuuuuugaaggguuuuuugugucucuauuuccuucaguucugcucugaucuuaguuauuucuugccuucugcuagcuucugacuguguuugcucuuucuucucuaguucuuuucauugugauguuagggugucgauuuuagaucuuuccugcuuucuccugugggcauuuagugcuauaaauuucccucuacacacugcuuuaaaugugucccagagauucugguauguugugucuuuguucucauugguuucaaagaacaucuuuauuugugccuucauuucauuauuuacccaguagucauucaggagcagguuguucaguuuccauguaguugugugguuuugagugaguuucuuaauccugaguucuaauuugauugcacuguggucugagagacaguuuguuauaauuucuguucuuuuacauuugcugaggagugcuuuacuuccaacuauguggucaauuuuguuuacaagagcuccugaaggaagcacuaaacauggaaaggaacaaccgguaccagccacugcaaaaacaugccaaauuguaaagaccaucgauguuaggaagaaacugccucaacuaaugagcaaaauaaccagcuaacaucguaaugacaggaucaaauucacacauaacgauauuaaccuuaaagguaagugggcuaaaugccccaauuaaaagacccagacuggcaaauuggauaaaaagucaagacccaucagugugcuguauucaggagucccaucucaugugcagacacacacauaggcucaaaauaaagggauggaggaagaucuaccaagcaaauggaaaacaaaaaagcaggguuugcaauccuagucucugauaaaacaggcuuuaaaccaucaaagaucaaaagagaugaagaaggcaauuacauaaugguaaagggaucaauucaacaagaagagcuaacuauccuaaauauauaugcacccaauacaggagcacccacauucauaaagcaaguccuuagagaccuacaaagagacuuagacucccacacaauaauaaugggagacuuuaacacccacugucaacauuagacagaucaacgagacagaaaguuaacagggauguccaggaauugaacucagcucugcaccaaguggaccuaauagacaucuacagaacuuuccacaccauaucaacagaauauacauucuuagcaccgugucgcacuuauuccaaauuuguuuuuguuuuuggcacaggaucuugcugugucacucagacuggaaugcaguggugugaucacagcacacuguagcugccaucuacugggcucaggugauccucucaccucagccucgugaguaggugggacuauaggcacgugccaccaugccuggaugauuuuuuaaauuuuuaguagagacgaggucucgcuauguugcucaggcuggucucuaacuccugagcucaaggaauccuccugccuuggccucccgaagugcugggauuauaggcauuagcuacuguacccagccuguuggcuauuuuuuaagauuuucuuuuuauuacuaguuuuaaguaauuuguuuuugauguacaugguguaguuuguguguuuugugcugaguuuaaauugcuuguggaucuguagggcucuaguuuucaucaaauuugaacauuuuccccuauaucacugauguucugauuuaauuuuuaagauuaagauuuagucuaucuuuguucugucaucugugcuauuucuugguuucuucuuuuucucuucacugugggucagaauuuccuucuuagaaugccugucauuuuuuauuagaugccaguuauugugauuuuuaccuugauggguacugaauuuuuucauuccuuuaaauguccuuaagcuuuguuccgaacacaauuccuuuggaacaguuugauccuucuaagacuucuuuuugaacuuuuuuuuuuuuuuuugagacagagucuugcucuguccucagguuggauugcaguggcgcgaucucagcucacugcaaccucugccuccuggguucaagcaauucuccugucucagccuccugaguagcugggacuauaggugcacaccaccacgcccagcuaauguuuguauucuuaguagagaugggguucccuuggccaggauguucucgaucuccugaccucgugauccguccaccuuggccucccaaaguguugggauuacaggggugagccacugcgcccagcccuuuuugaacuuuuuaaagacagaaccaaaguaaccuuuagauuaaggauaauuucuuccgauuauugaggcaaugccauucugagugcauuauuuccucuauuauggugucuuucaacuguggcugaugagaauaccaacaacccuuaaaggcuuugagaauuguuuuaccuaauccuuucccgugguuuuuuucucuggcuugggguagucuaaucacauggcgugcaccuguaguuguagcuacaugggaggcugagacaggaggacgguuugagaccaggagguugaggcugcagugaguuguguuugccccauuguacuccagugugagugacagaaugaggcccugucucaaaagaaaaaagaaauguuugcacuauuaacccuagagugguuccuggugaauuuuguguguugcagcguaauagugaauugauuauuugauuugauuuuguucaacuuuucuuaaaaaaauguauuuacacaaaccugcacauugugcacauguacccuagaacuuaaaguauaauaaaaaaaauguauuuacuaauguguuaauauuucagcaaauuuauugcaauggguuuaaaaggcagacagaggccaggcgcaguggcucacaccuguaaucccaggacuuugggagacugaggcggguggaucaccugaggucgggaguucgagaucagccugaccaacauggagaaaccccaucucuacuaaaaauacaaaaaaaguggucgggugugguggcgcaugccuguaaucccagcuacucgggaggcugaggcaggagaaucacuugaaccugggaggugaaguuugcggugagcugagaucacgccauugcacuccagccugggcagcaagagugaaacucugucucaaaaauaaauaaauaaauaaauaaauaaauaaauaaauaaauaauaaaaggcagacagacacucuuauauaagcuacaggguaacaaagggguucuauauaguuauaaacuauuacauagaccugcaugguuuauugaauaacuuauaaaccacaaaggaaauuaaauuuacaguguuucugaaguucaaacuuuuaaacuguuucauucuauccuagcaaguucuaaacuuuuuuugggaaaguguucucaaaccucaaaguugaauuaagagcaugaaaagcccuguuauuaaaaagguacaaccaaaagaucuaggaauaccaaauuagacuugagaccuuuggaaaucacucgcuuuacuugaaccaaacacuguggaucaguaaaguuugcaucucuuagccuuaugugcaaaugaagcuaauaauggugccuauuucagggguuguaaagaucaugaaaaugggguucucaaaccuggagagauuuugucccccagaggguauaauuuaaaacagucuagagacacuggucaucagaguucagagugguggcagggauggucugucugucucuuguggauagaagugggaauguugccaaauaaccugcagugcacaggacaaucccucacagcgaagaauuaucuggcccuaagugucaauagugccgggaucgagaaacccugauauaaagugcuuauccugguauaaggccaggauaccagaugauuuaauuuaugccaucaguaggggguccuauuaguagaaaaaugaagcuuucuacuugaaguuuuuuuuuuucaacuccuaguccagccuaaggauuaauuuuuuuuuuaaaaggauaaaagugcuucacaguugaauaacuugaauauuccccccuuuuauuuaucuauaaaaagugaaaugagaggggaaaagcagcaaaagucauggagaaacaaacuuacauuuguuuauagaugucaauuuuaauaaaauguuuauguaguagagaaauuuccaguguucagauuaacuucaauucugaaaacucaucuauguuugagaauacacucuuuuuacagggcaaacuuauaucauucuuauguuaucuuuuaaucauuuuuaauauguuaacauuuuaauuuuuuuauuuuuuggaaucuuugcaggcauuguaagcauuuauuaauuuuuuuguguguguuacuuuucuuauagguguuaccucauuuugaaagucuugggaaacaggaaaaaauuccuaacaaaaugucagcuuuucgaaaucauuguccacauuuggauucaguuggugaaauaacaaaagaagauuugauacaaaaaucccuuguaagaaacagguuuuuucuuccuugaaaaacuauucacuuuucucuugaauguguaauuuucauaaauuacuguaauacucuaugagcaguauuuuaaaaauauguaugaugucauuagugcauuagugaauuguauguguuugugucaauauaaccaauguugucuuuuuaauuucuuuuuauaggguacuugucaggauuguaaaguccaaggaccaaaucuuugggcaugucuggagguguguauauguuuuuuccugaaaagauugcuauaauaauaauaaauuuggaucugaauaaucauaaccagaaaauuuuugauacuuaaagugauuuuuguaaauuaaacuugcuuuuaaaaggucauuauuaauaacaaaaauuaaacuuuggaaagaucuuaaucuguagugcuuuuguaguuuuuaguaaaucacucagcuauuuuaugcuugccuuuuauuagaaaugacauagcuuuuagcuuagaaauauauccugguuuuauuuugugccuggaaacauuugguuaaauuuaaugacuggaaagucauuuacucauugaauguaaaacagguaauccaaacuuaauuguaaauguaauuguaaugcuguuauaaauuuacauguauauuauaaaguaccuuauuuuucuuccuauauaauuauuuauagaauagauguucauauguuggcuguggugaaucacaaguagaucacagcaccauacauucucagguauguauauaaaaaauuuaauggaagacuuguuaaaaaaagugccugaaggaaagggaaagccaguauaacauuauuaauucaaguuguaauucaaauuugcacucuaaguuaaaacuucacuuacauucucugugaaggauggggaagggaauugcuaggaggaugaacauuagaaugagguugugauuaagaaagcacugauuucaaaaguguacauccggccaggcaugguggcucacgccugaaucccagcacuuuggaaggccaaggcagguggaucaccugaggucaggaguucgagaccagccuggccaacauggcgaaacccugucucuauuaaaaguacaaaaaaauuagcugggugugguggugggcaccuguaaucccagcuacucgggaggcugaggcaggagaauuguuugaaccugggaggcggagguugcagugagccgagaucgugccauugcacuccagccugggcaacaagagcgaaacuccaucucaaaaaaaaaaaaaaaaguguauauccagauauuugaaggugauagcuggcauauuaggagguugaagcccaagagagagugggugcuuagguuuaugacauggccuggcuaacuucuuuaagucucagcucaugucauauugccuuuuccugcacauaguccuaacuggacucaccuuucugcuuugcucugguuguuugguacuucccauguaacucuggcaugccucuucuauaguguuauguagagcucccauucuaaauggaaaguuucucgaaugacuuuguuuuaagaugcacauugauaccucuacagcaucaacuguucucaaccaggauuccucuauagaauuaauuaagccugaauacccaagcucugagucaucauuguauaucauuugccucuuucugugcaucuaagaugguauuugcuguguaccaccauugggagaauugauaaauuagucacucagaucauuuuuuguagggcuuaauucuguagcagaacucugguugugaaaggcuagacuuuuaucuuuccaagauuauauauucuguauugcuagagcuguuuuaugccuugacucaugucauuuguguucuuuugccauucugauuucuuagaauaguuacuugcuauuguuaauuauuuucuuguguuauauuuauuuguagacugcaaagcaaggucuuacacucuugcguuuaucuuuuuguauaaugaauagugaggggagaauggcagaguaauuucuagaguaggcuuagauguuguuacuguuuauuauaccuuagaaguuuaucuaaagaauuuuuuucauguucuaaauuagcuuuugaguauauuguuacucaucaaaggcaagcaguuuaucuucuguuaucuuuugaagaagucuuuucaaguauauguaauuuugguuccucuuuucccucuacugugaaauuauauaggagacaaagcauuaucuaacugugaaccuuaccacucuucgaguaugguguuaugcuugcagcaaagaaguauuuuuggauaggaaauuaggaacucagccuucauugccucauguaagacaaccucaccaaauacaagaaaacaguguccagguaauaaucuagauccacuuaguuaagcuguaaaacauuccgguaauaauuucagaauuugucauguagcugaaauuuucaaaaggaauacugccuaaccuguacuuugaaaauuucuguaaugugccuuuuuucucucaaauaaagcacucagacuccccuuucuuguguugcuuagagugcuagauuagggugagauugaagcccaccuguuugaagauggaaaaggcccuaaugaauuuuugaaguuuuuuuuuuuaaaugacucaaguagucuuuaucuuuuucugguaagucugauuucaagaaagguggugggccuucuuugauagcauauggcaguuacuaauucagcucucuuccccguucucuccuccccuccauccccuuuguauuacugugaacauuuuacuuauuauugacaacaaaguagaauauaauaaagcuuagcaucagucuuuggguuaaagauuuuucucccuuugggcugggugcgguggcucacgccuguaaucccagugcuuugggaggccaaggcggcuggaucacgaggucaggagaucgagaccauccuggcuaacauggugacaccccgucucuacuaaaaauacaaaacauuagccgggugugguggcgggcaccuguauucccagcuacuuuggaggcugaggcaggagaauggcgugaaccugggaggcagagcuggcagugagccgagaccuugccacugcacuccagccuaggugacagagugagacuccaucuaaaaaaaaaaaagaaaaaaagauuuuucuccuuuuggaucaagagacuuagaaaacacauggguuugcuugcagaauuuaucacuuaauuuucagaauucuuaaagucauagaaaaauaggaaaaaggaaauuaacuuagaauaguuggcuucuuaaucagaucaucaguugaucagaauuugaucagauuugauuaacagcaaguuuuuuuccucauguguguuauagaaaucacauauuucuguacuuguucauugauaccaacugucagguuuuucuguuguauguuuguaucacauucuuaugguagauauuugugauaauaaauuugcuugccuuacacaugaaagauggcuagauuuuagucaaagaauaauuucuugcauuuucaguuucucaguugaauggcucuaguuaauuauaaccauuacuguuucucccacuuauaccuauuuaucauucacaaacauguuuagucuuuuucaaaaguccagauaguaugaaaauggccguuucguugaauccucuuacauuauuaacaaaaguuugucccacugaagauagcugaaugguaauaaguagaaaaaguuuuaaaaaagaaaaaaguguaauguuaugacuaaaguuuaaucacacaaggaacuaauaauauauaaaggcaaaacuaucagcaucacuuacuagagaaguaaguuaaauaagcuaucuguugccauuucugccagaaaagaucaagauuacaaacuuuaauaaauguugaaucugauagaauaaguauacugauacuuuccugauggcuuguuaauaauuuucugaugacuuguaaauauguuaacacauaaaaggcauaaacuuaauuucauucaacuuccuuaugaucccauuguugaagaaauuauucagaagaaaacagugguucagauagauuucuuuagugguccaaaacuuauaugcuguugaaauccaguuuaccacaggauauuugcaaaauaguaaaauauuggaggccaugcaaauauuaauaagauuuuucaaauagacauuuuuucuagauaguaaaauuucaggugauuuaagccucuguacuucuguguauuuagauauuuuguagugagcauguaucuuuuuaaaagcaauuacuuuaugaaaacaaaaugaaaguaugaaguccacucaaauguccagucucuacagaugucaggaaaguaaaaucguugggaauuagugcauaugccugcauuuuagagguaaaguaaggcuauaauaacuuggagaaccagaguacaugcuaaauucuuucugcuauucaguuuccuucucuguuuggguguugcugaauguugguucauuguaguucaaucuucugauauuacaagagaacuuucaaauuuugauuuuuauuugucgucuccgaauuuuuuaaacuuuagcucaaaguuuuuuucguuuuuuuuuuuaaaguguuuacuagcauuuggcuaacagguuaucaguugcaaccucugagucaagccaauuguuggaaauuaauauuagaauauuauuauuuaaaguaagugcuugaacuauuuaauauacguaaaagugugcaggccggguguggugucucacaccuguaaucccagcauuuugggaggccgaggugggcggaucaugaggucaagagaucaagaccauucaggccaacauggugaaaccccuucucuacuaaaaauacaaaaauuagcugggcguuguggcaugcaccuauagucccagcugcuugggagucugaggcaggagaagcguuugaacccaggagguggagguugcagugagcugagaucgugccacugcacuccagccuggcaacagagugagacucuguuucggaaaaaaaaaagugugcaaaguaaauacaguaauaaguaucaggagagauuguagaagucuauagauaauguguuaugaugaaaaacuuuugccuuuuucccuguugaaaaugagaucugagaagacaguguaggauaguauccuucggagaucuuuuuagcuaugguuuacugucacauaauugcaguuauuguggaguuuuaauucagaaaauucgguuguaaaaagugccuuuuuaacucaaauauauauguuaauaaagcgggacugacaugcuauuacccuaggguuuuauuuccuucaaaauauaaauguaaguuuaauugcuaauaccacaaauucuuaugguuccacuauuaaaauaacaucucaauaauuuuuaugguauagauguuauauaaguuacaauuaaaacuuuuuuuaaauuuaaggauuuguucaagugugcuaucuuuuuuuguuaucaaggauuuuaaaauacccaguaauacaacauuaaaaacuccucugguugccguauuugaugaucuggauauagaagcggaugaagaagaugaacuuagggccagagguaaauuaauccuguguaacgcuucuuuguauggcacugcccauuucuuuagaaaaccauauaauguaaaaguuucaaaauguggagguaaaaugggcuugauaauuaaaacaaaaggacucugaaauuuggccuaguaaaauuuuauuugcaaaacaaacuuuugguuucucuggugucaguuuaccaaagguaggauccuacuuacucuuuugcaguugagccuuaugaucuuuuuguuuaacuugccuuuugaggucuguuugaacaguguuucucauuuuucuauugucagugauggggagguauuagguauaaagguauucccuuagcagaaguuccggggaaaacauuuggaaaaagaaucaggugauacacuucucccuucuuccccuaaauugagaaccggucuauuuggauuuuucauauucuuuuaggcccacuguucuuaguauaagcuuaaaauuuucuguuuuauaauugauacuagugguacauugaauguauauuuagauaauuaucuggaaauuaacacuuugguuuaagcuuaacaugacuagagauaaguuauaaauauuuuauguauuucccaguuuuaacccauuaauuuagcucacacuauuaauuuuacuggauacuuaucaauaagugguaauucagucuuguuuuagagauuuuuagaauuuuaaauuuucuucauuuugcuccaaauccaaauagcauuuauaauuuuuuguaguauuuauuucaucuuuuaauaaugaaaguaaacugaugaaagugaacuugacuauauauggaagagauaacagucauucaauggcucguuuuaauauuagcuugaaccauaugaaauugccauuuuuguagauugucagcaguuuccuaugguucaaccuaauaaauacuacuuucuuuuuuucuuuuuuuuuugagauggagucucgcucuguugcccaggcuggagugcaguggugcaaucucggcucacugcaagcuccgccuccuggguucacaccauucuccugcuucagccucccgaguagcugggacuacaggcacccgccaccaugcccggcaaauuuuuuguauuuuuaguagagaugggguuucgccauguuagccaggauggucucgaucuccugaccucgugauccacccaccucagccucccaaagugcugggauuacaggcgugagccacugcgcccggcauaaauacuacuuucagugcaauacguugaaauggaaaggaaaaggguguuugcuuaucauuuaucaugacgaguuuuuuugcauugucauuaauuuucucaaaauaauuaaacuuuaguuauaauaagaaauguaaaagucucaauuaaugcuuuuuaaaaacacguagucuuaaauguuaauaggaaagacuguucuuccugugcaaauuucaaaguuugaacuguuuaauccuugaauuuauguaaaacucaaaauuuuggugauuguaaggcuucccaaagugugaccucucugaauuguucaaguugcuauauuguauuuccgugguccuuaauguaauuugggaaccauauuaaugaccccuaaaauugagucauuuugcauuauugaaugaugacuucauguauauuuuuucuuaauaggucuuacagguuugaaaaauauuggaaauacuuguuacaugaaugcagcuuugcaggcucuuucuaauugguaaauagagaaauuaauuuuguuuuauuuguauaauuuuuuaaguuauuuuuugagcagaaaaccuugcaacuauaguaguugacuaacucaagguagaacaggcaagaaucugguuugggacauaacccauucuugucccaacgauguuacucuauguauacccguaguuucuugaggcugcugguccuuguguaaacccuggguaguugugugucuuugagcaaguuauuguuucuuacaucuagaaaaugagugucagcuaauuauucagaucacuuuuaauucagagaucuuaugaaaauauuuuauauuuuucuguagauggaaagccuuuaauaaaggaguuagauuuuuuuuuuaaucguagucuuacaaaauagauaugucaggugguuuuacucaaguuuggaugcauugagucaggugauauuacccuugaaauuagaugcauugagucuggaccaaaauucagaaaucaaugacuuugacauuacccuuucccuuggauuaaauuauagagcagugauuggagauugaacguaugucuacagguugaguaucccucauaugaaaugcugggaaucagaaguguuucagauuuuuuuggauuuuggaguauuuauuugcauuaugcuuacugguugagcuuuccuuauccaaaaauccaauauuugaaaugcuccaaugagcauuuccuuuggauaucguguuggcauucaaaaaguuuuggauuuuggagcauuuugaauuuuguauuuuguauuagggauauuaaagcuguacuucuuccccaaauaaucuaauuuuuauuuagacauaacccuccauaaauauuuugccuucaguuuucuuauguuucauaaccuugugaaauaaagauaaccuaauuuuuauuaagugaucagagaacacaucuuugaagaagagacuuuuuuuuucuuuuuuuuuuuuuaggcugggucucacucuguugcccagguuagagugcaguggcacgauuuuggcucacugcagcucugccucccggguuugugugauccuccugcuucagccuccugaguagcugagacuacaggcacaugccaccaaaccugacuaauuuuuaaauuuuuuguagagaugggguuucaccuuguugccuaggcugguuuucaacuccuggguucaagugauucgcaugccucagccucccaaagugcugggauuauaggcaugggccacugugcucggacguuaaagaagagacauuuaggccaggcguggugguucaugccuguaaucccagcacuuugggaggcugaggcggguggaucaugaggucaggaguucgagaccagccuggccaacauagugaaacccugucucuacuaaaaauacaaaaaauuagccgggugugguggugugugccuguaaucccagcuacucgagaggcugaggcaggagaauuguguaaacccuggagguggagguugcaaugagccuaggucaugccauugcacucuagcccaggugacagugugagacuccgucaaaaaaaaaaaaaaaaaaaaaaaagaagagacauuuacucugaaacuugaggaaugaguaucgguugguuguuugaaaggauggggagagcauuccuagcagaaugcuccuuguaagcagccuugggaugggaaagagcuugacacauuugaggaacuggaagaaaaucugugugacgggguacaguaaucauagggcugaaugacaugggucuagguuauguagaccacauuaaagauguaggucuuuauucucauaguaguacgauaccauugaaguguuuguguaguaggguagcuaauaaucucucuuauauuuuuaaaauauuacugugguugcuauguggacagugaauuggagggggaagagaguggaauuugaaagaccagcuaggagacuaugauaaugauuuaggcaagaaguagugguaguuuacaucaucuagggugguaggaaaagagugaaggaauuggagauaaacacuuuuaggaggaugauugauugauaggauguggguagaguaacuagagaaagggagaggagauucaaaguuuaacaguacaaaccugugauaagagaacuguagguugauacuauuguuauuuuuauacagauaagaaaaccagacacagaaguuuaaauaacuuugccgauauaaccagcuaguaaguacuagcagaauucugguuuuuuuuuuuuuuuuuaaguuagagacagggucuuacucugucacccaggcuggaguguaguggagcgaucauggcucacugaagccuugaacuccuggguucaaggguucuuccugccucagccugccaaguagcuacgaccacaggugcaugccagugcucccagauaauguuuuaaaauuuuuguagagauggguuuucgcuauguugcccaggcuggucuugaacuccuguccuugagucauguccugccuuggccucccaaaguauuggaauuacaggcaugaccaaccaugccuggcagggacaaaauucugagucugagauuuuuacguguauguuuguuuuuguagauguuuuguuuauuacugcacaauacugcuuccaccgauuuacuuuguaauuccucugauuucauugaaaaagauguggcugauacgauuacacuauugguggcugggugugguggcucaugccuguagcacuuugggaggcuaaggugggaggauugcuugaggagccuaggaguucuggaaccagcaugggcaacauaacaagacccugucucuaccaaaaaaaaaaaaaagauuacacuuggcaaagagaugacuuaguaguuaucuaacugccuucauaggagguuugguuuauguaggucaggauuugguccuuugccuaaucaguuuccuauaaauagauuuauggagauucccucaagcuaaucaaacucacgacagacagacuauacuuccuuauaaauugcuaacuugagccaccaacaaauauuaauaccaaaugauggaauguagaaggcuggaggaagugcagguucacuugaaaguuaaauuuuuauccuguuuaguuugggcauuucauauaaaucugaaauuuagaugacaugguugacuuuauauaaauuugaccaucauuggaauaugguugaaaauuuuagaucgcccaggggaaaaaaguauauagggaaaugucauaggaucaagucccgaggaauccuuacguuuacaugucugaggccaaaaagagcaauagagagggaaaaggaguuucaagagcuaaagaggaaaaguaggaaaaugcauuacaauaguccugagaauguuuguucaagagugagggcauaguugucuguggcaaauguuacugaguggggacugaaaaguguaucuggcagcauggaggacucuugauaugcuggggccaaaucugauuugaauggauugagcucuuuaugaaggaaugaaagugaagcuguaagagggaucaaagaaagaaauaacggcuaaaggaauguauguguugucaguuaauugaaugacuagaaauaaucaguauuagcuuugacuccacucuaacauuuuucucuuuuuaaaauuagcccaccuuugacacaguuuuuucuugauuguggaggacuagcucgaacagauaagaaaccugccauuuguaaaaguuaucucaaacuaaugacagagcuguggcauaaaagcagguauguaacuuaauauacucuucuucuuuauuaaacuuuuaaaugaauauuauaaauauuuaaagguugcagguccauuuauggagccggaaaaaaguagaagagagauagauuagagacagcuuuguuucaggcauguuacauuugaagcugaauguaaggugucauagaaguuuagaagcagaugaaggugucauagaagucuacaaguauuuggauauaguauauaguguuggaauguuaaagcugcuauuacuggaacuuuagaguuuugcauucaggagcagccauucucacaaugauaaaaucagacccuaaauacuauaugaauauuuuccugcuuauguuuauuuguucuaaaguuuagcauuaggaucauaguuugcuguaauauguuaauaauuuuguuuuagaacuauucaggaaacuugcauuuuugaaaagucauggggugaagcauaaucauuuaauugagggaggauagcaguaaaauaucacuuaaaauaucaaggauaagguguucugaugugccugugaaacauaauauuaggcaguuuugaaugauuuuuuugaaacauacuuuucaauuuauuuaacacuuugaauuauugguaguuaauuuuuaaaaugaaaauuaaaaauaacaaaaauugcucuuuaaaaauguuuucuugcucaggccaggaucuguugugccuacuacucuguuucaaggaauuaaaacuguaaauccaacauuucggggguauucucagcagguuaguuuauugcuuuucauuuguaauuuuaaucuaaauaaauuuggaaaaugccauuauguuuuuuuugggucuacuuaucuuuuggggucaucacuccuugugucuuucuuuugccaagaauaguaacccuuuuucauguuuauuguuuauauuuuuucaacuuuccuuuaucuuuaucuuuuuuuugaggcagagucuugcucuaucgcccaggcuggagugcaguggugcaaucuuggcucacugcaaccuccaccucccgaauucaagcgauucuccugccucagccuucugaguaacugggauugcagaugugugccaccacgcccagcuaauuuuuguguuuucaguagagauaggguuucgucauguuggccaagccagacuugaacuccugaccucagguaauccacccuccucggccucccacaguguuggauuacaggcaugaggcacuguacucagccuuuuuuuuuuuuuuuuuuuuaagagagauaaugucucauuauguugcccuggcuggucuugaacuccugacucaaacgauccucccuccuugaucucccgaaguguuaggauuacaagcauaagccccugcauccagcggaaguugaucuucagaucaucuuuaguuuuuuaaaauuuuuaucuggcugggcgugauggcucaugccuguaaucccagcacuucagaaggccgagguaggcggauugcuuaagcccaggagcuugagaccagccuggguaacauagggagaccucauuucuaaaaauaauuuagaaauauguaucaaccaggugugguggcacgugcaucuggucccagcuacuuaggagacugaggugggagaauugcuugagccugggggaucgaggcuacagugagcuguggucaugccacaacacuccagcuuggacaacagaaugagaccccaucucaaaaaaagaaaacuuuuauuuacauaacuuuuuggaaguuaaugcaucucauuuaucuagugccuuaugcucuccaaacugguauuugcucaauauagugcuguaccuucauauauaaguuuguaaugacauuuuguauauuuucccuuacguuucuauauacacauguaaugaagugguuaacauuauguugcugauauauuaggaugcucaagaauuccuucgauguuuaauggauuugcuucaugaagaauugaaagagcaagucauggaaguagaagaagauccgcaaaccauaaccacugaggagacaauggaagaagacaagagccagucggauguagauuuucagucuugugaaucuuguagcaacagugauagagcagaaaaugaaaauggcucuagaugcuuuucugaagauaauaaugaaacaacaauguuaauucaggaugaugaaaacaauucagaaaugucaaaggauuggcaaaaagagaagaugugcaauaagauuaauaaaguaaauucugaaggcgaauuugauaaagauagagacucuauaucugaaacagucgacuuaaacaaccaggaaacugucaaagugcaaauacacagcagagcuucaggugacaauuuaguaguuuguucaugaaaaugauaguauuucauuuguagacauggguguuuaaauaauuguuacuuuggguauuucuaauuagaauuauaguuuagcaguauuugcaugugaguauuagucauaaaauuauagaacccgaggauaaaaggaauuuuuugggucauuuaauuauauaagaaauuaauccuccuuuugaaguaaacauuucaucagaugucuuuuguguagucaugcaguaaucuaaaaaauugggcuccccagaauuuucucuuuuauuuuaagcaaauuauguugcgauccuggaaaaaagcaaauaacccaaauugcaauuuucuaauuauauacacuaguagauuuagauuguugucauuggagucacaucagauguguuuuaguguagaaguugaauuaacuauagugagcccugcugugauagauuaugccaugauacuagucaguguuccuuugagaaagagcauguggccaaaugaaaguugaauugcuuuguaauuuaucucuucaagaguuaacuuaucuuggcuuaaaaugugguauguaguuuuccaaagcacacaaaauugggccauuagagguucaaauuaugugaucuuaaaauaaguggcagacauguaauguaaaaaaguuuauuuucuguaauuacugaagagugagaguaacuaagcaauuuauuuagguauuugaaugaauccaaaauuucuucuugaaaauauuauuaacuauaggaagacuugugguucacuuggguaaagugcacagaugcuuucuaaucgggaagacuaggaguguuaggcuccuuaauuauacugaucuuguguagaaguuguuagugaauaaauaugucagguaucaguauugaaagacuuagcuuugacugcuguccaggcuuuucuugucaaaagcccaguuaagccugauuagggacauacucaucuuugauugcucuguaacagguuuguucuuacacauaguaacaaggggaugaccuaaaucaggagucugagcuuuuagguguuuuaagggcuugaugaaaaaaaucuggcgaagucuguaaggcacacaaaccuaaaacacuucaucucugguccguuagaggaaaaaauugccaacuccccaucuaaaucucauuaacuuuauucccuucagaaaguccuagagugaguuguuuuuucacucccaauauuaugcagucugauuuagucaugauugaaauauugagaaaugccugugugaaaaaugauuuugcauuaucuggaaaaauuucugaguacauccccuuuccagaucucuuacgaacaauucucuuuucuucacucaaauaguuacugagcacauucccuugcccuggaauauguuaggcacuaggaauccaaagcaaacaaucaagguagcucuuauauuuucuugauucaucuuauaauuuaauucuaaaaaaagauucuuuccugaugaagugguguauuuuuuauuauaguaagauaaaauaacuuaugauuacuuuauaccuacauuucuugauuuugauuauuauguuaguuugggagaauaaucgauuuuucuuucacaugguuuuagaacuucuaaaaaccuguccugaauaucuuuuuuuuuuuuuuuccugaaacagggucucauucugucacccaggcuggagugcaguggcaugaucacaucucaccacagccucaaccuccugggcucaagugauccucccaccucagccucuugaguagccagcacuacagguguacaccaccaugcccagcuaauuuuuagauuuuuuuguagagaugggggucucaugauguugcgcaguuggucuugaacuccugggcucaagcagucuucccaccuuggccucccaguguugggauuguaggcguuagccacccagccuagccucuuuuuuuuuuuuuaaugcuauauuuggacaaacaagauccucuuuggcuuuguauuuccacugcucacuuccuaaacugccuguaauagucguguguuauaaacauuaguugggauugggcacggugguucaugccuauaaucccaacacuuugggaggccaaaguggguggaucacuugaggccaggacuuugagaccagccuggccaaaauggugaaaccccaucucuacuaaaaauacaaaaaugaggugggccugguggcacaugccuguaaucucagcuacuugggaggcugaggcagaagaaucgcuugaauccaggaugcggagguugcagugagcugagaucgcaccucugcacugcagccugggggacagagggagacucugucucaaaaaaacaaguaaacaaaaauuaguuggauuucuggguagaagauuacuguuauuuugcuuaguaagcacuuuguuaaguauuuaacuugacauuuguuaauaugauuguguucaaaauaucaaauuaagaaaccuuuaacauuauuggacaguuagaauaauuuuacuauuuaagguaauaaugcaaauuuuaaaucuuacagaauauaucacugauguccauucgaaugaccugucuacaccacagauccuuccaucaaaugaagguguuaauccacguuuaucggcaagcccuccuaaaucaggcaauuuguggccaggauuggcaccaccacacaaaaaagguaaaacguuucucuuauucagucucuuuugcuuugggucuuaguuuaaaaugaugguuuugguacuugauaauuuaaaguguuaauuaugaaauaugauuugaucuuuuaaaauugauagcauaauuuuacauagacaugauuaaaaauuuuguguguugguacucugcuuuuaaaauuuuacauacaguugaauucacuuuuucuuguauagagcuuuaugaauuuuaacacuugcagcauagauucuuguuaccaccaccacaaacagaauacagaacagcucuaacaccccaaagaauuccugcauaguacuacuuuguaaucagaucauuucucuauuccuauguucuggcacccuugauccucuuuucuuauuguuuugccuuuuccuagaaugucauauaaaugaaaucauauaguauguagucuuuugauuuuuuuaaaucuuuucauauguagucuuuugaaacagguuugccucucaggauaaugcauuugaaauucagauauguuacugcgugucugaauaguuuguuccuuuuacuaccaaguaauguuucuuuuuuuuuguuuuguuuugagauggagucucacugucgcccaggcuggaguacaguggugcaaucuuggcccacugcaaccucugccugccagguucaagcaguucuccugccucagccucccgaguagcugggacuacaggugcacgccaccaugccuggcuaauuuuuuguauuuuuaguagagaugggccaugcuggucucgaacuccugaccuugugaucuccccaccucugccucccaaaguguuagaauuacaggcaugagccaccaugcccggccuaauaucucauuuuuuauggguauaccacuguuuauuuaccuacugguggacuuuugaauuguuuccaauuuuuggcaauuaugaauaauguugcucuaaaauuuauguauagguuuuuguaagaacauuuuuucauuugucuaggacaaauaccuagaagugggguuacuggguuuuauguuuguuuaaugcuuauaguuguauuaaacugccagacuuuuuaccagagugucuaccauuuaguauuccuuccagguauauaugggaguuccaguauuauguuuucuuagaagaaaacauaggagaaagucuucauggccuuggguuagacaaagaguucuuaaagacauuaaaagcaugauccauuaaagaaaaaaauuaaagauuuuuguugacaaaggacauucagagaauggaaagauaagguuggauguauuuauaaaucauauagcuagcaaaggacauguauccagaaauauauaaagaacucuuaaaaacuuuaaauaauagaaucuuuucuucaaauaaagccuuaccuggagacaaaaacaaauaagugaaaacagaauugcucucaagucaggauagggagaccgaaccccuucuauuucaucuuuagcuugaugaugacuuucaucaucuuucccucacuuucuaaccucuuccccucuucuuuugacuuguaaaacauuuaaguaaacaucccagugaugaagcauuugugguuuugugcuaauuuagaauuuuguucauuuucucauauguacauuuaugguggccaaggaucauuuauacuuuaaaaaaaaaaacaggcugggugcgguggcucacgccuguaaucucaguacuuugggaggcugaaguggguggaucaugaggucaggagaucgagacuauccuggcuaacauggugaaacccugucucuacuaaaaauacaaaaaaauagcugggcgugguggugggcgccuguagucccagcuacuugggaggcuaagguaggagaauggcaugaacccgggaggcagaacuuggcagugagccgagaucgcaccacugcacuccagugugggcaacagugcgagacuccaccucaaaacaaaaaaacaaaaaaaaacaacaaauaucuuaagccuugucugcuuaguuucuuuuauuuuuuuaauacuuaugcucuuuugaagaguauuuugaaaauuuucaacacaguaauuuuuacaguuuaaggauucuagagaucauauacaaguaagauugacaagacaaaaaaagauuccagagaaaaauguuaaaggagcugcuuugauuuuuuuuuaauguuuuucaauccuagcucagucugcaucuccaaagagaaaaaaacagcacaagaaauacagaaguguuauuucagacauauuugauggaacaaucauuaguucagugcagugucugacuugugacagggugaguaugaggguauuagaauacacagaaaauucgugucaaaugauuuuuaaaaaugugacaagaugaugugaaaaguuuaauuccuucucuuugcuauugaugagcauacaugcauuuauuguguuuacaucaacacaaauuugauucuagguguagaauuuuuuuuggaaguagcagcauccuguuuaaaggauggugacccaucauuggacaggcacauauuauccuucgucaucuauuuugguuacauauaaaggugagaaguugcucagcaacaagaauugguaacaccugcauauucucccaggcugaugaaauuuguauacugggaaucuguugauauucacagguacaaagcugugaauguaucucuuacauuuggucauauaugguuuguaaauauuuuuccauguuuaggaugggacucagauacuaaagguaguaucaaauucauagacaauaacaaagcauacauuaaaaucaucaugaauuuuuuaauaacacuucuucaaaguuucuuugagcuuuucuuaaguacaguuuuacuuuagugcaaugaugaauaugaaauaacaucucaaaaacaaaaagaagauuucaauuauuguguuagaaucucaagucaaaucuaagaacuuucaaucgggucguuuuaauguagguuauuuugguacuaaauauuuaaguggaauuaucaggcauguuuuuagcuauuuaaaauuagaugccagauuuugucucacccuuuuaaaaaaauauuuuaaaacuaccaucaaaggucaauuuucaaaaauaaauacaauagugcuuaagaguuuggaccucaagaugcaguggcuggauuugggguguuuaaugcugcagugucugugauuguaauggggaugcuaauacuacugcacaggacuuacgugaagauaccugguacagagcaaguguguuuuguuuuuuguuuuuguuuuuuuuuuugcuauuaugacuaugaaagcaguucaauuugcguguuuuuuuuuguuuuuuguuuuuuuugcuuauuuaaacaugcuuugaucuuuagagucuaaaaucuaaccuuggaaauguuuuacugcauuauguucaucccauuuuuaaaacacaaaacaauuuuaggugucuguaacccucgagaccuuucaagaucuguccuugccaauuccuggcaaggaagaccuugcuaagcugcauucaucaagucauccaacuucuauagucaaagcaggaucauguggcgaagcauaugcuccacaaggguggauagcuuuuuucauggaauaugugaagagguauguauuuauuuucuuuguauuacaugauuguuaaaccugcuguuucugcuguacuggcagaacacuuccuuuuuuuucuaucaaugauguuucagguuuguugucucaugugucccuagcugguuuugggguccaguaguaaccuugcaagauugucuugcugccuucuuugccagagaugaacuaaaagguaagaaauauaauaucuauggcuaaauuuuuguagguaaaucuaaaauacuagugggacuaaauaauaaaguguauucauaaaagcucaguuuuaagacagcuuaauaguacauucacauauuggcauucgguuagugucuaccuugauaauauaaauauaacaagaaaaaucacauccugaaggaauucaugugaauuccuguaguauaagacaaaugauaagugaaauguuuuaaagcuguucugagauccauagaagggcaaacucaaccaaaauaauggacuuauuugugugucuguaauugugaacuacuccauaucauuuaaggucauucacuauuuuugugugucuagcaccuugcuuggacauaugacaggcagucaguaaguuuuguucaaugaauaaauggaaaagauauuauuugagguaggucuucaauguuggcaggaguuaagggaggggaagguaaacaguaaccugauucaugagcauagauuaaaaaaauggaaccuuguuuuucugugcugggaggucagcauggggcaaaaucaaauaauuacaggaccauaauaagcaauuugcuguuaauuugaaaccaaugccagaucuguuuuauuugcaggugacaauauguacaguugugaaaaaugcaaaaaguaagugacauugacagugcuuuuaauugcauguuguguauuuuucuugguuuuuagaauuggguauguggaguuaaauuugccacuguauuuagaaaaauguaggccagaaagguuuauccuaguaauaauagagauuagcuguuuugugaaacaaaugugagguaaaaauuugacaaauuuaauaggcuuauuaagaugugagagaguauauuuugagggaugaaaucuguaugugauuuugcauaaaacguuuuccuaaauaaggcaauauuuucuucugaauuaccauuuuaacaggcuagauucaggaagugaaagguacaaaguuucauauccacauaaaauuccuaaagguuauaccgacuucgauguuaucugcuguuaacaauggcauacgagaaagacagcuaaagucugauuuuguuuacaucuacuaccagcugccuuuuucugucuuguaaucaauuuagacuuuuaaugcuucuuagugguaagucagaaaaaaguguuggaagacuuggugaaaagcaacuauuugugaggcaaagugaacuggaaauuucuucucaaucucuguaauaggaaugcaacggcuugcuaauaagaucugggauaauacagacuucuaguucuuggcaguaaccuaaaggaaacauugaucugcaacugaucaugacaugacagaaaggaaugguauacuauuugguugauaaagaugaaaaagcugacuucuacuuuuggagaaaguaucacuuuguucuugaagcccuagcugacugcugaaaaggaaguuggcuuggaaggggauuguuccuuguaaagcaaagcauacuaagaaaaagauaacagugaagauggaaaagaaccuugcaucuaccuccauauucaaaguagagaucugucaaauguauauuaauuuugauuauauaauaauaaccauccuuuaucuuuuuuuccacauguaagaauaaagguuuuuuuuuuuuuuuuuuuuuuuuuuuuucauuugagacauagucucauucugucgccaaggcugaagauucaguagcaugauuacagcucuuugcaggcucagcuuccugggcacaagcgauccuccugccucagccucucaaguagcugggacuacagaugcaugccaccaugccuggcuaauuuguauuuuuuguagaaaugggguuuugucauguugcccaggcuguuugugaacuccuuggcuugcaugauuugccaacauuggccucccaaaaugcugagauuacaagcgugagccacuguguccggccaagacuuuuuuuuuuuuuuuuuucuugagagggagccuugcucugucgcccaggcuggagugcaguggugugaucucggcucacugcaaccucugccuucuggguucaagcaauuuucccugccucagccucuugaguagcugggauuacaggugcccgccaccacacccagcuaauuuuuguauuuuuaguugagaugggguuuugccauauuggucaggcuggucuuaaacuccugaccucaggugaucugcccaccuuggccucccaaaaugcugggauuauaggcgugagccacggugccuggccaagaguuugauauguugacuugaacuacaaauuuuauaaaacugagguuuugcuuuaucugguuuuacuuaauaucuagauguuuuaaaggcauagccacaccacagacaguagcacauuuguuaaaacaaaacaauuuucaucaaagaguuauacagcucucuaaauuuuugauuaccgauaucuugguuuaaauuacuauuguuauuuuuugagauggagucuugcucuguccccaggcuggagugcaguggcacgauauugacucacugcagccucugccuccuggguucaagugauuccucugccucagccucaugaauagcugggacuacaggcgugcgccaccaugcccggcuaauuuuuuguauuuuaguagacaugggguuucaccauguuggccaggauggucuccaucuccugaccuuaugaucggcccgccuuggccucccaaagugcugagauuacaggcgugagccacugcgccuggccaguuuaaauuauuuuuuacaauaagggacuccaguguuuugauuaagauauuuaauguauacauguaacguaauucaguggcaaguauuucuagucugauaucuuuugucucugcauuuucuuucuuucuuucuuuuuuuuuuuuuuuuuuugaggcagggucucacucuagcccaggcuggaguacaauggugcgaucuuggcucucugcaaacuccgugucccggguucaagugauucuccugccucagccuccugaguaucugggacuacaggcaugugccaccaugccuggcuaauuuuguauuuuuaguagagacgggauuucaccauguuugccaggcuggaucucugcauuuucuaaaagauuuuuguugcaaauuuaaauauacuaaguuuuuuuguagacuaauugauuuucucuuuucuccccuuagguugagaaauggagugaaguuuuguaaaguacaaaacuuuccugagguaugggcauuauuuuaauucaacuuauauugugugguaggaacauaaaguauuaauguaacaaaauguaguaauaaauucucuuugcuugguugaagaauugaaugauugcuaugcaugccuuuuuaagauuauucaguuuuaaaauauugaguuaaauaccguaagugcccuuuaacaaugugcuguguugaacaaaguuuaaucauacuugcaggaucuugccaggucuaaaguguaaaauuagaaaaacaaauagcagugaacuuagaaaguaccauguuucaccauuuccauauuuuuaacaucucuggaagcagguuauaauugcagaucaauacuuaaccuugacacuucaguauauauugaauagacugcuuuaucuagcauuuaaaacgaaauaaaaaucuaaauaacuucauaauuguaauuugauugaacaccucaguuucuugcuuguugaauaaaaauguuacuaaguuuuaccuguuauaaugcuuuuuguuuucuguauugacaaauuaguuuugaauuuuauucuuuuuuagauuuugugcauccaccuuaaaagauucagacaugaacuaauguuuuccaccaaaaucaguacccauguuucauuuccgcuagaaggcuuggaucuucagccauuucuugcuaaggauaguccagcucaaauugugacauaugaucuucugucagucauuugccaucauggaacugcaaguaguaaguauauagguuuaacaguuguuccuagauuuaaaaaaaaauuaaaauaagccugggcgugguggcucauaccuguaauaccagccuuuugggagaaugaggugggagaaucacuuaauuaaagccaggaguuugagaccagcuugggcagcauagugaaaccccaucucuacaaaauaaauaaauaaacauccuaauuaaucuuuuaaauaauaucugaauaaaagaaaaaauguuaaaaacagauguuacugcuaauuauuaaaaacaugucagauaauuuuaugcaauuaaauauuuuuacuaugauguuuccaauauugaaaauuguauacaguuaauaaggcauuaacaugauuuuuuuuuuuuuuuuggagacagagucucacucuguugcccaggcuggagugcaguggcgcgaucuuggcucacugcaaccaccgccucccagguucacgccauucuccugccucagccucccaaguagcugggacuacaggcgccugccaccacgcccagcuaauuuuuuuguauuuuuaguggagacgggguuucaccguguuagccaggauggucucgaucuccugaccucgugaucugcccgccucggccucccgaaguggugggauuacaggugugagccaccaugccuggcccuaacaugauuuuuauacuggauuuuuuaagauuauguguucuagcugggugugguggcucauaccuguaaucccagcacugggaggccaaggcagguggaucaucugaagucaggaguucgugaccagucuggccgacauugugaaaccccgucucuacuaaaaauacaaaaaauuagccaagcaugauggcaggcgccuguaaucccagcuacucgggaggcugagacaggagaaucgcuugaaccuggaagguggagguugcagugagcugagauugcaccauugcacuccagccugggcaacaagagcaaaacuccaugucaaaaaaaaaaaaaagaaaaaaaagaauauguuuucuaauagcuggguguuugugggggcgcagucaggcuggugggaaaaauuuuaguuuuagaaaauauacacaaacccuucuggagggcugggaguuuuuacauacaguacuuggcugaaggcagccuuguccccuuaguuaaguaaauuagauuagaaaaggaauguggggaguuuaucucacuagcuuguuuacccaugugguccuaagacuaaccuuugauuuaccggguucuuaauugcuuucuacuggggagguuugcaauaucaauuacccucuagugguguugacucaaggcuuugucaauuaaucuguacugaauaaaugcgagucucacuggcucgucgaggcugcugucugcaacuguuuacagcacuguucuuggagucuguaaguggcccagaugcuuagccagacuggcaaagcagaauaucugugucaguguacuuuauucauccgucauugggucagggucugugggacagacccccgcagguguuaaugacucaugccuguaaucccagcaccuuuggaggcugaggcagaaggaucacuugaggcucggaguuugagaacagccuggacaacauagcaagaccccaucuguaaaaaaacaaaaauaaauuagcuggguguggugaugugcaccuguaguuccaauuacucaggaggcugaggcaagaggauagcuugagcccagaaauuugaggcugcagugagcugugaucccuucacugaacgccagcuugggcaacagagcaagacugugucuauuaaaaaauaaaaaaauuuaaaaaauuacauguucugucgucaggugaugaaggaaugguggcaagcgugcaaacugaaaaaaaaauacaagcauaauucuuccuauauuccagcuacugugcuaggcacuggaaauauaaaaaguuuauccuccuuucuucuguuguuuuuguauuacuguaaugauuucuuuucccucaaauucagguggacacuauauagccuacugccgaaacaaucuaaauaaucucugguaugaauuugaugaucagagugucacugaaguuucagaaucuacuguacaaaaugcagaagcuuacguucuuuucuauagguaauggaaauaaguguagaugcgaaaggacaucucucacauuuugggcuuaucagugacuucuaagacauucuaauggauugcugagucaagauuaggaauuguuuuccuccuauuucauuacaguaaaauacagugaaaggcuguauauguagaaugauucuuuguucagaaaaugcuaaaucauuuacuugaagagcaaagggauauauuuuguuuuagaaagauuaauuuuagugccgggcacaguggcucaggccuguaaucccagcacuuugggaggccaaggcggguggaucacgaggucaggaguucaagaccagccuggccaagauggugaaacccugucucuacuaaaaauacaaaaauuagucaggugugguggcaggugccuguaaucccagcuacuggggaggcugaggcaggagaaucgcuugaacccggcggguggggguugcagugagccuagauugcgccacugcacuccagccucggcaacagagugagacgccaucugaaaaaaaaagaaaaagaaagauuagguuuaauuuaaaaauuaggcauugauggucugaauuaaguaccaaauuuucucccaaaguagcuaauaaugaaaguauuacuauaaaaauauuuguuuuuuuuuagcaucuuauaaaagaagaugcuagcuucugaaacagaagcagauuaauuauuuagcuugaucuuauuaacaaacauuugaaugcuuacuguguuccaguaguuauguggauaccuguagguaagauacaguuucaucccuaugaguauauaauguauuugguggauaauacaaaguauauuucucuugaaauucccaagaccuaauaaagauaguguuaauauguguguuaagucuaauaagaagaaaaauccaucuacuaguaauguaguaaaaugcauauugaauuuaacuaaucauuguccuuaauaggaagagcagcgaagaggcacaaaaagagaggagaaggauaucaaauuuauugaacauaauggaaccaagccuccuucaguuuuauauuucucgacaguggcuuaauaaauuuaagaccuuugccgaaccuggcccuauuucaaauaaugacuuucuuuguauucauggagguaagaacuccuguaaugcaaaccgguaguagaaguuugcuguaaaauaauuugcaaauuaggagagccaagaauuuuccucucccacuuauuucccauuuccccaccugcauucaaacuuaauguguuuuaauuccauaugguuucagaaauucacccuuccuuuuuaauuguagguaaucucuagcuucuuuauugaacauauauuuacugaguacaugcuuucuaaacuuuuugcuagugccuaaggacacuaaaaauccuuuuucuucugugaaagcucuaauuucauaguagaguaagauacauaaacagcuguuuacauuacagugagcuccucuauuauacaucauuuuuccuaccugaggcauuccugugcuggugauuuuaucuaucgacuauauuggugguucuuaaccccauugucuaaaugaauagcuggcuuuuuucccaaguauggaaauguaucugggauuuaagaaaaaaaagccucauaauuaaauauaacuuuggcccuugugagauuggcuguguuaauguuuauuucuacaauaaauaggaccuuugugugaugccaauuaaacuucaagguugaagaugggauauucaugguaauuauguuuguagugaaaccagaagggauagggauaccuguauuggacauagaaauuuuaagguguauguucaucuugaggaaacacaaucaccaaaaaugcuuuauaauuaccguucuugggagagagaguguaagaauaaugauugagcugggugcaguggcucacaccuguaaucucauugucucaggaggcugaggcaggaggacuccuugagcccuagaguuugagguugcagugagccauggucaugcugcugcacuccagccugggugacagagugagaccuugacucaaaaaaauggccagacacaauggcucaugccucuaagcucagcacuuugggaggccaaagcaggaggaucacuugaggucaugaguuugagaccagccugggcaacauaaugagagccuguuucuacaaaaaaaaaaaaaaaaaaaagaaaaguuagcuggguguguugaagcaugccuguagucccagcuacucaggacgcuggggugggaggaugccuugagcccaggaauuuugaggcugcugugagccaugaucaugccacugcacucucuggacugggugacagaacaagacccuuccacuuaaaaaaacaaugaugauugaucugucauuuaguuacuguuaaaaaaaaaaugaguuuaauguuugaaaggaauauaauuaaaagcaugaaacagauauguuuauauauuuuuuuagguguuccuccaagaaaagcugguuauauugaagaccugguuuugaugcugccucagaacauuugggauaaccuauauagcagguuuguuuuuuaaaucagaccauacaguguugugaaagucgguuaaacugguuaaaagggguuuggauuauuucagagaugcuccuugugcuauguguuuauucuuuucccuuacuuauucauucuaaagugugaguaggaagacuuuguagcuacuguggcauagucuagauaauuaauuuuaauuuuuucuaauuaucuaucugugaagguaugcugugguaauuuaaguaccuuguuuaaaauacuuugcauauccccacacuaaaauuuuacauauguauauacucacacaauugaguaucuuacucuuaaauuguaaauuuuuuuuucuuuuuuuuugagacaaggucuugcuccaucaaccaggcuggagugcaguggcacgaucuuggcuuacugcagcgucgaccuccuaggcuccagugguccucucacuucagccugccuaguagcugggaucacaggcgugcaucaccaugucuggcuaauuuugggguguuuuuuguagagaugggguuuugccauguugccugggcugaucuugaacuccugggcugaucuugaacuccugggcucaagccauguggcugcuuuggccucccaaaguccaaaguauugggauuacaggcaugcaucacugggccuggccuuaacaucguaaacuuuaaaauuuuaagauggagucucgcucugucgcccagucgggagugcaguggugcaaucucagcucacugcaaccucugccucccaguuucaagcgauuuugugccucacccucccaaguaccugggauuacaggcacacaucaccaugccuggcuaauguuuauauuuuuaauagagacgggguuucaccacauuggccagguuggucucgcaacuccugaccuuuauuuuaaaacauuuuccaccacaguuuuccuacuaauuauguuuucuuuaauuaaauauuaaaaauaauucauacauugaaugcuucuuacuugagaggccaggggaggccuucaucugaugaaaacuugacuaugacugugauguguaacuaagauuuauauguuguaugauacuuuuugaaaccacuucuuuuaguuuguuguuggcucuaacauuuuggagcagaaauaagggaaaguugaaauauagauaaagcagguuaagcaauaaacugauaaagucacugaccuuaauaaacauaauaacaaguccuuauaugauuuuugauuuuuauauuacuuugagaauuuuauuaagaggauuuauuuuuacuggguauuuggccacugacuuaaauguuagaaacaaacuuccuagaacauuaauucuuaaauuuuucaugcuuuagguaugguggaggaccagcugucaaccaucuguacauuugucauacuugccaaauugaggcggagaaaauugaaaaaagaagaaaaacugaauuggaaauuuuuauucggguaaaaaagugaugcuuuucaaauugaucuaggauaaagaugaagaccugacaauuaucagaguuauaugauauuaauaaaaugauuagaugaaagaguuguaauagauuucaaguguucuaggugcauaauggugaaugaccucaggcaguucacuacaguucuguugaguuauguucucccuuuguguguguguguguguguguguguguguguguaugagacaaaaucuugcucugucgcccaggcuggagugcaguggugcaaucucggcucacagcaaccucugccuccuagguucaagcaauucuccugccucagcuucccaaguagcuggaacuacaggcaugccccaccacgcuaggcuaauuuuuguauuuuuaguagagacaggguuuugccauguuggccaugcuggucucgaacuccugaccucaugugauuugcugucuuggccccacaaaguacugggauuauaggcaugagccacugcuccuggccccuuuguggguuuuugcuuuuauggauugacaauacuuuuuuuuuuuuuaauguauuggcacuggcagaaaucuuauugaaauggaaaauuacagguuuccuuaaguuaguguugucuguagucuauccagacugcauguacuacuuugauucuuuugugagauauaauauucuuuuguuuuuuugagggacuccugggcuuauaaauauacucacuuuucacaaacugagcauauuaugaggugucccuuaauuguaagcaacagaaaguguggucauaaaaucaaaagcaugaacaaccagguuuuaugggcaaggacuaguacccuuccaauuauugacguagcaagaagucucugcaguacuguugucaguaacauaacuccaacuauuuaagacaauugaaaauuuggaucacuugagagacacguuuauucauaaaucuacugagacacuauuauggggaggaguaauacugcaagaaaaaaauugggauucuuuuaguaaaagcaguggagaagauauugagcagaucaaaauaagauguccaguauguuuuguauuauucauuuccugcacauguguagacacacacacacaccugcuuuuccucauugauucagggcuuuuuuugugcccuugccuaaaguaaaguaaauuuuacauaaaaaagaugcagguauagauuuauuuauuuuacaugggcuucauuugcuucuugaaucuaaggaagcaaacuuuaguugaauauuaaaaauaguuuuuuccaucaaugcuuaaauaauggcuaaugacugugucugucaggauuugauuaauaguagcuauucuaaguauuuugaauagaaucagaauguagggaaugagagauguacauuacuauugaaaggacugggcagugaaggucaagaagaccacugcugacuuucaggaaaucuaaaaguggaauaggguaccacauugugggugggagagaagcaguggccaagaaugguguuuauaaccacagaggguaaagagaauuucuguauagugaguggcaugagcccagucaaggguguuagagcccaggcaggauaagaagggaugcccauguuggccugacauugguggcuacaaggguacagcauaguggugguaguggcagugagcgauugguuccauaugggaaaaugaucaagacauacguguaaugaguaccaaguuucucauugucagaugaggaaguuucaaauauggaaaaggagaaaacuaaacuguaccuuguguuguuauuggauuggaguuauggguaucuuugugaacucaugauaauagcugaguaaauauggacguguguguguguguguguguguguguguguauguguaugcauguauagaaacuugauauuucuuaacucucacugaaagugccuuggaucaaugauuacuccaguaggauugaucauaccuagcucucagauauauauaugucuauauguuuauauagauaucuauaucuauauauagauugauuacuccaaucuauugauuacuccaguaggauugaucauaccuagcugucagagacauauauauauauagaucuaucuagauagaucuauauguagcuuuauauagagagagaauauguucuauauuuacagaauguuaaaauuaaacauguauauaaaauauagauauauagauauguaucuauauauaucuauauauuucuaaauuuuauuuuaaaagacagggucucauucugucaccaggcuggaaugcaguggcuggucauaguucacuguaaccuugaacuccuaggcuaaagggauccuccugccucagcaucccgaguagcuaggacuacagaugcacaccaccauguguagcuaauuuaaaaaauaaauuuuuuuguagagacagugucuugcugucuugcucaggcuggucucuaauuccuggccucaagugauuuuccugccucugccucccaaagcucugggauuacaagcauaaacuacugugccuagccucaaaauaaauuacaguaacauauaaccucauuaaauaaaauaggagauacugcauccauauugguauaaauaaauaaaugaauaaauggaaaggaugaggauuggaaugcuuauaucauuucuacuuaacucccucauuaaacacuuauuaauuacaaacggaaaagacuaacuuucagcagagaauccugacaccaucucgaugaagauaaaaugagcaucauuagaaaugaaacaaaucaauuaguugggugugcugguguguaaguuccagauauucaggaggcggaggcaagaggaucacuugagcccaggaguuuaagaccagccuggacaacauagcgagacuuuauaucuuaaaaaaaagaaagaaaugaaacaaaaucaaaauuaugugccagaauaguauacaauuagaagaacauggcaccacuuuuugguacacagguggauaaccugaaucucaaaugaggaaagucacaaacccuaauugagggacauuuuauaaaacaacaaacuauuuggaggaaaggaacaucuguucagcaacuuauucugaaaucaaacuagguaaagaaaauuucuuuguauacuuggaguuuuccuauaaguuucagauugcuucagaguuuuaaaaaauucaaaacugcauaaagcccuuggaaacgauuucagcugucugccuauggcagugcucagaaaccugagaagcuacugcuacuaucaggacccaagugaauuauucaagaggacgcccaggagacacaggaugcugcuguuaaagauguuagcugcauacaauacuaagugagauuggauucuuuggaagaugcuuagaagugguggcaaaacccuacuuaugcuaucuguggaugccucaagccugcccaaagcugccaccagaggggaaaaucauuuuucuuucucuuauaccuuucauauauuucauauaucaugguuauauauagucugguguacuacuggcaauggauccugcaaaauguaggcuugucuucacagaagggaguauaugaauacaugaaaaugauguucauuaacagauaauagagcacagccuaccccuuugucaacucagcacccauaugcacuuacacaaccaaacaacaguagcaacaauaucaugcuucugccugauguaauacaacuagcuccugcaccaguauguguugcauuugcccuuuccccauauuugggagacccaaagucccaccagucacuauaccuauuucuaaaugauguucauaaaucuuuuaguucagagaguauagucacacuuuucccuguuauggucuguaaucuaaagaaugaacaguaacguuaaccaccaccaauauaccuuauaguagucaaaugaaaggaaaaaaauaaauugguaguuauuucaacaucugguaaauauuuauaaauauguacguggagcaaggaagaaauauguaucuauagcuaaucacuacccauuucuuauuuccucuguucucagccaauacccuggcugguugugaauguauuuaccucauaaaauaacccagaccuucauuucugaaggguuugaacccuuaguagucuugucuguauuaaauuucucucucugaguauggaaauacuaaauggugccuauaguggguugaauggugguucccaaaaagauauuuccauacucuaaucucuguaaauuaaccuuauuggugaaugugaccuuacuugaaaaaaggguauuugcauauguaaggauuuuugagaugagaucauccucaguugucugaaugggcccuaaauccaguaagugacccuucacagagauacacagcagagagauacgcagagaagaggugaaaaucaugaagauggaggcagagauuggaaugaugcagcugcaagguagaagcuuuagaagcaugacaggcaaggaauggagucuuccccuagagccucugcagggugaaugguucuccugacacuuugauuuuggaguucuguucucuaaaacugagagaauaaauaccuuuucauuuaccaaauuuguggcauuuuguuauagcaucccucugaaacuaacacaguggguauaaucugguuucccaacauaauccucuuuguuccuacuauguaguaauguaguauucauuuuauuuacccuuuauaacuggggucagucauugcagccaguacuguaaccuccucuuugcuugcugauucagugacaugagaaacucaaaauggccagggggcugucucaacuuuuaguccagucaaauuguuguuguguucacuugggauauaaaucuuccacauuuaguagaggccgaaguugugaguaugggaagcaaaacuugugugaauaugucaguagguaguaguagaugagcucucuuauuuccuuuaccugacuccuagguuuauguauuccaguuaugggaaaaaccaccauauauugguuucuaauuuggagcauauacuacaucguguaagauaguaccaaacccacaaaguguugccacccacacaaaaaaacuaaguccaguaggccaacaucuuuugcaugauagcgcaugguaagaucagugaauuuuauggaaguaagccuguuucuucauuucuuuuguguaaaaugacuuccauggucagagccaauguaggauauuaugguuacgaaugagucauucacuaaguccaagaauagugguacgugguaaaacacuggguuaggaagguagaccuaaauccaguguaaguuauagguguuuacaaaucacgugucaucaaaggacucauauccagacuauguauauaaagaacauacaacucaguaaguaaacaaauacuccaauuggaagauaggcaaaaaauuuggauaggaauuacccuuaagaagauaggucuaauaagcacauaaaaaguacacagugucagucauuagggaauuccuaugaauaucaaugaugagcaugcaaaaugcugugugccacaugauaaacaguuugguaauuucuuguagguucaacuccuaguacaugacccagcaaucccacucuuagguauucauuccagagaaaugaaaauuuauguuaacauaaaacauguaaacaaauguuuauggcaguauuguucauaauugcccaaaacuggaaacaauugaaaugucuaucaucugacaaauggauaaacaaaauguguuauaguuguauaauaaaaugcuacucagcaguaaaaagaucauggcguacugauccaugaagcaacauggaugaauaguagaaacauuaugccaaguguaagacauacaaaagacuauauaaugucuaauuucauuuauaugaaauuucuaaaaagggaaaaaguguggagacaaacagugauuucaagggcugagagaaggggaauugauugcaaacuggugcaagacagcuuuuguggguguuggagggcucuaagcuggauuguggugacaguugcacaacuauaaauuuacagaaaaccauuaaaguccauacgaagagugggaggauuacaccuuaauaaaauuuuuuuuuuuuuuuuaaagcaaaucuggggcugggcaagguggcuuaugccuugcuagcacuuugggaggcugagaauaggggauugcuugagccuaggaauuggagauuacggugagcuaugaccaugacccugcacuccagccuaggcaacagagcaagacccugucuuuaaaaauaaauaaaauuggcugggcucaguggcucaugccuguaaucccagcaccuugggaggcugaggcaggcggaucacuugaggucaggaguucaagaccagccuggccaacauggugaaaccccaucucuacuaaaaauacaaaaauuagccaggcaugguggcgggugccuguaaucccagcuacuagggaggccgaggcaggagaaucgcuugaauuggggagguggagauugcagugagccgagaucgcaccacugcacuccagccuggaugaaagagugagauucugucucaaaaaaaaaaauaaaaaauaaaaagugcaaaccuauuauuauucuauaauauuaggguuuuuuuuguuuuauucagcccccccccuuuuuuuuuuaaacaaagcauuuguguuaacagaaauaacacuggaauauaaaaauaggugcccuuaguggauuggaagcuaagugaaguuucugaaaaaccgaaaaagcagauaggaucagaucaaagaagcaagccaagggccacaggaaaugacugugugggcuuuaauuuuggaagugacagauacggaugaugaccuuagcauucugccuguugcacuguaccaggcagcaaguauaaagguaucugccuggguagagcagugaguguagaccaugugaaguaugauugauauucagggagauacauaaggauauuguauccuaaauaacaaaacaaaaccucaauagauggguugauugaauggcaaaauaaauacuauuggagaggaaaugaguaugcugaaagauauagcggaaagauuucuucuaaggugaagcacaaaaagauaaacagaaggaagaaaaguuuugacauguuggauagcuauaggauccauuguuuuucuauuauguauuuuuuaaaagagaacagagugagaacuacauuuagaguaaccauuuagauaaauuuuccagaacuagagagaaacacauccuuaaauuaaugagguaacugugcuuaacuaaauuuuaaaaagcgccuaccuaaacacauaggaaguaacuucuuaauaccaaagauaaaguaaguccugaaaguuuucaaacaugguagugguaugaauuuaaugguuguuagaauccagcaucuggcagauucagucugauaugacauuuuagaacucucaguucucuagggauaaguugcacaucacagaaagcccgaacuuuaauuccaugccuugagacaaauaugccuuaauuucuuuguuaaccaucagagacugccacagcauuuuccauuucauuguuccauugaagcagcuaccuugugucccagaaagaucuuugccuucagagagcuuauauaugcauacacacacacauauauacuuuuuuuuuuuuuuugagacaaguuguugcucuuuugcccgggcuggagcacgguggcaugaucacagcuuucugcagccucgaucucccacgcucaagagauccuccacaucagccuccugaugaauagcugagacuauaggcgugugccaccauacccaguuaauuuugcagccuugaucucccaggcucaagagaucccccacaucagccuccugaugaauagcugggacuauagggaugugccacugcacccagcuaauuuuuuguguauuuuuaguagagaugggguuuuaaccauguugcccaggcuggucuugaauuuucuggucucaagugagccacugugccaugccagagcuuauauuuaauaaauauguuauauguuauauuaaaaggugauggguacaauggaaaagggaaacauugaacagaauuagaggcaccaagauuacacuggugagggggaggagucagguuggaguuuuauauuuuauuuuacuuuugagauggagucuugcuuuuuuguccaggcuagagugcaguggcacgauaucggcccacugcaaccuucucgucccggguucaagugauucuccugccucagccucccaaguagcugggauuacaggcacccaccaccaugccuagcuaauuuuuguauuauuaguagagaugagguuucaccauguuggccagacuggucucgaacuccugaccucaggugaucugccuuggccuuccaaagugcugggauuacaggcgugagccacugcgccuggcccagguuggaguuuuaaacaggguggucaagauaggccucauugagaagaugacauuuaagcaaagacuuaaaggagguaagggagauagucauucagacaccugcaaaaagaaggguuagugcaaaaggcuugugaggcagagguguauuuguuugguucuggcaauaacaaaguggccaguaugaucaccagugaaaaaugaggaagaaagaagaugaggucagauuauggggugagaucauggagguacuucugggcuauuuuuauaaggguaucugugaauaauuacaggguuuugauuaauuugguuagaggaauuauauaaucugaacuugguugucuuuguccacagguaguguguuccauggauugaauugcccaucaugagaugggcaauuacuuacacacuacuacacacuacuuacacacuacuuacacacuacuacaauuagauuaauuccaaauacucuuaauuuucccgagccucuuuugcuugugcuucucuuucuauaucaguuuuucucucacuuggguuuuuuuuuaauugcaagugguagaagccagacuggcuaaccuggcaaaaaagaaauuuacuaagaauaaaaauugaaaaaccagaccuccaaaaguuugagaacuaagguagcccugaguaucuaccugaauugacauuggaaugauuccauucuaaccauuaggucacuucucugaagauuuuuauuucugacagaguuguguauaguuugagucauauacccauuccuuaggccugagggcuggaagagggaauuggucuucagggacugucccaccacuuauuagaauuuacuuauacauuuauguauauugcuugugaaaugacauguacaagaucauucauucauugcagcaugguaauagcaaguugucuaccaguaucuuaaguaaacaaaaaguauagacuguggauauaguauguguacauaaaguuuacacauuagauuuuuaauaaauauguggcguauuuauuguuuugaagacuuugucuugaccaucuucauuuacccagucuuuaugccccuuuuauguauacuuguuaaauuuugagacagaaccuagaauuguuuauucauagaugcuaccacguauucuaguacuaaguuagcauacaucuuacuguaccacugguuuuuuuuuuuuuuuuuuuuuuuuuuuuuuuuuuuugagacagggucuuguucugucacccaggcuggaguacaguggcacaaucacggcucacuguagucucaaccuucugggcucaaguaauccuccuaccucagcuuccccgaauagcugggacuacaggugcaaaucaccucacacagcuaauuaaaaaaauuuuuuguguguguaggccgagugugguggcucacaucuguaaucccagcacuuugggagcccaaggcagguaucacuugaggucaggaguucaagaccagccuggccaacauggcaaaaccucauuucuacuaaaaauacaaaaauuagccaggugcgguggcaggcaccuguaauccuagcuacccgggaggcugaggcuggagaaucacuugaacuugggaggcggagguuacagugagcccagaucgugccauugcacuccagccugggcaacaacagcaaaacucuaucucaaaaauaaauaaauaaaaauaaaaaauaauguuuuuuuuguagagauguucucacgauguugcccagacugguuuggaacuccuggguucaaggacuccuccugccucagccucccaaagugcugaguuaucaaacacugaaguggaaugaugguauuguuuugccauaaagcaaguuuuagauauuagaugacuguuuuuuuucccccuuguagcuuaacagagcguuccaaaaagaggacucuccagcuacuuuuuauugcaucaguaugcagugguuuagagaaugggaaaguuuugugaaggguaaagauggagguaagugguugacugaaaaauuuuuuuuugguaaauuauuuguuuuuuuguuugacaaguauuucuugaauaucugugugcacuugggauuacacuauugaacagaagagaaaaagauccuguccucagggaucuuacguucuaguuuauauucuguugguuguaaauuuuguuaaacuuauuuuaugaauuauagcaggaauaagaggacugaacaaaguaaaucugugaucuuaauguugaaaaaauuuuagaaaucuuuauaaggaauaagagguugcuuaaaguaugguuuauucaauacaguggacuuuuaaaguaaaauuguaugacaauauuuaauaauaugaaaauaagauauucugauaugugccaggcacgguggcucacgcccauaaucccaaaaguuugggaggcugacguggguggaucaccugacgucaggaguucaagaccagccugaaacauagugaaacccugucucuacuaaaaauacaaaaauuagcugggugugguggcagucaccuguaaucccagcuacucaggaggcugaggcaggagaauugcuugaauccacgaggcggaggcugcagugaacugagaucaugccacuguacuccagccugggugacagagcaagacuuugucuuuaaaaaaaaaaaaaaaaaaaagauucugauaugugaaaaaggcugcaacaauaugccuaguuaaagcuuuuuguauuuauguauuuacuuuuuaaaauuuuaaauuaauagagacaaggucuuaacccuguugcccagguuuaaguacagcagcaugauuauggcucacugcagcccugaacucucagcccaugcgauccuccuaccuccaucuccugaguaguugggacuacaggcauguacuaccacacuuggcuaauuuaaaaauuauuuuuuacaauuauuuguagagacauggucucacaguguugcccaggaacuccugggcucaagcagugcaccaaccuuggccucccaaagugcugaauuacugaguucucucuguauuguccaggcuggccucaaacuccugggcuccagcgauccucuugcuucagccuccugaguagcugggacuauaggugcacaccaccauaucuggcuuuucuacaccuuuaaaaaaauuuauuuuuauuuuguaaguuccagcauacaugugcaggaugugcagguuuguuacauagguaaacaugugccauggcgauuugcuccaccuaucaacccauuaccuagguaucaagcccagcaugcauuagcuguuuuuccuguuguucucccaccccucaucccucaacccccaccaacaggcccuaguguguguucuccucccuguguccuuguguucuuguuguucagcccccacuuauaagugagaacaugcaguguuugguuuucuguucuugcauuaguuugcugaggauaauggcuuccagcuccauccaugucccugcauaggacaugaucucuuuccuuuuuauggcugcguaguauuccauaguguauauuuaccacauuuucuuuauccagucuaucauagaugggcauuuggguugauuccuuaucuuugcuauugugaauagugcugccaugaacauaugugugcauguaucuuuauaauagaaugaauuguguucuuuuggauauauacccaguaaugggauugcugggucaaaugguauuucugguucuaggucuuugaggaauugccacacugucuuccacaaugguugaacuaauuuacauucccaccaacaguguaaaaguguucccauuucuccacagccucgccagcaucucuuguuucuugacucucucuuuuuuuugaaaaagaggcucacuuugucacucaggcuggaguggaguggcgugaucucagcucauugcaaccuccuccuggguucagacgauuguccugccucagcguccugaguagcugggauuacaggugccgcugucaugccuggcuaauuuuucuauuuuuaguagagaugggguuucaccauguuagccagguuggucucaaacuccugaucucaagugagccaccugccucggccucccaaaguggugggauuacaggcauaagccacugggcccagccuguuucuugacuuuuuaauaacuggcauucugacugaugugacaugguaucucauugugguuuugauuuguguuucucuaaugaucagugauguugaucuuuuuuucauguuuuuuuggccacauaaaugucuucuuuugagaaguguucauguucuuuguccacuuucuaauuggguuuuuuuaauuguaaauuuguuuaaguugcuuuuacaacuuuugaugaugaccaugcgguucacuuuugccuuaaauuuuaaaaagaauguauuuaaacgguuucuuuuauaaugcuuuuauuguucuuaauguuacuuugauaaucugaagcaaauuaauuguauaauuucuuucaaauuacaaaggaauugcuauuuuauagcauuagugguacauuuugacuuguaauccccaaauggagaguuaaaaaauaauuucugggccgggcgugguggcucaugccugucaucccagcacuuugggaggccgagggggguggaucacgaggucaggagaucaagaccauccuggcuaacacggugaaaccccaucucuacuaaaaauacaaaaaauuagcugggcgugguggugggugccuguagucccagcuacucgggaggcugaggcaggagaauggcaugaaccugggaggcggagcuugcagugagccgagaugaugccacugcacuccagcccuuggcaacagagcgagacuccgucucaaaaaaaaaaaaaaaaacaaaacauuucuguuaaacugugaugguugugaacgagccucucuuaccuucuuuccugguucuguuuugggggaacuaagaacuaaaaacgaagaagcucaggagaagacauuaagaauuaaccauaggccagguguaguggcucacgccuguaaucccagcacuuugggaggcugagguggguagaucgugaggucaggaguucgagaccagccugaccaacauggugaaacucccaucucuacuaaaaaaaaaaaaaaaagcaaaaauuagccgggcgugguggugugugccuguauucccagcuacucaggaggcugaggcaggagaaucacuugaacccaaggcggagguugcagugagcugugauggugccacugcacuccagccugggcaacagagcgagacuccaucucaaaaaaaaaaaaaaagaauuaacuauaauaauuugccugagaaauaaccagucugauaauguaguuauaggucacaauuuugucaagcacaaaauuaugcaauuuuuuguuacauuucuuugaaaaauacauuuugauauuuuuuccuuuagauccuccagguccuauugacaauacuaagauugcagucacuaaaugugguaaugugaugcuuaggcaagguaaguuugacucguauuuaagcuuuuacuugugagugauuugucacuguuagaaauauguuaucauuagucaucuauaguacuuuuuuauucaacugaagaauguaauccauacauuaacuagggcaaguaaugaaaagcagccacuuuuuuuuuaucugaggaaaggucuuaaggcuguuguuaagagcaaagcaaaagcaucucugacuuuuuaagacaagccauauguuucagcuuauaacaauaugggcugguagucugcagauucauguuccagaaguucucaauuaucccgagaagauucaugcugggggguacauuaugaacgcuuuugcaauaugaauauauagguuuguaaacauuauuucuucuacguaauuuuaaggagcagauucuggccagauuucugaagaaacauggaauuuucugcagucuauuuaugguggagggccugaaguuauccugcgaccuccgguuguucauguugauccagauauacuucaagcagaagaaaaaauugaaguagaaacucggucuuuguaauuuuuaggauguagagaguucuaaugaggaaucauuuucaugugcccugacauguacacaugcgaaaacauuccuaaaagcguguuuauuugcuuuauuuuuuuucaucauuuaucccauuuauuucuucuuagugggcauuauggaagaauauauuaaaauguguaauauaccacagguugguauauuuaguuuuaaauacuuaccauaaagucuuucaguguaauuuuuuuuugagacagagucuugcuuugucacccaggcuggagugcugugguguuaccucagcucacugcagccuccaccuccuggguucaagcgauucuccugccucagccucucgaguagcugggauuacaggcaccugccaccaugcccggcuaauuuuuguauuuuaguagagaugggguuucaccauguuggccaggcuagucucaaacuccugaccucaggugauccacccaccucggccucccaaagugcugggauuacaggugugagccacagcgccuggcccaguguaauauuuuugaaagaggagggacaauugugaaaucaguagguuaucuuuaaucuuuacacuacaugcagauccauaguauccuuuguaguguuguaaauacuuuugcuuugaaaacuuuuucauuguccuaaaucacccugacucugaccagucuuucaguucuccaaaagcccaauuuaauuguauaguuuugucauggcuucauauaauaaagagccuauuuuaaguugaaaguaguagucagaaaauuguuaauuuccuaaagcucaggaaacuagggugucacuuuuuuugcacugcagcauauacacuaacuagcuuauuaaaauuuacaaaaugucuuuuugaauguaucaaggauauauuuaguuugaguggaauuugucagcagauaucaguaacuuauugccgcuuauauuguacaauguuaaacuucaauuccuguaaccugguuaguauuaaugucagugacuaaaaaacuuagaguuaguuuuagggcacuuuuuauuuugagagcaugaaguguggaaugugucacuacgauuguugauaaagcugaggccacuugcaacuugauuuuuuaaaugaaauagauaaagucuuuuugaauaauauaguaugcacugcuauuugcuugauuauguaaugucaaaaguuuaacuauauuccaaguacaaaaacauacuggauuacauugaggauguugaauagcauucaugauggcuuuguuuugguuuggggcagcugucaccagcuaaagcaauguuguuaaaauuagcucaauaaaaaugucuuuaaaauguaa

SEQ ID NO: 191342 - RNA, 63864 nt, Homo sapiens
uuacauuuuaaagacauuuuuauugagcuaauuuuaacaacauugcuuuagcuggugacagcugccccaaaccaaaacaaagccaucaugaaugcuauucaacauccucaauguaauccaguauguuuuuguacuuggaauauaguuaaacuuuugacauuacauaaucaagcaaauagcagugcauacuauauuauucaaaaagacuuuaucuauuucauuuaaaaaaucaaguugcaaguggccucagcuuuaucaacaaucguagugacacauuccacacuucaugcucucaaaauaaaaagugcccuaaaacuaacucuaaguuuuuuagucacugacauuaauacuaaccagguuacaggaauugaaguuuaacauuguacaauauaagcggcaauaaguuacugauaucugcugacaaauuccacucaaacuaaauauauccuugauacauucaaaaagacauuuuguaaauuuuaauaagcuaguuaguguauaugcugcagugcaaaaaaagugacacccuaguuuccugagcuuuaggaaauuaacaauuuucugacuacuacuuucaacuuaaaauaggcucuuuauuauaugaagccaugacaaaacuauacaauuaaauugggcuuuuggagaacugaaagacuggucagagucagggugauuuaggacaaugaaaaaguuuucaaagcaaaaguauuuacaacacuacaaaggauacuauggaucugcauguaguguaaagauuaaagauaaccuacugauuucacaauugucccuccucuuucaaaaauauuacacugggccaggcgcuguggcucacaccuguaaucccagcacuuugggaggccgagguggguggaucaccugaggucaggaguuugagacuagccuggccaacauggugaaaccccaucucuacuaaaauacaaaaauuagccgggcaugguggcaggugccuguaaucccagcuacucgagaggcugaggcaggagaaucgcuugaacccaggagguggaggcugcagugagcugagguaacaccacagcacuccagccugggugacaaagcaagacucugucucaaaaaaaaauuacacugaaagacuuuaugguaaguauuuaaaacuaaauauaccaaccugugguauauuacacauuuuaauauauucuuccauaaugcccacuaagaagaaauaaaugggauaaaugaugaaaaaaaauaaagcaaauaaacacgcuuuuaggaauguuuucgcauguguacaugucagggcacaugaaaaugauuccucauuagaacucucuacauccuaaaaauuacaaagaccgaguuucuacuucaauuuuuucuucugcuugaaguauaucuggaucaacaugaacaaccggaggucgcaggauaacuucaggcccuccaccauaaauagacugcagaaaauuccauguuucuucagaaaucuggccagaaucugcuccuuaaaauuacguagaagaaauaauguuuacaaaccuauauauucauauugcaaaagcguucauaauguaccccccagcaugaaucuucucgggauaauugagaacuucuggaacaugaaucugcagacuaccagcccauauuguuauaagcugaaacauauggcuugucuuaaaaagucagagaugcuuuugcuuugcucuuaacaacagccuuaagaccuuuccucagauaaaaaaaaaguggcugcuuuucauuacuugcccuaguuaauguauggauuacauucuucaguugaauaaaaaaguacuauagaugacuaaugauaacauauuucuaacagugacaaaucacucacaaguaaaagcuuaaauacgagucaaacuuaccuugccuaagcaucacauuaccacauuuagugacugcaaucuuaguauugucaauaggaccuggaggaucuaaaggaaaaaauaucaaaauguauuuuucaaagaaauguaacaaaaaauugcauaauuuugugcuugacaaaauugugaccuauaacuacauuaucagacugguuauuucucaggcaaauuauuauaguuaauucuuuuuuuuuuuuuuugagauggagucucgcucuguugcccaggcuggagugcaguggcaccaucacagcucacugcaaccuccgccuuggguucaagugauucuccugccucagccuccugaguagcugggaauacaggcacacaccaccacgcccggcuaauuuuugcuuuuuuuuuuuuuuuuaguagagaugggaguuucaccauguuggucaggcuggucucgaacuccugaccucacgaucuacccaccucagccucccaaagugcugggauuacaggcgugagccacuacaccuggccuaugguuaauucuuaaugucuucuccugagcuucuucguuuuuaguucuuaguucccccaaaacagaaccaggaaagaagguaagagaggcucguucacaaccaucacaguuuaacagaaauguuuuguuuuuuuuuuuuuuuuugagacggagucucgcucuguugccaagggcuggagugcaguggcaucaucucggcucacugcaagcuccgccucccagguucaugccauucuccugccucagccucccgaguagcugggacuacaggcacccaccaccacgcccagcuaauuuuuuguauuuuuaguagagaugggguuucaccguguuagccaggauggucuugaucuccugaccucgugauccaccccccucggccucccaaagugcugggaugacaggcaugagccaccacgcccggcccagaaauuauuuuuuaacucuccauuuggggauuacaagucaaaauguaccacuaaugcuauaaaauagcaauuccuuuguaauuugaaagaaauuauacaauuaauuugcuucagauuaucaaaguaacauuaagaacaauaaaagcauuauaaaagaaaccguuuaaauacauucuuuuuaaaauuuaaggcaaaagugaaccgcauggucaucaucaaaaguuguaaaagcaacuuaaacaaauuuacaauuaaaaaaacccaauuagaaaguggacaaagaacaugaacacuucucaaaagaagacauuuauguggccaaaaaaacaugaaaaaaagaucaacaucacugaucauuagagaaacacaaaucaaaaccacaaugagauaccaugucacaucagucagaaugccaguuauuaaaaagucaagaaacaggcugggcccaguggcuuaugccuguaaucccaccacuuugggaggccgaggcagguggcucacuugagaucaggaguuugagaccaaccuggcuaacauggugaaaccccaucucuacuaaaaauagaaaaauuagccaggcaugacagcggcaccuguaaucccagcuacucaggacgcugaggcaggacaaucgucugaacccaggaggagguugcaaugagcugagaucacgccacuccacuccagccugagugacaaagugagccucuuuuucaaaaaaaagagagagucaagaaacaagagaugcuggcgaggcuguggagaaaugggaacacuuuuacacuguuggugggaauguaaauuaguucaaccauuguggaagacaguguggcaauuccucaaagaccuagaaccagaaauaccauuugacccagcaaucccauuacuggguauauauccaaaagaacacaauucauucuauuauaaagauacaugcacacauauguucauggcagcacuauucacaauagcaaagauaaggaaucaacccaaaugcccaucuaugauagacuggauaaagaaaaugugguaaauauacacuauggaauacuacgcagccauaaaaaggaaagagaucauguccuaugcagggacauggauggagcuggaagccauuauccucagcaaacuaaugcaagaacagaaaaccaaacacugcauguucucacuuauaagugggggcugaacaacaagaacacaaggacacagggaggagaacacacacuagggccuguugguggggguugagggaugaggggugggagaacaacaggaaaaacagcuaaugcaugcugggcuugauaccuagguaauggguugauagguggagcaaaucgccauggcacauguuuaccuauguaacaaaccugcacauccugcacauguaugcuggaacuuacaaaauaaaaauaaauuuuuuuaaagguguagaaaagccagauaugguggugugcaccuauagucccagcuacucaggaggcugaagcaagaggaucgcuggagcccaggaguuugaggccagccuggacaauacagagagaacucaguaauucagcacuuugggaggccaagguuggugcacugcuugagcccaggaguuccugggcaacacugugagaccaugucucuacaaauaauuguaaaaaauaauuuuuaaauuagccaagugugguaguacaugccuguagucccaacuacucaggagauggagguaggaggaucgcaugggcugagaguucagggcugcagugagccauaaucaugcugcuguacuuaaaccugggcaacaggguuaagaccuugucucuauuaauuuaaaauuuuaaaaaguaaauacauaaauacaaaaagcuuuaacuaggcauauuguugcagccuuuuucacauaucagaaucuuuuuuuuuuuuuuuuuuuuaaagacaaagucuugcucugucacccaggcuggaguacaguggcaugaucucaguucacugcagccuccgccucguggauucaagcaauucuccugccucagccuccugaguagcugggauuacaggugacugccaccacacccagcuaauuuuuguauuuuuaguagagacaggguuucacuauguuucaggcuggucuugaacuccugacgucaggugauccacccacgucagccucccaaacuuuugggauuaugggcgugagccaccgugccuggcacauaucagaauaucuuauuuucauauuauuaaauauugucauacaauuuuacuuuaaaaguccacuguauugaauaaaccauacuuuaagcaaccucuuauuccuuauaaagauuucuaaaauuuuuucaacauuaagaucacagauuuacuuuguucaguccucuuauuccugcuauaauucauaaaauaaguuuaacaaaauuuacaaccaacagaauauaaacuagaacguaagaucccugaggacaggaucuuuuucucuucuguucaauaguguaaucccaagugcacacagauauucaagaaauacuugucaaacaaaaaaacaaauaauuuaccaaaaaaaaauuuuucagucaaccacuuaccuccaucuuuacccuucacaaaacuuucccauucucuaaaccacugcauacugaugcaauaaaaaguagcuggagaguccucuuuuuggaacgcucuguuaagcuacaagggggaaaaaaaacagucaucuaauaucuaaaacuugcuuuauggcaaaacaauaccaucauuccacuucaguguuugauaacucagcacuuugggaggcugaggcaggaggaguccuugaacccaggaguuccaaaccagucugggcaacaucgugagaacaucucuacaaaaaaaacauuauuuuuuauuuuuauuuauuuauuuuugagauagaguuuugcuguuguugcccaggcuggagugcaauggcacgaucugggcucacuguaaccuccgccucccaaguucaagugauucuccagccucagccucccggguagcuaggauuacaggugccugccaccgcaccuggcuaauuuuuguauuuuuaguagaaaugagguuuugccauguuggccaggcuggucuugaacuccugaccucaagugauaccugccuugggcucccaaagugcugggauuacagaugugagccaccacacucggccuacacacacaaaaaauuuuuuuaauuagcugugugaggugauuugcaccuguagucccagcuauucggggaagcugagguaggaggauuacuugagcccagaagguugagacuacagugagccgugauugugccacuguacuccagccugggugacagaacaagacccugucucaaaaaaaaaaaaaaaaaaaaaaaaaaaaaaaaaaaaccagugguacaguaagauguaugcuaacuuaguacuagaauacgugguagcaucuaugaauaaacaauucuagguucugucucaaaauuuaacaaguauacauaaaaggggcauaaagacuggguaaaugaagauggucaagacaaagucuucaaaacaauaaauacgccacauauuuauuaaaaaucuaauguguaaacuuuauguacacauacuauauccacagucuauacuuuuuguuuacuuaagauacugguagacaacuugcuauuaccaugcugcaaugaaugaaugaucuuguacaugucauuucacaagcaauauacauaaauguauaaguaaauucuaauaaguggugggacagucccugaagaccaauucccucuuccagcccucaggccuaaggaauggguauaugacucaaacuauacacaacucugucagaaauaaaaaucuucagagaagugaccuaaugguuagaauggaaucauuccaaugucaauucagguagauacucagggcuaccuuaguucucaaacuuuuggaggucugguuuuucaauuuuuauucuuaguaaauuucuuuuuugccagguuagccagucuggcuucuaccacuugcaauuaaaaaaaaacccaagugagagaaaaacugauauagaaagagaagcacaagcaaaagaggcucgggaaaauuaagaguauuuggaauuaaucuaauuguaguaguguguaaguaguguguaaguaguguguaguaguguguaaguaauugcccaucucaugaugggcaauucaauccauggaacacacuaccuguggacaaagacaaccaaguucagauuauauaauuccucuaaccaaauuaaucaaaacccuguaauuauucacagauacccuuauaaaaauagcccagaaguaccuccaugaucucaccccauaaucugaccucaucuucuuucuuccucauuuuucacuggugaucauacuggccacuuuguuauugccagaaccaaacaaauacaccucugccucacaagccuuuugcacuaacccuucuuuuugcaggugucugaaugacuaucucccuuaccuccuuuaagucuuugcuuaaaugucaucuucucaaugaggccuaucuugaccacccuguuuaaaacuccaaccugggccaggcgcaguggcucacgccuguaaucccagcacuuuggaaggccaaggcagaucaccugaggucaggaguucgagaccagucuggccaacauggugaaaccucaucucuacuaauaauacaaaaauuagcuaggcaugguggugggugccuguaaucccagcuacuugggaggcugaggcaggagaaucacuugaacccgggacgagaagguugcagugggccgauaucgugccacugcacucuagccuggacaaaaaagcaagacuccaucucaaaaguaaaauaaaauauaaaacuccaaccugacuccucccccucaccaguguaaucuuggugccucuaauucuguucaauguuucccuuuuccauuguacccaucaccuuuuaauauaacauauaacauauuuauuaaauauaagcucuggcauggcacaguggcucacuugagaccagaaaauucaagaccagccugggcaacaugguuaaaaccccaucucuacuaaaaauacacaaaaaauuagcugggugcaguggcacaucccuauagucccagcuauucaucaggaggcugaugugggggaucucuugagccugggagaucaaggcugcaaaauuaacuggguaugguggcacacgccuauagucucagcuauucaucaggaggcugauguggaggaucucuugagcgugggagaucgaggcugcagaaagcugugaucaugccaccgugcuccagcccgggcaaaagagcaacaacuugucucaaaaaaaaaaaaaaaguauauauguguguguguaugcauauauaagcucucugaaggcaaagaucuuucugggacacaagguagcugcuucaauggaacaaugaaauggaaaaugcuguggcagucucugaugguuaacaaagaaauuaaggcauauuugucucaaggcauggaauuaaaguucgggcuuucugugaugugcaacuuaucccuagagaacugagaguucuaaaaugucauaucagacugaaucugccagaugcuggauucuaacaaccauuaaauucauaccacuaccauguuugaaaacuuucaggacuuacuuuaucuuugguauuaagaaguuacuuccuauguguuuagguaggcgcuuuuuaaaauuuaguuaagcacaguuaccucauuaauuuaaggauguguuucucucuaguucuggaaaauuuaucuaaaugguuacucuaaauguaguucucacucuguucucuuuuaaaaaauacauaauagaaaaacaauggauccuauagcuauccaacaugucaaaacuuuucuuccuucuguuuaucuuuuugugcuucaccuuagaagaaaucuuuccgcuauaucuuucagcauacucauuuccucuccaauaguauuuauuuugccauucaaucaacccaucuauugagguuuuguuuuguuauuuaggauacaauauccuuauguaucucccugaauaucaaucauacuucacauggucuacacucacugcucuacccaggcagauaccuuuauacuugcugccugguacagugcaacaggcagaaugcuaaggucaucauccguaucugucacuuccaaaauuaaagcccacacagucauuuccuguggcccuuggcuugcuucuuugaucugauccuaucugcuuuuucgguuuuucagaaacuucacuuagcuuccaauccacuaagggcaccuauuuuuauauuccaguguuauuucuguuaacacaaaugcuuuguuuaaaaaaaaaagggggggggcugaauaaaacaaaaaaaacccuaauauuauagaauaauaauagguuugcacuuuuuauuuuuuauuuuuuuuuuugagacagaaucucacucuuucauccaggcuggagugcaguggugcgaucucggcucacugcaaucuccaccuccccaauucaagcgauucuccugccucggccucccuaguagcugggauuacaggcacccgccaccaugccuggcuaauuuuuguauuuuuaguagagaugggguuucaccauguuggccaggcuggucuugaacuccugaccucaagugauccgccugccucagccucccaaggugcugggauuacaggcaugagccacugagcccagccaauuuuauuuauuuuuaaagacagggucuugcucuguugccuaggcuggagugcagggucauggucauagcucaccguaaucuccaauuccuaggcucaagcaauccccuauucucagccucccaaagugcuagcaaggcauaagccaccuugcccagccccagauuugcuuuaaaaaaaaaaaaaaaauuuuauuaagguguaauccucccacucuucguauggacuuuaaugguuuucuguaaauuuauaguugugcaacugucaccacaauccagcuuagagcccuccaacacccacaaaagcugucuugcaccaguuugcaaucaauuccccuucucucagcccuugaaaucacuguuugucuccacacuuuuucccuuuuuagaaauuucauauaaaugaaauuagacauuauauagucuuuuguaugucuuacacuuggcauaauguuucuacuauucauccauguugcuucauggaucaguacgccaugaucuuuuuacugcugaguagcauuuuauuauacaacuauaacacauuuuguuuauccauuugucagaugauagacauuucaauuguuuccaguuuugggcaauuaugaacaauacugccauaaacauuuguuuacauguuuuauguuaacauaaauuuucauuucucuggaaugaauaccuaagagugggauugcugggucauguacuaggaguugaaccuacaagaaauuaccaaacuguuuaucauguggcacacagcauuuugcaugcucaucauugauauucauaggaauucccuaaugacugacacuguguacuuuuuaugugcuuauuagaccuaucuucuuaaggguaauuccuauccaaauuuuuugccuaucuuccaauuggaguauuuguuuacuuacugaguuguauguucuuuauauacauagucuggauaugaguccuuugaugacacgugauuuguaaacaccuauaacuuacacuggauuuaggucuaccuuccuaacccaguguuuuaccacguaccacuauucuuggacuuagugaaugacucauucguaaccauaauauccuacauuggcucugaccauggaagucauuuuacacaaaagaaaugaagaaacaggcuuacuuccauaaaauucacugaucuuaccaugcgcuaucaugcaaaagauguuggccuacuggacuuaguuuuuuuguguggguggcaacacuuuguggguuugguacuaucuuacacgauguaguauaugcuccaaauuagaaaccaauauauggugguuuuucccauaacuggaauacauaaaccuaggagucagguaaaggaaauaagagagcucaucuacuacuaccuacugacauauucacacaaguuuugcuucccauacucacaacuucggccucuacuaaauguggaagauuuauaucccaagugaacacaacaacaauuugacuggacuaaaaguugagacagcccccuggccauuuugaguuucucaugucacugaaucagcaagcaaagaggagguuacaguacuggcugcaaugacugaccccaguuauaaaggguaaauaaaaugaauacuacauuacuacauaguaggaacaaagaggauuauguugggaaaccagauuauacccacuguguuaguuucagagggaugcuauaacaaaaugccacaaauuugguaaaugaaaagguauuuauucucucaguuuuagagaacagaacuccaaaaucaaagugucaggagaaccauucacccugcagaggcucuaggggaagacuccauuccuugccugucaugcuucuaaagcuucuaccuugcagcugcaucauuccaaucucugccuccaucuucaugauuuucaccucuucucugcguaucucucugcuguguaucucugugaagggucacuuacuggauuuagggcccauucagacaacugaggaugaucucaucucaaaaauccuuacauaugcaaauacccuuuuuucaaguaaggucacauucaccaauaagguuaauuuacagagauuagaguauggaaauaucuuuuugggaaccaccauucaacccacuauaggcaccauuuaguauuuccauacucagagagagaaauuuaauacagacaagacuacuaaggguucaaacccuucagaaaugaaggucuggguuauuuuaugagguaaauacauucacaaccagccaggguauuggcugagaacagaggaaauaagaaauggguagugauuagcuauagauacauauuucuuccuugcuccacguacauauuuauaaauauuuaccagauguugaaauaacuaccaauuuauuuuuuuccuuucauuugacuacuauaagguauauugguggugguuaacguuacuguucauucuuuagauuacagaccauaacagggaaaagugugacuauacucucugaacuaaaagauuuaugaacaucauuuagaaauagguauagugacuggugggacuuugggucucccaaauauggggaaagggcaaaugcaacacauacuggugcaggagcuaguuguauuacaucaggcagaagcaugauauuguugcuacuguuguuugguuguguaagugcauaugggugcugaguugacaaagggguaggcugugcucuauuaucuguuaaugaacaucauuuucauguauucauauacucccuucugugaagacaagccuacauuuugcaggauccauugccaguaguacaccagacuauauauaaccaugauauaugaaauauaugaaagguauaagagaaagaaaaaugauuuuccccucugguggcagcuuugggcaggcuugaggcauccacagauagcauaaguaggguuuugccaccacuucuaagcaucuuccaaagaauccaaucucacuuaguauuguaugcagcuaacaucuuuaacagcagcauccugugucuccugggcguccucuugaauaauucacuuggguccugauaguagcaguagcuucucagguuucugagcacugccauaggcagacagcugaaaucguuuccaagggcuuuaugcaguuuugaauuuuuuaaaacucugaagcaaucugaaacuuauaggaaaacuccaaguauacaaagaaauuuucuuuaccuaguuugauuucagaauaaguugcugaacagauguuccuuuccuccaaauaguuuguuguuuuauaaaaugucccucaauuaggguuugugacuuuccucauuugagauucagguuauccaccuguguaccaaaaaguggugccauguucuucuaauuguauacuauucuggcacauaauuuugauuuuguuucauuucuuucuuuuuuuuaagauauaaagucucgcuauguuguccaggcuggucuuaaacuccugggcucaagugauccucuugccuccgccuccugaauaucuggaacuuacacaccagcacacccaacuaauugauuuguuucauuucuaaugaugcucauuuuaucuucaucgagauggugucaggauucucugcugaaaguuagucuuuuccguuuguaauuaauaaguguuuaaugagggaguuaaguagaaaugauauaagcauuccaauccucauccuuuccauuuauucauuuauuuauuuauaccaauauggaugcaguaucuccuauuuuauuuaaugagguuauauguuacuguaauuuauuuugaggcuaggcacaguaguuuaugcuuguaaucccagagcuuugggaggcagaggcaggaaaaucacuugaggccaggaauuagagaccagccugagcaagacagcaagacacugucucuacaaaaaaauuuauuuuuuaaauuagcuacacaugguggugugcaucuguaguccuagcuacucgggaugcugaggcaggaggaucccuuuagccuaggaguucaagguuacagugaacuaugaccagccacugcauuccagccuggugacagaaugagacccugucuuuuaaaauaaaauuuagaaauauauagauauauauagauacauaucuauauaucuauauuuuauauacauguuuaauuuuaacauucuguaaauauagaacauauucucucucuauauaaagcuacauauagaucuaucuagauagaucuauauauauauaugucucugacagcuagguaugaucaauccuacuggaguaaucaauagauuggaguaaucaaucuauauauagauauagauaucuauauaaacauauagacauauauauaucugagagcuagguaugaucaauccuacuggaguaaucauugauccaaggcacuuucagugagaguuaagaaauaucaaguuucuauacaugcauacacauacacacacacacacacacacacacacacacguccauauuuacucagcuauuaucaugaguucacaaagauacccauaacuccaauccaauaacaacacaagguacaguuuaguuuucuccuuuuccauauuugaaacuuccucaucugacaaugagaaacuugguacucauuacacguaugucuugaucauuuucccauauggaaccaaucgcucacugccacuaccaccacuaugcuguacccuuguagccaccaaugucaggccaacaugggcaucccuucuuauccugccugggcucuaacacccuugacugggcucaugccacucacuauacagaaauucucuuuacccucugugguuauaaacaccauucuuggccacugcuucucucccacccacaaugugguacccuauuccacuuuuagauuuccugaaagucagcaguggucuucuugaccuucacugcccaguccuuucaauaguaauguacaucucucauucccuacauucugauucuauucaaaauacuuagaauagcuacuauuaaucaaauccugacagacacagucauuagccauuauuuaagcauugauggaaaaaacuauuuuuaauauucaacuaaaguuugcuuccuuagauucaagaagcaaaugaagcccauguaaaauaaauaaaucuauaccugcaucuuuuuuauguaaaauuuacuuuacuuuaggcaagggcacaaaaaaagcccugaaucaaugaggaaaagcaggugugugugugugucuacacaugugcaggaaaugaauaauacaaaacauacuggacaucuuauuuugaucugcucaauaucuucuccacugcuuuuacuaaaagaaucccaauuuuuuucuugcaguauuacuccuccccauaauagugucucaguagauuuaugaauaaacgugucucucaagugauccaaauuuucaauugucuuaaauaguuggaguuauguuacugacaacaguacugcagagacuucuugcuacgucaauaauuggaaggguacuaguccuugcccauaaaaccugguuguucaugcuuuugauuuuaugaccacacuuucuguugcuuacaauuaagggacaccucauaauaugcucaguuugugaaaagugaguauauuuauaagcccaggagucccucaaaaaaacaaaagaauauuauaucucacaaaagaaucaaaguaguacaugcagucuggauagacuacagacaacacuaacuuaaggaaaccuguaauuuuccauuucaauaagauuucugccagugccaauacauuaaaaaaaaaaaaaguauugucaauccauaaaagcaaaaacccacaaaggggccaggagcaguggcucaugccuauaaucccaguacuuuguggggccaagacagcaaaucacaugaggucaggaguucgagaccagcauggccaacauggcaaaacccugucucuacuaaaaauacaaaaauuagccuagcgugguggggcaugccuguaguuccagcuacuugggaagcugaggcaggagaauugcuugaaccuaggaggcagagguugcugugagccgagauugcaccacugcacuccagccugggcgacagagcaagauuuugucucauacacacacacacacacacacacacacacacacaaagggagaacauaacucaacagaacuguagugaacugccugaggucauucaccauuaugcaccuagaacacuugaaaucuauuacaacucuuucaucuaaucauuuuauuaauaucauauaacucugauaauugucaggucuucaucuuuauccuagaucaauuugaaaagcaucacuuuuuuacccgaauaaaaauuuccaauucaguuuuucuucuuuuuucaauuuucuccgccucaauuuggcaaguaugacaaauguacagaugguugacagcugguccuccaccauaccuaaagcaugaaaaauuuaagaauuaauguucuaggaaguuuguuucuaacauuuaagucaguggccaaauacccaguaaaaauaaauccucuuaauaaaauucucaaaguaauauaaaaaucaaaaaucauauaaggacuuguuauuauguuuauuaaggucagugacuuuaucaguuuauugcuuaaccugcuuuaucuauauuucaacuuucccuuauuucugcuccaaaauguuagagccaacaacaaacuaaaagaagugguuucaaaaaguaucauacaacauauaaaucuuaguuacacaucacagucauagucaaguuuucaucagaugaaggccuccccuggccucucaaguaagaagcauucaauguaugaauuauuuuuaauauuuaauuaaagaaaacauaauuaguaggaaaacugugguggaaaauguuuuaaaauaaaggucaggaguugcgagaccaaccuggccaauguggugaaaccccgucucuauuaaaaauauaaacauuagccaggcauggugaugugugccuguaaucccagguacuugggagggugaggcacaaaaucgcuugaaacugggaggcagagguugcagugagcugagauugcaccacugcacucccgacugggcgacagagcgagacuccaucuuaaaauuuuaaaguuuacgauguuaaggccaggcccagugaugcaugccuguaaucccaauacuuuggacuuugggaggccaaagcagccacauggcuugagcccaggaguucaagaucagcccaggaguucaagaucagcccaggcaacauggcaaaaccccaucucuacaaaaaacaccccaaaauuagccagacauggugaugcacgccugugaucccagcuacuaggcaggcugaagugagaggaccacuggagccuaggaggucgacgcugcaguaagccaagaucgugccacugcacuccagccugguugauggagcaagaccuugucucaaaaaaaaagaaaaaaaaauuuacaauuuaagaguaagauacucaauugugugaguauauacauauguaaaauuuuaguguggggauaugcaaaguauuuuaaacaagguacuuaaauuaccacagcauaccuucacagauagauaauuagaaaaaauuaaaauuaauuaucuagacuaugccacaguagcuacaaagucuuccuacucacacuuuagaaugaauaaguaagggaaaagaauaaacacauagcacaaggagcaucucugaaauaauccaaaccccuuuuaaccaguuuaaccgacuuucacaacacuguauggucugauuuaaaaaacaaaccugcuauauagguuaucccaaauguucugaggcagcaucaaaaccaggucuucaauauaaccagcuuuucuuggaggaacaccuaaaaaaauauauaaacauaucuguuucaugcuuuuaauuauauuccuuucaaacauuaaacucauuuuuuuuuuaacaguaacuaaaugacagaucaaucaucauuguuuuuuuaaguggaagggucuuguucugucacccaguccagagagugcaguggcaugaucauggcucacagcagccucaaaauuccugggcucaaggcauccucccaccccagcguccugaguagcugggacuacaggcaugcuucaacacacccagcuaacuuuucuuuuuuuuuuuuuuuuuuuuguagaaacaggcucucauuauguugcccaggcuggucucaaacucaugaccucaagugauccuccugcuuuggccucccaaagugcugagcuuagaggcaugagccauugugucuggccauuuuuuugagucaaggucucacucugucacccaggcuggagugcagcagcaugaccauggcucacugcaaccucaaacucuagggcucaaggaguccuccugccucagccuccugagacaaugagauuacaggugugagccacugcacccagcucaaucauuauucuuacacucucucucccaagaacgguaauuauaaagcauuuuuggugauuguguuuccucaagaugaacauacaccuuaaaauuucuauguccaauacagguaucccuaucccuucugguuucacuacaaacauaauuaccaugaauaucccaucuucaaccuugaaguuuaauuggcaucacacaaagguccuauuuauuguagaaauaaacauuaacacagccaaucucacaagggccaaaguuauauuuaauuaugaggcuuuuuuuucuuaaaucccagauacauuuccauacuugggaaaaaagccagcuauucauuuagacaaugggguuaagaaccaccaauauagucgauagauaaaaucaccagcacaggaaugccucagguaggaaaaaugauguauaauagaggagcucacuguaauguaaacagcuguuuauguaucuuacucuacuaugaaauuagagcuuucacagaagaaaaaggauuuuuaguguccuuaggcacuagcaaaaaguuuagaaagcauguacucaguaaauauauguucaauaaagaagcuagagauuaccuacaauuaaaaaggaagggugaauuucugaaaccauauggaauuaaaacacauuaaguuugaaugcagguggggaaaugggaaauaagugggagaggaaaauucuuggcucuccuaauuugcaaauuauuuuacagcaaacuucuacuaccgguuugcauuacaggaguucuuaccuccaugaauacaaagaaagucauuauuugaaauagggccagguucggcaaaggucuuaaauuuauuaagccacugucgagaaauauaaaacugaaggaggcuugguuccauuauguucaauaaauuugauauccuucuccucucuuuuugugccucuucgcugcucuuccuauuaaggacaaugauuaguuaaauucaauaugcauuuuacuacauuacuaguagauggauuuuucuucuuauuagacuuaacacacauauuaacacuaucuuuauuaggucuugggaauuucaagagaaauauacuuuguauuauccaccaaauacauuauauacucauagggaugaaacuguaucuuaccuacagguauccacauaacuacuggaacacaguaagcauucaaauguuuguuaauaagaucaagcuaaauaauuaaucugcuucuguuucagaagcuagcaucuucuuuuauaagaugcuaaaaaaaaacaaauauuuuuauaguaauacuuucauuauuagcuacuuugggagaaaauuugguacuuaauucagaccaucaaugccuaauuuuuaaauuaaaccuaaucuuucuuuuucuuuuuuuuucagauggcgucucacucuguugccgaggcuggagugcaguggcgcaaucuaggcucacugcaacccccacccgccggguucaagcgauucuccugccucagccuccccaguagcugggauuacaggcaccugccaccacaccugacuaauuuuuguauuuuuaguagagacaggguuucaccaucuuggccaggcuggucuugaacuccugaccucgugauccacccgccuuggccucccaaagugcugggauuacaggccugagccacugugcccggcacuaaaauuaaucuuucuaaaacaaaauauaucccuuugcucuucaaguaaaugauuuagcauuuucugaacaaagaaucauucuacauauacagccuuucacuguauuuuacuguaaugaaauaggaggaaaacaauuccuaaucuugacucagcaauccauuagaaugucuuagaagucacugauaagcccaaaaugugagagauguccuuucgcaucuacacuuauuuccauuaccuauagaaaagaacguaagcuucugcauuuuguacaguagauucugaaacuucagugacacucugaucaucaaauucauaccagagauuauuuagauuguuucggcaguaggcuauauaguguccaccugaauuugagggaaaagaaaucauuacaguaauacaaaaacaacagaagaaaggaggauaaacuuuuuauauuuccagugccuagcacaguagcuggaauauaggaagaauuaugcuuguauuuuuuuuucaguuugcacgcuugccaccauuccuucaucaccugacgacagaacauguaauuuuuuaaauuuuuuuauuuuuuaauagacacagucuugcucuguugcccaagcuggcguucagugaagggaucacagcucacugcagccucaaauuucugggcucaagcuauccucuugccucagccuccugaguaauuggaacuacaggugcacaucaccacacccagcuaauuuauuuuuguuuuuuuacagauggggucuugcuauguuguccaggcuguucucaaacuccgagccucaagugauccuucugccucagccuccaaaggugcugggauuacaggcaugagucauuaacaccugcgggggucugucccacagacccugacccaaugacggaugaauaaaguacacugacacagauauucugcuuugccagucuggcuaagcaucugggccacuuacagacuccaagaacagugcuguaaacaguugcagacagcagccucgacgagccagugagacucgcauuuauucaguacagauuaauugacaaagccuugagucaacaccacuagaggguaauugauauugcaaaccuccccaguagaaagcaauuaagaacccgguaaaucaaagguuagucuuaggaccacauggguaaacaagcuagugagauaaacuccccacauuccuuuucuaaucuaauuuacuuaacuaaggggacaaggcugccuucagccaaguacuguauguaaaaacucccagcccuccagaaggguuuguguauauuuucuaaaacuaaaauuuuucccaccagccugacugcgcccccacaaacacccagcuauuagaaaacauauucuuuuuuuucuuuuuuuuuuuuuugacauggaguuuugcucuuguugcccaggcuggagugcaauggugcaaucucagcucacugcaaccuccaccuuccagguucaagcgauucuccugucucagccucccgaguagcugggauuacaggcgccugccaucaugcuuggcuaauuuuuuguauuuuuaguagagacgggguuucacaaugucggccagacuggucacgaacuccugacuucagaugauccaccugccuuggccucccagugcugggauuacagguaugagccaccacacccagcuagaacacauaaucuuaaaaaauccaguauaaaaaucauguuagggccaggcaugguggcucacaccuguaaucccaccacuucgggaggccgaggcgggcagaucacgaggucaggagaucgagaccauccuggcuaacacggugaaaccccgucuccacuaaaaauacaaaaaaauuagcugggcgugguggcaggcgccuguagucccagcuacuugggaggcugaggcaggagaauggcgugaaccugggaggcggugguugcagugagccaagaucgcgccacugcacuccagccugggcaacagagugagacucugucuccaaaaaaaaaaaaaaaaucauguuaaugccuuauuaacuguauacaauuuucaauauuggaaacaucauaguaaaaauauuuaauugcauaaaauuaucugacauguuuuuaauaauuagcaguaacaucuguuuuuaacauuuuuucuuuuauucagauauuauuuaaaagauuaauuaggauguuuauuuauuuauuuuguagagaugggguuucacuaugcugcccaagcuggucucaaacuccuggcuuuaauuaagugauucucccaccucauucucccaaaaggcugguauuacagguaugagccaccacgcccaggcuuauuuuaauuuuuuuuuaaaucuaggaacaacuguuaaaccuauauacuuacuacuugcaguuccaugauggcaaaugacugacagaagaucauaugucacaauuugagcuggacuauccuuagcaagaaauggcugaagauccaagccuucuagcggaaaugaaacauggguacugauuuugguggaaaacauuaguucaugucugaaucuuuuaagguggaugcacaaaaucuaaaaaagaauaaaauucaaaacuaauuugucaauacagaaaacaaaaagcauuauaacagguaaaacuuaguaacauuuuuauucaacaagcaagaaacugagguguucaaucaaauuacaauuaugaaguuauuuagauuuuuauuucguuuuaaaugcuagauaaagcagucuauucaauauauacugaagugucaagguuaaguauugaucugcaauuauaaccugcuuccagagauguuaaaaauauggaaauggugaaacaugguacuuucuaaguucacugcuauuuguuuuucuaauuuuacacuuuagaccuggcaagauccugcaaguaugauuaaacuuuguucaacacagcacauuguuaaagggcacuuacgguauuuaacucaauauuuuaaaacugaauaaucuuaaaaaggcaugcauagcaaucauucaauucuucaaccaagcaaagagaauuuauuacuacauuuuguuacauuaauacuuuauguuccuaccacacaauauaaguugaauuaaaauaaugcccauaccucaggaaaguuuuguacuuuacaaaacuucacuccauuucucaaccuaaggggagaaaagagaaaaucaauuagucuacaaaaaaacuuaguauauuuaaauuugcaacaaaaaucuuuuagaaaaugcagagauccagccuggcaaacauggugaaaucccgucucuacuaaaaauacaaaauuagccaggcaugguggcacaugccuguagucccagauacucaggaggcugaggcaggagaaucacuugaacccgggacacggaguuugcagagagccaagaucgcaccauuguacuccagccugggcuagagugagacccugccucaaaaaaaaaaaaaaaaaaagaaagaaagaaagaaaaugcagagacaaaagauaucagacuagaaauacuugccacugaauuacguuacauguauacauuaaauaucuuaaucaaaacacuggagucccuuauuguaaaaaauaauuuaaacuggccaggcgcaguggcucacgccuguaaucucagcacuuugggaggccaaggcgggccgaucauaaggucaggagauggagaccauccuggccaacauggugaaaccccaugucuacuaaaauacaaaaaauuagccgggcaugguggcgcacgccuguagucccagcuauucaugaggcugaggcagaggaaucacuugaacccaggaggcagaggcugcagugagucaauaucgugccacugcacuccagccuggggacagagcaagacuccaucucaaaaaauaacaauaguaauuuaaaccaagauaucgguaaucaaaaauuuagagagcuguauaacucuuugaugaaaauuguuuuguuuuaacaaaugugcuacugucugugguguggcuaugccuuuaaaacaucuagauauuaaguaaaaccagauaaagcaaaaccucaguuuuauaaaauuuguaguucaagucaacauaucaaacucuuggccaggcaccguggcucacgccuauaaucccagcauuuugggaggccaaggugggcagaucaccugaggucaggaguuuaagaccagccugaccaauauggcaaaaccccaucucaacuaaaaauacaaaaauuagcugggugugguggcgggcaccuguaaucccagcuacucaagaggcugaggcagggaaaauugcuugaacccagaaggcagagguugcagugagccgagaucacaccacugcacuccagccugggcgacagagcaaggcucccucucaagaaaaaaaaaaaaaaaaaagucuuggccggacacaguggcucacgcuuguaaucucagcauuuugggaggccaauguuggcaaaucaugcaagccaaggaguucacaaacagccugggcaacaugacaaaaccccauuucuacaaaaaauacaaauuagccaggcaugguggcaugcaucuguagucccagcuacuugagaggcugaggcaggaggaucgcuugugcccaggaagcugagccugcaaagagcuguaaucaugcuacugaaucuucagccuuggcgacagaaugagacuaugucucaaaugaaaaaaaaaaaaaaaaaaaaaaaaaaaaaccuuuauucuuacauguggaaaaaaagauaaaggaugguuauuauuauauaaucaaaauuaauauacauuugacagaucucuacuuugaauauggagguagaugcaagguucuuuuccaucuucacuguuaucuuuuucuuaguaugcuuugcuuuacaaggaacaauccccuuccaagccaacuuccuuuucagcagucagcuagggcuucaagaacaaagugauacuuucuccaaaaguagaagucagcuuuuucaucuuuaucaaccaaauaguauaccauuccuuucugucaugucaugaucaguugcagaucaauguuuccuuuagguuacugccaagaacuagaagucuguauuaucccagaucuuauuagcaagccguugcauuccuauuacagagauugagaagaaauuuccaguucacuuugccucacaaauaguugcuuuucaccaagucuuccaacacuuuuuucugacuuaccacuaagaagcauuaaaagucuaaauugauuacaagacagaaaaaggcagcugguaguagauguaaacaaaaucagacuuuagcugucuuucucguaugccauuguuaacagcagauaacaucgaagucgguauaaccuuuaggaauuuuauguggauaugaaacuuuguaccuuucacuuccugaaucuagccuguuaaaaugguaauucagaagaaaauauugccuuauuuaggaaaacguuuuaugcaaaaucacauacagauuucaucccucaaaauauacucucucacaucuuaauaagccuauuaaauuugucaaauuuuuaccucacauuuguuucacaaaacagcuaaucucuauuauuacuaggauaaaccuuucuggccuacauuuuucuaaauacaguggcaaauuuaacuccacauacccaauucuaaaaaccaagaaaaauacacaacaugcaauuaaaagcacugucaaugucacuuacuuuuugcauuuuucacaacuguacauauugucaccugcaaauaaaacagaucuggcauugguuucaaauuaacagcaaauugcuuauuaugguccuguaauuauuugauuuugccccaugcugaccucccagcacagaaaaacaagguuccauuuuuuuaaucuaugcucaugaaucagguuacuguuuaccuuccccucccuuaacuccugccaacauugaagaccuaccucaaauaauaucuuuuccauuuauucauugaacaaaacuuacugacugccugucauauguccaagcaaggugcuagacacacaaaaauagugaaugaccuuaaaugauauggaguaguucacaauuacagacacacaaauaaguccauuauuuugguugaguuugcccuucuauggaucucagaacagcuuuaaaacauuucacuuaucauuugucuuauacuacaggaauucacaugaauuccuucaggaugugauuuuucuuguuauauuuauauuaucaagguagacacuaaccgaaugccaauaugugaauguacuauuaagcugucuuaaaacugagcuuuuaugaauacacuuuauuauuuagucccacuaguauuuuagauuuaccuacaaaaauuuagccauagauauuauauuucuuaccuuuuaguucaucucuggcaaagaaggcagcaagacaaucuugcaagguuacuacuggaccccaaaaccagcuagggacacaugagacaacaaaccugaaacaucauugauagaaaaaaaaggaaguguucugccaguacagcagaaacagcagguuuaacaaucauguaauacaaagaaaauaaauacauaccucuucacauauuccaugaaaaaagcuauccacccuuguggagcauaugcuucgccacaugauccugcuuugacuauagaaguuggaugacuugaugaaugcagcuuagcaaggucuuccuugccaggaauuggcaaggacagaucuugaaaggucucgaggguuacagacaccuaaaauuguuuuguguuuuaaaaaugggaugaacauaaugcaguaaaacauuuccaagguuagauuuuagacucuaaagaucaaagcauguuuaaauaagcaaaaaaaacaaaaaacaaaaaaaaacacgcaaauugaacugcuuucauagucauaauagcaaaaaaaaaaacaaaaacaaaaaacaaaacacacuugcucuguaccagguaucuucacguaaguccugugcaguaguauuagcauccccauuacaaucacagacacugcagcauuaaacaccccaaauccagccacugcaucuugagguccaaacucuuaagcacuauuguauuuauuuuugaaaauugaccuuugaugguaguuuuaaaauauuuuuuuaaaagggugagacaaaaucuggcaucuaauuuuaaauagcuaaaaacaugccugauaauuccacuuaaauauuuaguaccaaaauaaccuacauuaaaacgacccgauugaaaguucuuagauuugacuugagauucuaacacaauaauugaaaucuucuuuuuguuuuugagauguuauuucauauucaucauugcacuaaaguaaaacuguacuuaagaaaagcucaaagaaacuuugaagaaguguuauuaaaaaauucaugaugauuuuaauguaugcuuuguuauugucuaugaauuugauacuaccuuuaguaucugagucccauccuaaacauggaaaaauauuuacaaaccauauaugaccaaauguaagagauacauucacagcuuuguaccugugaauaucaacagauucccaguauacaaauuucaucagccugggagaauaugcagguguuaccaauucuuguugcugagcaacuucucaccuuuauauguaaccaaaauagaugacgaaggauaauaugugccuguccaaugaugggucaccauccuuuaaacaggaugcugcuacuuccaaaaaaaauucuacaccuagaaucaaauuuguguugauguaaacacaauaaaugcauguaugcucaucaauagcaaagagaaggaauuaaacuuuucacaucaucuugucacauuuuuaaaaaucauuugacacgaauuuucuguguauucuaauacccucauacucacccugucacaagucagacacugcacugaacuaaugauuguuccaucaaauaugucugaaauaacacuucuguauuucuugugcuguuuuuuucucuuuggagaugcagacugagcuaggauugaaaaacauuaaaaaaaaaucaaagcagcuccuuuaacauuuuucucuggaaucuuuuuuugucuugucaaucuuacuuguauaugaucucuagaauccuuaaacuguaaaaauuacuguguugaaaauuuucaaaauacucuucaaaagagcauaaguauuaaaaaaauaaaagaaacuaagcagacaaggcuuaagauauuuguuguuuuuuuuuguuuuuuuguuuugagguggagucucgcacuguugcccacacuggagugcaguggugcgaucucggcucacugccaaguucugccucccggguucaugccauucuccuaccuuagccucccaaguagcugggacuacaggcgcccaccaccacgcccagcuauuuuuuuguauuuuuaguagagacaggguuucaccauguuagccaggauagucucgaucuccugaccucaugauccacccacuucagccucccaaaguacugagauuacaggcgugagccaccgcacccagccuguuuuuuuuuuuaaaguauaaaugauccuuggccaccauaaauguacauaugagaaaaugaacaaaauucuaaauuagcacaaaaccacaaaugcuucaucacugggauguuuacuuaaauguuuuacaagucaaaagaagaggggaagagguuagaaagugagggaaagaugaugaaagucaucaucaagcuaaagaugaaauagaagggguucggucucccuauccugacuugagagcaauucuguuuucacuuauuuguuuuugucuccagguaaggcuuuauuugaagaaaagauucuauuauuuaaaguuuuuaagaguucuuuauauauuucuggauacauguccuuugcuagcuauaugauuuauaaauacauccaaccuuaucuuuccauucucugaauguccuuugucaacaaaaaucuuuaauuuuuuucuuuaauggaucaugcuuuuaaugucuuuaagaacucuuugucuaacccaaggccaugaagacuuucuccuauguuuucuucuaagaaaacauaauacuggaacucccauauauaccuggaaggaauacuaaaugguagacacucugguaaaaagucuggcaguuuaauacaacuauaagcauuaaacaaacauaaaacccaguaaccccacuucuagguauuuguccuagacaaaugaaaaaauguucuuacaaaaaccuauacauaaauuuuagagcaacauuauucauaauugccaaaaauuggaaacaauucaaaaguccaccaguagguaaauaaacagugguauacccauaaaaaaugagauauuaggccgggcaugguggcucaugccuguaauucuaacacuuugggaggcagagguggggagaucacaaggucaggaguucgagaccagcauggcccaucucuacuaaaaauacaaaaaauuagccaggcaugguggcgugcaccuguagucccagcuacucgggaggcugaggcaggagaacugcuugaaccuggcaggcagagguugcagugggccaagauugcaccacuguacuccagccugggcgacagugagacuccaucucaaaacaaaacaaaaaaaaagaaacauuacuugguaguaaaaggaacaaacuauucagacacgcaguaacauaucugaauuucaaaugcauuauccugagaggcaaaccuguuucaaaagacuacauaugaaaagauuuaaaaaaaucaaaagacuacauacuauaugauuucauuuauaugacauucuaggaaaaggcaaaacaauaagaaaagaggaucaagggugccagaacauaggaauagagaaaugaucugauuacaaaguaguacuaugcaggaauucuuugggguguuagagcuguucuguauucuguuugugguggugguaacaagaaucuaugcugcaaguguuaaaauucauaaagcucuauacaagaaaaagugaauucaacuguauguaaaauuuuaaaagcagaguaccaacacacaaaauuuuuaaucaugucuauguaaaauuaugcuaucaauuuuaaaagaucaaaucauauuucauaauuaacacuuuaaauuaucaaguaccaaaaccaucauuuuaaacuaagacccaaagcaaaagagacugaauaagagaaacguuuuaccuuuuuugugugguggugccaauccuggccacaaauugccugauuuaggagggcuugccgauaaacguggauuaacaccuucauuugauggaaggaucugugguguagacaggucauucgaauggacaucagugauauauucuguaagauuuaaaauuugcauuauuaccuuaaauaguaaaauuauucuaacuguccaauaauguuaaagguuucuuaauuugauauuuugaacacaaucauauuaacaaaugucaaguuaaauacuuaacaaagugcuuacuaagcaaaauaacaguaaucuucuacccagaaauccaacuaauuuuuguuuacuuguuuuuuugagacagagucucccucugucccccaggcugcagugcagaggugcgaucucagcucacugcaaccuccgcauccuggauucaagcgauucuucugccucagccucccaaguagcugagauuacaggcaugugccaccaggcccaccucauuuuuguauuuuuaguagagaugggguuucaccauuuuggccaggcuggucucaaaguccuggccucaagugauccacccacuuuggccucccaaaguguugggauuauaggcaugaaccaccgugcccaaucccaacuaauguuuauaacacacgacuauuacaggcaguuuaggaagugagcaguggaaauacaaagccaaagaggaucuuguuuguccaaauauagcauuaaaaaaaaaaaaagaggcuaggcuggguggcuaacgccuacaaucccaacacugggaggccaaggugggaagacugcuugagcccaggaguucaagaccaacugcgcaacaucaugagacccccaucucuacaaaaaaaucuaaaaauuagcugggcauggugguguacaccuguagugcuggcuacucaagaggcugaggugggaggaucacuugagcccaggagguugaggcuguggugagaugugaucaugccacugcacuccagccugggugacagaaugagacccuguuucaggaaaaaaaaaaaaaaagauauucaggacagguuuuuagaaguucuaaaaccaugugaaagaaaaaucgauuauucucccaaacuaacauaauaaucaaaaucaagaaauguagguauaaaguaaucauaaguuauuuuaucuuacuauaauaaaaaauacaccacuucaucaggaaagaaucuuuuuuuagaauuaaauuauaagaugaaucaagaaaauauaagagcuaccuugauuguuugcuuuggauuccuagugccuaacauauuccagggcaagggaaugugcucaguaacuauuugagugaagaaaagagaauuguucguaagagaucuggaaaggggauguacucagaaauuuuuccagauaaugcaaaaucauuuuucacacaggcauuucucaauauuucaaucaugacuaaaucagacugcauaauauugggagugaaaaaacaacucacucuaggacuuucugaagggaauaaaguuaaugagauuuagauggggaguuggcaauuuuuuccucuaacggaccagagaugaaguguuuuagguuugugugccuuacagacuucgccagauuuuuuucaucaagcccuuaaaacaccuaaaagcucagacuccugauuuaggucauccccuuguuacuauguguaagaacaaaccuguuacagagcaaucaaagaugaguaugucccuaaucaggcuuaacugggcuuuugacaagaaaagccuggacagcagucaaagcuaagucuuucaauacugauaccugacauauuuauucacuaacaacuucuacacaagaucaguauaauuaaggagccuaacacuccuagucuucccgauuagaaagcaucugugcacuuuacccaagugaaccacaagucuuccuauaguuaauaauauuuucaagaagaaauuuuggauucauucaaauaccuaaauaaauugcuuaguuacucucacucuucaguaauuacagaaaauaaacuuuuuuacauuacaugucugccacuuauuuuaagaucacauaauuugaaccucuaauggcccaauuuugugugcuuuggaaaacuacauaccacauuuuaagccaagauaaguuaacucuugaagagauaaauuacaaagcaauucaacuuucauuuggccacaugcucuuucucaaaggaacacugacuaguaucauggcauaaucuaucacagcagggcucacuauaguuaauucaacuucuacacuaaaacacaucugaugugacuccaaugacaacaaucuaaaucuacuaguguauauaauuagaaaauugcaauuuggguuauuugcuuuuuuccaggaucgcaacauaauuugcuuaaaauaaaagagaaaauucuggggagcccaauuuuuuagauuacugcaugacuacacaaaagacaucugaugaaauguuuacuucaaaaggaggauuaauuucuuauauaauuaaaugacccaaaaaauuccuuuuauccucggguucuauaauuuuaugacuaauacucacaugcaaauacugcuaaacuauaauucuaauuagaaauacccaaaguaacaauuauuuaaacacccaugucuacaaaugaaauacuaucauuuucaugaacaaacuacuaaauugucaccugaagcucugcuguguauuugcacuuugacaguuuccugguuguuuaagucgacuguuucagauauagagucucuaucuuuaucaaauucgccuucagaauuuacuuuauuaaucuuauugcacaucuucucuuuuugccaauccuuugacauuucugaauuguuuucaucauccugaauuaacauuguuguuucauuauuaucuucagaaaagcaucuagagccauuuucauuuucugcucuaucacuguugcuacaagauucacaagacugaaaaucuacauccgacuggcucuugucuucuuccauugucuccucagugguuaugguuugcggaucuucuucuacuuccaugacuugcucuuucaauucuucaugaagcaaauccauuaaacaucgaaggaauucuugagcauccuaauauaucagcaacauaauguuaaccacuucauuacauguguauauagaaacguaagggaaaauauacaaaaugucauuacaaacuuauauaugaagguacagcacuauauugagcaaauaccaguuuggagagcauaaggcacuagauaaaugagaugcauuaacuuccaaaaaguuauguaaauaaaaguuuucuuuuuuugagauggggucucauucuguuguccaagcuggaguguuguggcaugaccacagcucacuguagccucgaucccccaggcucaagcaauucucccaccucagucuccuaaguagcugggaccagaugcacgugccaccacaccugguugauacauauuucuaaauuauuuuuagaaaugaggucucccuauguuacccaggcuggucucaagcuccugggcuuaagcaauccgccuaccucggccuucugaagugcugggauuacaggcaugagccaucacgcccagccagauaaaaauuuuaaaaaacuaaagaugaucugaagaucaacuuccgcuggaugcaggggcuuaugcuuguaauccuaacacuucgggagaucaaggagggaggaucguuugagucaggaguucaagaccagccagggcaacauaaugagacauuaucucucuuaaaaaaaaaaaaaaaaaaaaggcugaguacagugccucaugccuguaauccaacacugugggaggccgaggaggguggauuaccugaggucaggaguucaagucuggcuuggccaacaugacgaaacccuaucucuacugaaaacacaaaaauuagcugggcgugguggcacacaucugcaaucccaguuacucagaaggcugaggcaggagaaucgcuugaauucgggagguggagguugcagugagccaagauugcaccacugcacuccagccugggcgauagagcaagacucugccucaaaaaaaagauaaagauaaaggaaaguugaaaaaauauaaacaauaaacaugaaaaaggguuacuauucuuggcaaaagaaagacacaaggagugaugaccccaaaagauaaguagacccaaaaaaaacauaauggcauuuuccaaauuuauuuagauuaaaauuacaaaugaaaagcaauaaacuaaccugcugagaauacccccgaaauguuggauuuacaguuuuaauuccuugaaacagaguaguaggcacaacagauccuggccugagcaagaaaacauuuuuaaagagcaauuuuuguuauuuuuaauuuucauuuuaaaaauuaacuaccaauaauucaaaguguuaaauaaauugaaaaguauguuucaaaaaaaucauucaaaacugccuaauauuauguuucacaggcacaucagaacaccuuauccuugauauuuuaagugauauuuuacugcuauccucccucaauuaaaugauuaugcuucaccccaugacuuuucaaaaaugcaaguuuccugaauaguucuaaaacaaaauuauuaacauauuacagcaaacuaugauccuaaugcuaaacuuuagaacaaauaaacauaagcaggaaaauauucauauaguauuuagggucugauuuuaucauugugagaauggcugcuccugaaugcaaaacucuaaaguuccaguaauagcagcuuuaacauuccaacacuauauacuauauccaaauacuuguagacuucuaugacaccuucaucugcuucuaaacuucuaugacaccuuacauucagcuucaaauguaacaugccugaaacaaagcugucucuaaucuaucucucuucuacuuuuuuccggcuccauaaauggaccugcaaccuuuaaauauuuauaauauucauuuaaaaguuuaauaaagaagaagaguauauuaaguuacauaccugcuuuuaugccacagcucugucauuaguuugagauaacuuuuacaaauggcagguuucuuaucuguucgagcuaguccuccacaaucaagaaaaaacugugucaaaggugggcuaauuuuaaaaagagaaaaauguuagaguggagucaaagcuaauacugauuauuucuagucauucaauuaacugacaacacauacauuccuuuagccguuauuucuuucuuugaucccucuuacagcuucacuuucauuccuucauaaagagcucaauccauucaaaucagauuuggccccagcauaucaagaguccuccaugcugccagauacacuuuucaguccccacucaguaacauuugccacagacaacuaugcccucacucuugaacaaacauucucaggacuauuguaaugcauuuuccuacuuuuccucuuuagcucuugaaacuccuuuucccucucuauugcucuuuuuggccucagacauguaaacguaaggauuccucgggacuugauccuaugacauuucccuauauacuuuuuuccccugggcgaucuaaaauuuucaaccauauuccaaugauggucaaauuuauauaaagucaaccaugucaucuaaauuucagauuuauaugaaaugcccaaacuaaacaggauaaaaauuuaacuuucaagugaaccugcacuuccuccagccuucuacauuccaucauuugguauuaauauuuguugguggcucaaguuagcaauuuauaaggaaguauagucugucugucgugaguuugauuagcuugagggaaucuccauaaaucuauuuauaggaaacugauuaggcaaaggaccaaauccugaccuacauaaaccaaaccuccuaugaaggcaguuagauaacuacuaagucaucucuuugccaaguguaaucuuuuuuuuuuuuuugguagagacagggucuuguuauguugcccaugcugguuccagaacuccuaggcuccucaagcaauccucccaccuuagccucccaaagugcuacaggcaugagccaccacacccagccaccaauaguguaaucguaucagccacaucuuuuucaaugaaaucagaggaauuacaaaguaaaucgguggaagcaguauugugcaguaauaaacaaaacaucuacaaaaacaaacauacacguaaaaaucucagacucagaauuuugucccugccaggcaugguuggucaugccuguaauuccaauacuuugggaggccaaggcaggacaugacucaaggacaggaguucaagaccagccugggcaacauagcgaaaacccaucucuacaaaaauuuuaaaacauuaucugggagcacuggcaugcaccuguggucguagcuacuuggcaggcugaggcaggaagaacccuugaacccaggaguucaaggcuucagugagccaugaucgcuccacuacacuccagccugggugacagaguaagacccugucucuaacuuaaaaaaaaaaaaaaaaaccagaauucugcuaguacuuacuagcugguuauaucggcaaaguuauuuaaacuucugugucugguuuucuuaucuguauaaaaauaacaauaguaucaaccuacaguucucuuaucacagguuuguacuguuaaacuuugaaucuccucucccuuucucuaguuacucuacccacauccuaucaaucaaucauccuccuaaaaguguuuaucuccaauuccuucacucuuuuccuaccacccuagaugauguaaacuaccacuacuucuugccuaaaucauuaucauagucuccuagcuggucuuucaaauuccacucucuucccccuccaauucacuguccacauagcaaccacaguaauauuuuaaaaauauaagagagauuauuagcuacccuacuacacaaacacuucaaugguaucguacuacuaugagaauaaagaccuacaucuuuaauguggucuacauaaccuagacccaugucauucagcccuaugauuacuguaccccgucacacagauuuucuuccaguuccucaaaugugucaagcucuuucccaucccaaggcugcuuacaaggagcauucugcuaggaaugcucuccccauccuuucaaacaaccaaccgauacucauuccucaaguuucagaguaaaugucucuucuuuuuuuuuuuuuuuuuuuuuuuugacggagucucacacugucaccugggcuagagugcaauggcaugaccuaggcucauugcaaccuccaccuccaggguuuacacaauucuccugccucagccucucgaguagcugggauuacaggcacacaccaccacacccggcuaauuuuuuguauuuuuaguagagacaggguuucacuauguuggccaggcuggucucgaacuccugaccucaugauccacccgccucagccucccaaagugcugggauuacaggcaugaaccaccacgccuggccuaaaugucucuucuuuaacguccgagcacaguggcccaugccuauaaucccagcacuuugggaggcugaggcaugcgaaucacuugaacccaggaguugaaaaccagccuaggcaacaaggugaaaccccaucucuacaaaaaauuuaaaaauuagucagguuugguggcaugugccuguagucucagcuacucaggaggcugaagcaggaggaucacacaaacccgggaggcagagcugcagugagccaaaaucgugccacugcacucuaaccugggcaacagagugagacccagccuaaaaaaaaaaaaagaaaaaaaaagucucuucuucaaagauguguucucugaucacuuaauaaaaauuagguuaucuuuauuucacaagguuaugaaacauaagaaaacugaaggcaaaauauuuauggaggguuaugucuaaauaaaaauuagauuauuuggggaagaaguacagcuuuaauaucccuaauacaaaauacaaaauucaaaaugcuccaaaauccaaaacuuuuugaaugccaacacgauauccaaaggaaaugcucauuggagcauuucaaauauuggauuuuuggauaaggaaagcucaaccaguaagcauaaugcaaauaaauacuccaaaauccaaaaaaaucugaaacacuucugauucccagcauuucauaugagggauacucaaccuguagacauacguucaaucuccaaucacugcucuauaauuuaauccaagggaaaggguaaugucaaagucauugauuucugaauuuugguccagacucaaugcaucuaauuucaaggguaauaucaccugacucaaugcauccaaacuugaguaaaaccaccugacauaucuauuuuguaagacuacgauuaaaaaaaaaaucuaacuccuuuauuaaaggcuuuccaucuacagaaaaauauaaaauauuuucauaagaucucugaauuaaaagugaucugaauaauuagcugacacucauuuucuagauguaagaaacaauaacuugcucaaagacacacaacuacccaggguuuacacaaggaccagcagccucaagaaacuacggguauacauagaguaacaucguugggacaagaauggguuaugucccaaaccagauucuugccuguucuaccuugaguuagucaacuacuauaguugcaagguuuucugcucaaaaaauaacuuaaaaaauuauacaaauaaaacaaaauuaauuucucuauuuaccaauuagaaagagccugcaaagcugcauucauguaacaaguauuuccaauauuuuucaaaccuguaagaccuauuaagaaaaaauauacaugaagucaucauucaauaaugcaaaaugacucaauuuuaggggucauuaauaugguucccaaauuacauuaaggaccacggaaauacaauauagcaacuugaacaauucagagaggucacacuuugggaagccuuacaaucaccaaaauuuugaguuuuacauaaauucaaggauuaaacaguucaaacuuugaaauuugcacaggaagaacagucuuuccuauuaacauuuaagacuacguguuuuuaaaaagcauuaauugagacuuuuacauuucuuauuauaacuaaaguuuaauuauuuugagaaaauuaaugacaaugcaaaaaaacucgucaugauaaaugauaagcaaacacccuuuuccuuuccauuucaacguauugcacugaaaguaguauuuaugccgggcgcaguggcucacgccuguaaucccagcacuuugggaggcugagguggguggaucacgaggucaggagaucgagaccauccuggcuaacauggcgaaaccccaucucuacuaaaaauacaaaaaauuugccgggcaugguggcgggugccuguagucccagcuacucgggaggcugaagcaggagaauggugugaacccaggaggcggagcuugcagugagccgagauugcaccacugcacuccagccugggcaacagagcgagacuccaucucaaaaaaaaaagaaaaaaagaaaguaguauuuauuagguugaaccauaggaaacugcugacaaucuacaaaaauggcaauuucauaugguucaagcuaauauuaaaacgagccauugaaugacuguuaucucuuccauauauagucaaguucacuuucaucaguuuacuuucauuauuaaaagaugaaauaaauacuacaaaaaauuauaaaugcuauuuggauuuggagcaaaaugaagaaaauuuaaaauucuaaaaaucucuaaaacaagacugaauuaccacuuauugauaaguauccaguaaaauuaauagugugagcuaaauuaauggguuaaaacugggaaauacauaaaauauuuauaacuuaucucuagucauguuaagcuuaaaccaaaguguuaauuuccagauaauuaucuaaauauacauucaauguaccacuaguaucaauuauaaaacagaaaauuuuaagcuuauacuaagaacagugggccuaaaagaauaugaaaaauccaaauagaccgguucucaauuuaggggaagaagggagaaguguaucaccugauucuuuuuccaaauguuuuccccggaacuucugcuaagggaauaccuuuauaccuaauaccuccccaucacugacaauagaaaaaugagaaacacuguucaaacagaccucaaaaggcaaguuaaacaaaaagaucauaaggcucaacugcaaaagaguaaguaggauccuaccuuugguaaacugacaccagagaaaccaaaaguuuguuuugcaaauaaaauuuuacuaggccaaauuucagaguccuuuuguuuuaauuaucaagcccauuuuaccuccacauuuugaaacuuuuacauuauaugguuuucuaaagaaaugggcagugccauacaaagaagcguuacacaggauuaauuuaccucuggcccuaaguucaucuucuucauccgcuucuauauccagaucaucaaauacggcaaccagaggaguuuuuaauguuguauuacuggguauuuuaaaauccuugauaacaaaaaaagauagcacacuugaacaaauccuuaaauuuaaaaaaaguuuuaauuguaacuuauauaacaucuauaccauaaaaauuauugagauguuauuuuaauaguggaaccauaagaauuugugguauuagcaauuaaacuuacauuuauauuuugaaggaaauaaaacccuaggguaauagcaugucagucccgcuuuauuaacauauauauuugaguuaaaaaggcacuuuuuacaaccgaauuuucugaauuaaaacuccacaauaacugcaauuaugugacaguaaaccauagcuaaaaagaucuccgaaggauacuauccuacacugucuucucagaucucauuuucaacagggaaaaaggcaaaaguuuuucaucauaacacauuaucuauagacuucuacaaucucuccugauacuuauuacuguauuuacuuugcacacuuuuuuuuuuccgaaacagagucucacucuguugccaggcuggagugcaguggcacgaucucagcucacugcaaccuccaccuccuggguucaaacgcuucuccugccucagacucccaagcagcugggacuauaggugcaugccacaacgcccagcuaauuuuuguauuuuuaguagagaagggguuucaccauguuggccugaauggucuugaucucuugaccucaugauccgcccaccucggccucccaaaaugcugggauuacaggugugagacaccacacccggccugcacacuuuuacguauauuaaauaguucaagcacuuacuuuaaauaauaauauucuaauauuaauuuccaacaauuggcuugacucagagguugcaacugauaaccuguuagccaaaugcuaguaaacacuuuaaaaaaaaaaacgaaaaaaacuuugagcuaaaguuuaaaaaauucggagacgacaaauaaaaaucaaaauuugaaaguucucuuguaauaucagaagauugaacuacaaugaaccaacauucagcaacacccaaacagagaaggaaacugaauagcagaaagaauuuagcauguacucugguucuccaaguuauuauagccuuacuuuaccucuaaaaugcaggcauaugcacuaauucccaacgauuuuacuuuccugacaucuguagagacuggacauuugaguggacuucauacuuucauuuuguuuucauaaaguaauugcuuuuaaaaagauacaugcucacuacaaaauaucuaaauacacagaaguacagaggcuuaaaucaccugaaauuuuacuaucuagaaaaaaugucuauuugaaaaaucuuauuaauauuugcauggccuccaauauuuuacuauuuugcaaauauccugugguaaacuggauuucaacagcauauaaguuuuggaccacuaaagaaaucuaucugaaccacuguuuucuucugaauaauuucuucaacaaugggaucauaaggaaguugaaugaaauuaaguuuaugccuuuuauguguuaacauauuuacaagucaucagaaaauuauuaacaagccaucaggaaaguaucaguauacuuauucuaucagauucaacauuuauuaaaguuuguaaucuugaucuuuucuggcagaaauggcaacagauagcuuauuuaacuuacuucucuaguaagugaugcugauaguuuugccuuuauauauuauuaguuccuugugugauuaaacuuuagucauaacauuacacuuuuuucuuuuuuaaaacuuuuucuacuuauuaccauucagcuaucuucagugggacaaacuuuuguuaauaauguaagaggauucaacgaaacggccauuuucauacuaucuggacuuuugaaaaagacuaaacauguuugugaaugauaaauagguauaagugggagaaacaguaaugguuauaauuaacuagagccauucaacugagaaacugaaaaugcaagaaauuauucuuugacuaaaaucuagccaucuuucauguguaaggcaagcaaauuuauuaucacaaauaucuaccauaagaaugugauacaaacauacaacagaaaaaccugacaguugguaucaaugaacaaguacagaaauaugugauuucuauaacacacaugaggaaaaaaacuugcuguuaaucaaaucugaucaaauucugaucaacugaugaucugauuaagaagccaacuauucuaaguuaauuuccuuuuuccuauuuuucuaugacuuuaagaauucugaaaauuaagugauaaauucugcaagcaaacccauguguuuucuaagucucuugauccaaaaggagaaaaaucuuuuuuucuuuuuuuuuuuuagauggagucucacucugucaccuaggcuggagugcaguggcaaggucucggcucacugccagcucugccucccagguucacgccauucuccugccucagccuccaaaguagcugggaauacaggugcccgccaccacacccggcuaauguuuuguauuuuuaguagagacggggugucaccauguuagccaggauggucucgaucuccugaccucgugauccagccgccuuggccucccaaagcacugggauuacaggcgugagccaccgcacccagcccaaagggagaaaaaucuuuaacccaaagacugaugcuaagcuuuauuauauucuacuuuguugucaauaauaaguaaaauguucacaguaauacaaaggggauggaggggaggagagaacggggaagagagcugaauuaguaacugccauaugcuaucaaagaaggcccaccaccuuucuugaaaucagacuuaccagaaaaagauaaagacuacuugagucauuuaaaaaaaaaaacuucaaaaauucauuagggccuuuuccaucuucaaacaggugggcuucaaucucacccuaaucuagcacucuaagcaacacaagaaaggggagucugagugcuuuauuugagagaaaaaaggcacauuacagaaauuuucaaaguacagguuaggcaguauuccuuuugaaaauuucagcuacaugacaaauucugaaauuauuaccggaauguuuuacagcuuaacuaaguggaucuagauuauuaccuggacacuguuuucuuguauuuggugagguugucuuacaugaggcaaugaaggcugaguuccuaauuuccuauccaaaaauacuucuuugcugcaagcauaacaccauacucgaagagugguaagguucacaguuagauaaugcuuugucuccuauauaauuucacaguagagggaaaagaggaaccaaaauuacauauacuugaaaagacuucuucaaaagauaacagaagauaaacugcuugccuuugaugaguaacaauauacucaaaagcuaauuuagaacaugaaaaaaauucuuuagauaaacuucuaagguauaauaaacaguaacaacaucuaagccuacucuagaaauuacucugccauucuccccucacuauucauuauacaaaaagauaaacgcaagaguguaagaccuugcuuugcagucuacaaauaaauauaacacaagaaaauaauuaacaauagcaaguaacuauucuaagaaaucagaauggcaaaagaacacaaaugacaugagucaaggcauaaaacagcucuagcaauacagaauauauaaucuuggaaagauaaaagucuagccuuucacaaccagaguucugcuacagaauuaagcccuacaaaaaaugaucugagugacuaauuuaucaauucucccaauggugguacacagcaaauaccaucuuagaugcacagaaagaggcaaaugauauacaaugaugacucagagcuuggguauucaggcuuaauuaauucuauagaggaauccugguugagaacaguugaugcuguagagguaucaaugugcaucuuaaaacaaagucauucgagaaacuuuccauuuagaaugggagcucuacauaacacuauagaagaggcaugccagaguuacaugggaaguaccaaacaaccagagcaaagcagaaaggugaguccaguuaggacuaugugcaggaaaaggcaauaugacaugagcugagacuuaaagaaguuagccaggccaugucauaaaccuaagcacccacucucucuugggcuucaaccuccuaauaugccagcuaucaccuucaaauaucuggauauacacuuuuuuuuuuuuuuuugagauggaguuucgcucuuguugcccaggcuggagugcaauggcacgaucucggcucacugcaaccuccgccucccagguucaaacaauucuccugccucagccucccgaguagcugggauuacaggugcccaccaccacacccagcuaauuuuuuuguacuuuuaauagagacaggguuucgccauguuggccaggcuggucucgaacuccugaccucaggugauccaccugccuuggccuuccaaagugcugggauucaggcgugagccaccaugccuggccggauguacacuuuugaaaucagugcuuucuuaaucacaaccucauucuaauguucauccuccuagcaauucccuuccccauccuucacagagaauguaagugaaguuuuaacuuagagugcaaauuugaauuacaacuugaauuaauaauguuauacuggcuuucccuuuccuucaggcacuuuuuuuaacaagucuuccauuaaauuuuuuauauacauaccugagaauguauggugcugugaucuacuugugauucaccacagccaacauaugaacaucuauucuauaaauaauuauauaggaagaaaaauaagguacuuuauaauauacauguaaauuuauaacagcauuacaauuacauuuacaauuaaguuuggauuaccuguuuuacauucaaugaguaaaugacuuuccagucauuaaauuuaaccaaauguuuccaggcacaaaauaaaaccaggauauauuucuaagcuaaaagcuaugucauuucuaauaaaaggcaagcauaaaauagcugagugauuuacuaaaaacuacaaaagcacuacagauuaagaucuuuccaaaguuuaauuuuuguuauuaauaaugaccuuuuaaaagcaaguuuaauuuacaaaaaucacuuuaaguaucaaaaauuuucugguuaugauuauucagauccaaauuuauuauuauuauagcaaucuuuucaggaaaaaacauauacacaccuccagacaugcccaaagauuugguccuuggacuuuacaauccugacaaguacccuauaaaaagaaauuaaaaagacaacauugguuauauugacacaaacacauacaauucacuaaugcacuaaugacaucauacauauuuuuaaaauacugcucauagaguauuacaguaauuuaugaaaauuacacauucaagagaaaagugaauaguuuuucaaggaagaaaaaaccuguuucuuacaagggauuuuuguaucaaaucuucuuuuguuauuucaccaacugaauccaaauguggacaaugauuucgaaaagcugacauuuuguuaggaauuuuuuccuguuucccaagacuuucaaaaugagguaacaccuauaagaaaaguaacacacacaaaaaaauuaauaaaugcuuacaaugccugcaaagauuccaaaaaauaaaaaaauuaaaauguuaacauauuaaaaaugauuaaaagauaacauaagaaugauauaaguuugcccuguaaaaagaguguauucucaaacauagaugaguuuucagaauugaaguuaaucugaacacuggaaauuucucuacuacauaaacauuuuauuaaaauugacaucuauaaacaaauguaaguuuguuucuccaugacuuuugcugcuuuuccccucucauuucacuuuuuauagauaaauaaaaggggggaauauucaaguuauucaacugugaagcacuuuuauccuuuuaaaaaaaaaauuaauccuuaggcuggacuaggaguugaaaaaaaaaaacuucaaguagaaagcuucauuuuucuacuaauaggacccccuacugauggcauaaauuaaaucaucugguauccuggccuuauaccaggauaagcacuuuauaucaggguuucucgaucccggcacuauugacacuuagggccagauaauucuucgcugugagggauuguccugugcacugcagguuauuuggcaacauucccacuucuauccacaagagacagacagaccaucccugccaccacucugaacucugaugaccagugucucuagacuguuuuaaauuauacccucugggggacaaaaucucuccagguuugagaaccccauuuucaugaucuuuacaaccccugaaauaggcaccauuauuagcuucauuugcacauaaggcuaagagaugcaaacuuuacugauccacaguguuugguucaaguaaagcgagugauuuccaaaggucucaagucuaauuugguauuccuagaucuuuugguuguaccuuuuuaauaacagggcuuuucaugcucuuaauucaacuuugagguuugagaacacuuucccaaaaaaaguuuagaacuugcuaggauagaaugaaacaguuuaaaaguuugaacuucagaaacacuguaaauuuaauuuccuuugugguuuauaaguuauucaauaaaccaugcaggucuauguaauaguuuauaacuauauagaaccccuuuguuacccuguagcuuauauaagagugucugucugccuuuuauuauuuauuuauuuauuuauuuauuuauuuauuuauuuauuuuugagacagaguuucacucuugcugcccaggcuggagugcaauggcgugaucucagcucaccgcaaacuucaccucccagguucaagugauucuccugccucagccucccgaguagcugggauuacaggcaugcgccaccacacccgaccacuuuuuuuguauuuuuaguagagaugggguuucuccauguuggucaggcugaucucgaacucccgaccucaggugauccacccgccucagucucccaaaguccugggauuacaggugugagccacugcgccuggccucugucugccuuuuaaacccauugcaauaaauuugcugaaauauuaacacauuaguaaauacauuuuuuuuauuauacuuuaaguucuaggguacaugugcacaaugugcagguuuguguaaauacauuuuuuuaagaaaaguugaacaaaaucaaaucaaauaaucaauucacuauuacgcugcaacacacaaaauucaccaggaaccacucuaggguuaauagugcaaacauuucuuuuuucuuuugagacagggccucauucugucacucacacuggaguacaauggggcaaacacaacucacugcagccucaaccuccuggucucaaaccguccuccugucucagccucccauguagcuacaacuacaggugcacgccaugugauuagacuaccccaagccagagaaaaaaaccacgggaaaggauuagguaaaacaauucucaaagccuuuaaggguuguugguauucucaucagccacaguugaaagacaccauaauagaggaaauaaugcacucagaauggcauugccucaauaaucggaagaaauuauccuuaaucuaaagguuacuuugguucugucuuuaaaaaguucaaaaagggcugggcgcaguggcucaccccuguaaucccaacacuuugggaggccaagguggacggaucacgaggucaggagaucgagaacauccuggccaagggaaccccaucucuacuaagaauacaaacauuagcugggcgugguggugugcaccuauagucccagcuacucaggaggcugagacaggagaauugcuugaacccaggaggcagagguugcagugagcugagaucgcgccacugcaauccaaccugaggacagagcaagacucugucucaaaaaaaaaaaaaaaaguucaaaaagaagucuuagaaggaucaaacuguuccaaaggaauuguguucggaacaaagcuuaaggacauuuaaaggaaugaaaaaauucaguacccaucaagguaaaaaucacaauaacuggcaucuaauaaaaaaugacaggcauucuaagaaggaaauucugacccacagugaagagaaaaagaagaaaccaagaaauagcacagaugacagaacaaagauagacuaaaucuuaaucuuaaaaauuaaaucagaacaucagugauauaggggaaaauguucaaauuugaugaaaacuagagcccuacagauccacaagcaauuuaaacucagcacaaaacacacaaacuacaccauguacaucaaaaacaaauuacuuaaaacuaguaauaaaaagaaaaucuuaaaaaauagccaacaggcuggguacaguagcuaaugccuauaaucccagcacuucgggaggccaaggcaggaggauuccuugagcucaggaguuagagaccagccugagcaacauagcgagaccucgucucuacuaaaaauuuaaaaaaucauccaggcaugguggcacgugccuauagucccaccuacucacgaggcugaggugagaggaucaccugagcccaguagauggcagcuacagugugcugugaucacaccacugcauuccagucugagugacacagcaagauccugugccaaaaacaaaaacaaauuuggaauaagugcgacacggugcuaagaauguauauucuguugauaugguguggaaaguucuguagaugucuauuagguccacuuggugcagagcugaguucaauuccuggacaucccuguuaacuuucugucucguugaucugucuaauguugacaguggguguuaaagucucccauuauuauugugugggagucuaagucucuuuguaggucucuaaggacuugcuuuaugaaugugggugcuccuguauugggugcauauauauuuaggauaguuagcucuucuuguugaauugaucccuuuaccauuauguaauugccuucuucaucucuuuugaucuuugaugguuuaaagccuguuuuaucagagacuaggauugcaaacccugcuuuuuuguuuuccauuugcuugguagaucuuccuccaucccuuuauuuugagccuaugugugugucugcacaugagaugggacuccugaauacagcacacugaugggucuugacuuuuuauccaauuugccagucugggucuuuuaauuggggcauuuagcccacuuaccuuuaagguuaauaucguuaugugugaauuugauccugucauuacgauguuagcugguuauuuugcucauuaguugaggcaguuucuuccuaacaucgauggucuuuacaauuuggcauguuuuugcaguggcugguaccgguuguuccuuuccauguuuagugcuuccuucaggagcucuuguaaacaaaauugaccacauaguuggaaguaaagcacuccucagcaaauguaaaagaacagaaauuauaacaaacugucucucagaccacagugcaaucaaauuagaacucaggauuaagaaacucacucaaaaccacacaacuacauggaaacugaacaaccugcuccugaaugacuacuggguaaauaaugaaaugaaggcacaaauaaagauguucuuugaaaccaaugagaacaaagacacaacauaccagaaucucugggacacauuuaaagcaguguguagagggaaauuuauagcacuaaaugcccacaggagaaagcaggaaagaucuaaaaucgacacccuaacaucacaaugaaaagaacuagagaagaaagagcaaacacagucagaagcuagcagaaggcaagaaauaacuaagaucagagcagaacugaaggaaauagagacacaaaaaacccuucaaaaaauuaaugaauccaggagcugguuuuuugaaaagaucaacaaaauugauagaccgcuagcaagacuaauaaagaagaaaagagagaagaaucaaacagaugcaauaaaaaaugauaaaggggauaucaccaccaaucccacagaaauacagacuacgaucagagaauacuauaaacaccucuacgcaaauaaaccagaaaaucuagacgaaauggauaaauuccuggacacauacacccucccaagacuaaaccaggaagaagcugaaucccugaauagaccaauaacaggcucugaaauugaggcaauaauagccuaccaaccaaaaaaaguccaggaccagacggauucacagccgaauucuaccagagguacaaagaggagcugguaccauuccuucugaaacuauuccaaucaauauaaaaagaaggaauccuccguaacucauuuuaugaagccagcaucauccugacaccaaagccugguauagacacaacaaaaaaaagagaauuuuagaccaauaucccugaugaacaucgaugcaaaaauccucaauaaaauacuggcaaaccgaauccagcaauacaucaaaaagcuuauccaccacgaucaaguuggcuucaucccugggaugcaaggcugguucaacauacgcaaaucaauaaacauaauccaucauauaaacagaaccaaagacaaaaaccacaugauuaucucaauagaugcagaaaaggccuucaacaaaauucaacagcccuucaugcuaaaaacucucaauaaacuagguauugaugggacauaucucaaaauaauaagagcuauguuauaauauuucacuaguacuuuaauuuacguuauccugacaaccaguaaguuugaaugucuuuucauaaauguuacagcuuucuggauuuguucuuuuauuaauugcuucuuuaaaucuuuugcccuuuuuacuauuggguccauaaccucuucuuuuaaaauuaauccucuauccucuauauugcaaaauauuuuuucaaacuuaccuaccuaccuuuuuaauugugguaaacaccaugcugaaaagauugcccucuccccacugaauggucuuggcaucacugucaaaaaucauuugaucauauauaguacauaaggauuuauuucugggcuucugggcuuuuuuuuuuuuuuuuuuuuuuaaagagauggugucuuguuccauuacuuucauuacucaggggagugcaguggcaugaucauagcucacugcaaccuccaacucauagacccaaacaauuccacugccgcagccuuccaagcagcuaggacuacaggugugagccaccccaccuggcuaauuuuuaacuuucuuuuguggagacaaagucuugcuauguugaccaggcuggucucaaacuccuagccucaagcaauccuccuaaccuuggacucccaaagcgcugggauuauaagcaugagccacugcaccaagccuauuccuaaucuauuccauuggucaauaugucugucuuaaugccaauacuguuauuaacuuucuuaugguauccuuuaccauuaaaaggucuuaauuuuuguaaaauuaaauaugccucuuguaauagcuucugaguuucuuaucuucacauuuccuuuacccuagcuuguauaacuaaaccuggagaauaaccuuaaguauuucuauaaggcuuugauccaucuggaauuuaucuuaagauaggaacccaauuuuauuuucuuccagaugggcagacaguuguaccagcaccacuuauuaaauaaucuccccauuucccauugaacuguaauacuaccuuuaucuuuuauuaaaucugcacauauacuggauuucuggauucucuauuuuauuccaccaaucuaugacaauaccauauuaaucugauuacagaggcuagauacaauauuuugguaacaaaagacacaccuccucacuaauccuuuucaugguuucccuggcuacacuguggcuguaauggaaaacauaaguuuuccauuuuuauuuuguuucaaccuuucaaaaaguuuuacuucuuuucaaggggaggaguuuuaguucuuauuucaaggggaggaguuuuaguucuuauuuucugauauuaacaccauuauucacuuuuacuguuuuaaugcauuuaccagaaccucuuaagacaauacugaauacaaaugugaucaugggcauccccaaguccccaucaaguuucuaauuuuaaugcucuugacauuuaggauauuugcuguaacuucccucuauucuuacuuuacuuauuagaaauggucuugaugggcugggcaugguagcucacaucuguaaucccagcaauuugggaggcugaggcggguggaucacaagaucaggaguuuaagacuagccuggucaauauggugaaaccccaucucuacuaaaaauacaaaaauuagccaggcaugguggcaggcgccuguagucccagcuacucaggagacugaggcaggagaaucacuuuaacccgggaggcagaggcugcagugagccaagauugcgucacugcacuccauccuggcgacacagcgagacuccgucucaaaaaaaaaaaaaaagaaauggucuugaugaacuauggcuaauauuguauuuagaaauuuugcauuucugggcauaagugagacuguucuuuuuuggcagcauuccuucccucccccccccccccgugcuugaaucaggauuggcagcauuuaucagagauaaaauaugugugcuucacagaaugcauugacuagcuuugcauucuucaucauggaaaagagaguuccuuuuuauuauaaugauguguuguucuucauaaaugaaacucagcugugaaauuauaugcuaugcugccucugucaagaaccaaucuuccaucauuuuuucaaaccuuucauggggauugggcaauuaacauuuuuacuucuugggucaauuuuacucauugacauuuugcuauaacaacauccauuuucucuugaaauaacuuugacaguauagcauuacauguauauucucaagaaaaucugcaaaagauuccauuaaugucuccuguauuuggggucuaugguguuuacucauucccaaucuuguacauuuuuauuccauaucuuuuucuucuacaagauguuuaucuagaucauugguauuugcaaagaaccagauuugggauuuauuuaucuucuccacuauuuuuguucugaucuguuuucaauuccauuaauauccauauccuacuugccuuugguuguauuuuuuuauguuuuuuguuuuguuuguuuuuuuuuuuggagacggagucucgcucugcugcccaggcuggagugcagugguacaaucuuggcucacugcaaccuccaccucccagguucguacgauucucuugucucagccucccaaauagcugggacuacaggcgugugccaccacgacuggcuaauuuuuguauuauuaguagagaugggauuucaccauguuggccaggcugaucucaaacuccugaccucaggugauccacucuccucagccucccaaagugccggaauuacaggcaugaaucacugcacccagccugguuuuauuuucuuaaucccuaaagaugaguacugagcgcuuuguuuacugaaaguauuuaagcuauguauuuuccucuaaaguaaaaauucugcauuugccaaugaaauguagauguucuucucacugcuuuuuaggcaauacuauuuugccucagaggaaagaaaugggaucagaggauugaaaagaaacuuccaagauaaauauuuuuuucuaaaaucucaagcaaaaaauaagauuaaaauaaauucucucugcugauagcugagaugaaaaaaagaauaaaacauaaauacauucucucugcucugcuauuaauuuugcauuaucuaaacaauuuaauaagaauuggcugggcagggccaggugcgaugacuguaauuccagaauuuugggaggccgaaguagguggaucaccugaguucaggagucugagaccagccuggccaacauggcaaaaccccuucuuuacuaaaaauacaaaaauuagccgugcauaguggugggugccuguaaucccagcuacucgggaggcugaagcaggagaaucacuugaacccaggaggcagagguugcagugagccgugaucacgccacugcacaccagccugggcaacagagcaaggcuccaucuccaaaaaaagaaagaaagaaagaauuggcugggcagccacgcaugacagcucaggucuguaaucccagcacuuugggaggccaaggcgggaagaucauuugagcugacgaguucaagaccagccugggcaacauggugaaaccccaucucucuacagaaaauagaaaaaucagcccagcgugguggugcacaccuguaguuccacugaggcaggagaaucccuugagcccaggaggcaaagguugcagugagccaagauugcaccacugcacuccagccugugcaacacagcaagacccugacuuaaaaaagaaagaaagaaagaaagaaagaaagaaagaaagaaagaaagaaagaaagaaagaaagaaaaaggaaaagaauuagugcauguaaacaaaggcuaacaauuugucccaaggauauuuaguaucccguauaauacaaugcuaucaaaauagaaaacccuuaguauuuucuuugccuaguuuuacucaguuuauuuacuaagguaauaaaaucauucuuuuauuccuuuauuugacaaauguuuauugaggguagggcauucagauauaguaggguaagacaaugggaguucuuagcuacuucaauuucuucucaaauuguacaccaaaagaaagaaggcauguaugcuuccauucuugucugauaauuuaaucacaggagaugaguauuagacauuagaaaaaaacagaaaaugguuguauauggaaaugcuauuguccaauccacagaaguagauuuugcaaaacuaagacuccuguagaagcuugugacuuacaaguuggaaaucacaaagagugcacaagauuuuaucuguuuguccuuaucuuuguaaucuuguaucuggcagcuuuuuccucuaucugccacacuaacuggacuacuggaaguuuucucaccaauaaugauggcagcaacaccaacugaaaauuuuuccagaugaaaacgacugcacucacgcucuaugauguacagcuccgguggcuaaauugcucaucugcauuaaaguaaaugcaaaacugcuucugggcugggcaugguggcucgcaccuguaaucccagcacuuuaggagacugaggcgggaggacugcuugaacccaggaguucaagaccagccugggcaacacggcaauacccugucucuaccccaaaaaaauacaaaaauuacccaggccugguggcaugccccugcagucccagcuauucaggaggcugaggugggaggaucaccugagcccaggaggcagaaguugcaugcagugagcugugauugcaccacugcacucccgccugagugacagagcuaggccuugucucaaaaacaaaacaaaacugcuucugaagauauuaccuuuuuuuuuuugagacggagucuugcucugucgcccaggcuugagugcaguggcgcgaucucagcucacugcaagcuccaccucccggguucacgccauucuccugccucagccuccugaguagcugggacuacaggcacccgccaucacacccagcuaauuuuuuguauuuccaguagagaugggguuucacuguguuagccaggauggucucgaucucuugaccucgugauccgcccaccucggccucccaaagugcugggauuacaggcuugagccaccgcgccgcgcccgaagauauuacuuuuaaggggagaauauuuucguaguacaaucuccaaauuccagguugaaauucugaccccuuauccuaauagaagauaaucaaucagcuauucaaauuuuaauauuaggaaaaguauagggaaccauguuauuaguacaauuuuuuuuuuuuuugagacagaauuucacucugucgcccaggcuggagugcaguggcgcaaucucggcucacuugcaacuucucccucccagguucaagcaauucucaugccucagucacuugaguagcugggauuacaagcaugugucaccacauccagcuaaauuuuuguauuuuuaguagagacggaguuucaccguguuacccagacuggucucaaacuucuggccucaagugauccacccaccucggccucccaaagugcugggauuacaggagugagccacugcgccuggccuuaauauaauaauuacacaucaggacauaguugguaaccuaaggagcuuuuaauauugagaaacugccugaauuccauugccuagucuauuccaaaaaguaaagcucuucauaaaaagucagauucacauuacagagaaaaaaaauuaugucagaaggauugguagcuauuuaauaguuacauauaagauuaauaugaaugcaggaggucuucacuagcaggugucagaacugcucaauauuuuuaacaauaaccuggauaaagcuacagaaggcaggcuaguaaaauauaaacuuaaaauuauaaaaauaaguuuuuaaagaaaaauuaaacuauuuuuuaaaauaagcuaaaauuggcugggcgugguggcucacaccuguaaucccagcacuuugcgaggccgaggccgguggaucaccugaggucaggaguucauuaccagccuagccaacauggugaaacccugucucuacuaaaaacacaaaaaauuagcagggcgugguggugugcgucuguaguccuagcuagcugggaggcugaggcaugggaauugcuggaacccgcgaagaggaggucgaagugagccaagaucaugccacugcacuccagucugggugacaagagcaaaacuccaucucaaaaaauaaaaaauaaaaaaaauuagcuaaaauuaacaggacgaaauuuaauaaugauggaugugauauucgacauugggauucaaagaaucaaccauauaaacugagaccaaaaaagggggucagguauuuggauucuagacccuugaagaaguagcaauuccuacucaauuaaucaacagaacacuagguuucaagguuucagaauaaaaagaguaaccagucuugcuggguaugguggcucacaccuguaaucccagcacucugggaggcaggggcaugaggaucgcuugaggccaagaguucaagaccagccuaggcaacagagugauacccaccccccaucuuuacaaaaaaaaaauaauaauuuuuuaauugaauagaguggugaaaaggggaaaaaauaauagccaaucuuaauguucgcauaaaauaaguagauuauaucuggaauacaguauuuuauuuaagaagaauacuaaaagcuacagaauaagagugccucucauagaaaaccuuaaaagaaauaauuugaaaacuguaucuuauaagauagcacuguacuaagaguaaaguuucuggagcaaggcuccacuaucuccuagauuugggaccagugguaaguuucuucucuuugccuuagcucccucaucuaaaacacugaucuaauuacaaauaucuacuuucuagaguuuuggagaagauuaauauauaauauuuuaaacuaauuauauaauuacacauaauacguuaauauauaauuacauauuauauauuaguauauauaaaauacuuagaagagggugauauaguaaguacucaguaaaugucaaccauuacgaacugaaagcauggauguuuaaacagcagaaggcaaaagaugccaggacuugauacacauguuccaauugaacaugaugaccaaagggauccuuucuuuucugugcaacuugagaaagucagaacagcauauucaaucaacggugaagacuucgguucaaauacagaugaacuuucauggaaggagcauguuccccauaauuguuacacagagguuggguaacugucagaggugcuucaaaggacagcaagcacuuugcacuaaaaacucagaauugaauuaagauucuaugauuauaaaaaaauugauuugucuuucaacaguuucaaucuagacuaugguuccacgaguacuaguccagcaguaccauaugaaauauuacacuuuagcaaaaauacaaugaaggaauaagcuuauggcuuaucuuuccauauuuaucauggaagaaaauugcuacccaauaaaagcaagccaaaaaaacugaugaauggaaggaaguuaucaaugaagagugcaacaacaagcagaaaaguuuauuuuauucucaauccauaguaagugcucagggagacuuuucacaaaagaaaucagcugacaagcauuuuaaauaacuguuucuuucccuuuaaacaaauauucugagaauaaaaucauucaaaccucugugaggauuugaagaucccacaaaguccuauaauacuuaccuaaucauucuuaauuuucauucaaaaccacaacacagaaaaagaaauguagugcuaaucuuuuuauuucucuuuuacuagaaaaucugucucauugauccuuaagagucuaauuaaugagagccuuaaggcuauuaaaagaaauacgcagucuucuaacugaguucucuggcuacaaccuauguguucuacaaucuauucuuaacauuaccacuauuaauaauaccaaaguauagcuccaaucuggcaaucuucauuccaaauaacauccucuaaaugagauuuguaaauauuaauuagcauuuccuauaaagauuuuuaaaaaucuguccaauaaugaauggcaaaauauggucaauucuagccuuaucucguugaaauaauuuugagaaauauuggaagagagaggaaauagaaaugaauuaaugaauaugacagaguucuaacagagucucaaauaagcugaugauaauuuucacucuaagucucacuuuugagcaagaugaagaguuaauauacuggcauuacggaacagucauuaaaaauauucauguaaaccacauagaaacauggaaaaaccuaaaucuucaguucagcuugugagcaaaaagaaaaaagaaagaaagaauaugagaaaacaaaugcuaucaccauauucaaaugagaaccaccauaagaaaaauuaucaauucuuuuauuguuuaccagacuauaauauugauuuuaaaacuaaucaaaacugauucaucuaaacacaguaaugcuuccauaaaaaauauaagaaauuccagccagacauggcagcucaugccuguaaucccagcacuuugggaauccaaggugggagggucacuugaggucaggaguuugagaccagccuggccaacauggugaaacccccauuucuaccaaaaaauacaaaaauuagcuggguaugguggcgugcgccuguaaucucagcuacuccagaggcugaguggugagaacugcuugaacgcaggagguggagguugcagugagccaagaucgcaccacugcacgccaggcugggcaagagugagacccuuucacaaaaaaguaaaauauauaagaaauuccucuucuaggauuuuauaaaaguuaaaaccugugggaaauggucuuauuuuaggucacauucagcccuauaguuucaccacauuacuguauuucaggacugugauaagcccugggggauagaaauuaauuuaacaaaugcuuauaauccagcaugggccagacauuauaaguuuguggggauggcagcauuguucaagucuccacccugcuuuccuuuugaaugacuggucaucaacacucuuaucaucacucuccugaauacuaugcaauuuuuucacuuuccuuaaaaaacuaauuugaaagucaguguccuucugucaacccuucuuuuucacaaguuaacuaacuuuuaaaccucaguaccaucuuagaucccuccuuacuuuuuucauuuacuuuuuuugaaaugggaggcucucuauauugcccagguuggacuugaacuucugggcucaagcaaaucuccuguuucagccucccaagugacugagacuacaggcucaagccacagcaccuggcuccccuccucacuuucuaucaguuucuaaauucggcauuuuuuuuuuuaaccacauuucaucucacauuucuucuaggucucuaucuaaauugaggcuuuuauuucacaucuggauuauucaaugagaaugccuguuaagacacagaguugauaccuggaccaucuccuuucagcucacuucaauguuuacuuguagcugguaugcacaguuaacacacugacaacuucccaucucaacuacuucucuccucagcucuccagcaccucaggagcuugccaagcccuaccuaaccaguguaccugggaaguucugggagccuuuuagauaaaggcaaucuuuaucagugaggauugacuguagauggaaaaccacccagcuccccuucauuuggggcaguuauacaaaacucugaggcaguuauacaaaaaucuccaaaggcuuaagcagccuccaguuggccuuccacuauuaaccuuuuuuccuccuucucugauucuaccugcuuccucacuugugcuuuauagcaucucaccugcacccaugucaucucagguccaaguucaagaugcacuucagagaaaccauaagggcuacaaaaauaauggucacaaucuagcuuaacauaaagccaccccagcagucuuccagucucaaucuucuaacaguuacagcucauuuuccuuucauguggaucacauaccucuucugaucaaacaccuucagugaagucuuucauaauuugucuucuuuaucuauuauuaacuuacauaaacuaugaauaucagccacauuguucuaccgauguuuucucaaauguaaguuguacccuucaaggagcucauuaaucuguucacauuacaaauauccuccaauauuuaccuuucaaagcucacucaucucaaauacuaccuucaccaagccccaaucacaaguaaugucuaccucaccuaaauuccuaaggaacuuuuauaaaaacucauaaggcauuuacuguuguguaaaaaauugccucacuugacuacaaguucuuugaaggcagaaaccacguuucauucuuuuuguuuuccaaagggccuuguccugguagacucaaaauauugaccuaacuuaaccuucugaacauuugacagcaugauuuauuuugauauacauauuguuucuuaaagacuaguucucaguauacaauauagcacauaauucaugugccuuuuuauagauaguuaaaagcaacuguacucaucucacacucuuuggaguuuucccacuuaucaaaauguuccugcagacacauguacacuuuuaaaguuuaaaaacuacacuaaauagagcuguuacuuauucccuuccuuuuuagaaaugguuacauuucacauuucucaccaaaaaucuuucagcauuuuauguacuucauuuucuugugaagaguccacagucuugucauauguuauaguucacagugcuccaaucuuaaucuaucugaauucccaaucuguaucaaaagcugcuuuggcaacauuauuucaggcuuuacgaaauucugauccuuacacaaucuugaaauguuucugucauggggaaagacuuuauuucuuggcauucggagcucagaggacuggcaugaggaucaaguaagacuguguaagugaaaggucacagaaaauucuaauacuacuacauaaauguaagaauuaucaucucaauucugaauuucaaauauuuaaaaucaccuauuuacuacaaucuaaugucauuaaacugcaguuauauaaaaagacuugcuuacuguuaaguuauaaaaaguucagaaaagacagaaaaaaagugaaacuggccauaaaccagaucauaaauaggaagcaaucuuaaguagacuaucccucuugcacauaucaggucaaauauuuuauuccaauaauauuuuuuguacuguccuuuuuuuuuuuuuuuuuuuuuuugagacagagucucgcucugcugcccaggcuggagugcaguggcaugaucucggcucauugcaagcucugccucccggauucacgccauucuccugccucagccucccaaguagcugggacuacaggcaccugccaccaugcccggcuaauuuuuuguaauuuuuaguacagacgggguuucaccguauuacccaggauggucucgaucuccugaccucgugaucgucggccucccagagugcugggauuacaggcgugagccaccgugcccagcccugaccuuucuuucaauccugccaaaguaaugaaauaauacaaagcuccuagcauuguguaacuauuucuauuauuuuuucauaaaacuagcauugucuuuaagauuccuauuuucucucuuauuuauaauaguaugaauucacuaacaauauuuguauuaugcucaaaucaaauagccuaugacgauaaugugacuuggucagaccuuuccaaauaagacaguaggaaaaacggaacuaggacggccuuguuacuuuuuguaacacguuuuucuuaaaggaaaaauaaucugauuaaacuuaaaaauucucuacauccacauaguuauuaagcaaaaggccuagagaucguuacgguaaaauucaccuucaauuuaagucuaugcuccugccagaauuucacccucuggcucaauuuuccaggccuaauacugauucuaugagaauguaaacuccaacgguacuugagugcaaaacacccaggaaaaucucaucguccaagagcucaacguaaaacccuguaaauauucaaaugaagagcguuuuguauacgagaaauauaaguaaaggucugggaaaccacacacuauggaucuuucauccaaacaaaggcugcagauggacagaagguaagggguaaccucucagucaagaucaaacauuggucgaagaaaaauuccagggacgaugacaccucgguuuuuccguucacaacaacaaacaacggggccggcccccucaacagcgccgaaaagcgaaaccagaacccaggagccggcgcgcugcagggcuuucagucacccacugagagggacuggcaagccugaguggggagaccgaggaagggagcagagcccccgcuucucgggcucaccugcaccucccgcuuccagggaagaaccccugaggacccuuccucaaaucaacgaccgguucccauccuccaccgaccguugacagggcgaccacuagauuaucucugcaacgcagagcaccgaggggccaaggccuucuucccgcccgcgaacccgccgccacccaggaccaagaaaaagaggcugcugcagcggccgcaaccccagcgcgcggaagcgagaacagagaccggaccccggacgcgagcgaaacgcccuugggccccgcgccccucccagcagcgccgcgcucaccuccacggccuggcccgcgggacccgccagcucgaccaacaacggccugcagccgcaccuccgcaagcuccucuuuuccuucucagcucucggagaggggcagugucgcgucaggagggccggaaaacggccccgcagcgcugcccucgggggguccgccuccugaacuggccacuucccgcagcagccgcggcuccuuccggugucucc

SEQ ID NO: 191343 - RNA, 39313 nt, Homo sapiens
cgcaaguccccccaccguucagcgcaaccgggcccucccagccccgccgccgucccccucccccgcccuggcucucuuuccgcgcugcggucagccucggcgucccacagagagggccagagguggaaacgcagaaaaccaaaccaggacuaucagagauugcccggagaggggaugcgaccccuccccaggucgcagcgacggcgcacgcaagggucacggagcaugcguuggcuacccggcgccggggaccgcugccaccccgccuagcgcagcgccccguccuuccgcagcccaaccgccucuucccgccccgccccaucccgcccacgggcuccagugggcgggaccagaggagucccgcguucggggaguaugucaaggccgugacccguguauuauuguccgaguggccggaacgggagccaacauggcagcgggguucgggcgaugcugcagggugagagggagcccagcggugcgguggggcuggaacauggguauuguggugucggagcagggggcccugggccaaaaauaggugcggccgggaggagugggaagucgggcugaggaaggagccagccuaggggcccccaaccugcuuucacgccuccuaccaccggacggaacguagccuagcguuucauuuuccguauccucccgucaggcgaccccguuauagccggcauccucucuuuagaauaucguuuuucuuucucugguaaacccuccaaauauuuaccgcgggaaucccaccuuuuuccaaagugaccccgucucugugucagaaccacgggaaaaagaaaaauggagcagcuacuccuugaaauacuuaauguuuaauaagcuuuucguuguaacguuuccacguugcuuacgggaaaaaaaaaaguaaaaaaaaaaccugcagaauuuuaugugaacuuguguguauauucuaguauuggaucuuaauagauucuaaauaaguuugucacuagaugaauuuugguaucuuaaauauucuugauauguucacaccacugccauuuagaugucacuuaaaauuaaguuaaaguuaugucuuggaccaaaaaagcugcgguuuuagaauaauccuaaagaauugcugcccauguuuugcugguguuaugcaaguuaaugugcagugaaggcagaaauugggagauuucagcuauuuuuaacuccuacaccagaaaagcagauuucucaaccuccaaggaaggaucuaaaaaaaaccugauauagaaaacuuacacccuuuuucucuucuuuaacccauaaaacugacacucuuauauucccaagaaaugcacaaaaguguucaauucuaguggugcuguuucgauauuuggaauuucauuguucuagacagagagcccgaaguaauaaaaccaauaguuauauagcauuaggcuuucaaaacauuaucguacuuuaaucguccgaaaauacgcagugagauuagucccauuuuuugguuuugaacggaagcuauaagcaguuuguaaaccugucuacggccacaaauaugguuguggaaccuagauucacauucagcaauuauaacuccagaucccgugcuguuucuguuuucuauuugcaaaccaccucucuaauuaacuggcuaacuuuguuauguaauuaacagguugaugggcauuguauucugguaauagcaaccuuugcacuuuguucuauguaacauauuuuccugaacagucacaugugaagugacuuuuucccuauuuaaauucccucgguuggccaggugcggcggcucacgguugugauccuagcaccuugggaggccucggcggguugaucacuuaaggccaggaguucgagaccagccuggccaaagcagggaaacccugucuuuacuaaaaauaggaaaaauuagcugggcaugguagcauaugccuguaaucccaggaggcugagucugcagugagcggagaucucuccaccgcacucuagccugggugacagagggagacucugucaaaaaaaaaaaaaagucccucaguagaccauuuaaccugguuugaguucugacuuuugugcaugguauuuaaaaacgcauuuauaauagagucagguuuuuuguucugauuuuuguggaauguuuuccuuuguuauggaaccuagugaccaauuaggauacuaacagaaagaucaguauagcaaggugguuaauagcaugcgcucuugauaguaaauguuagaauccugguugcacuaauaguagagugacuuugccuaauuuaguugacuuucugagccuucguuucuucacaugcgaaaguggaauaaaaguaauggcuuaauccuagacuugaccugggauucagugaauuaaccuguguaacgcgacuguaaaucagaguagauuuggucugugacugcuggacaauaagcaccagagaaacuguuucacuuuuuuuuuuuuuuuuuuuuuugagacggagucuugcucugucacccaggcuggaaugcaauggugcagucuaggcucacugcaaccuccgccuuccggguucaagcgauucuccugccucagcgucccgaguagcugggacuacaggugcgugccaccacaccuggcuaauuuuuguauuuuuaguagaaaugggguuucaccauguuggucaggcuggucucaaaccccugaccucgugauccgcccaccucagccucccaaagugcugggauuacacgcaugagccaccccaccuggcacuguuucacuuucaaaauaaaauuaaugaagaugcaaagaaaaugcgaguuuucauacucuguauguuuuuauuacuguaguaugagguauguuauuuggaaagcacuguuucaauuacaaauauuugacacucuuaauuauauugucaccuuacauguaggaauucgucuuuuauaaguugaaauugucaucuacaaagacaguuucuuuuuacggauuuugaaaaacauaagaauuuaaauaaagaaacuuuaguauauucuucagcugcucuuuucucuuaguaucuaagcuuguuaaaauugcuggauaguucaauuaaaaucuuuuacagugaaaauuguguaauuuugacuguccugaaaccuuuacucaagaacaccauugugguucccaguuuggcagcuuuaauaaaugcaaauuuuuacuuuuguauccauuaaacugucaugaauauaaaaauggguugcaaaacaauaauauauguauauuugauuguuuguuucuuuauauguuccuuugaagaaauaugacuauauuucagauccuaagacaaguaguguauuaguaguuuagaagagggauggcaaacguguuuguaaaggaacggauaguacauguuuuuggcuuugugaaccagauggucucugugguaacuacuuagaucugcugugaaagcggcaauagacagcaugauguggcugcacugguuuggugacuccuugcucagaacauuguaagaaucccuguagacagcagaaaauacagaacaugguuuuaugcuaauuuguuuuguuagagugggguauccuaaaaaaugagauccucugaggggaagguuuccagaggcaugcaugggaggcucacagugacaggguaucaaaguugauggacuaggcaacucuugaacacaguauguucacuuccagccuaucguucuccccaccccaacucuccaaccauuaauguccuaggagcuuguaagauacccagaauagugguccuacaucuacuacuacccuugacuguuguuuguccuaaacccuccacuucaguaguauaaauaccacugacuuuauuuucauuacuuuuuaaaaacaucuccucuguaauaggaauuuauauaacugauaauuggcuuauuuaaauuaugauugaaggcauuuaaauagugaugacuuuaaaaacuaugaguauggucaaaccaguugcuguacucacuuaugauuaucaguagucucuuaucugauuaauguuuaacuuaucaaauuuauuuuaauaaaaguguucuuuacagguccugagaaguauuucucguuuucauuggagaucacagcauacaaaagccaaucgacaacgugaaccaggauuaggauuuaguuuugguauauguucgguucuaucuuuugacuuuaaacuuauacauaugaagcuuuauauguuuuguuuggaauauguuuguaaauaaacuuaauaaugucuuucaaugaguagaaccaguccacuguccacagauaauuuacaauaacucacacuccauucuuccugaucucauuuucuuccucaguauacuacacuguacauuagaucuguuuuagcagcauacauacacuuaaauuccuuccuuuuuuucugaguguuuagcccaaaauaaaugagauuuacugauauauaugaauagucuucaacuuacauaucugaaugccacaaauacauuuuaaaaacacuuguuagauuacaauucuaggugccugguaauaagcuaaagcuuguuuuugcuauaauauauccaaauugcaauuuugguacuauuagaugaaguucucacuccugggaccagggagccaugauuuuuuuuccucugcccucuauaaaaugaaaacuacacacaaaaaauuugaaauaauaucuaucuuuggcauucuuggccuucuaaagugcuucuucaaaauuuuuauuuuuucucuaguuaaaaaccauuuacucaauuuauuuggucucagaaaauaguuaaaggcagcugcgauaacucacagcuagguacaaaugacaaucucaaagcucuccagaguuauuuuuuuuauuauuuguuguguuuuuuaaagauuuuucccuuuucuuuauaaagguuuuuuuuuuucuuaccagaauuuaaugaaauuuuucuuuucuuuuucuuucuuucuuuuuucuuuuuuuuuuuuuuuuuaagaugagguuucauugucucauuauguugcccaggccgaucuugaacuccuaggcucaagcaguccucuuauuucagccucccaaagugcugggauuauaggcaugagcuacugcacccagaccaaaugaaaaguuucuguguuuuuuuuuuuuuuccugugacuucuagccaaagacuggaugaaaauuuucucuuuucuuuuuuuugagacagagucucacucugucacccaggcuggugugcaaguggcucacugcaaccucuaccucccaggaucaagcgauucuccugccccagccuccugaguagcugggacuacaggugugggucaucaugccuggcuaauuucuauauuuuuaguagggaugggguuuugccacguuggccaggcuggucucgaacagcugaagacaagugauccacccaccucugccucccaaagugcugggauuacaggcaugaaccacugugcccaaccuaaaugaaaauuuuuuuucuuuucucuuucuguagccaaagacuaaaugaaaguuuucaagcacugugaggauagccauuugggaugguggauuuuuuuuuuuuuuuuuuuuuuuuuuugagacugagucuugcucuguugcucaggcuggauugcaguagcuccaucugggcucauugcaaccucugccuccuggguucaagcgauucuccugccucagccacccaaguagcugagauuacaggugugggccaccauaccuggcuaauuuuuauauuauuaguagauaugagguuucgccauguuggcaacgcuggucucgaacuccuggccucaagugauccacccgucuuguccucccaaagugggauuaugggcauuagccagcaugcccagccaggguaguggaucauacugagauaauuagcauuaauuugguaugauugcuugucacuuuaaauuucucucucaguaguaagagacuugcaggagaaaucuauggugguucacugagugacagaggaugaguuagauauaauuguuugggagggagauugugaaguucaauacgggucuauuccuugaaccaguugcaucugguucuuuaucuguaaaguggaaauaauaucuauaacacagaauuucuaugaagauuaaauuauaugcuguauuuaaagccccuagcacuuagugacuggaucaaaguaguuucucaauaaauaauacauaauacauacuugucauuuuuccuuuuuuuuuuuuuuaagagacaggguuucacucugucacccaagcuggaugcaaccuugaccucuggggcuccauggauucucucgccucagcuuccugagcaguuaggacaauagguccaugucaaccacaccuagcugauuuuuuaaauuuuuaaauguuuuguugagacaggaucuugcuauauugcucaggcuggccccaaacuccuggccucaaaugguucaccugccucagccucccaaaauucuagaauuauaggcaugagcuaccgugcccagacuuucucuacccucuaucuaccugcaagauugcuaucaacuggcaccaaucuuagaaguaaagcugugauagagagaacacuggacugaaauucuuaaguauacuucugcuaauucauugugagacugauacuagaauuuccuuacucugcauuaguuuaucaauaaaaagagagauuuggcugggcgcaguggcucgggccuguaaucccagcacuuugggaggccgaggugggcggaucacgaggucagaagaucgagauccuggugaaaccccgucucuacuaaaaauacaaaaaaaaaaauuagccgggcgcgguggcaggcaccuguagucccagcugcucaggaggcugagacaggagaauggcgugaacccgggaggcggagcuugcagugagccuagauugcgccacugcacuccagucugggcgacagagcgagacuccgucucaaaaaaaaaaaaaaaaaaaaaaaaaaagagauuugaucuuaugcucuucaauucagcaccagaauucagcuuuuauguauuguuucucacauccccauacaaaugauuacuguagucuuaaacauuccucugugcauuugcucucauuuuucuugcuugaaauacccuauuaucucuuaaauuuuaccuaaucuuugacguuagaugcaaccacauuaaaacacaaggauaccauggauuugaaaagaugcaguuagcaauugacuccucuccucaaucaagccaccauacuaauuucauuaauuuuaaaacaaucccuuauuuuauguaaacaaauuguuggacaccauuuauuagcauugcagcaggauuuuauguuauuaucuuuugaaaaaccuuucuaccacuuuuaccaguugcuuugugcuaauuuauaagcuugucugaguuuaaaggagcuguaagccuaggcauggugucucaugcuuguaaucccagcacuuuaggagaccacggcaggaggauugcuugaggccacgaguucaagaccagccuggcaucauagugagacccugucucugugaaaacaaaaaaaaugaaauagauagggugagguggcucccagcacuuugggaggccaagaugggagaaucauuugagcccaggaguucuagacccauuugggcaacauggcaaaacccuguaucuacaaaaauuacaaaaauuagccagauaugguggcaugugccugugaucccagcuaguugagaagcuguggugggaagaucauuuaaggccaggaggucgaggcuacagugagucguaauugcaccacugcacuccagccugagugacaaaaugagacugucucaaaaaaaaaaagcaaaauuaugauauugauauucuuauaugacacuuugaaauaaguuuuauugcuuuaugucacugaguguguuucaucuauuucguuagauugauucuugucgucagggagaugucuuguauauuaguuucacuucaguguuagcaaacauuugauaaauuggcuuaggaacuaauaauaaguuaaacguuuuuuauaucaccaauuggaaaagaaaaacucacuugagcucuacagguuaauaucuauuacucauuuguaaaaguuaaaaaucuuaccuauuuccuuuagcauuuguauugacauagguuuauuuauauuguguagugaacucuugauuagucaaaaaaugcacuguagucugaguuucugauaaucaaggauuuaaguccccacaauaaauacacauuucuacauacugacuucauaggacauuuuuccuuguuauccaguuuuaacuuuucuaaauaauuuucccuuagaguucaccgaacagcagaaagaauuucaagcuacugcucguaaauuugccagagaggaaaucaucccaguggcugcagaauaugauaaaacuggugaaguagguauauacauuuuaaagagggaaaaaucuuuuacauuuuuuacaagauuauguaaucaaacuaucuggauuucaaaauauauuuuaacucaguucuuuuucuucuaguauccagucccccuaauuagaagagccugggaacuugguuuaaugaacacacacauuccagagaacugugguaagcuuucuuuauauuuuuaauacuggaaugcauaugaguaagaaaaauuguggaacucuacucagucauuuuuuucaaauauuucuugccauuaaaugacuuucuaccuuugucuuccugcucagacuacaguguuugcccacuuuuggaagcuugcacucuauaccuagaugcguuuuuccuucuucuaacugguuccaaccuuaacuugcaccuaaaccuugguaacuuccguuucuagaguuggucaauuuguuguguuuuauuccuaucuucuauauuacauuuuauugagucuuuuuugugaaccaugauucuuuuccucagacccaguuuuagaguugaauugaguuuuaacaaaaucaaguuagaacaggaauacagguucaaauuacaaauaguaaaauaauuuuuugaaaauuuuagagcuuuaagaaaguauaauuucuuauugugccagccagaacacauguagauauuauauugcaaauuuccuuuuaaaacaaauuuuggucauauugaaagcaauuaaaauaguuuaccuuuauuucuauugugauguacuacauauuacaauguguugaaacauuuugauacuguaggaggucuuggacuuggaacuuuugaugcuuguuuaauuagugaagaauuggcuuauggauguacagggguucagacugcuauugaaggaaauucuuuggggguaagugacuuagaaaauuaacuaccuaacucagcucuuguuaaugagauaguuacuccugaagaaguuggauuuuuagaagaaaaaaaaaggaaagucaguuacuacuagguaagguuaguggguacacacaguuuucuuuaaagaggaacacaagauucagcagugaagccuggaguucugauuucgaggcuugauaacucuggccuugucucuaguacucggaguucugacuguccuuuggaggaaacuguauacuuuggcugcagcuucaguggcaauucuuagguaaagccaagggcuaaauccagaauucaggagcaggauugggaugguuugcugccacuauggcaguacugaaauuuagcaagcaauucuuuuuuuucucacucugucgcccaggcuggaguguaguagcgcgaucuuggcucacugcaaccugcaccuccuggguucaagcaauucuccugccucagccuccugaguagcugggauuacaagugcgcaccaccacgcccagcuaauuuuuguauuuuuuuuuuuuuuuuuuuuugagacggagucucacucuguugcccaggcuggagugcaguggcgcgaucucagcucacugcaagcuccgccucccagguucacgccauucuccugucucagccucccaaguaacugggacuacaggcgcccgccaccaugcccggcuaauuuuuuuuuuuuuuuuuuguauuuuuaguagagacggggugucacccuguuggccaggauggucucuaucucuugaccucguaauccgcccaccucggccucccaaagugcugggauuacaggcgugagccacugcgcccggccuaacaagcaauucuuaggccugaucauacauacugugucacauauucuaaacauaauuuuuuauuagugcauuucacuauaguagauuuucacagauuauaaugccacagguccuacauauaaccuaauuuuaugaaaauacuuagauuagcagauuuauuuccucauucuaacuuagaggcaagguauaggccaguucuuuggacuuaccuguuaggugaaaaauaguuauuuuuucauuuugaauuauagcaucucugaauuuacauauccaauaaaaaugacuugauuuuuuaaugucaauuuucuucgguagcaaaugccuauuauuauugcuggaaaugaucaacaaaagaagaaguauuuggggagaaugacugaggagccauugaugugugugaguauguguaacugccgcuuuauuucacacuuaagaagggaacaaaggugcuauuucuccuuuucagucuauauguauauauugggauauuuagcauugaaacaaaacuuagcaacauauuauuacaaugaugugucaaggaugccaagaaaguaucauaauaggccgagggcaauggcucgcaccuguaaucccagcacuuugggaggcggaggcgggcagauuacuugagguuaggaguucacagccuggcuaacguggugaaaccccaucucuacugaaaauacaaaaauuaaccaggcgugauggcgccugccuauaaucccagcugcucaggaggcugaggcauaagaaucgcuugaacccgaaaaguggaagaugcagugagcagagaucacaccacugcacugcuaccugggcgacagagugagugagacccugucucaaaaaaaaaaaaaaaaaaaaggugucaucauaauuuuguugcuuauuuccaggagaagagagaucuacuugugauguuuuugggaugucaaaaagugucauaauaauccucuuacuucaggagagagagcucuauuuaguggagcauucuacacuuuaagaacugagucauugugucaggaaguucagauugaauguagggcaauguguguuugaacuaguaguguuuugaauuaguaaaaaauuaauguuggcuggucgugguggcucacgccuguaaucccagcacuuugagagucugaggcagguggaucaccugagguuaggaguucgagaccagccuagccaaaauggagaaaccccaucucuacuaaaaauacaaaaauuagcuggaugugguggcgcuugccagcuacuugggaggcugaggcaugagaaucucuugaaccugggaggcagagguugcugaguaaagauggcggcacugcacuccagccugggcaacagagugagacucugucucaaaaaaaaaaaaaagcaauuaaugugggcugggcauaguggcucacaccuguaaugucagcacuuugagaggcuaaggcaggagaacugcuugagcccgggaguucaagaccagccuggguaacacagugagacccugucucuaaauaaauaaauaaaugaauaaauaaauaaaaauuaaugugaaccuguaacugaagaaauagcaacuuauuuguugaaugacugaaugacuugggaagaauaguuguagaguuuauuuaaaccucugaaagcaacucaacaaauuuuuaaauuagauuuuuuuaacaagauaaauacacacacagacauacacacacacacacacacacacacacacacacgcucuauucugaaacuguuguuuaccuaaggauuuuuacuucuuguuuacucaaacauauuucaaucuaaggugugguuguuauacugaaauacaguagauguauuaguuuugagcuaaugaugagaauucaucuuaaagaacagaaaauaauauuugaaaauaaauguuuuuuauuucagauaccuaaaauuucaagcaaacuguuuaauaaaggaauuuguacauauuugcuaggaaauuugcaauuuuuuuuaacaauugagagguuagcuaaacauucucacuauugucuauaagaacugugugaaacgucuagauuguucuccuguagcauauacagucagcucuccauauccaugagggaauaguuuaggacagguugcccuccauaucaaaauuuuugguugccaagucuguuauacaaaauguacaguuagcccuuuguaucuguggguuuugcuccacaguugguuaaauuccaaaauucguggaugccaaaggcaaacuuuuaaaaaauuaaaauuuuauaacuuuucuaauuauaaaauacugaguauagaaaauuuagaaauguuuuaaguagaacaaaaauaucuguaaucccucagauauggaguuaauuaguauuacuuccuuauuguagugccuaccacauuuuuaaauauguaauuguguuuuuaacaguuagcccccauuauauacauguaguuuuauguacaucuuuauuuaacaacaugaacauuuucuuaugccuuccuucuuuuuacaugcuguaacaauacugcauaauuugcuaucuaauggauaugcuauaaauuguuucacuuuucuguacuguugaauguuuaaacuccuuggguuuuuacuuuggaaaauaauguuaugguaaaaaauaauacagaaaaaaaauaaauaaaaaugaucaaauaagaagccaagaacaggccaggcaugguggcucaugccuguaaucuuaacacuuugggaagccaaggcaggaggaucgcuugaggccaggaguucaagaccagccuggacaacguugagagacugccaccacacacacacacaaauauauauauauauauauauauauauauauauauauauauauauauaugaaaccaaaaagaagaaaagaagacaaaaacaacucugaggaaccaguagugacaagccauuuuguauagaaaaaaacaggcucauuuacuucacaggcucuaaaaacuucacuguauuaugaaacagacagaugucuaauagcauauuucagggaaaaaaauaccuuaaaggugguuaaaacaaaauuuugguacuuaaaaggggcaucuuuuauggacaacuccuuaauuugucaugaugcugaauacaucaaaucuccagguagcagaguaaucuaguucaguuaacuugagugacaccugaauccccucuacagaaucccugucaaaagaccaucuggcugacauguuuuuauaccucaggugccugggaaucaacaccuucugaaacagcaucauuugcgagcaucuguuaucauuagaaaaauauuuuggauuacauaaugcuuaagcacagaaccugucauuuuuuuuuuuauaauuuuaccaguucauacuguaauagguguucaauaaauguuagagugauuucacuguacuuuucuuuggcuauauugcccuucagauguuugaguauaguuauauuuauuuauuuauuuauuuuuugagacggagucucgcucuguugcccaggucggagugcaguggugugaucuuggcccacugcaaccucugccucccagguucaagcgauucuccugccucagccucccaagcagcugggacuacaggugcgugccaccacgccugccuaauuuuuuguauguuuaguagagacaagauuucacuguguuagccaggauggucucuaucuccugaccucaugaucugcccaccuuggccucccaaugugcuggaauuacaggugugagccaccaugcccagccaaguauuguuauuauuuuuuuuuucugaaauggagucucgcucuguugccuaggcuggagugcaguggcaccaucucggcucacugcaaccuccaccucccagguucaagcaauucuuccucagccucccaaguagcugggauuacaggcgcccgccaccaagccuggcuaaguuuuuguauuuuuaguagagacaggguuucaccauguuggccaggcuggucucgaacuccuaaccucaggugacccaccugccucggccucccaaagugcugggauuacaaaccugaagccucagccaccacgcccggcccuaaguaaucauuucuagugccccuauauaugcuuacuacuuugaauuaaaauguauauaguuucuuucuuuuuuguuguauauuuuuaaaaaauaaauugacauggguucucggcauguugaccaggcuggucuugaacuccuggucucaagcgauccucccaucucagccucacaaaaugcuaggauuacagguggggggccaccaugcucggcccaguuucuuucuucuuuggacuguaaguaccuuaagggcaaguaacuuguuucuuuaguauccacaguaccggccacucuugaauuaacuugcacuaacacuugccuucuaccacccccuuuuauccauuacugcuugugucuugucacuccucuguuuaagagcucuaagaggcuccccuguuucuaccagauaaaauuuuaaauuuguaaugugauauaaaagauucucgucgaccauuuccuuccuuucuuuccagacucaugucuuaccauucccuuacaugcacagaauuuacauacuguggaacucugguacuuucagcauuagaaacacuggguaacucuguuucuuaucuuagugucauagcauaugccauuacuuguaccuggaaugcauauucuuccucuuuuucccuccucgcaaagaagccauuuuccuuuuugagacuuaauuuaaacauccucugcccugggaaacuaguuucucaagccccuugucugacuuucacacauagaguugcaguauaguuauuuaucuucacuguuacauugugaaaaucucuaggacugaaugucuuuuaccucugguuuccccauauccuaauuuacaucgugguacauaguagauauucaauacauguuugcaugaaugaauacaugugaaauugaauuuaaugaacuuguuuaaagcuaucuaacauuuucacuuuuuauuaaauauaugauuuguugauauaccuaugccuaauuugaauuauauauuaaguguuuuuaggccaggcacuguggcucauaccuguagucccagcacuuugggaggcugaggcagaggauugccugagcccaggagguugagaccagccuaggcaacacagugagaugccaugucuacaaaaaauuuaaaauuagcugggcauggugaugugugcuugcagucucagcuauuauacacgggaggcugaggcgggaggauuuccugaguccaggaagccaagacugcauugagccucugcauuccagccugggcaagagagugagacccugucucuuacaaacaaaacagaaaaguuuuuacauuugagugguuucuuugauuuuguaagaacauuuuaauuuuagauauuuaaaaauauuuaaaauacagcuuaaaaaauaaaacaauccuguuuccaaacagucaaaauuuaaucacuaacauuuaauuucauuucucuuguuuuuauauauucaaggcuuauuguguaacagaaccuggagcaggcucugauguagcugguauaaagaccaaagcagaaaagaaaggagaugaguauauuauuaauggucagaagauguggauaaccaacggaggaaaagcuaauugguauguuguucaaaacaucuuuguauauuuuuucuuaauuguuuuaucuucaaaucucucuuucuuucuguauauuuuuaaaccacuacaguuaagguauguuuguggaacuggaaggccuaaaggagauuauaaacaguucagugauuuucaaaaacuaauuuuaagccccugcacuguuuuuucaaauuaacucucagaaguuuaauguguaaaauaaaauacaaaugcgugcucuguuugaaucugauuaggaaggcuagcacucugucuacuuggcuuauuaucuccacuccucaucuccuauaccagccgcuccuuggaaucccuaaaacccuaaggaaaaaggagaaccuuugguauagugccugucuccagaugucagaaauaaacagagucagucuuaaaacagguuaucuauuagagaagacagaauuugacuuuaauaaaaucugaaauuuucuaauauauggucaaaaaauaugaaguucaacaaaggaucaaaaauaauuuguauaaauauaaaauacuaaaaaaaaacacucgauuauuuguugauaaaagaugaggaaaguucaauaacuguuaaguucaauaagaaucaauaguaugagccuuuaaaaagccaauguaauuuuaagccaaaguaauagaaguacagcaucaaauagagaaaaaauggugacaguucugggcaacacauuuuaaaacauguauugaaaaacuugacuaaaucuagaagcauguaaguaucuugcauuaggaggagccuacaaaacauguucugaaaagcaaagccuugguuauuuuggaagaaucuugaaguuuuucaaauauuauuacacagaaagaugaucaggcuuauauguuuacuucaggaugccagcuuagaauuaaugagugaaaguuagaaaaauguagaauuuagcuuaacauaaggacaggcuuucuaucagcagugcuguuaaguugucaugggaaauacuguauuuacccaucacuacaaguauauagagaguuucuagaauaacuuuuuauugauuggaauaauguacuaaaugaccugucucucuuuguaaaaaauucagauucaauauauuugugugccauauacuacaguuuucuagcaaauaaaacaucauuuuuuuucagagugagccuacuaaaaaguuacuuagauuaaacauaucagucaauuccuuaugagcauccuaaauauauucaguauuauggagugcuauaucuuuaccuuuaaccaauuccugguaauaucagcaacuaauaaaaagugaagaaacuauuaaaauuuaacaaguugagagaaaucuaacaaugcaguuugaaguuuucguaauuuuaaaaacggauuagccaggugcaaucacucacgucuacaaucccagcaguuuuggaggcugaggcaggaggauugcuugagcccagggguucaagaccagcuugggcaacauaacgagaccccaucuuuacaaaauuaaaacaaaaagaaagaacugauuacaacuguucacuguucauauaguaaggcaaauuagguaauauaugaaaccagauaacaauuuuuacgauuuuguuacuauuauuaaauaaaacuauagaaugagugguaauguauugguuuuaaccaaagaaaauaaguuuguguuguuuagggaagaauauaccuuuuuaaaagaauuuuucguguaccaggauauauagaacaugaauuagacagaugcuuggauauuugcauuuuuuucuuauguugcacuucaagaucuuucugagaaauucuucuguaggaaaaaaucagcaaauauucauaauaacucagcuauaacaaaaacacugacuugcugcauaaagaaacaguaguuggaacauauggaucuccauuuuauuuauuuauuuuuuugagaacaucugcccuuuaauuugcauuuaaaaucaguuucuuuaaauacuuuaguuacaaguucugaauagugaagacagaguaguagaugcugcaggcacucaguauuggcucccaccccuuccccccuccccacccccaggccucacuucuuggcucaagauacaaaaaggcacucucuacuggcccuagugucaaaugucagcagccucaggccuggaugcaguuggauacaaagccaugaaucccaguagcuccaaggaauuccaaugauugugcccagauccaccggcaacacaucuuagaaaugaccucauccauuacaccacuaucuacuaacacccucagggugguuuccuaccccaguccacguccuccaaaucuguguccugcagaggaagagacaaggccccacuauaacgcaggaaggaacaagaacugccuccucagcccacgggcuuacagcaacuuacuugaaaagcucaaggcaaucugagucuagaggagaccucccuucccuaaucucuaccaggcucuggcccuucuucgggacuacgcuugguuccacugccaugaugugcuagaaucugcucuaaguaagaacaaggugcuagaaugaggcccagcaaccaggaaaggguugcuacagccccagcugugugagauugugccaagaugagucuucuuggugugagccuaugauggagagcgugagggcagaccugggcucuccuucuaugaugauuacaacacgugaccucagggaaccucugcucucuccucccauucacacacccagauccccuggccugugcuuccugguagagguagaagaggcaucuugaagucaaugacaauggagaaugaaggugccauugaagaaggaaagcagcaccucuuugccuguguucaaucccuccauacaaguggaaucgagaaugugcacagccaggacagaggcugcucugagcuugggaggcacagcauccuccuagaugucucugcagaacaaacuuucaaaagauaggaacuuaaucacaugguccucggggguuucucuauaguauaccagcacuagggagaagcaaaaucaucuuugcagagagcugauggaagaaaggcaggaauaugaaugagcauccauuaaggcucucucucucaagccuaaggaauuaagauauucgaggguaugagacaggugcagagagggagagagccaggcaggaacaccaagaaaaaagcugugacugcugguuacauagugcucugcuuccuugcuugaggccaacagcaugugccugucaccaggcuaaccugggacccaugaggggacagggagaagacugguuuucaguuccugcaugaucaauuuguaggguguguggguuccuccuaaagaucaaagaggaggacucugggauccucuaccgcugccuugauuuugcggaggaaagucacagccucucugccaucaaucagccggugaucauaggucagugccacguacaucaugggcugcaccucuaccuugccuccuauagccacuggcuugucaaagaugccaugcauccccaggauggcagacagggggguugauaauggguguucaaagagugagccaaaaacaccuccauugcuaauggugaagguaccaccauccauaucuucaauggcaaauucauucuuucgggccuucucucccaguucagugauggucuguucaauaucugcauaauucauagcuuccacauuccugaugacuggaaccaccagacccugugggguggccacugcaacacugaugucaauauaaucccuauauaccaccucuuugguuauaucaucaaucacugcguuuacaacaggcuguuccugcaaggcaaaggcugaggccuucacagaugccgacaugaagccuaguuugagguuauguuucuucaaaaaagccucuuugugccgagcccucaucuucuggauguuacucacaucaaucucauuaaaaauugucagcauuggcacauguauucugggccuccuucagacgcugagcaaugcacugccgcauccuguucauuuucuccugauguucugaaugcagaccuuugccagcuccuggcucagcuaguggugggacagcaguggguuuuacugcagacacagguuugcuagaaggagguugugagggcgagggcacugguggcaucgaguggguaugggugcugcauggggaggaacugccgcugcuauagguucugcuuuuggggcugcagcagcaggagcuucagccggcuuggccuuagcaggagcagcaccaguuuuccugagugugaaaagcggagugccuccuucgacuuuucccccaucagguacgaaaagagcuucaaucaugccauuugcuggugauggaaccugcaccaaugucuugucaguuucaaucucacaaaccacuucaucuucugcaacugugucuccaacagcuuucucccaccugacaucucccucugugacagguucugcaaacgcugggguuuugacuguaaccaagucauacuugcauacaguuguaguucugaagaagcgaacacugaagacacuguuguuaaugacaaccuuccugcuguuaggguaaccuggucccuggcauaaggagaccccaggcagggaaugucucccuagagggcaguuccccuucuggaaggcagagagcgaguggcugaacgcccgggacacagugggaccgggacagcaucacggcggccgggucuccguuuuauauuauuccuuuucacaggcagcucuauuugcccuccuuuucaagauagcaugccccuuaaagaauaaaauuaguuuugggaaagaaaaagugccaguuucaacaggcauagacugucuuguuguaauaauaauacuauaccaggaauuuuuacuugcaacucauauuacuaaaagaaaguuaaauagcauacuauagucccuccuuauccuugcaggauacauuccaggaccccuaauggaugccugaaaccucagaaauaccaaacccuguauauacuauguuuuuuuccuacacauauauacuuauuauaaaguuuaaucuauaaagugggcccagcaagagauuaacaacaacuaauaaaauagaacuauaacaauguauuguaauaaguuauguaaauguaggccaggcaugguggcucacaccuguaaucccagcacuuuagaaggcccacgugggaagaucccuugaguccaagaguuugagaccagccugggaaagguagugagacuucaucccuacaaaaaauaaacaaaaaauuagcuaggcaugguggcacaugcccauaguaccagugacucagaagagguggaaggauggcuugagcuggggaagucgagacugcagugagccaagaucaugccacuguacuccagccugcgcaacagagugagaucuugucuaaaaaaaaaaaguuauguaaauguccucuuugucuuucaaaauaucauauauacuguacugcggguaacugaaaccacagaaagugaaaccccauggaaugggggagggccuacuguguuauuaagacauagaccucaaauacuagcucuuccauauacuagguacgugacuaggcaaguuuuuaaaccugauuauuuauuuccucauuuguaaaauguagguaauaauaauugggauuguuaagagaauuaacugagagagcaaucaccauguguuauuugccgauauuaucaccauuauccgguauguguaucucuuagguauuuuuuauuggcacguucugauccagauccuaaagcuccugcuaauaaagccuuuacuggauucauuguggaagcagauaccccaggaauucagauugggagaaagguaaaguauuuauuaaugauuagggccccaaauauuauuuuaauuauaaauugcaaaauuacuuaacuuuccuuuaauaaaaacauuuguuuguauuaaguuggaguaaaaauaaagcuauguuuugaugauauuagaucaaauagucuauauacuacugaagauuuugugaacagucauuucaagucauuuugaaagaguaguaccaaccuguggagaaggcuaauaacagcugugaggaauaaugaaguaaaaucaagcuaucauuuauauuaccugaccaauaauaagaauucuggauauuucaagggacuuucccacucuuuuccccauuggauccucacagcaaccuuuugguaggauaaguggcauuaugcccauuuuacagauaaaaacaaugugacauaacugagauuuuacuaggucauacaacacuaagaaaaaagucuaugccugaaaagaguguagaaaauagcaaauagccuugaauauggaaaggcaagaaaaucuuacuuaaauaagaaaagguaauuuaacauauuugaaaagguuuguauucugaauauguggagauaaauuuggcauuuaaaguagacuaaagagaaaagaguuuaaaauuuuauaaaucacaauuuaaaauuauaaauuuuauaaagaaggaaagaaaugaagucaauaaaguaauuuuuuuuuuuuuuuuuugagacagcgucucgcucuguugcccaggcuggagugcaguggcaggaucucagcucacugcaaccucugccuccugggcucaaacaaucaucccaccucagccuccugaguggcuaggauuauuggcaugcaccaccacaccuggcuaauuuuuguauuuuuuguagagacaggguugugcuguguugcccaggcuggucucagacuccugggcucaagcaauccucccaccuuggcccccuaaagugcugggauuacaggcaugagccacugcgcccaaccaaagucccaaaguuagaggcagaguugaaaucaauaugaagguauccuaggaccuuacccaguauaguuucugauacuguauugugcuauauuuucaaucagauauuaaagguagacugcacuugacaaaacagaugauacuguuguauguaacaaaauauaagaauuaaaaauuauugugcuuuucccaagaaauuguuuuuuauuuguauaacagaucauguuucugucuuagggauaguugcuagcaaacuuggccaaauguauggcccaucuuuagaaaguauaaaggaccuaacagcuuauacuuuuuuuaguaguaaacucacuccugauuuuaucuugcuauuucuaguuuuuuucuuugccuaauuuucucacuuaaaaaaaaaucuacuucaauaaauauuuauguagugcauacuauauacaguauucuaucuauuagggauacaguauggaucaaaauagacaaaaaucccuggccuuagguaaauuacuuucuggugagugauagagauaauuauauuguguauauuuaagccuccuuaaaucuuuauugaaacaaauggauauuuacaaauuugugaaauuuaauguuuucaggccagguuuggugguucaugacuguaauccuagcacuuugggagguugaggugggagaacuauuugaacccaggaguucaggaccagccugggcaacauauugagacuuuaccucuacaaaaaaauuugaaaauuagccaguggcaguggcgcacaccuguagucccagcuacuuggaaggcugaagugggaggaucaccuaagcccaggaagucaaggcugcagugagccaugcuccuguugcugucuguacugcagccuggaugacagagugagaccuaauguuuucaaaucuuuuguguuuuagaaauuauaugguuugagaugagcccaggaagcauuuugguuuuaaauguugugggguuugggauaaaucugguaggguguuuucucauuauauaugcauggugguccaagauucuaguuuauuaacuuuuaaagacaaaauaaagggauguuggcuucuuucuaggucaaacuaucguuauuauuucuucaaacucagaagcagacuauuaaaaccagcaaauuaaaggguuaguuuauagcucuuuguuuccauugcuccuguuucuuauucugcuuauuaaacaugagaucaaguuuuuuuccuuauuaagaguuaugucugcaacuuccucucaugauuuagcauaacacuaauagucauauacaaagagaaagagaaauaaaaaauaaagcaaauguaucaaaauguuaacaauuggugaaucuauuauagaugaaggguguauaaguacuuacaugccuguuacaacuccuccauugguuugaaaauuuuuaaaacaaaaaguugagggaauguagcuaguuuaguaguuucuuauaaagucaaacauacacuuaucacauaaccagugcccuuaaauaaauacccaagagaaaugaaaauaaagaccuauauacaaauguuuauuguaauuuuauuaaugauugcuaaaaaggaggggaguauccgucaacuagugaaaagauaauggauauaugguacauccaagagugggauacuacuuagcaguaaaauaaaugaauuauugaucaugcagcaacauggaugaaucucagaagcacuauacuaagugaaaagucagacacagaaagcggacuuuauuauuucacuuaaaugacauucuggaaaaggaaagacuacgcggagagaaaucacacagugguugccaggggauaaguguagaauaaggaaauugacuauaaagggagaacaagguaacuuuuugggguucuaaaguacucuguaucuugagcaugguggugguuacacacauauacauuugucagagcuauuagaaauguauacauaaaaauggugacuuuucuacauguaaauuauaccucaguaaaccuaauuuuaacagagucaaaggaaaacaaaaucaauuuuuauucaguagauuauuuuacuagcucuauuaagauuaaaggucucaaaucagauuguguuuacuaaauguuuuuucugacaugguaaaauagauagcuuucaaacauauaaugagauuugucuuuguugauaagauguacuuguagaccuuuagacuaguguugguuucaaaauuugugaaacauuguuuuagauuaugguuggcaaauuuuuuuguaaagauccaaauuauaaauauuucaggcuuugcaggccauaucucugucacaacuacucaguucugccauuguagcaagaaaguaacuguagaugauauaugaacaaauaggcgugacuguauuccaaucaggcuuucuuugcaaaacaggcauugcagacuacaguuuguugaucccuguuuuagguaauugcagaaagucaugaaacagugauuaaagcaaaaauugaugcuggcucaaaaaaaauuccuuaaaauauaucaauuuucuuauuaggaauuaaacaugggccagcgauguucagauacuagaggaauugucuucgaagaugugaaagugccuaaagaaaauguuuuaauuggugacggagcugguuucaaaguugcaaugggagcuuuugauaaaaccagaccuguaguaaguaauauggguucauaaucuuuauaggaucuuuuauuuauuacauuaaauaaguauuuuuacuuuaaaauuguauguucaguguguuucucuuuuuaauaucugcuuauuuuauuaaggauauaggaaaaauacuguuacuuuucuuucuuuuuuuuuuuuuuuuuuugagacagagucucacucugucaccaggauggagugcaguggugcaaucucagcucauugcaaccuucacguccuggguucaagagauucuccugccuuagccucaugaguagcugggacuacaggugcacaccacucugcccagcuaauuuuuguauuuuuaguagagaugggguuucaugauguuggccaggauggucucgaucucuugaccucgugaucugccuaccucggccucccaaagugcugggauuacaggcgugagccaccgcgccugaccauauuguuacuuuucuuaauuuuuuaaauaauucuucaaguuuucuuacuauacauuauagaaauuauuuuagcaacugcaaaauuacuguaguuggugcuagauuuagagaggcaguccacccuaaauaugaucauccuguuaauauguacucauuuucuguuuuuacucauuaagaacauuuccccuaguaagauuucucuuguuaaacaaaagcaaugacuuuuuucuagaguaugauacuaugccuaacaaaugccucuuacuaccuuuaauuaacaaauaauauaaacuuacgugccuauucccuguuccccaccaguuucuuguugcuguacaucaccuucucuuuguacacucccuaacauagacacuuaggcagauauuguguguuuuaaagauaacaugaacuuuugcuuuauaauaucuuaaaauacuagguagcugcuggugcuguuggauuagcacaaagagcuuuggaugaagcuaccaaguaugcccuggaaaggaaaacuuucggaaagcuacuuguagagguaauuuuaauacugcuugcuuuguucaaauguaaagacacucauuuucauuuaauauuuagaaaugauuuuuaaaccacaaacuaaucaauuucuacuuugauagcaagaagauaaugugguuuuaucaagaugaguuucaaagacauuucuuuuuagagugugccacuauugguuacuucugaaccugacacugugcuaugcauuuuuuuuuuuuuuugagauggagucucgcucuguugcucaggcuagagugcaguggcacaaucucgguucaccacagucuccgccucccgaguucgaguaauucuccugccucagccucccaaguagugggaacuacaggugcgcaccacuaugccuggcuaauuuuuguauuuuuaguagagaugggguuucacuauguuggccaggcuggucucgaucugcccgccucagccucccauagugcugggauuacaggcaugagccacugggcccggccuugugcuaugcauuuuaaauauauuuucuagccgggcgcgguggaucacgccuguaaucccagcacuuugggaggcugaggcgggcggaucaugaggucaggagaucaagaccauccuggcuaacacggugaaaccccgucucuacuaaaaauacaaaaauuagccgagcaugguggugggcgccuguagucccagcuacucgggaggcugaggcaggaggauggcgugaacccaggaggcagagcuugcagugagccaagaucacgccacugcacuccagccugggcgacagagugagacuccgucucaaaaaagaaaauauauauauauuuucugauucucucaguaacccuuuuuugggugguguuaucucuuuuaaggaucaagaaacugaagcucagagguauuaaaugauuuguccaaggccacacaauuuauaagucacagauccaggauccuugcuuuuuuuuuuuugcggggggugggagacaaagucuugcucugucguccaagcugaaguacaguggcaugaucugggcucacugaaacccccaccuccuguguucaagugauucuccugccucagccucccgagucgcugggacuacaggcacacaccaccacacccagcaaauuuugauauuuuuaguagagaugggguucccuuauguuggccaggcugguguugaacuccuggccucaagugaucugccugccucggccucccaaagugcuaggauuacaggccugaaccacugcgccuggccuauguuauacucuuaauucuuguuacuucccauguccucuugaguaucagauaauuuuaguacuauaaagagucgugucuuccaugaauuuccaggguaauucuuaacucuuaccccuuuaaauauugaugcucccccauuaucuguauucuuuccugcaacucacuaugaguuguauagugaaccuccuauuucucuuuuuuuuuuuuuuugagacagggucuugguugcccaaaugcgagugcaauggugcagucauggcuuauugcagccucuugggaucaagcaauccucccaccucagccuccuaaauaacuggaacuauaggggcacacuaccaugccugccuaauuuuuuuauuuuuguagagaugaggucucacuauguugcccagacuggucucaaacaccugagcucaagcaaucuuuccaccucagccccccaugagccuccuauuccuaucuccauuugucagugguucucaaacuauuuguggugaaagaccaguuuguuuuaauuuccaguuaauguggaccauuauuuuuguaaaauauaagaaugucacaacaauguuaaauugcuguaaaagugucuaaaugcuuauucucaucuucuguaccaucaaccaguaacaguuugugaauuggcacuguggacaaacuuggauuagcacugcucugugucccuuaaccuuaguuucauaauguaucuuucuacacuauauucuagauaauuuuuucagaucugcuuucuaguucucuuaucuugugccuaaucuauuuaaucuguugauuuuuuauuaaugacuacuuuucauuuccagaaguuauauuugguuuuuuccauuauaccuucuguucaacaucauaccgccuuuuccuuuuuucucauuaaucauguaaaaauucuucauuuauaaucaauuucagauuuuuuuguuaucuucaauucuuugggugcuaaucuuucaagguguauugugucuucuaacucuuuuauggucaauuauuuugcuuuuauuuuuuauuuguaaacaacuuaccugcaggaaguacucuauuucucagagcauuauggaagcauuuuagaaauuggcuuuuguacuuuuuuggcacuuuuguuagguacuccagagauuucaccauucuaagagcuguuauuuuacauuaauuucuugacuuggagaauccuguaucacagagcucguacauugaucucacacauuaagaaacuccguacauuccagucugggcaacagugugagacccugucucaaaacaacaacaauaacaaaaguccuuuuuuuucuuguucuuuuuuuaacccuccugggcaagagaucagcuucuuuguggcccuccuaugcugaugagcccagacuuuuaauugccccuuuggaaagcaaagcuuuuacaugcagugauucucaguuuuagccccuuagauuguucaugcucacaucgaaaucuccuguucuuauguguuucuuaaaacucugguuccuauccugcugagcccaaaucugagucugauuuuucuuuuccuccauguuaucucuucucaggauuuaaauuccuuuuuagaggcacuuagagauuucuguuucuuuccuaugagcuuuuuuuuuuucuuaaccaaguauuucuuuguuaacuccuucauguugccagaacuacauauguacauuuuacuaaauguuaguuuaucuuauucauaaacaaauuucaaccuaaugcuuuucagugaagaucugucaucgucuuccagguccuccuuacccaaguaucugaugauaacuguauuuuuggcuuucaacucaauauagaaucuucuccuuuuauguucucuuucuuauaaauucuaaagauuuuuuucuuauuaaauauugaaaaaucuuaguuuuuccuuacugcuuaacucaaaauagucuuuuaucauuugauuucuacugaagauuugcuuaucuuuuaagcacucugcaaaaugcugauagcuucuuuuuuuuuuuuuuuuuuugagacagggucucacucuauugcccaggcuggagugcaauggugugaucucagcucacugcaaccacugccuccuggcuuaagugauccuccuaccuuagccuccugaguagcuggaacuauaggugugagccaccaugcucagcuuuuuuuuuuuuuuuuuguagaaaugggguuuugccauguuaccuaggcuggucucgaacuccugagcuugaguaauccgcccaucuuggucucccaaagugcugggauuacaggcaugagugacugcgccuggccuaguuuuucauuuuuaauugguagguacagugauaugacacuguaauuccuugucacuccuuugcuaggugucucucaacccauuugugugcccuuugaaacuucaguuuuuuguuuuuuuuuuuuuuuugagacggagucuuacucuguugcccaggcuggagugcaguggugcgaucucugcucccugcaaccucugcccccgggguucaagugauucuccugccucagccucccgaguagcuggguuuacaggugcccgcaacugcacccggcuaauuuucuuuuguacuuuuaguagagaugagguuucaccaucuuggccaggcuggucuuaaacuccugaccuugugauccacccaccuuggccucccaguguugggauuacaggcgugagccaccguguccagccacuugucuuucagucuguguacucuauguauagcauuaugaaugaaaagggucagguuauucuuggaauccacaauuaaauaauuguuuagccauuucaugugugguauuagaaaauauacaaugaucugcccaaggguuccaagauggcugaauaggaacaacuccagucuacaggucccagcaugagugacacagaagacgggugauuucugcauuuccagcugagguaccggguucaucucacugggauuugucguacagugggcgcagcccacagagcaugagccgaagcagggcaggucaucaccucacccaggaagcgcaaggggucggggaauucccuuuccuagcuaagggaaacugugacagaugguaccuggaaaacuaggacacucccacccuaauacugcgcuuuuccaacagucuuagcaaacaacacaccaggagauuauauccugcgccuggcuuggagggucccacacccauggaaccucacccacugcuagcacagcagucugagaugaaacuacaaggcggcagcaaggcucagggaggggcauccgccauugcugaggcuugaguagguaaacaaaguggccgggaagcucgaacuggguggagcccacugcagcucaaggaggccugcuuguugcuguagacuccccucugggggcagggcauagcugaacaaaaggcagcagaaacuucugcagacuuaaaccucccugucugaaagcuuugaagagaguagugguccucccagaauggaguuugagaucugagaacagacagacugccuccucaagugggucccugaccccugaguagccuaacugggagagaccucccaguaggggccgauugacaccucauacguccgggugccccucugagacgaagcuuccagaggaacaaucaggcagcaauguuugucauucugcaauauuugcaguucugcagccucugcuggugauacccaggcaaagagggucuggaguggaccuccagcaaacuccaacagaccugcagcugaggguccugacugauagaaggaaaacuaacaaacagaaaggacauucacaccaaaaccgcaucuguacgucaccaucaccaaagaccaaagguagauaaacccacaaagauggggagaaaccagagcagaaaagcugaaaauucuacaaaucaagagugccucuucuccuccaaaggaaugcagcuccucgccagcaacggaagaaagcuggauggagaaugacgaguugagagaagaaggcuucagaugauugguaauaacaaacuucuccgagcuaaaggaggauacuggcaaacugaauccagcagcacaucaaaaagcuuauccaccacgaucaagucagcuuucucccugggaugcaaggcugauucaacauaccuugaaucaauaaauguaauccaucacauacagaaccaacgacaaaaacuuaugauuaucucaauagaugcagaaaaggccuucagcaaaauucaacaguucuucaugcuaaaaacucaauaaacuagguauugauggaauguaucucaaaauaauagcuauuuaugacaaacccacagccaauaucauacugaaugggcaaaaucuggaagaauucccuuugaaaacuggcacaagacagggauaccuucucucaccacuccucuucaacauaguguuggaagcucuggccagggcagucaggcaagagaaggaaauaaaggguauucaguuaggaaaagaggaagucaaauugucccuguuugcacaugucaugauuguuuauuuagaaaaccccaucauaucaucccaaaaucuccuuaagcagauaagcaacuucagcaaagucucuggauacaaaaucaaugugcaaaaaucacaagcauuccuauacaccaacaacacacagagagccaaaucaugagugaacucccauucacaauugcuucaaagagaauaaaauaccuaggaauacaacuuacaagggaugugaaggaccucuucaaggagaaccacaaaccaccacucaaugaaauaaaagaggacacaaacaaguggaagaacauuccaugcucauggguaggaagaaucaauaucgugaaaauggccauauugcccaagguaauuuauagauucagugccauccccuucaagcuaccaaugacuuucuucacagaauuggaaaaaacuacuuuaaaguucauauggaaccaaaaaagcccacauugcccagacaauccuaagccaaaacaacaaagauggaugcaucaugcuaccugacuucaaacuauacuacaaggcuacaguaaccaaaacagcaugguacugguaccaaaacagauauauagacaaauggaacagaauagagcccuuggaaauaauaccacaugucuacaaccaucugaucuuugacaaaccugacaaacacaagaaaugggggaaggauucccuauuuaauaaauggugcugggaaaacuggcuagccauauguagaaagcugaaacuggaucccuuccuuaccuuauauaaaaauuaauucaagauggauuaaagacuuaaauguuagaccuaaaaccauaagaacccuagaagaaaaccuaggcaguaccauucaggacauagacaugggcaaggacuucaugucuaaaacaccagaagcaauggaaacaaaagccaaaauugacaauugggaucuaauuaaacucaagaguuucugcacagcaaaagaaacuaccaucagagugaacaggcaaccuacagaaugggagaaaauuuuuauaaucuacccaucugacaaagggcuaauauccagaaucuacaaugaacucaaacaaauuuacaagaaaaaaaucaacccuaucaaaaagugggugaaggauaugaacagacacuucucaaaagaagacauuuaugcauccaacagacacaugaaaaaaugcucaucaucacuggccaucagagaaaugcaaaucaaaaccacaaugagauaccaucucauaucauuuagaauggcaaucauuaaaaagucaggaaacaacaggugcuggagaggauguggagaaauaggaauacuuuuacacuguuggugggacuguaaacuaguucaaccauuguggaagacaguguggcaauuucucaaggaucuagaacuagaaaugccauuugacccagcaaucccauugcuggguauauacccaaaggauuauaaaucaugcugcuauaaagacuucuaugaccaaagauguaggaggauuucccacccacaccaagcaacagacacuagcuggguauccuccaacuuaguucugacacuaccuacccagagauagcaucagaucccacaggcuuagucucacaagacugccccuucuuuuccccuaguugcaaguccuggacuccagaacuucuggcugacuggcuucaaguugggguucccaugaccucaucugugaauuccaguaauuugcuaaagcagcucacagaacucagggaaacacauuuaccaguuuauuaggaaggauaucuaauuuuuuuacuuuuuuuuuaauuauuauuuuuuucauacagagucucccucuuguugcccaggcuggaguguaauggcguaaucuuggcucacugcaaccucugccuccuggguucaauugauucuccucccucagccucccacauagcugggauuacaggcaccugccaccaugccuggccuuuuuuuguuuguuuguuuuuuaaguagagacaggguuucaucauguuggccaggcuggucucaaacuccugaccucaggugauccacccaccuuggcgucccaaagugcugggauuacaggugugagccaccacgcccagccaggaaggauauuuuaaaggauacagaugaagagaugugcaggguaagguaugagggaagaugcauauggcuuccaugcucucccugggaaucucacccuguaggaaccucuggaagcucuccaaacccuguccucuugagaggugaagccagcuggacuuccugggucgaguggggacuuggaggacuugucugucuagcuagaugauuguaaacacaccaaucagcacucuguaaaaaugcacuaaucagcacucucugucuagcuaaaggauuguaaacacaccaaucagugcucuguaaaaaugcaccaaucagugcugugucuagcuaaaggauuguaaacucaccaaucagcacuguguaaaaaugcacgaaucagcgcucugugucuagcuaaaggauuguaaaugcaccagucagcacucuguaaaauggaccaaccagcacucuguaaaauggaccaaucagcaggauauggguggggacaaauaagggaauaaaaacuggccaccccagccugcagcggcaaccugcuuuggucccuuuccacgcuguggaagcuuuguucuuuugcucuucacaauaaaucuugcugcugcuuacucuuuggguccacaccaccuuuaagagcuguaacacuugccacggagguccgcggcuucauuccugaagucagcaagaccacgaacccacuggaaggaagaaacucuggacacaucugaaggaacaaacuccagacacaccaucuuuaagagcuguaacaccgcgaaggucuguggcuucauucuugaagucagcaagaccaagaacccacuggaaggaaccaacucuggacacacucuuggguguucauggaggcuucauuacauaggcaugauuaauuaaaccauuggucauugaugauuuaacuugacuuguagccccucuccccucccuggagguuguaggguuggggcugaaacucccaacccucuaauccugccaucgucuuuccagugaccagcaccacgcugaaccuagcagacaaaagacagcacguuggagaucccaaggaauuuaggaguuguaugccagggaacaggaacauauuuccauccuauaacauaucuuggccauauaacuaacucauagagcacuuacuaucccuuauugaaaguauuuguuuuaugucuucuauuuaauucugagccucuagagucuaagaagcaucuuuuaguuguccuuuccucugucuugguaucugauacagugccacauuauuuuucucuaucuguagcaacuuucuuuuuuuuuuuuuuuuuuuuuugagacagaguuuugcuuuuguugcccaggcuggagugcaauggugugaucuuggcucaccacaaccuccaccucccagguuuaagcgauucuucugccucagccuccugaguagcugguauuacaagcaugugccaccaugccuggcuaauuuuguauuuuuaguagagacgggguuuauccauguuggucaggcucgucucaaacucccaaccucaggugaucugcccgccucggccucucaaagugcugggauuacagguguaagccacugugcccagccagcaauuucuucuagaaagucccagcagaggcuggguauggugaaucacaccuguaauccuagcauuuugggaggccgagguggguggaucccuugagcccaggaguuugagaacagccuggaacagccugggcaacauagggagggaccucaucucuauuuaaaaagaaaaaaaagaggccgagugcgguggcucacaccuguaauccuagcacuuugggaggcugaggcggguggaucaccugcgaucaggaguuugagcagccuggccaacauggugaaacccugucucuacuaaaaauacaaaaaaaaaaaaaaaaaaagccuggugugguggcacacgcccagcuacucgggaggcugaggcaggaaaaucgcuugaaccuggggggcagagguugcagugagccgauaacgcaccacuucaccccagccugggcaaaagagugaaacuuugucucagaaaaaaaaaaagaaaagucccagcuacuuugggggcugaggcgggagggucguugaggcugcagugaucugagaucaugccauugcauuccagccuggaaaacaaagugagacccugucucaaaaaaaaaaaaaaaaaaaaaaaaaaaaaaaaaaaaucaggcaaacugaaauugaaggacauuuuacauaaaauaaccaaucaacauucuucagaagugcaaagacguaaaagauaaggaaggauugaggaauuauaauagccugggaaagaauaagaagaaauaacuaaauucaacguauaaugguggaaaaagaacauuaguagaaaacuugaccagauuugaguaaggcuuauaguuuaguuguuaauacuauaccaguguuaauguccuguucucgaucauggcacuaugguuugguaauauguuaacauuagaggaagcuggguguaacuucuauaaaccuaaaauucguuaaugaaaaguuuaaaaaauaaaaaggucaggcacaguggcucacgccuguaaucucagcacuuugagaggccuaaguaggaggauugcuugaggccaggaguugcagaccagccugggcaacauagcaagaccccgucacuauaaaaaugaaaaagccccaggaaaaaacuuuuaaguuuucucaauaaauauccuuuaauuuuuuucuuuuuaauucuagcaccaagcaauaucauuuaugcuggcugaaauggcaaugaaaguugaacuagcuagaaugaguuaccagagagcagcuugggagguugauucuggucgucgaaauaccuauuaugcuucuauugcaaaggcauuugcuggagauauugcaaaucaguuagcuacugaugcugugcagauacuuggaggcaauggauuuaauacagaauauccuguagaaaaacuaaugagggaugccaaaaucuaucagguaagguuaaagaugauuuuuuugguuugcaaggagagagaauauucauaaaugacaacguggauuucugauuauuuagaaauuuuaugucccuaguagcaauaaaugacugucauauauggcugugagccaguuuuuggaauuaauuaauagaaagaagaauguuauuugugauuaaguauaagucugaagagagaauaggcuaaaaaaaaugguacagacauguguauuacguuuggauuagauuucuuugaguuuuaacagauuggcuaauuguaacccaaacuuuucucuccaaaaaguaugcaugucauuuaaaauuaauuauuuugauuugaaucuugccugacaacuauuuaauuuauuguaacuauacuuggagucaaaaaccaacaucaggagacagugauguagauuaauuccaaauuaaauugguagucaaaaaaacuuaggaggaauucaguaaaaggaaauauaaaugugcauguucucuacauguggcuuaaguaauuacuuaauaauuaccacauucuugcuccucaguaucucuucccuuguucccccuacaccuagcaaauuauuugacucauccagucauuggaaauacugaguucgaaucaaaaugcuggagugagaaggaauguuacacguagugcagccucuccauguagacaugaaaaaacugagguccagaauuugugccuuauccaaagucacagguuuauguggugauacucuuccucuccuagagccuuuaauuauaauuauuacuauuauuaucaucaacaguuuagcuuuucucugccaucugagaagaugaacuaacgaauggcuaaaguuagaaguuuagaauggaaauaaggucugacucuugaaauccuuccagcaucuuuuucuuuagcaacucuguuccacaggcagugggagaaaaaaaaaaaauuaaggguaagaauaaaagacugaaggagacagcuagcuaagaacaguucagaaaauuagacaaauauuuuggccacauuaaacuuuaguuuucccaaacuuucugaaauguaaauaucuuuucuuuuuuuauauuuugaagacucuucuccaaaauuuugauaaauggcuuuuuauaauaacuuaaccaaucuuuagagaauuccauauuuucagacuuucacaaaaucagguuuuggaaucuguagaggcuacagacccuauauaugguuugauucgguuuuauauuacaacacagcuuaugcuacugucuaaaauguugaauaaaucaaaguauuuauguacuaaagauauuuaaccuacacuuauauuuuucuugcagauuuaugaagguacuucacaaauucaaagacuuauuguagcccgugaacacauugacaaguacaaaaauuaaaaaaauuacuguagaaauauugaauaacuagaacacaagccacuguuucagcuccagaaaaaagaaagggcuuuaacguuuuuuccagugaaaacaaauccucuuauauuaaaucuaagcaacugcuuauuauaguaguuuauacuuuugcuuaacucuguuaugucucuuaagcagguuugguuuuuauuaaaaugauguguuuucuuuaguaccacuuuacuugaauuacauuaaccuagaaaacuacauagguuauuuugaucucuuaagauuaauguagcagaaauuucuuggaauuuuauuuuuguaaugacagaaaagugggcuuagaaaguauucaagauguuacaaaauuuacauuuagaaaauauuguaguauuugaauacugucaacuugacaguaacuuuguagacuuaaugguauuauuaaaguucuuuuuauugcaguuuggaaagcauuugugaaacuuucuguuuggcacagaaacagucaaaauuuugacauucauauucuccuauuuuacagcuacaagaacuuucuugaaaaucuuauuuaauucugagcccauauuucacuuaccuuauuuaaaauaaaucaauaaagcuugccuuaaauuauuuuuauaugacuguuggucucuagguagccuuuggucuauuguacacaaucucauuucauauguuugcauuuuggcaaagaacuuaauaaaauuguucagugcuuauuaucauaucuuucuguauuuuuuccaggaaauuucauuacuucguguaauaguguauauuucuuguauuuacuaugaugaaaaaaggucguuuuaauuuugaauugaauaaaguuaccuguucauuuuuuauuagauauuuuaaagacuucagaaaauauaaauaugaaauaauuuaa

SEQ ID NO: 191344 - RNA, 33525 nt, Homo sapiens
cuuuucggccaccgcucgcuucaauauggcugcccccagggagagacgaggcuaccaugaaggagccgagcgcagacccugaguccgucacccauggaucgcagcgcggaguucaggaaauggaaggcgcaauguuugagcaaagcggaccucagccggaagggcaguguugacgaggaugugguagagcuugugcaguuucugaacaugcgagaucaguuuuucaccaccagcuccugcgcuggccgcauccuacuccuugaccgggugaggccccuuugcgccuguccaucgccugccuucuagugcgaaacuucaggagcccuguucccauccagugacgaccggauccagcaugucuguguuugcuccucugagggguggucucuguuucuuuauaugugaaauuuaggggauuagaucagugcuucuaaaaguuuaacguggcuauuaaucagcugagcaucuuuuaaaauacagaucccgauucuuuaaguguaggguagggccugauacugugcauuucuaacaagugcccaaaugauguugaaacugcugaccugggaacuaucuuguguggcaaaguuuagaaaauuugauuuuauuauaugaauacuaagggaaucuaaagacuuuguagcuugcuaagguauugaaugccggaauccgcucaucaacagcucuggcaaaucauuguuacugcaugcuugaacaucaccaguguuaaggaguuuacugccuccuagugagccccuccauuauuacaacucuaguaguuuuacgcagagaaaaguacgaucguauauaauuuaggaugguuagacuuuuuuuuuuaacuuuaugauggguuuacagggguaguaaaugcauuuugacuuacauuuuccacuuaugacggauuuauugggauguaaccccaucauaaaucaagaagcagcuguacaagccauaccuccuuauuugcagguucaguuaccccagucaacagcagucugaaaauauuaaaugaaaauuccagaaauaaacaauuaguaaguuuuaaauugcaugcuguucugaguagcgugauaaaaucuugagccaaccagcuccuuccagaauggaaggugaaucaucccuuuguccagaauauuccacuauauauucuugcugcccuuuagcugcuugguagccuucuggguuaucagaucgacuguggugguaucacagugcuuguguucaaguaacucuuauuuuacuuaauaauggccccaaaguacgggaguaaugaugcuggcgauuuggaucugccaacaguaaguuuuaaagugcuuuuuugaagugaaaaggugaaaguucuuaaggaaagacuuaaggaaagaaaaaacagcauaugcugagguugcuaagaucuacggaaagaaugaaucuugucagugaaauugugaagugaagaaggaaaaagaaauugaucugagguuucaggcauccacuagggggucuugggacauauccccugaggauaaggcugcuugggagugauacugcuuagauuaaaaaccacgggcuaugugaccuuaggaaagcuaucucaacucugccccuuccuguucuaugaacugaggauaauaaaaaguaucugcuuuauagggauuuuguguggagaaaauaggauaauuuuuuuugaaauauuuggcuuugugccuggcccaugcacuguaaaaguuggcuguguacugauuuuauucguaguauuggcuuaagagcauggaagacagcacauuguuaggcucauucuuuagguccauuauugacugaucauuuauuugcugaucucucaaguuagcagggccuguucauuuuuaaaucacuuccaucaccuucagagcaauggcauucuugcccacaaacucucucuugccccauuuccauaacucugucucgccuugauuuuugcaaugguucucuaacaagccacuuaacuauucuucuccaaaccauguuugacaaauugcaacucugcuuaucucucaccuaugcuauguuuuauuacacauuuuucuacaucagaaaauccaaaugcuuacucuaguauaccuuucaaccuuuuuuucauugcuuuucuucaucuuuagcuaguuacugaaacuaaacuguucuuuucaucuuguauuuacuugcuuuugcucauguuuuuuggcgguuuuuuuccugaaauguuuuccuaucucugcauaucugagacaugauucccaaaacuccccucucccaccugaacccacaaacacauacuaccuacuuggaaguaaugacugcuucuguacugguuagacuuuuauuucuuaucuuacaccucguauuaugguuuauuuuaaaaucugccuuauuucaguaaggauuuggggcaacuuacaaacaggcaacacaagaaaaaauaaaaagugggaaaaucuggauaaagaaaauauagauaagaugaagccagcgauggcauuaguugccaaucccaccacuagauccuguaaaguugcuagaagugggccauacauuuggcucuaagauucagaguagccagcacaaugucagauacguaagucaccaucaccgaagucauacaaugaagucaaaauauuuauuuaggacaugcauagcaauucccgguuccaagggcagacagcagagucucuuguggauccaucguauaaauuauaguuacuuugaguauagugauuucuguucaugugguuuccugcauccccuuuccaguguccuugagggguagguucuguguauacccaaaguaccuaauagaacuuugcaaauaaacauuuguucaauuuaaguuaauauuaaaauguuugccuucaugaaacuuugaccuuucagucuuagcuccauccuucaggacuacaucuaaagucuaauucagaggucacaaauuuaugccucuagagaccaaggaaguauuauaaauguguaaacggcauaggugacaauaaaggguaguaggucuuguguggaauugggacagugcuguccuacaaaagaaauuaaaauuauuuuuuuuucauuuuuaaauacugugcuagccaaauagcuagaguacaacucaggugcugcuaguauuaucccuuauacuaaucccuuuuuuucuugcaaaaucaugaccauauuucagaagauguuuaucaaguaguuuuaccuuucacauaauuuucuaccucaaguuauuugggcucauucuuauucuggguuaacauuacccaaaaacauaccgaauuguuuuuauuaauacuuaaaauccugacuugggauuauuaauuuaagaaagccuacaauauacuaugcauuaugcuuauuauuuuuguaaaauauuauaugaaacuuaaauuauguuauuuuuuauuuuaggguauaaaugguuuugagguucagaaacaaaacuguugcuggcuacugguuacacacaaacuuuguguaaaagaugaugugguaaguuuuaaaaaauaaauuuggaaauaaacuuuuaaauucaguuacuuuaaauacauaugacaagaauagaaaauucaagguaauuuauaugcagaguuauaauggcugaagauuauaaaaccuagagagcuuucauuacaauggcucuuuuuggguuguaggagauaaaaaguauggaagcauuacuuacugcuacucaacaaaacacauccucuuggacacagcagaaaguucauggauauuggacaccuauuggauccaaauuuugaauuuuaauucugcuauuugaaaacccuguaaccuagaacaaauuauggaaagagaaggggauuagcacuaucucuguguuaccagcuuuacugauauaaauaaauaauacauuacuuaccugcauugcuuuuugaaaaucuucauaucucugcuggguuauuuaguuuccuaagguaaagaguuuagaugaauucauaaguuuuuaucagccaggcacuuuucauucccagugaauuuacaaauccaauucuguuuuuagcaaaaaagauaauuuauuuaacuggaaagggcgaauggagcuagaaucaaguauugcugguucagauguucaaaucuugucuucagaguacccacuucaucuucaucuuuaggcacugguucucuuugcagugugccuuuauucucuucugcugcagauaaucuuuguugcagaaaugguagcugucagcaacaccaguagaaaaagaacuccuuuuccugcaauucauguguccaucuuagagaaggacuuggaauuguccugcuuagauuaggugcucucccucuuagguuaauuauuuuugcuaguggaaugugaugauauccuugaucagacauaagcaagcacuuggcaccucugauauugugauagggagagugaugugugacaggguaaugauugacagccccaccagaaaucaaauggugugaaggcaggacgauguugcccggggaugcugggcagacagaaauaauaacugucuuguauaaauucuagcucagacacaauauuacauguuucacuagguggucagacuacgccgcaggauacacuguaacaugggugcagccaagguuaaaaggcaggcaagugcuaccuagggaagagacuaguaccugacucaaggucacuaacaaaaaacacgcauacuaggcucaaguguuguaacauuugcuuauagcaggagggaagagacuacacaagaucuagcccuuugcaaugugucaguccccauggcuagcagauugguuccacagcugaucagggcagagugauggcauguaccccacuuugugcugcaguagcucccagacccugaacacugccccauagggucugaaauacagaaagcuaggaacgugcucaggggccauugguucucauguagcugagcaguuccaagguuccucucccaaaguuaggagauagcaaaaacaaacaagugaacagggaaaaaaaaacaaacaaaaaaacugcaaguugcaauuguuacaacaacugugccuguuacagagggaacaggaacucacuggcugugcucugagcucuuugcaugcacugcuauuugugagcuuacuagugcugcugguaagcacuggugcuugguacaggaugcuucuugggaacauggguggcaguuaggcuuuguuuggacccuucucucacauuacauuugucucuaucucaaucuaacaaaaaauuuaaacaauccuaauacaguuuuuguauacuacauuuccuaaugaaaaauccguuauggaauuaaauaaaguaguaguuuacuucuucaaagcacacuaauagguggaaagaaugguauagaagauuuacgggagaacuagaaauuuuaagaaaauaagcaaauaaauuuuuggugaaaaaggaccaagaaagcagagggaaaaguuacugcagaaaaaauaugcugagugauucugaaaauuucuaagagaaauugaaguuauguaugggguaaagggucgccaaaggacaggccauauacuugcaucugauaccacuguucauuuauuuagauuguagcucugaagaaagcaaauggugaugccacuuugaaauuugaaccauuuguucuucaugugcagugucgacaauugcaggaugcacagauucugguaaaauuuuguuguaauuguacuugaauuuauagauauguggguagauguaauuuuaagcuuuuaaccugcuauaaauaucaaugagauauuaccuuauucaacuaguuauguauauauuauuuauuggucugcucaaucuauuaauuuuuaauauuagaaaaaaagaguagcuaaucauugcuaggaaaauauaagucccagguuaugcuuccuguuuucuuucuuaacguuuuuauuuauaaauuuuacuucagcauucuauaguuuguuuuuguuugccaagcuuuaagaaaaaauacuguggaacuacauguaaaauuaagaguuuuaaagaauauuucauuuuucccauuuaaaugagcaugcaugagguaaacaucuguuuagucuugauucuccuuuuuauaccuuuuauauauuuauauauaaaacugaauugcauuuuaagcaacaauaauguauugagucucagugugucaaguacuaggggcacagugaugaacaagauuaaagacugucuugguuccucuuccaaaguuaggagacagcaaaaacaaacaagugaacuggcaaaaaaacaaaaaacaaacugcaaguugcaaaauguucuaccgaaggaaaaaacaaccugguaauagagaacagugcaaaaagcagcucacuugaagauaggcuucucugaaaagcuuucuuuaagcuaagacuuaaaggaacagaaagagcuaggcauguagcugggaaaugaacauuccaugaagauggaaaaguauauacaaaguuucagugggucuagagaguggaaagaaggugccagaaggaggcuggggccaggucauuuaaggcuuuguagaccagauuaaagaguuugaauuucuuucugaguucagggaaaaguuauugaagggacaguuuuaagcaaagaguggcuuucuagguuuuuguucugaaaaacucaguucugcuucagcauagagaaaggagugcaguaagugaaaagauacgaguuaggaguaguuuguggugauagguugguguaaggugauagcaccaaagcaggugagaaaggaauagauucaauauguauuucagcauuugaaucaacagaauuguaagguugucuggggaaggacagccagagggaggaggagaaagaggaaucaaggauaacuacuuaggucuggcuggagccccuagcuguaugguagucgccuuuauccagauggggugugcugaaguugaaguguguccagaauugguuccuuccaguggguuauuggucucgcugacuucaagaaugaagccguggacccucgcagugagugugacaguucuuaaagaugguauguccggaguuuguuccuucagauguucagauguguccggaguuucuuccuuccaguggguucguggucuugcugacuucaggagugaagcugcagaccuucgcagugaguguuacagcucuuaaagguggcauguccagaguuguuuguuccucccaguggguucguggucuugcugauuucagaaaugaagccgcagacuuccacagugaguguuaacagcucauaaugguaaugcagacccaaagacugagcagcagcaagauuuauuaagagugaaagaauaaagcuucugcagcuuggaaggggacucaaguggguugcugcugcuggcucggguggacaguuuuuauucccuuauuuggccccacccacauccugcugauuggucgcuuuuacagacagcugauugguccauuuuacagagugcagauuggugcauuuacaauccuuuagcuagacauagagcgcugauuggugcguuuuuacagagugcugauuggugcguuuacaauccuuuagcuagacacagagcgcugauuggugcauuuuuacagagugcugauuggugcguuuacaauccuuuagcuagacacagagcgcugauuggugcauuuuuacagagugcugauuggugcauuuacaguccuuuagcuacacacagagcgcuaauuggugcguuuuuacagagugcugauuggugcauuugcaguccucuagcuagacagaaaaguucuccaaguccccacuugacccagaaaguccagcuggcuucaucucucaauccacccucuaaacaggacaccucaacugcugcugggaauuuggcgaugacggcucuagcuacuuccugcuggauaggggugaagaaggggcccugcaguuguaguguccuccagaggggaacucuuuagaccagugaaagggccaguggguccguccagggguccucgguagaaguuguuaguugagcucguuuggcuacaguauauaguccuaucacaaagaguaugguuaguaugcugcuagaaaauaugaugaaauaguaaaaggauuccauuaaagggguaaagagagguguuaaagauuauguagguuuucacuuauauuuuuuaaggaggaauggguuuuuccucaggaucagagguaagagccuuuuuagucugggauguuuccuuccaaaauaggagaugcaaguccuccaaugguucgcagguguaucgaggcuggucuggcugaucuugggacuccugagcugauggucccgcagguuccuccggggguguccaaaauuuaacugggguguggugaauccaagauuccacuccugccaucuuaacugcaguggggguagagaggauuaccgaguaugguccuucccacaaagaaucuauagauggggagguagaggggagagauuugacuaacacuggaucuccugguugaaacaacucuguucccuuuucucugugacauccuucagguagguuuuuaagguuucguugauauuuugccaaagaaguuauauuuuugaccaaguuggccauuuccugaucaaguaggaguucauuugugagaaaaguucuuccauacagcauuucauagggacugagccccauuuugugaggacaauuuuggauucucaacaaggccaugggcaaaagaguaggccaugggagaugaguuucuuguguuaguuuucuuaagugccucuugaguguuucauuugccuucucgaccuucccucaggauuguggccuccaggcacagugaaggugauauuguaucccuagcucccuggaaaugucccugaguuaucauggcuuuaaaagccagaucauuguugcucuguaagcuuuggggaagcccaaaucuaggaauuauuucauaaauuaggacuuuaaucacugccugagccuucucugucuugcaggggaaagcuucuauccaauuuguaaagguaucaacacagaccgacaaguauugaaaucccuuugacuuaggcauaugggugaagucuaauugccaguccucucugggauagugaccuacucuuuguuccccaaaagaggccuuaggaugaacuaagggauuauuccuuuggcacaccccucacaggcuuugacuaccugucggauggccuggaggagauuuggcccuguaaauagggauuuggccauuugaugcguguuuucaauacccaugugaacaguuucguggaggguuuuaaguauuuuccacuggcuggcuuuggguauaaguaccuuuccuucuucugucguuaaccacgccgaggggagaaaacuaugcccccgugaaaguccccacucuguuucgguuggggaauacuggagcuuaaccucuuggaggggguuguuccauaccaaggguccuuccguagguauuucuaaugggauguucugccuggcagcaauuuuagccucagcaucugcccaacgguuuccuucugccuuuucuccuucaccuuuccgauggcuuuggcaauguaagacugccaccuccuuggguuuuuacacuguguguaguaacuccauaauuuccuugugguauuuaacgggaguucccccagagguuaggaacucccuuucuuuccauauugcagcaugggcauguaggauuagauaagcauacuuacuaucuguaacaaagucucccaaucacaacugaggagguaggagaaauaccugguuacaggcugucccaggauuccuuggaugguaacggaccuugaggacaacucccugagacaggagauuaacacugagaaagccacaccaguguccaggaggaagucaauuuccuggcccucaaugguuaaacaugcccagggcucagugagggugaugacaugagcuggcacuugcccccggcacccugaguccuguuguugggucagcugguugggggcuucuggcucagagaacguuuguucucuggggcagugcaccuuccagugauugcccuggcauagcagacauggacaagcgggcagcuuguuucucguuggacaaucuuuuuuaagguguccuugcaaaccacacugguaacaagccccaccgggugauuggccugcuccauuuuauguccucucugaaccaucaagguuuguuugucugauggccaugacuaagucugcagccuuucucggaucucgcuuuuccuuuugggccuguuccucuuggucucuauuauagaacaccaacguugccagguuuaauaaugccuccagauuuuuucagggcccagggcuugcuuuuggagcuuucuucugauaccugcagcugauuagauaauaaacucaucuuuaaggaucaguugacccucgagugagucgggugacaggggaguauauuuucuuaaggccucccauagccgcucgaggaaggcaaaaugauuuucuuccuuucccugaguuaugguggacaucguugaguaauucaugggcuuuuuccuaauucuccuuaguccuucuagaacacaugucaacagauguuuaugacuccaguccccaugaucugagucgaggucccaguggggagccauacuggggauggcuugcugacugguggggaauuugucccuuucuucggcugucauucuaucauuuacuugacugagauaucagguaucuccaaacucucgggcugcagcuaaagccacauucuuuucauuaaaggccaggguuugaucuaacaguagcaugacaucucuccaagagagaucacagguuugcccuggagccuguaggacaucuguauaccuaucaggaucaucugaaaacuuccccagauguaccuugaucugcuuuaaaucagagagggagaaggagacauguacccaaguugggccaaauuccccucccgcuacagcuugaaggggacauaacugauagcccaggcguuuuugugguccuuuggagauuucuuugcuuguuuccuucugggagggggagauuagaggaggcuuaucauuaauaggaaggggagcuauagggaugcuaggauguggggguaagcugagagguccucuuguaggauguaaauugcaaguuugcauaguuguguauucuccuucaaugaaaagaaagcuuggacauaagauauuucacuccauuuaccuucccuguuacagaaaagaucaagcugcaggauaguauuguaauuuauacugcccucagguggccauuuuuccccaucagagagagaauauuggggccaagcugugaugcagaaaaaaaaaaaugagccgccucuuuuucacgguuugcgggucaaauuggucccaauggcuuaggaugcauuucaagggugaaccuguugaugcgugaguguuuggcugacaggugucugguauuuagcccccaaauucuaaggaaaaauaggacagaauagcaagcgaaagcgguccaaugguacucaccacuuggcaauaggcgauugucccaucugggucgccaaaaugugucccaucugggucgccaaaugugucccaucuggguugccaaaaugugucuagaauugguuccuuccgauggguucuuggucucacugacuucaagaaugaaguugcagacacucauggugaguguuacaguucuuaaagaugguguguccggaguuuguuccugcagauguucagaugugucuggaguuucuuccuucuuguggguucauggucuugcugacuuccggagugaagccacagaccuucgcagugaguguuacagcucuuaaaggugguguguccagaguuguuuguucaucccgguggguucauggucucgcugacuucaggagugaaacugcagacauucacagugaguguuacagcucuuaaagguggcgcguccagaguuguuuguuccuccugguggguucguggucucacugacuuuaggagugaagccacaggccuucgcaguguguuacagcucuuaaagguggcccaucuggaguuguuuguuccucccggugggcgaguggucucacugacuaaaggaaugaagccucagaccuccgcagugaguguuacagcucauaaggguagugugggcccaaagagugagcagcagcaagauuuauugugaagagcaaaagaacaaagcuuccacagcuuggaaggggaccugagcagguugccacugcuggcucgaguggccagcuuuuauucccuuauuuggccccacccacauccugcugauugguccauuuuacagagagcugauugguccauuuuacagagugcugauuggcccauuuuacagagugcugauuggugcaucuacaauccuuuagcuagacacagagcacugauuggugcguuuuuacagagugcugauuggugcguuuacaauccuuuagcuagacacagagcgcugauuggugcguuauuacagagugcugauuggugcauuuacaauccucuagcuaggcagaaaaguucuccaaauccccacucgacccaggaaguccagcuggccucaccucucagaaggaauggaaaucaagaaugugauucauauguuaagugugaaaugucuguuaagacaccuguuuuugucugcuagcguugacauaacaauauaacacagacuggguaguauaaacaacagaaauuuauuuuucucacaguuaggaggcugaaaguccaggaugaagguacuggcagggguaguuccuucugaggcccuuguccuuggcuugcaggcagcugccuucucccuguguccucucauggcccuuucucuguguaugcaugucacuuguuucuucuacuucuuguaaggacaccaguccuguuggaucagggcuccauccuuaugauuucauuuaaccuaauuaacaccuuaaaggccucaucuccaaauauagucacauuggagguuagggcaucaacauaugaauuuugaagcccuguagacacaauucaguccguaaaaacaccaccuaagugaaaauuucaaauagacauuuggguagaagucuggaacucaggggagccauguggacugaggacagacauugagaagaugccaauacacaauuauuauuuuaagccaugagccuaguugaaaucaccuguggagaaaguacagaagaaaaagagaagagggcuugaggaacacgagcauuuagagacagucuccaaaacaugguguuuaaucauuuaguggcucauggcuucagucucugcucuaacccugaacuuuuaucuaaccuuauuuuagucucauuauaccacaucacaucacugaugugucuccagacuuuaacucuccuguuucuauauccauguucuguucucugugcuaauccugacugagcccagccaugcucuucuuugggccuaagccucauuggaaagcuaacauuucagggagcuaauugaaguggacuuagaggaacugagaaauucacucauucacagccccuuuuugagggggguccuuaccuaaggagcuuauauuuguauucuaggggacagaggcagacaauaaguauguaauaaaacagaauuucucacugugagaugugcugugaaggagauaagaagggcacuccacuagagagucaggggagagcugcauuuaaagaggugguuaaagaaggccuuuauucgaagguugcagugagccgagauugcaccauugcacuccagccugggugacaagaguggaacuccaucucaaaaaagaagaggaccuuuuuagguaguagcauugaauggaaacaggaugaaugacaagaaaccagccaggaaaagaguaguccugacagaggaacagcaaaaauaaagaaguugaugcaggaaaggguuuggaguauucaaagaacagaagggaagccacucaagguuagagaaaauagcaagggcuggagcaaauagaacaucauuagucaugguuuagagcuuggauucugucacuagcuagucuguaagaaugguuugaaggggcaagagugaaagaagagacuaauugggagacuccuccagaaguuaaggagagaggugauggagacuugaaaaagagugggcaguggauguggcaagagcuggauuaauuugagguaaucguagagguagaaucaaugggaauuggguauaggggaugaagaaguagaaagcaucggggcuaucuagguuuggagcuugagcagcuagauagaugauggugucauuuuacuguaauuagaaagaccgggccaggcgcgguggcucacgccuguaaucccagcacuuugggaggccgaggcgggcggaucacgaggucaggagaucgagaccaucccggcuaaaacagugaaaccccgucucuacuaaaaauacaaaaaauuagcugggcguaguggcgggcgccuguagucccagcuacuugggaggcugaggcaggagaauggcgugaacccgggaggcggagcuugcugugagccgagaucccgccacugcacuccagccugggcgacagagcgagacuccgucucaaaaaaaaaaaaaagaaaaagaaaaaaagaaaagaaaagaaagacuggaugugaguauguauacauauguguguguguauauauauguauacacauauauacacacacauauauguauauauguauguguauauguguguauauguauacacauguguacauauauauguguacacacauauguauauauaugggugcguauauauguguauacacauauguauguauacauacacauacacacacauauacacauauacacacauauauacacacguauauacauauauacauauauguguguauauaugguauuuaaaccagggaaucucaaaaggagagcauguacuuagagcaagguuuuucaaccauggcacagcuggcauuucaggucaaauaauuauuugugugggggcuguccuguauaauggagaauguuuaagcugcaucccuggccucuacccacuauuugcuagagaucucccuuccucuucccuugaguugugacaaccaaaaauggcuucagauauugccagauggccccugggguucaaaauuauucuugcuuaagaacuacugagcuggagaaaauaagggacccaugucugcuccccagggcucucugacauuuagagacugacaaaauaacuuacaaagucaccucagucagaucagaauuugugugcuugcuaugcuuucuuauaucauuucaacaaaguuuuuuaagcaauagaagggauauugagaaacauuguacucauuuuaaaagauuuuguuuuguuuauuuuuauacaacacaauuagaagaaugauuguuuuuugguuacauucugcuuucuggaagcaaucacuagccaaaugucacuguuugugauugaauucuacuuuuacucuuucucaaugacacauccauaguucauauuucaauauuuuuccugauguuaggaguuugaucaaagucauuuuuaagcauaguccguauuggcuagacgaaaaauuuuuuuaaaaaccuuaauagcuuuuaggguuauauauguuucuguaguuuguggagccaaacagaugaucugguuacccacaguaucaaaauguaacaaguuuuauuuucuuacagcauuccauggcaauagauucugguuucaggaacucuggcauaacggugggaaagagaggaaaaacuauguugguaagauauuuugucaaagaguaauuuuuuuaguguaaagugauccagaaauugaauaaccuaauuagacuccugccuuuaaugucuccuuucucaaaucuucuugccauucucuuacucauaaacccucagugacuuacuccuuccuacagggcaaaguccagaguuuggauuuacaguugaggucuuauuuaauaauauucuucuccacuuacuuuuaaccugauucuuaacucugcccuccucauccuaaguaggcaaggccccaaagcacuaugacaucauggaaagagucacagagagaguucaaaguccccuuuacugauaccugcuggaucacagcugugugaauuugggcaagcuccucagucccucaggguuugaauuuucucagcaguaucagugguccagcuaacuacugucguagggccacauucagcccacauggggcaggaucccacuauacucauuugauuacuuauugucugagguugcuuuugugagacaauggcaaacuuuaguaguugugacagauacuauaugccuugcaaagucaaaaauguuuacuaucuauccuuuuagagaaaagauuugcugaccuuucgacuagaugaucuuuaagacuugcuuucuuuuugaguccuucucuagccaagcuagcccuuagauauuucucccuauucugaucuccugugauauuuacuguuuggcauggcauguuuuugaacuauuugagauuacccuccuucuaccuuccuauauucuccuauuuucuauuuuuaacaauaaccuauuucccaaauagggguggaugacaaaagaggacacccuuaaagcauggcugaauagaaaaucaaagccuggccaggcgugguggcucaugcuuguaaucccagcacuuugggaggccaaggcaggcgaaucacgaggucaagagaucgagaccauccuggugaaaccccaucucuacuaaaaauacaaaaauuagcugggcgugguggugcguagcuguggucccagcuacucaggaggcugaggcaggagaaucacuugaacccaggagguggaaguugcaguuagcagagaucacgccacugcgcucuggcuggacagagcaagacucugucucaaaaaaacaaagaaaagaaaauuaaagcccguaguacugguuuauguccccaucucacucuuuacuccaucugguaucccagaugaaagcagagccauucuuucaccuucuucuuuguuuccauauucaauucguuauagguccuauccaugcugccccucguuucuaauacuugaccccacccuaggucuucuggcacugcccagcccucaagaucccuaaccucagucuuuaccauugucucccgacuagucuucuuacuuuaggucuucuccuugagucccuccaaccagugcucucagaaucccccuuuaaaaaacucagggccucagcugggcgcgguggcucaugccuguaaucccagcacuuugggaggcugagguggguggaucaccugaggucaggaguucgagaccagccugaccaacauggugaaaccccaucucuacuaaaaauaccaaaauuagccaggcaugguggcaugugccuguaauuacagcuacuugggaggcugaggcaggagaauugcuugaaccugggagguggagguugcagugagccaagaucaugccacugcacuccagccugggcaacagagcaagacucugucucaaaaauaaaauaaaaaaaaccucagggccuccaaacauuuucuugguauucagggucuuacccagacuauuuugcaucuaccuguuuauguucgucuuccaauuacauacuuaugcuccagcuauauagaacuauugguuguuuuccaaggguaucaugcucuuuuaugucucuaugcccacagauaaguggugccucuggcuggaguucuuccucucccuuucucucccccgcuccuuuuuuuuuuuuuuuuuuuuuuuugagauagaguuucacucuuauugcccagacuguagugcaaugucucagucucagcucacugcaaccgccaccucccagguucaagugauuuuccugccucagccucccaaguagcuggaauuacacacaggcccuugccacuaugccugguuaauuuuuuuauuuuuaguagagacgggguuucaccauguuggccaggcuggucucgaacuccugaccucaggugauccaucuuccuuggccucccaaaguguugggauuacaggcgugagccaccaugcccggccccuucuuaauuuuuaugucuggugaaauugcacucauccuuuaaaaucccaacucaauugcugccuuucccauaaagcugaguucuuagacucaguugcuucucuucaacauuuucuugccaguguguguguauguguguguauguacaugcacaugcaugcauguguguuucuucugucauaagucuuaaagccagaggucauguuauagucacccuguaucuucaugccuuauagggagccuagaacauugcagaugcucagcaaaaguuuauggaauggccaggcgugguggcuuaugccuguaaucccagcacuuugggaggccgagguggguggaucaccuaagacugggaguucaagaccagccugaccaacauggagaaaccccgucucuaugaaaaauacaaaauuagccaggcguggcgcaugccuguaaucccagcuacucuggaggcugaggcaggagaaucgcuugaaccugggaggcggagguugcugugagccgagauugcaccauugcacuccagccggggcaacaagagugaaacucugucugaaaaaaaaaaaaagaaaauguauggagugaauuuuuauucucauaauaauuuuuauagaccuuguaugguuguucuuaaccucuauccaguguuugccucuacuuggaacauguugacuauuucaucaacagggcuauuaagauugugaacccuaaagcauugagaagcagcuccuguguaugauagaggaggcauaguuuacucuuguaacugugcucugcuccaagagcacugagacccuuuggcauccaguucuuuuuuauuuucccuugagauuucuguugagguuuucuuucuuucuuuaagucguguauuauggcuuucuaagcuauagugagauugaaauuguuaaaaguuauuugauucuuugauaucaucuguuucucugaaagguaacguacagaauaucuuucuuuagaaaugacuguagaugauggaaaaaauuuuauuuaaucuccuuugcuuuaacugugcucagcuaaauucuaucaaagcgcuaacuuaacuguuguaauggaacuaaaguauguucaaacacagcccugacgggacuuuucuugaguuauuuucaguuucugugguaucuaagucuucauaucuaaauuguuuuuuccuuguaggcuguccggaguacacauggcuuagaaguuccauuaagccauaagggaaaacugauggugacagaggaauauauugacuuccuguuaaauguggcaaaucaaaaaauggaggaaaacaagaaaagaauugagagguauauuaauuggguauuuccauguuauucuuauaugccuagaucauccuugaaaacauuaauacuuacuaucuucaguuuauaaugccaacugcuuaucuauuuguagauaauuuaaaaauacuuuuauuaucauuaauaauaaaaagaugaucaaaguaauagaugagaguaggucuggcugccaugggcacuaaauggagcauacgggagaggcucucugggggaugguaggcacgugaccaccagaagcuggcauaaaggggagaaacauaauuauucuggaaggacagcccagcagccacaggaacuguaacugaucaauuugaaggcagccagggaagagaugcacacugccccuagaugggaccuaucagagauuaccuagucuuuccuguugaggggaacagccugguugacuuuuuuugucugauaaauauuucacuucucuggcuuaggcuaguuuaauaccaaacucuugucauggauuagaucuagaauugccauaacuuucuaaauaggaagguauggcuuucauuucacaucuccauacuucuuuuguucuucaucguuaccuccuggcaaaggaaacuucuauauuauuuucuuuaacaacuuuuucccaagaauaaaguuuauauauaaaguaguaaauauuaugcugucuuucauauaugaaaguaaugccacugaccuaccaucagcuagaugcacaguuuugaguuauccaaggaguaauagccaauuugaugucguuuauaauuuucuuuuuucuucucuccacucuuuuggcuacuuccauucagucaaucgcugucugaauaucucuucagucauucugucuccauccauacugcuucuuuccucauucaugaccaucacaauagccucauucaggaugcuucugguaugccucucugcuaagccauucuuuaucaaaucauguuuguaaagugcaaaggauuccuguugcuuaacuugccugcuuaagauucuuuaauacuuagaacuuuuuuugaagcauugaaggccaacaagugcuagugguggcaguguaaaagggugaagugagguagaaguaugccaccaaggcagaacuggguucaaaucgugguucugaguuacucagucugguuccaccaaauugcucaacuuuccagacuucaauuuucuuaucucuaacuucugggaaauaccuaucuuaaagaauaauuauuauauucauuagauaguguauuuauaaugacugcccugacccuguuauguuuuggacucucaggacaggauagccauucuccuucauugauucauggagaauaaaccuauaaucauaaaaauaucaccauucaggcuuucucaacuaggguuccucauuugaaccacacaauucacaaaguuauuugagugacuauuuucugaauucucccaaggauuuuauguaacauguacuauuuuagauacauuggagaaaagucaauucauuacuuacaauggaugucuuaggguacuagagcuuaauuuuccagccacacccugguugagaaaaacugaccacaaaaaccuggccacaaaauacuuugagcagguauucuaacuaaaguaauacuuuuaaauaagcaaaacccauuccaccagacuacagacuacuauauguaaguauuuacugguaccauuccauaaguuuaccacuuauuaaauuguaauccagugagacuguuugcuaaaacauaggagguagcaaaucaguuuucucuguuuccuuucuugaauuuuaacaagcuuauaaauagagcccaagaucaacuaacuguacaccuggugaaguuaauugagccacguucaccaacuauaaaaucaaauuaugcuuaaauccauugacucaaaaauauguuuugagauuauaaugugcaugcugccauuaagagccacgcuuaucauauaaaaucagggaaaaauuaaagaaggguaaaaaugucuuaagauacugauuagaagauuacaugugaauuuagaaagugagaacaaauuaaggagcuccuuugggaacagcuguauguucaaccaaaugcagugaaagaguuacucuucugauguugaaaagagaaaaaaauccuugaggugaugaguuaugcaaucagacauucauuaaguacuaagauugguuugccauaggaccaaaguuucacaauucagagaauuucaaaaacaaaaaauccugaaaaacauuucagcaauaagaaauauucuauaaaugugaaaauuaaagagguagaauauuuuuaauaaaaaaaaaggccuuguucaugagaaacaauuccuaagcccacuucuuaugggaagagacuuauccauuggguuccuguuguuucuggagcugggcaagacaagaccuucaagcagcagacugcuuuauaaacagcuaauuuggagacuggaagagacagggacugacaccagauguaggaagacaauucauacauaacgaucuagagaaauuuggauagcuauugacugacuacaagaggaaggcuaucuuugaaucuauuaauaagcagucagcacaugggucagaugaaaccaucaucuggcuaugaguagcauaaaauuagccaugugcuuuucaccaacuguguaaugagaaaauauuacauaaaauguacaauaaaggggcagaauauauugucaucuaauauuguugauaaagcaaaucuggaagaaaaguaauugaauccacuuucaauaguuuuuuuuuuaacucuauuuucugauaaaauguacgcaauaggaaauuuaccauuuuaaccaguggcauuaagugcauucacauuguuaugcaacugucgccacuguccaucuccagaacguuuucaucaucacaaacuaaacuucucuacccauuaaacacuaacucucgauuccucguacuccauuccccugguaaucacuauucuauuuucucuaugaauuccacuauuauagguaauucaucuaagugggaucauacaauaugcauccuccaguaucuggccuauuuuacuucguuaauguaggauucauccaugcuauaacauguaucagaauuucaguuucuuuaagagugaauaauauuccauuguauuuauagacugaauuuuguuuauucauugaugugucaauggacauuuaaggugucuuucccuuuuagcuauuauaaaugcugcucugaacaucauuguacaaguaucugagucacugcuuucaguucuguuggauauauacucagaagugguauaguguaaucaaagaaagcauauuggaagaagucacugagcagggccuaaaaugcaggcaggguuuuuauaugaagagcucugugggagggggaaauagcaugauagauaaaaaagaagagcaugaacaaaggaaaaagagauagugauaugguuuggcuuuguccucacccaaaucucaucuugaauuuccauguguugugagagggagcuggagggagguaauugaauuaugggggcaggucuuuccugugcuguucuugugauggugcauaagucucacaagaucugacgguuuuaaaaacgggagucgcccugcacaaguucucuucacuugccugcugccaugugagacaugccuuucaccuuccaccaugauugugaggccuucccagccacauggaacuguaaguucauuaaaucucuuucuuuuguaaauugcccggucucggguaugucuuuaucagcagugugaaaauggacuaauacaguaaauugguaccacuauaguggggcacugcggaaaagauacccaaaaauguggaagcgacuuuggaacuggguaacagguagagguuggaacaguuuggaggauucagaagaagacaggaaaaugugggaaaguuuggaacuuccuagagacuugucuaauggcuuugaccaaaaugcugauaaugauauggacaaggaaauccaggcugauguagucucagauggagaugaggaacuuguugggaacuggagcaaaggugacucuuguuauguuuuagcaaagagacuggcagcauuuuaccccugcccucgagacuuguggaacuuugauguugagagagaugauuuaggguauccggcagaauuucuaagcagcaaagcauucaagaggugacuugggugcuguuaaacacauucaguuuuauaagggaagcagagcauaaaaguuuugaaaacuugcagcaugacaaugugauagaaaagaaaauuccauuuucugaggagaaauucaagucagcccuagaaauuugcauaaguaaugaggagcugaauguuaauccccaaggcaauggggaaaaugucucuagggcaugucagcggucuucacagcagucccucccaucacaggcccagaggccuaggaggaaaaagugguuuugugggcugggcccaaggucccugugcugugugcagccuaggaacuuggugcccugugucccagccacucaagccauggcugaaagggaccaauguagagcuuggggcuguggcuucagagggugcaagccccaaaccuuggcagcuuccaugugguguugagccuacgaguggacaaaagucaagaauuggcaucuggggaccuccaucuagauuucagaagauauauggcaacaccuggaugcccagauggaaguuuagugcagaggcggggcccucauggagaaccucugcuagggcagugccaaagggaaguguggggucagagcccccacacagagucccuacucgggcaaugccuaguggagcugugagaagcgggcuaccauccuccagaccccagaaugauagauccaccgacagcuuguacuguguaccuggaaaagccacagacacucagugccagcuugugaagguagccagaagggaagcuguauccugcaaagccacagaggcagagcugcccaagacuaugggaacccaccucuugcaucagcaugaucuggaugugagacauggagucaaaggagaucauuuuggagcuuuaauguuugacugcccugcuggauuuuagacuuccauggggccuguagcccuuuuauuuuggccaauuuauccuauuugaaauggcuauauuuacccaaugcccacaccaccauuguaucuaggaaauaacuaacuugcuuuugauuuuacaggcugauaggcagaagggacuugccuugucucagaugagacuuuggacuauggacuuuugaguucaugcugaaaugaguuaagacuuugggggacuguuggaaagggaugauugguuuugaaaugugaggacaugagauuugggaggggccaguggggcaaccuggugggagguaauugaauccuggggacaaggucuuuccugugguguucucaugauuguaagucucaugagaucugaugguuuuaaaaacgggagucuuccugcacaagcucacuuuucuugucugcugccaugugagaccuuccaccaugaccaugaggccuccccagccacauggaaccauaaguccauuaaaucucuuucuuuuguaaauugcccagucucagguaugucuuuaucagcagcacgaaaauggacuaauacagauggcaauauguaagccauaaauagggaucagugaaugguucgguuuaccuagaagaugagagaguaagaauuucuguuguaucacuuugcugcuuuucuuccugcuugugauguuucuucuuaguuucauuguagguuucucuucuuccucuucauuaaauacuguucuccaagcuucuguccuuggcccauggcuucaacuaguucugcuacuuuuccauguacuggcaggucuucuaaaucuuucuagagucuugggccaacauauccaauaaccauuugaacauaucuaauuaaaaucucucaccagcuuuuccuuaauauguuucuuaccuuauucuaaaucccccagccguuuucuugguuccaauucuuaucaucauuuaccagccauuuucaugguucugauucuuaucaucauuuaccagccauuuucaugguucugauucuuaucgucauuuaccagccauuuucaugguucugauucuuaucgucauuuaccagccauuuucaugguucugauucuuaucgucauuuaccagccauuuucaugguucugauucuuaucgucauuuaccagccauuuucaugguucugauucuuaucgucauuuaccagccauuuucaugguucugauucuuaucgucauuuaccagccauuuucaugguucugauucuuaucaucauuuaccagugcaaaacagguauuucuauuacauugaauuacaauuacuuaauugcacaucuuuuuuuuccacugcaacauggucacguugaagauaggacuccccccaccagcccccaaccuuacacacauacacaaacacacuugagauaucuuauccuacaauguaacauguaucuggcucacaguagaagcccaagaaauguuuauugaauuaaugauaaaagauaaaggagcuugaaaguuaacacauuauauugaguucuccaaaggcaaaaacaguuucuuguucauuauauucugagugucuggaaugagaauagugguuaauaaauguucacaaauuuaguugacuagacuuuuucauaaauagugcuacuuuuuuuaaggcuucaaagcauuaggaugcuuauucuggaagaccugucagaugguuuagagauggggugaguacaaguaggcucuuucuauagccuaaggaagaaguaauaggucccugaguaacaagaugaaugagaaugagacugcagaauauccaucagacauggcagcagguuggaaauagggguaacacagagaaggaggacuaaagaauaagagcugucuuagauuccucauaguugcuagucuuuaucauuuuucuuucuuucuuuucuuuucuuuuuuuuuuuuuuugguagagaugaggucuuucuauguugcccagguugguuucaaacuccuggccuggccagaagugauugucacaccuuagccucccaaaguuuugggauuauaagcaugagccacugcacauggucaagucuuaccauuucuaaaaaugggucuaaaacagcuaaauaaauaacacacauuucccuguauaguugacccuugaacaacauggaguuaggguuaccaccccccuauguaguugaaaauccacauggcuuuuguuguuguuguuuuugagacaggaucucacugucacccaggcuggaguacaguggcaugaucuuggcucacugcaaccuucgccuuccaggcucaagugauccuccaccucagcuucccgaguagcuguuacuacaggcauguaccaccaagcccagauaauuuuuuguauuuuuuuguagagaugggguuuugccauguugccuaggcuggucucaaacuccuggacucaagugauugcccgccuuggccucccaaaguguugggauuacaugcauaagccaccgcaccuggcugacauaugacuugacucccaagaaacuuagguacugauauccuaccuuugacuggaagcauuauucauaacauaagcaguugauuagcacauguauuguauguuauauauauuguguacuguauucuuacaauaaaguaagcuagagaaaaauguuauuaagaaaaucauaaggaagagaaaauauauuuauuauucauuaaguggaaauggaucaucacaaaagccuuugucuucaucgucuucaccuugaguaggcugaggaagaggagugguugguccugcuaucucagggguggcagaggcagaagagguagagaagguagaaggagaagcaggaauauuugguguagcuuuuauucaaaaaaaaucugcauguaaguggaccuguguaguucaaaaccauauuguucaagggucaacuguauacuuaagaccaaauaaguaaauaauauaaagcgaaaacauauauuuuauuuucuaguaguguuuccugggacaucccccaugcccccaucuuuuuuccuccuaauuccucucuuagcacauugucagcuuccauucauccuugcaguucagcccaggcauuggaucuuauaacggagagcauuuugugauuucaguuagagcacugugucccaucuuuuucaugguguguuaaauguggcuuuacaguucuguagcuccuguuaaaccaugagcuccuugagggcacagaccacagaccacuucucugggcuucuaguacugggcacuuggccugucacauacauguuguuuuuuaaagaaaaugcuaguuaaaaucuaaauacauauuagaauagccuucuuugauauuugugaaugauggaagccuaaaggaaauaaaauugugccucaguuuccucaauucuguguuuuuguuugagaaguuagagaaauuccagcuuucuguugaaagugguuuucuaacugacguugaaaaacaagaauucauuuucucaggcuuggccugaaaacuuaugaagagaacuaaguacaaguuguccuaugcuaugauaaucuugacugcagaggcagaaaaacugaaggcuauuugcuuuucuuucaaggagagaaaaaauacaguugccugaacauacuuuuuuuuuuuuuuccuuaaaucucagagcucauuuuguugccugugagaguucagaaaauugcacuuuugaaaaucaggcuuaaguguuacuguauaaggggagaacauaacuuuugacuuacugaguacuguuucucaaaggacuuuuaaaguucucuuagaaaagggaaaggaaaacuaguauuugaaguuuuuauucaggaaaggaucuuuguuccauuuuaccaguuguuuugguacccuaaggacauagcuuugaauucuuagguucuuuaaugguugauuaaaguaaggcauacauuccuuuuuaauuacuuuuuuuuaaugugauggaugaggcauuuuucacaagcuguuaauucucggugaucauaaaggagcaauuuaaucuuaucuuucauuuucuaggaagaaaguauaauccagaaaaaaacacucaguuaccuaagccuaaagugcaggguugauaaagaaugguagaagaugagguuguauaacagggauggcgucuuaugaucaggaugagccacaccaucuuguggcaugcucagauuuauguuuuagauaacguuaauguaagucauucugaacaggcuguguggaacaugagaaggauaccagucauugacaucaccuaagauggugacaagaccuagaaagaaagaucaagucaagcauagaaguuuucaucaauguaaggaaccaaacauuauugguagaugacaugaggggcagauggaggaauuugggaaaauguugaugagccgguuuuauucugaccucaucucucagcucugugguagcaggauauggaaaacauaagcagucuccgcuugggaggaaugauggaagauggugucuacaggggagccagguuucaguaacggaaggauguaaagggugcauuaagugaaaggauguuaccauggaacaaggcccaaaaaguuauguaugucacgcaucucagucuuuuuaaauuuaacucugugucuguuuuugagauuaauucauucauugauaaaaauauuuauugagcaucuguuguuugccaagcacagcacuagauaucaagguguacagugaugagugcauaaguucuugaaaauggacaggauguguacucaucauguuguauauguauuagaguuaggugacauauuuaggaauauguggauauuuggaguuuuggaguuuuauaggcuucguaaguagaacuuagccuguuuauugaaucaaacaaagaugaaaauugguccaaauagagaucuauucuguagauaucaaaaauuucuugccauagucucccauuauaauaggacauaaaaguaagaugagaucucugcaguggcagggggguuuccuaacuuucagaucauucugauuugagaccuaggauaacacauuuauaguuacauuuuuauucugggguuauucauucauuuauucaauauagucuuacugaguaugccagcacucuacuacaugcucagaauauaacaggagacagguagauaggauccuugcucucaugaagucuauauuccauaaaaguagucauuuuugauaacuaacucucuggguacuuacauauaucaucuguaauccugugacaacccugauagcuacaggauaauaauauccagcuuuauaaaugugaaaaaucaagacugugggaaauuaauuggaauuagcugacaucaccuuuccuaaaagaauguuggugucaaaugcaugcaacacaccaugcuaugcugccugcugcaggcuacugugucaagcagaguuuuguguuagguguuaacaugaggguagaaaagaaaugaggccugguuuucagagagccuacaguuuauuguaucacaaaacuaacacuaaaacuccaauagaaaaaugaauaaagggaaacaauaauuuacacuaaaaaauucaaauagcuaauaaaugagaaacauuguauuuuacuuacaaagaaaugaaaguuaaaauaaugcgauaucauuuucacccauccagguagaauguguuuuuugaugggaauauucaguguauagguguagugaucucucucaagugcagcuauuagaagcguauuucuuugaauaucuauugugaaaacaagcaguauuuaucaagagccuuguaauguuuaugccuuuuaacgauguaaugauauuucuaggugucuauauaaagaaauggcuaaaaacucacaucacaucauuuucaaaaaugcuuaccacauuuuuguuuguaucagggaaaauuugaauguaaauaaaggccaaucuagaugacauaauguuguacugccacucucaauaaauaauaacuuugaaaaaacaauguaaaacuuuauauguaauauucuaauugugacaaauagguauauggauuaauuaauaaauacauuaauucagacuacauuaauaaacugaaaagaaaaauauugagaggaguuauuucuaguuauguagaggugaucuguauuuguaaccucacacauuauacaaauuaccuaaaaugagccauuacauuuauguaauaauaauugcauucuuuuuuacccucuucuuugaccccuacauuuggguuggaaagugagguaggacagagguugucaagaggugauuccaauccaguuuucagggcuguucuuaaagaacugaaaugcauuuauuucccuaauaaaacauauuauuuauuugauuuauauuuauaaagcuaauaugggacauagucaaauuuacauaacuuauaagcucuugguguauuucagucauuucguuucaguacacacagauauaauaguaguacuuauuucuucacagguuuuacaacugccuacagcaugcuuuggaaagggaaacgaugacuaacuuacaucccaagaucaaagagaaaaauaacucaucauauauucauaagaaaaaaagaaacccagaaaaaacacgugcccaguguauuacuaaagaaagugaugaagaacuugaaaaugaugaugaugaugaucuaggaaucaauguuaccaucuucccugaagauuacuaagcuuugguucugaugugucuuggccguaauguuucuaguagguuuuauaaagcugcucuucauaagaguauuuuaguuuguugaguguaucagccauucauaagccaguaaugacaagugcagagcuucaaacuauaacuuuguugcccagaggaugugcaguugucaucuaagcucucagcaguacccggcuuauccuacgacuucaccugaaaugcuauaguuaucccuacuuuuuuaccaguuucucccagaagcaccugcuuaauaaaucaaagauguuugaauggugucuuauucugaaauaaccugaccuaagacagguauuuagauuauuuuggauacauuuugaaaagggauagcauaaauauuuuaaguaaaaagaccuuuauuuuaaauaauaguggauauuuuaaugcuggaaauuagcauuauaguugauaugccagaaauuauaucuuugguugugauuuaaacuuaugcuauaaacuaaauuaaugauguaaauacauaguuuuaaacauucuuuuagggacauguaacuuuuaaguaucacuucaauaauacguauuauuauaggaacaaagauuugggaauaauugauuacaggugaggaaguacuggaauuccaguucaaggagauaccauuucauuuaggacuaaaaggacaagauacaaguucacaugaugggaaaaaucagaaaaccucucgcagacaaaggguauauaauggauaugaggcaucaaaaagcaugguauagucagugauggggaauaguccagaaaggcugaaacacagcaugugaugcgagucaagguaguugaugcccaacugugaagggccguucuaaucuagcauggagguagacaguguuuccuuaauauggcugcauaucagaauuaccuaggucaggacgaggcauggagaugcuacuuuaauaggcccugccgcagaucuuccaaaccagaaucuuaauccuggagucuaggaaucuuuauuuuucacacaacucauccaagugguucugauaaaaucaguccagcacuuuuagaacccacugauaacagacuuauuccuggagacagcauuugaggaggaauugaagauuuuucuaaugaaaagaaaaagggucacaugaacagauguugcaguguaccugugccagggauuucauguguacacuuuauaggagaauaagcaagagcuuagguaaguuauaguccuuaccauugggucuaaggcaguuuccaggaaagcauggcaacucguucagcuauguaaguugaacucuguaccacuugggagggaacauuccccuagaugacaaugucaguggcacucgaaguugugcagugcacauucuuaucuaccaacauauacagcaguccuucugggaaggaaauuugggcaggaaagggaacucacagugucggaaugccuggagcauuucuucuagucugguggacagaauaugaaaguaucugccuggcagugcaguaaaugaaaagagaagauaaaugaauaaaaaaaaaaguuauaaauaacaguaggaaagagagagugcagguggaacgagccuauccuguggugaaaugacaacacauucugcaguuuuaaaaucuaagaggcucauugacuuuucuucauucauuuaaauugaucuccaagaaaacuauguauuuuaaagauuccauaaacugaauauaugaaugagaauuaagaagagaggggcugcuuccuaaucuguuuauauaagguauaguauaguauaaucuguuuauauaagguuaguagagaggagacaccaggugcuggccauaaaccuaagaagacauugaaucccauucacuccuuaacauuccuuaauauacauucaugagcuacauaacauuuuaaucaucaaugauggaccauauaccauauacgauaugguggccccauaagauuauaauggaccugaaaaauuccuauugcuagugauguggucauuguaaagcuguagcacaacacauuacccacguuuguggugacagucauauaaaaguaugguacauauaauuauguacagugcauacauaauacuugauaauauguuacugguuugugucuuugcuaugcuuuuuaucauuauuuuaggguauacuacuuaaaauguuaacuguaaaacagcuucugacagguccuucaggaaguacuccagaagaaggcauuguuaucauagaaggugacagcuucauguguguuauugccccugaagaccuuccagugguacaagauguggaggaggaagacagugauacugaggauucugacccuguguaggcuuaggcuaauguguguguuuauaucuuaguuuuucacaaaaagguuuuuccaauguuaaaaaaaauauauaaaaaagcuuauagaauaaggauauaaagaaauauuuuguacagcuguacaauaagcuaagcauuauuaccaaagagucaaaaaguuuuaagaaauuaaaguuuauaaaccaaauguucauugugagccaagguuaauuuauugaagaaauaaaacauuuuuaaugaa

SEQ ID NO: 191345 - RNA, 27921 nt, Homo sapiens
aguaggaugcggccagcgcaggagcugguggugaaaaacugaucucgcauguucagaaacugcacaagcucuaccacauccucgucaacacugcccuuccggcugagguccgcuuugcucaaacauugcgccuuccauuuccugaacuccgcgcugcgauccaugggugacggacucagggucugcgcucggcuccuucaugguagccucgucucucccugggggcagccauauugaagcgagcgguggccgaaaagguccaaacuuccucuucguucuuaauuugggaaauucuagugccuucgccuagggguggagagaggcgcacauccuggguggagcgaggcgcacauccuggguggagccugcaaaaguuggagaagguguggcaguccucauuucuguggaaucugaagaagcccacgcagauuuuaauucccacucuagauucugguaagugguuuuaaaaacucuccuuaguuguuuagacagcgaaucuccccacugcucguccaaguggaaccgaguuugauuuuggcugcaccccuuuccugcccucuguccucccagagaacuagugcguagagcuccagaccgaagccauuccccuccaggggcugcaaguucccauccauaaaucagguaggaaguuuugccuucugguccugggcuccuagcccugguccugcguuuaggcucugaguuuaggcuaccacaccaugagguguccguuggcacuaccccugcccagccuccgccccccgcacucccugucccccagccccacgcugcaccccccccccccccccccgccagucacccgcuugauuuuucccugcagccagugccuggguuuggggauuccugcagcagcgcccagcggucuguccagggccccuucccacagcccagcucucagcuguagaggauuuguccuagguagggccccuucccacagcccagcuguaggggauuucuucuccuagguagggccccuucgcacagcccagcuguagggauuugauuucuucuccuagguagggccccuucccacagcccaccugucagcuguaggggauuucuccuagguagggcuccuucccacagcccagcugugggggauuucuucuccuagguagugccccuucgcacagcccagcuguaggggauuugauuucuucuccuagguagggccccuucccacagcccaccugucagcuguaggggauuucuccuagguagggcuccuucccacagcccagcuguaggggauuucuucuccuagguagugccccuucgcacagcccagcuguaggggauuugauuucuucuccuagguagggccccuucccacagcccagcugugggggauuuuuugucuuggauucccacaauuacagguuucccggagcuuccuccagcuuugccaucaggauugcagucuuugagagaaauguauaguuuuauugacccugugacgcccaccaccuagaauaaucuucaaaagaaaauuacaaaacacccuguuaacacaucguuggauguuuauacugaguuucuagaggagacucagugaccagggaaggugugucaaugauuaaaccuaaaggcuaaaguuuggaaugcuuguccguagcuaauggaaauuguugugcgagucccucugaagccacugugauuacgugucugguuagcgcagcgaguucagcagcaaaucucuccaagcucuacuccuccagcauuagggaacagacugcccuguuccauacgaucauggaaccuggaggaguccgaaauuauuaaacuccuccccucuucuuaccccguccuaucucaagugaacagaagugaccugauaagaucacacagccaggaagagacuuucucugaccacuuguaauucuugccuuuuuuacauuucuggguuaauaauaaaccauaugcuuacaugagucauuguguauuagcagcagaacaauuuguaaugauugauuuuuuuucuaaguuuucaguuuuuaaaauucuugccagaauucuuauuuaauuuuacuuuugcucuugucucauaauguuccuuugcucuggcuuugugacuugaucuguucauccuauguuaaaauauacuccuaacauuuucccaauuccuuuaauuuucguuuaaaucaaauggauacaagcauagccaggaaaaagaucacuguuggaagagggauuuuagauuuucuauuuccuagauuuguaaggcauauuggcaaccuuucagagguaaaauuaaaccaaaaauuaaaccaagggacucuuaauuuuuaaaaguuuauauuugauaaacaggaaggccuauuugaaguauaguuuaauuaaaaagcacaagcaauggaaaggccuguccuguucacaaggauccgaugcuagggaguaauuuuuuuuuauacauuuuuaaaaauagaaucauguccuuuguauuucugcugcauucccugacuuagugggcauuugagaaauuucaaacucuaagcagaugccuuagucauaaaauaugcgauucuaccugcagguuaguuugauuucacauuuucuagcucaaucugucucacuaucacuauuguaaaguuuauuucuacgaaguaaagggucuuauaugccagcaucucaaagggugagaugaaaaggaugguaaagaaaaaaaucagcuaacaccauuuaauuacaggacuuggguucuagcuuugcuucugugugacccugaccaagucucuuaaccucuugugauguuuucucauccauaaaauggauggcgauuuuauuuuuacuucugcauaaaauaauaguuuaaauaacuucucuaccuguucugaaaacaguuaagucaauggagguggaagacuuaugcuuuuuagaagaaauccgguauuacaggauuuuaaguauuauccuauuugccaucaguaugccacguuauuuuauucuuuguguaaucuccuuugacaggcuucaucguuaugaagcauaugaugaucccguggauaggugaguucaaaggcaaugagugcagguuggagccugaugaaucagaaugcuaaaggcucagugggagauaagaucaacagaagcaaaguaggagauaguguggucaggccaugccccaucacuuucaagccugauaggauaauguagucagauaguacugggcaaagcagaugagucuuccaaauccaguaggaugagucaucuuccuuuauuccuuucucccaacuuagccaaugccaaaauguggggggggaaagauacagauccuauuucagaguaauuuuacuuuuauuauuacaacaguuuuuuuaugguaaucaugagaugugagugaaagaaauauguaggaaguagguagauaucgaaaauggaaaaagcaagcaucucauaggcuauguguguaggugugagagagagagagagagcacccagcuuacagaagcuaggggcaggguggggcauuuucuucuugcucuuuguguucucugaguuuaacacaccacuucauguacaguuaagguucagaaaaauacgcauugcauaacaaccaauauuuaguauuaauguuuuguuuaagucaucuucuagaccgaauucuuugagaauaagagcuuguuuugauaaccagaguucuguaaauaucguuauauuaaagaugauuauagaacuauagaguauauuuuuuucauaacauuuuaaugacuucucuagucugcugcuuuuuuuuuuuuuuuugagacagggucucacucugucacccaggcuggaguggugcaguggcaggaucauggcucacugcauccugaucuccugggcucaagcaauccucccaccucagccuucugaguagcugggaccacuggugcuugccaccacaccuagauaauuuuuuuuuuuuuuuuuguagagauggcauuucgccauguugccaaggcuggccuugaucuccuaggcucaggcaauccuuaugauucagaaauugaaaagaagaauagaggggaaaacaauaaugaugucuacuauauacaagaucauguguuugcuaaguucugugcuuggugcuugccacgucucuagcacguaacucugagugggaucccagauuucagaugaggaaacagcaucaagagguugacugccuugcccaaggccauguggcucccacaugauagagcugggacucacaccucgagcugcauauuccaaaaccugcucuuuccguaacgucauguugaaaaaaaaaaaaacaaaacaaaaacaaccucuauguucuuauauccaccauggaaaauucucaucugggcuaccuuuuucuuuuuuauuuucuugauacuuucacuuucuugucuaaggaauucugagcuagagugaagaccugaauggaaguagaguggugagauugcugaguaggacuggacuguuuuuuucccagcccugcccucugacagaucaucuccccgucagagacugccaagcuguucuaaagugcaguguuuaugccguaggccugcuucugccucuguuuuuccccgaggaccacccuugaggauaugucauugcuaaacaaccuuuggaaaugucacuuucuccuuugugcuagacauuguuaaauccuuuuaaggguuuuaaaauggcacaaacuuuugauuaauuauaucaagaacuucccaucaauaacacuaccaaaauacuuaugauuccaccccuugccccagcugcuguauguggaaauguggaaugacauuuuauagccuguaugggcucuguucugaguaguccuguguggaguuuugauacaguaaaagucugaauucuuucauaucagguccugguuucugcagcucuucuuaauguuuaagcuucuugugguugaggcagauguuuuaggugauggcagaaucuaacacuauuugguugauuucaagaaauuauaacccacagauaaaauuauggggauauagucaaaaccuuucauuacaucuuuacagguacaaaaauuuuucuaagauuauauaacuuucuguacaaauguucuuugcuuuuuucuagguuauuugaacucugaguuuucauuuccuuugguauuaacagugauaggacagaaagguuagcugugaccuuguaauuuauaaaagauugcauauggugcacuguuuuuaguuuuuugauguuuuuccccuuuuguuaaaaugaaugaacuacauaaagccaaguguuuugacauugauaaaucucaaaaacuuaaugcugaaaggaaauagcgaauuguagaauucuuuuucaaaucagaauuuucuuuuuccuuucagcacuaaguuucugagauuuuuauauucccuaaacuguguaaauaaaguuugaaaacaugcaaaacaauaacacauauuguuuaauauuacauacucauguagaagugguauuaaaugcuugagaaugaugaguacuaaauuuaugguuauagucaccucuugaaagggugggacagaagcagguuuggcuucaauuauaucuauaaugguuuagguuuuuuaaauguuaagauuuguuaaagcuggguaauaucauuuggcucugucgccacccaaaucucaucuucaauuguagcucccauaauucccacgugucaugggagggaccugggggaggaauucaaucaugggucaggucuuuugcaugcuauucccaugauaguaagucucaugagaucuguuggguuuuuuuuuuuuuuuuuuuuuuugagacagagucucgcuguguugcccaggcugcagugcaguggcuggaguguaguggcaucucucagcucacuggaagcuccaccugccggguugacgccauucuccugccucagccuccugaguagcugggacuacaggcgccugccaccaugcccggcuaauuuuuuuuuuuuuuuuuuuuuuuuguauuuuuuaguagagaugggguuucacuguuagccaggauggucucggagaucugauggcuuuauaaaguggaguuccucugcacaugcucucuugucugccaccaugcaaguugugccuuuguucuccuuugccauaauugugaggucuccccagccacgugaaacugugaucccuuaaaccucuuuccuuuauaaauuguacccagucucagguguuucuucauagccauaugaaaaugaacuaauacgguaaauagguaccauuagagugggguacugcuguaaagauaccugcaaauguggaagcgacuuugaaacuggguaacaauuggaacaguuuggagggcucagaagacaggaagauuugggaaaguuuggaacuuccuagagacuuguugaauggcuuugaccaaaaugcugauagugauauggacaauaaaguccaggcugagguggucucagauggaaaugaggaaccuguugggaacugagcaaaggugacuuuuguuguguuuuagcaaagagacugguggcauuuugccccugcccuagacaucuguggagcauugaaccuaagaugauuuaggguaucuggcugaagaaauuucuaagcaguaaagcauucaagaggugacuugcgcauuauuaaaaucauuuaguuuuauguauucacaaagauaugguuuggaauuggaacuuauguuuaaaaggaaagcagagcauaaaauuucagaaaauuugcagccugaagaugcaauagaaaagaaaaacccauuuucugaggagaaauucaagccagccgcagaaacuugccuaaguaaggaggagccaaauguuaaucaucaagauaauggaauggggaaaaugucuccagggcaugucagaggccuuugcggcagucgcucucaucacaggccagaggccuaggaguuaaaaaaugguuuccugggccgggcccagggccuccaugccgugugcagccuagggacuuggugcucugcaucccagccauagcuuaaaggugccaacauacagaucaggccauuucuucagaggugcaagccccaagccucugaggcauucauguuguguugggccugccagugcacaagagucaagaauugagguuugggaacuuccaccuagauuucagagguuguguggaaauuccugaauguccaggcagagguaugcugcagggauggagcccucauggagaaccuaccucugcuagggcagugcagaagggaaaugugggcugggagcccccacgcagagucccuacugggacacugccugguggagcugugagaagaaggccacuguccuccagaccccagaaugguagauccacugauagcuuacacugugugccuggaaaggcugcagacacucaaugccagcccaugaaaacagccagcagggaggcuuacccugcaaagccacaggggcagagcugcccaaggccaugggaacccaccucuuuuaucaaagugaccuggaugugagacauggagucaaaagaguucauuuuggagcuuuaagauuugacugucucgcuggauuuuggacuugcaugggaccuguagccccuuuguuuuggccaauuucucccauuuggaauggcuguauuuacccauuuccuguaccuucuuuguaucuaggaaguaacuaacuugcuuuugauuuuacaggcugauaggcagaagagaguugccuugucuccaauuagacuuuggacugugaaccuuugaguuuaugcugaaaugaguuaagauuuugggagacuguugggaaggcaugauugguuuugaaaugugaggacaugagauuugugaggguccugggguagaaugauaugauuuggcuauguccccacccaaaucucaucuugaauuguagcucccauaauucccaugugucaugggagggaccuggugggagguaauugagucaugggggaagggaguucccaugcuguucuagugacagugaauaagucucacaauaucugaugguuuuauaaaagggaauuccccugcacaagcucucuuguuugccaccauguaagacaugccauugcuucuccuuugccuuccaccaugauugugagaccucccuagccauguggaacugcaaguccauuaaaccuguuuccuuuauaaauuauccagucaccaguauuucuucauagcaguaugaaaaugaaccaauacacugggugucagguaaauguuuggaauguuucauaaucuaacaaaaggaggucaguuuaccuaauguuaauaaaacucaacucauaaaauuucuaagguauugcaacucaagcaagaaaaccuaaauaugguaucaugcuaugucuauccagauguuuuuguuugcauguuugauuccuuuguugaaggcacugaaucccugcaggaaguagcaugaaggauucugcuuuauagcugagggauuuguaagaugaaagguccuuaaacaugaaaugagaucagugguaagcucaugauuuaaauuguuauuugaaaaaauuguuugaucugcucccuccaggggggaaaaacauggugauauccuagauacaaugugacaauacauuaauuuuuuuucuuccuuaguaucuagaucaccauggcgacuggacagaaguugaugagagcuguuagaguuuuugaauuuggugggccagaaguccugaaauugcgaucagauauugcaguaccgauuccaaaagaccaucagguagaaauaaaauuacuuuauugaggcuauaauuauacugagugugagucucuugcacauuguauuaaaaagaagcagacucacaauuauuuuuaaaaacauugaauuaggaugcaguuuacacuauguauacauauggacauugauaaaguuaacauaaaccugauaauuagugaaguagauguaugaaaaagaauaaccucugguuauaagaaaauuuuugauguagggaaugaucuauguagugcaauaauuggauuuuucugaauggacacauaaggaguuuugaauaaguuauucuauuacaaacauucaugauuuuuauuuuuugcaugcugggaaaacaauuuucuuuugcauucaugcuuuuucaugugugauucaugagaauuuaaguauauaguuuaaucaucuccagugacuuuaacaauacacuuuugauuuuaaauuauguauuuuuauuacugcacccuccauggcucccaagucuaauuuucuuagcaagccuaugagagucuuuacaguuuggauauaaccuaucuuuacaaauuuauuucucaucacuuccucuccauguagagauacagugcuguaacaacaucagcuuuuguccaauuuccuuaauacuuccuuucauuucucugucuuugcacaugcuauuuuuuuuuacccaaccuauccuuucucucauuccuaaagaauuucuacuuaucuuuuaaacccuaacuaaauaccacuuccuuuauaaagccuucccuuacuuuuauaccagagguaaucauucuguguuaauuaagguaaaauuagcucccacaauugcuguaaccuaaaaauugcaauaguccagccauggacaauuauuucuuauacacuaaauuuaaaaguucucaaauguggguggguagcuguucuccaacagugacuuagggacucagcuucuucuuucauguggcucugccacccaacccgucuucagggucuccauggaagaagaaaagcacgauguggcuuggcugggaaguuuuaaugggucaggucugcaagugucuacugucacuuuugcuaacauuccauuggcuagaacucaguuacuuggcuacucauaaccaugagggaggcgaagaaguaccacucuuucuguguacccaggaaaaggagaaaacggguuugaugaacacgcagaggucucugccacauauccccuuagauauuucuuucacuauuuuccccaaaauguuuuuaaugcaguacauaagccauucugucauacuuauuuauguuagcuuguaaaacuuggaaugugagcuuguugaaggcaagcacuuauuuguuuugcuuuugucucccauuuugauagcucccauaaucagcacaguccuagcauaaaguuaaaugaaugccuaaauucuuucugugaacuaaaauacauugucauugcagguucuaaucaagguccaugcauguggugucaaccccguggagacauacauucgcucugguacuuauaguagaaaaccacucuuacccuauacuccuggcucagauguggcuggggugauagaagcuguuggagauaaugcaucugcuuucaagguauugcauuuuuaauuauuucuauuuuggcugaauuuauuucauaaaaauauuugaacauagcuuucaacugcaucuuauuuaagguuuuaaaaggccccauuacacaauuucugccacucgggggacuccucuagucaaaaaaggaauuaagaaauuagauuuuauccagaggccuuauuuguuuacuacauuguagugaauaggugcuggguaauuucuguaucuucauguccccacagaaugaacugugauuuuuuuuauuuaauagaaauauguaaggaaagaaaacacacaaggaaguuagacuauuuccuaacucuugaugauacauaagcuaacauaauuuuuaauuucucuuauaaauuuugcuucauaauauaaagagaaaguuaauucuuuugaaaaauaaguaaaacaugaaaaaaugcaaggucacuauacaguuuuggagcccugacucagugaaaauguuaugcucaggauauauauauauacacacacacacauauauauauauauaugcccaaagacauauucauaguaagcucauguccuagcaucuuuccucauaauuccuugaccugcucaacuuuggcagcaccuuaccaaaauuagguugagacagagaagauuacugugccccuguacaggaagacuggcaaauucauacagcuuuccaccccucagcuuguggcaaccuggcuucugcccccaucgcuccacugaaaggauucuugcuaaugucacuaauggccucuguauugcugaaguuaaugggcccuuuuaugucauuaucuuucuugauuucucugugacauuugacacucuuagccacuuaacuuuuucuuuaaacuuuuucugcagcuucugugacaucauuuucuucuguucuccucucccccuccuuucugggccuccguuuucaggccucucuuuuucucuggauauuccuuaaaucuugguguugucuggggcucucagucucuauuuagaccucugcuuucuguauucuuuaccuuuuucauaaucucauacacucuuuuuguugccauuaucacauguuacaucuuuagcauagaauuuucugcuaagcucuggaucugugcuauccaaaacaguagccacuagcuacauguggcaauuuaaaauucaacuuaaauucauauugaaaauucaguuccugagucacucuagcaacauuucaaaugcuuaauagccucccguguccaguggcuauccugcuggacagugcagaugugaccauuuccaucauuacagagaguucuguuggagacacuagacucacaugaucaaccuccagaaaucucuuacaaaacaugucuaaaacuagcuuaucuuuucucacugcagauagcgccucucuugugugacugucuuggugacuucugggauuugaggauuacuccucgcuuucccuuacuagaacuguuuucucucuccuuuccauuuccacugccaguaguuuaguucaggcuaucuuaccuacuuaacuauaccccugaccugaauuucuauaauagacacuuucucuuuucccuggaauucauccuuacucuagaaugaaucacuuuauagaauuuaauucugauuguuuuacaccucuguuuucauucuugcauccaugucuuguagacuucagggagacucuuaaaauuccuuauugcuaugaaauaagacuguuucaugcucucucccaucugucuuuccagucuuaacucccacuccuccucacaguguaguuuauucuucaguaaugaaguguuuguccuucccugcacaucccaugcucucucaucucuguguuuuuguucauauugguucuucuaauugacagaauuaaauugaaacuuacaaacauggauucaaaggauuuuacacuuuagcuucaauuucuuuucauuuuaucuccugaaacaguuacauaccacacauuagucugcuuacucauugguaauaaaugcugcuaauuucauggcauuuauuccugucccuaucguuuggccaacuuuguuuccuucacccguaaugacucuuccccauucuaguuuucaaaaucuuguccuguucuucaagauuuaccucaauuguuagcuucucgauaaagcuaguccuaauuuccucuacuuagaaguaauuucuuucuuuuucuuguaccuaucuucaguggcucaucauguuugccuugcuuuuuguaauuauuucuauccuuugcuuuucucuccuccgagagucuaggaugcuugagguuagggacagugguauugaugugccucacauaacuugaaauaaugcuuucuauguaguauauucgcaguaaauguuugaauuauauugaaaucaauucaacauguuuuuuagcuguuaaaacuggauuaaucuucaucauauuugacauuucugggcaaccauauuaagcggugauacuugucuuugacucuuggauggcuuuugaaucuuuuuugucuuuauccuaucagauaacauuucuacauuuucagauuucaguuaaaguauacugagcaaucauuaccuuaauaauuugccuauucuaaggaauaucuacuuuuuucuaaaaaggaggaguuaagguaggugguuacggugggcagucuaauuuucccuaaugugcaaauuacauacuggcccaauaaugccuggccuagggcauuguuucacccugaguccugcaucuacuuuuuaauagugagguccagcagacauuuguugaggcuuuacuguguuucuggugccgugacaagaagaaggcuguccugggucauccugcugucaggguccuaguaugguuuucugccuuuggguguuugcaugagaaauaacggcaaugcaggggugaggaaacucauggaugggauuuagaguagguguuuggugugcggaagaaacuucauaucuuauuuguuucuucucccuagcauuuuggacaaaaauaacaguuuauauugacugcuauuuacuagcugcuugaucugaggaaauuauugaacuucuuuguuccucaguuuacucaucuguguaguggggauugcucuaaaguagagauaauacaugcccaccucacuagcuguugugaagaugaaauuagauaacacuccagagacacuuaaugcagugccugguauagcaagcucuucauggacugagccaucaacaucauuaugaugccauucaaggaaguuuauccuucuuuuucuuauauguuuucuguuuuccuuagauuuucuucccauugguucccauuaauaaauauuuuuaaaugugaaguauuuuaaaaugauuuauggcugggcaugguggcucacaccuguaaucccagcacuuugggaggccgaggugggcacauuaugaggucaggaguucaagaccagccugaccaacauggugaaaccccgucucuacuaaaaauacaaaaaucagccgggugugguggugcgcgccuguaauccuagcuacucaggaggcugaggcaggagaauugcuugaacccaggaggcggagguugcaaugagcugagaucaugccauugcacuccagccugggugacagugcaagacucugucucaaaaaaaaaaaaauuauuuauaugagacccuauagaggacaauauaugaguacucacuuauuucuuguuauaaaggauuauaccuauuuugacauaauauguuuagucuuccugcauuuauucauuuaucucuuccccuagaaaggugacagaguuuucacuagcagcacgaucucuggggguuaugcagaguaugcucuugcagcagaccacacuguuuacaaacuaccugaaaaacuggacuuuaaacaaggagcugccaucggcauuccauauuuuacugcuuaucgagcucugauccacagguaauaacacauucugucaauuuuauggccaaugccaaaagaggguaguguuaacugccugccuucuagcugucuguccauccaucuguucaucauauuugguuaccaguuacuuaccauuaaacauuuauauaauggaaacugugaauuuggggaauugugcuaaucacuagggauacaaagaagagcaaacacugucuucaagaugcucacagucuaguaagggaaaugacauaagagugaucauauuuauauauaauguggaaaguacagugguagagaugugcauagggauauauagacucagaaggcaugugccuguggugaugagguagggcuuccuggcaagguguaagacuuagauuauuuuaaagccaugguucaaaaaucuuguuauccauuagaaucaucuaggcagcaauuuaauaguacacuauugggcccuaccccagacccucuggucaguuuccauagcuggugccugagagucuauaguuuaaucccaucuacuaaguauuugaaaagcaucagagggaauucaccucaggaaggguaacuagaaggagagaggacauucuggacaaugggaauaguauggggaaaaacaguauggugugugggaacagcuauagaaacuugauuuuguuagagaagagauuucaagagaaagaguagcgaagaauaaaguuggaacagaguaaucucucaauaaauguuagcugucaucaaauauauagaauucagguuguaaaagacagauuauagagcuuauccauugcucuguaaaggacuggaaguaaugaaaugcuuuauucaggagacugcuauugucauauuuauguuuuauugagaugacuuaucugcuguguguaggauggauuugaggauaggaaugaagagauaagagcgucuuauaggagucuccacuagacaaaauccuuaugggccagagcaaggguucugguagaagaaguaaguagagaggaaagaauaacuauuuaguggggguaaaaucagggguauuuggugauuauuuucagguagagaaugaggaagaacuuaagaguaguccagcuuucuagcuugggucauguuuaacugugacaaagaaaagagggaaaaaguuucaaagggaagcuguauucaguuuuggauuugaaguugugagagacacauccuaauggagaaguucaguagccuauuggauaaaaaagugggaagcuugaagacuggagauacaaauuuggggauagcagcauguagguaagaauugacaaggugaaaagugguugaaauuccucagagagugagaacacuggagugagaauagagcccuugugaacaucaccauuuaagaauguagucagagaaaaaggauagaguuguaagagaccgaaaggauuccaugaccggcagaaucuagaggucaugguauuccuuaagcauccagugaaugcauggacuuugaagacagaacagccugggucaaugucuucacauaguacuaguugugugaccuugguuaaguuacuuaaacaucucaagggcaguuuacugauuugagaaacauagauaaugacagcaccuaccugcuagggugugguaagaauuacuuggagguaauguguauaaaguucuuaguacggggcuggcacaggguaagugcgcaaucacugcuggcagccuuaggaguggcaauugauauugauacuaaggagggaggccagcugucaaaugcaacagaggucuguucagaaaaaaaugacaguugggcccagcaauuaagaggucauuggugacauuagucaguuccuuuucaauagaauggugggaagagcuugacugaguggauugaggaaggaagaggaaaucaauuccuugaauggaaacuauucuuuuaaaaaugggggagacaaggaagagagaguagaagguuacuugaggagaguauguggaaaaaagggauuuuuuuuuuuaaggauagacaagacuugaacauauuuacagauggaauaagaucugcauaaggcaagauggaaaggacuuaggacauagguagagagauuggcuuccaguauggaaagcacagcucaucuguaaaaccuagaaaggguaaagaugauauaauuauggaaacauuuauggauagggagauggaguguugaagguacuugugugugauugcgucacuuuucacaauuaaguaggaggcaaaaagugauauuuuaagaaucagagcugaaguggcaccaaaaugcauggucaugugauuuuuuucuguaauacuuagccauuuggauggaguaucaaggaagcuagauuugaacauuaauccagggcuagaaugcugguggcaaaauugaauggugcaaaagaaaugagagcacaggggcugcggggagaggaggcugggcaaucuauggaguccaggcugaguagggacggaaggaaggccuggagcagcaagugggcagaaauggagcuauugagagucaguaaucucugcauaguugaagaaagauuuugagagaauauggguuuucagaauuaggauaaauuacugucauaauauugguuauuggcaucugauauuucucagggagaaugguugcugguaguuaagcccugggagagaguggcuauaaguggaggaaaauucaggaacugugaugcuugauuuucuuucuggggaaugcagugucuccuugauuggagcuggauuuggggugggagagaaagccuaugugccaggucuuagucuucagugacuagaagaugguaaaggacagcagcauggaaggccaggcugaguguuaugagcaccagggaagaugacuguauuagucaggguucuccagagaaacaaacaacgggaugugugucugucugucuaucuaucagucaaucaucuaucuauuugaucuucuauuugaucugaucuaucauuuaucucuauauaaauuccuuaagaaucagucacucuguacacauacacacacacacacacacacgcgcacacagauugauugauuuuaaagaguugacccaugaaauuguggaggacuggugagucuaaaaucuguugcggugggccagcagaugggagacacaaggaagaggugcaguuuaaguccauagaaaguuugcuggcugaauuuacucuugcucaucggaggucagucuuugaaaacaaaagccuucaacugauuggaugaggcccacccacauucuagagggucaucugcuuuacucaaaauccagcuauuccauuguuaaucucauucgaaaaaaaaaaaaaaacacuguuucuguaacagaguaauguuggaacaaauauuggguuccuuggcccagucaaguugacacauaaaauuaacugucacagcgacucugugcaaggauucaggaggggauuugccugcuuuuucuccccucaccccaggccccagggauuuaugagaaugugucuuuaguguuugaggggcaucuuauaagaauuuuugaaaaauuucuuugggagguauuucauaucccauaguuuaacacuagucauccuauccccuuauguuuauguuuuacuuuaacauauuguccucagucccuucagcucuaagcaagagugugggagaaagcuucacuuauugcucauuguugccacuucucagcuguuggugcauagcugggagcaggacucugguuacuguucucuuucccagguggagcauaauguucuauaaugucucugcaguguggccaccccacauuguuugaggaaguaagagagccuuccugagagucagaucuggaucucacagcaucugcuggcuuuugacauuggcaccguccaucuggaauagugaggcauccccucaugccuugcugcaugucccuucuuuucaguacauacuagaaaaguagucaugugaacuggaaguaaaaagaaaaugccauuucaccagagaaucuggacauuucagggggaugacaugggaaucuuugugauagaauuuauugcauuuccuacucucugaccuuugcuaacucagcauuccucccugaaagaguacaaggcuggugcaaccugauguucagagacauggagaagaaaaauuucuuucuuuccuugggcaaaaaaaauagcuacuguguuuacuuggacauuacucuagaccacagaauaaagacugagcuauauaauaaaccugcuuugaggcccuuucugugggggauauaugggaaugagagauuccagauccuccaggcucagcaauuuuacuucacaacccacaaggacuguagccacucagaaguagcaccacauagucaucccaguguccagcagcauagugccuggaacauaaagacucccaauaaauauuuguucaaggaauaaaugaauugaaggcuuuguuuauucuguggagcuuagggaauauuuggggcuguaugucagguugcauuugcuguuuguguaaguguuagccagacuagggguagaaauuccuuaagaugaugaaaacacccgagauuaauuagcuucaaaaaauaaggugauguaacuuaugcuuuccuuugcagugccugugugaaagcuggagagaguguucugguucauggggcaaguggaggaguaaguauuuuuuuuaauguauuuugaaacaagcuuggguuuauggguuucacauuauaguuccuuuggucauuuuuaaaagucagauuuauaaauagagucaaaggugcuuuuuuucuuuauguaguaaaacuuuugauuuuggucuucugaaggugauguuuugucauuaguuuagcauuucuugguuaauaaacucaacagagcaccccuucaaaaauauguuagauuuuccaccuguauuggguguagacuaagauaaacuggccuuguuuuugccuucaaguagcauauguuauaaaaauauuuauuuagaauuuuaaacaguucuuuaagguugauauuaauuccauauucccuuagauaaggaaacuaaggcucauuaaagcuuaccuauguugccccagacagcacgguaaagccacacugugaauucuuaguccuucuaucucccuucugcugcuugccugcugcacuuugaugacauccauggagugcacguauacagcccuguccuuaacaccacaacccauggcugaaaaugcuaaugugggggaaugggggaggaggacucagaacuuaaaauaagcccuucaaugaaaucacccaaugcagggcugucagaaaccucuucgagaaacuagcugccaaucugccucucaggagcuuagagggaaaaguuagagcucugcaguuagaauuuaacaagaaauccacaugaacucugucacuggaugcuuuggaaauuuuggagauaagauuuugcauuuuaaaaauaaaaggccuggggcuagaugcuuacuuugaggaggcuguuaaccauuucagagcacuguguauucuggagaguggauugaaagaaguaaccuauuaaauggcacauaguccccugaauaaugagugguauccugaaaaugugaauuuaccuuuaaaagugcccagguaauuucaguccuuuuugucucucuguuucuuuagguagaugaaucacgagguuucacaccuagcuuccuacacuucaaauagaucaauucuaaaggauuucacagaucaaacaauuuaugaaaaaacacuaggauugucuuuauggggcuugagacaauaugacagauauaccuuguccaaaacucccacuguuuaacuucacugaagaggcuauuuuuggguuaaauuaaauuuaacccuaaguaacuaaagggucugucaaacacauacauuuauuuaaauuacccuggcuuucagagagcuaacuuagugcucugugcagaagggaaagauuucaguaggaaggggagagaagaguuuaaagaaaaucucuuuauauucccuuuacccucuuguaaaaagcccaguugcuucaccaugauuuuuuuuuaagguaaaauccacacuguucucugagcuggcugaguuuguuaaauccucagcuggcagggauaggcuggugaccuggugugugaagugcuucugauccucccuguccuaucagagggaaacaguacuggguuuugccuugcuucuguuuguacuuucuguccucauuuaauucgaauuccuuugggauuauguuguguguuuaaaaugguguggaauuuaugaacacagcuauuauccagauauguuggugaggagugcccuauuuuaguguuagcaaaauaaguagaagaaaaauaguugacacauaauggugcauaaucuguugaaggaucauugcugguauaauuguugacaagaauagaauaaacagugccuuuuuaaaagagcuauugagugcccuuuuaaagcaguuagaacacaaggagauguaguuacguuagcuuuuuaaagugugguuuuauuagaggucuuuuauuuaaauuugaaaauuaaaauagaaaauuaauugugcccaccccauaguggguuguguuuuaucuaauuggaugucucucuccuccaucagacagugaguuucauguauuuguuuguuucaguuaaacaaauuccugccauaaccuggcugaguccagccucguuauucccaugugccauacaaucuuuaagguccacuucaggccuggaagucuguuacagcuuuaaucuguuucuaucauuauuuuucaucuuaauucuuuucuugccgaacccgguccucccuguaaaucacugguuaugaguagcgggugauuuugcaucauuucuccuuccgcucugggacauuuggcaaugucugaagacauauuugguugucacaacuuggggaagggguucuggcaucuagagaguagauauccuucaauacaugggauagucucccacagcaaauaauuaucuggcccaaaauguugauagugccaaguuugggaaacucugcucuaaauguaugugacacuuauuuguaccaucauuugucaucuaaucagauauauuuccuaguauuguuauuuaaguaauugcucuuuugucuauauucuuaaauuacuuugauuucucuuuuauacuaagcacauuuaucugguauucuagugauuucuuacaaucccagcauuuugggaggcugggauuuugccagguugcccaggcugguaucgaauuccugaccccaggugauccacucaccucagccucccaaagugcugggauuacaggcaugagccaccauguuccaccuaauccuuuggcuuuaaauaccauccguaagauaaugaaucucuaauauauaucuccaguugaacccuuuugaguccauacucauauucaacugauugcugaacaucuucgcccguaaguagaugagcacugugcagcucagcauguuacaagugauucuuuuauuuuuauuuuuuagagacagggucuugcuccguugcccagacuggagugcaguggcaugaucacugcaaucccaaacuccucaaauuccugggcccaagcgauccuccugccucagccucccacauagcugggauuacaggcaugcgccaccacacuuggcaaagugaaaucuggagauuuucacaaacuuaguguucuccagucuucucacucuacccaguuaaucuggccaaagacauaggagacagccuguauuuuucucuuuuccucaucucccgcauucaaucugugaggaagucccauuagcuuaccucuaaacuauaucugaauuuguuuauuuuuuccagugccaccaccuuuguucaagccagcuucaucucuuaucuagacuguucuaacagcuacaaacugaucuuccuccucccauuuuccucaccgcuuucuuugugccucacauguaauuggagcaaccuuuuuaaagccugagucaaccagaucauuuccuggcuuaagcucucccgugguucugcacagguuuuaauauacucggaagccucuacccucaccccucagauucugugugacuuggccuuucuggccucaucuucgacccuuucguacacgccccucccugagacacacugccccucuuucuguucuuugaccccaacugcauucccaccucgccagguuagccauggccauucacuaugcccacagcauccuccacguggcugaccggauguucucguggcuuguuccucacuuuuuucaggucucauuuuuucagaguggcucuuccugaugaccuaaauagccccuauuccugucucuuuaacccaacagccagucuuauuuuuucuuagcacuuuuauuuccugaauuuauuuuauucauucauaugacuauuaucuuccuccacccuuagaauauaaguuuauuucuuacauuaaguaccaugucuagcacaucguaaacacucuauaaacauucaccauauggaugaauuaguuaauuugcccauauaccuaucucuucuacuuaaaugguggaggccuuacauuuguuauuuagaauuucauaugcacaaagaagucagagagcauguucugaucaucuuuaaacccugcaaacaucuugaugcagugguuaaaaacucaaguucugcagucagacuggucuaacuccuguuuccaucuccgcauaugacuuggccaaauuacuuauaauuugaagcuucaacuuucuuaucuguacaauagggacaauaauaguaucuacuuuauagggucauugugaggauagaauaaaacaauauguagaaauuauuuaguaugguuccuggaauauuuuaaaugcucaauuaaaguuagcuguuuuucuuauuucuucauuuacacucuuaaguuccuuaaaguuaggguggguccuauaggaaucuuaaguucauuguauguauuuaaguguuuacaggaguguagagaauauauaacucuuggguuauauuuguuuuucagguuggauuagcagcaugccaaauugcuagagcuuauggcuuaaagauuuugggcacugcugguacugaggaaggacaaaagauuguuuugcaaaauggagcccaugaaguguucaaucacagagaagugaauuacauugauaaaauuaagguaaaauuuuccacuguuuuacaaaagucaaacuuuguuccuuggagacuugcgugguuuuuuaauauguuuuuaaccaacuacuccuuuaaagcuguuugcuuccuuuuuucagugcgaugaauuuuuaugcguguuuuaaaacuuuauuuaaaaaacagaugucuaaguuuuaaacuuuuacuaucauuuuuguauuguuuauguguauuaaauagaauauagcuucucuagaaucuuauagcuauaaaaauugauuuuuuaaugcaaauaacauucuaaguaaagcugcagcuuuguauuugcagcugugagguauucuuaauauaauuucuacugaugugaauucuccauggaaggugagauaucuguaaauuacaaacuggaucuguguggcccagggaauaaaguucauuuguuagcuggaugcuuuggaggaauaaucacuacugcauccaaaauggugagguggcauuuauuuaguugcugcauuuaacagaauucaagcagauucugaaguucuucacuuguacuauauuagcaauuugcuaaacacuuauugcuuugcuaauccucaaccacuuccucacguuagggagauuagaauuucccaaauauugaguacuguguaaauuagaucauuacaaaugaaggaaaaaauaagagugagaguuuauuaccuuuuuugcaaucaucuugccaaaaagccgaacaaaagcacuccuuuguuauacgucuggggaaccuaagaucuagcacugcugauaccauuauccaagaauauucacaaagaugaaaaauggcccguuauuuuaagaguaugguuuuuguucagcaauaaucuaauuuuaagaccaugaggucuugggagcuuccacugacuccuucugcuuaagucucucccauucucaaaaacauucucuuaaccuuuaucuuacuccccuuucucuucuccucuuucccacaaaacuucuugaaaaaguaguauuuauugcuuuuacuuccuuaccuuccaccacuucucacugcaguuuugcuuauagcccaaguauuuauacugcuucccagaggucacugagaagcuccuaauuaacagucugcuggucuucuuucagucuucaucuuguuugauuuuucaggagcauaugacccugaccacauuucuuugaaacagguucucuucuuacuuuccugacuuuucacuuucaaucuccgcccucuucauauuauuuaauauuaauauuccuuagguuguuuuugcuuggucucucaucuucccuggugcuagacuuucauccugaucagucucauauacucuuguggcucccuuacuacccauauacuguugauuuccaaaacugucuuuggccugaguucacuuccuucaugccaucaacccgcuagacauugcuacucaucuggucgcccaagacagaaacccucauuuuguuuguuuuuccugucuuuuaauuaucauucucccucccacccagcaaguugguuaccucauuuuaucaguuucaucucugacaugccuuucaaauguauuuccuuaucucuauuccacugaccaccauaacuuaguuuaggccucaguuucuccagccuugacuguuauucauaacugagcuaauacacccuuuuaucuaugcugucaucucccucuuaaaaaagaucuccagaaauaaauaaaauggaagcuuuaugaggagaggaguuuugucucucuguucccuacugcacuugcacaugcaguaauaaaccccuguaauaaaaaaacaaaacaaaacaacuacaaaaaaaaccccacacaauccaaauccuuuaauauggcauucacuguguuuucacuaucugucccaacuuacagucuccucucuccuaccucuuccucuccuugccacucccccuuaccugauuauguacuucaguuccucuuguauuucaauccuuguguucucaguccccuccaucuuugcuuuucuguuucuuugguccagacugacucagccucaggucuagcuuccccuuacucauuuuccuuucuuuuggcuugggaaacuccuauucaucccugagggcccaguucaucgucucuguggaacuuuaucugaccauggcaggcaaucaaaccuuaaccuuuuuucucuguauucuaugauuuauuucugcuaauguguuacuuagcccauuacuuuauagcuaugacuguaguauuucccaucuuucucacuaguuuuguuuugagcucccuauguuuguauuuguauuccugguaccuagugcaaucccgggcacagggauucauuuguguguguguguuaaaauaaaaugaauauaauguagauguguguagcuuuuuguaagagccagcguccaacauccaagagcccaaaagaguuagugcaucaaacagaugauaaaccauuuagaacaaaaccaaaugcacuaaaacaacaaaaaucaugcaaaaccgaacagcuaaugauaucuucuuuugcuuuuuguuuauuaauaaaaaugggagcccccuggggguuuggggcuuuugauuuauuguuucuuuaugaaaguuuauuuuacagauagaaaauuuucagcuaaguauuuuauacucaaguugagucuagcaccugaaaauuccagacaaacuuuauuucacuacagcaauguauuuaguacaaauuuuuaucaguuuagauguucuggcugguaccuuggaauuacaucgugauuauauaauuagauuauuuaaaauuuugcauuauuagucucaaagauguagcauuuauauaucauuugaaacauauuucuauaauaucuuguacagauaguagcuauuuuacaguuuuucacuugcuaucuuacucuacauuucucuuuuauuauauagaaguauguuggugagaaaggaauugauauaauuauugaaauguuagcuaauguaaaucuuaguaaagacuugagucuucugucacauggaggacgagugauaguaaguauuccuuuucuuuuuuuuuuuuuuaccacuuuaauguuuuaccacaauuuaacacuauuuuacaguaaucuuuaacuguagaauugcuguuuuucauguuagguuguuggcagcagagguacuauugaaauaaacccacgagacaccauggcaaaggagucgaguauaauuggaguuacucucuuuuccucaaccaagguaggaaaagaaguacuucugauuuugguaacuuaaacauugguacaguuugccuacucaggcaagcugaaaguuugaauagauguuaaacuuaguuauaugacuagugggaguugguaaggauuagucaccagaaggacaacuagggugacaguauaauuuauauccagguaagcauaccuuuugagauagaaaugugauacuaguaauaauuucaggacaacagguauuuuguacacuaacacugucucaggcagaugggauuuaugguuacccuguagauaacuacuuuuucuauaguucuggacaaguugacaaaagucacacauuuguaagagacucuucaugguauaacacuuagauucugaaguguuuuuaaugcuucugaaaauuaaaucauacgguucacuacaaaaagaaauuuguuuuuccuuuucuuaggaggaauuucagcaauaugcagcagcccuucaagcuggaauggaaauuggcugguugaaaccugugauagguucucaauauccauuggagaagguggccgaggcucaugaaaauaucauucaugguaguggggcuacuggaaaaaugauucuucucuuaugaugauuaauucuuucauggauuuccuauguaauuagagguacugucuuucccccaguuguacuuacccuaucuuuucuuuaauuaacauucgauuccaugagcuucuuaugugaaaaaauaagauuuuucuuuagagagcagaagcagaagaguaaaauuuauuguauagcuagcaauauuuuuuuaugccaucugucucaaaucaaagagucaucauaguaggaaauaacauguuaguugucauuuggcaugagugugcauuccaguaauucuuaauugauauuugauuaauuccauaccuuugauuaaaacaugcuaguucaaaauaagacugcucaguuuccaaggguuuucaagccuacuuaccuuuauaaagguucucuagucucugauuagccaugacuguauuggacuuugaacauuuucugaacuaaaaaccucuauucuaaacuaaucucauuuggauguguaagucuuuuguaaaggcaagaauaaauaauauccaggacaauuuauuaguuuucucaguauuuucccaaauauuagaauauuuacuucauuauugguuggcugccaaugaccccauauguucugugagaauaguagcuuuaucuuugauauaauacauagucuccaaauagguaauacuucgcaauugauuagauuuucagaguagauuuagaguuaucuguuuuucuggugagggucaaauauuuuuguuaauuaagcucacaaauuugauaaauuaagaauuaucugcauuugucucguaacauaauaauguguaauaaagucuauagaaaauuaa

SEQ ID NO: 191346 - RNA, 879653 nt, Homo sapiens
uccuguggcgcgccgccugguucccgggaagacucgccagcaccagggggugggggagugcgagcugaaagcugcuggagagugagcagcccuagcagggauggacaugaugcuguuggugcagggugcuuguugcucgaaccaguggcuggcggcggugcuccucagccugugcugccugcuacccuccugccucccggcuggacagaguguggacuuccccugggcggccguggacaacaugauggucagaaaaggggacacggcggugcuuagguaggaagaacggcgugcuuuucguacuuguuucggucuaucuuucugucucucuuugaacccucuuugccuucuuuauaacacaagcaauaaugcugguggugcucaucauggaaagaccacaucccaagaauuccaggugcagauucuucccggagccccggcccguuuaugcuggggcagguagcaagcuggacucgugaugcuaaagcacuuugccggaacgccaaguagccuggggaugagugaacugucagguuuagaaggaggggcaggugccacuuugaaacucaaugcacaaggucucuguuuuacugucaugggguacuccuggagagucugacaaguuuaucagguuuguuucuauuuuacuccagcauaagcgacucuuucaaacugcuguucucugcucccauuuauuuucccucucacuuggacacuuaggcucgauuucuugcucuuuaucuuucuuuccuuuuaccgcuuucuguuuucuuucuuuucuccuuccucauucucuuauaccauuuuccccaccuccuuguaacucuuuuucccuccaauaucucuuuucauaccuuuucuauuuucuguuuuuucccuccuuuuuaaaauuucuucucauauuuucucauuuuuaucuccacgacucuaauuucuguuccucacauuuaauccccuuuccuccucucuuuuacccuuuuuucuuuuugucuauuuuuuuuauuccuccuuaaugucccuauccugugcccugucuucccucuuuugacucccauuucucaucccucuccccauaccguuucccaccccuguggcacacacaggcauggucacuguuccccuccaguaccauuuacucacccucauaaaucuuauuuccauaaacauacuaacucacauacucucacauccucacaugcacuggcacuuccaugcuguaagaaccacuuccacauucagauugucucucacuguuuuuaaaaggcauacucuccuucucuguuccacauugucacucacacauguguacacacugccugucucacucgcugcucucacucugucucugcuucucucuuuuucucuuucugugucuuucuauccccuuuuuauuccuaccuuccucccuccaucagucuucacuuuuacuuauuuuucucauuuucccuucuuuccucugagcuugagcucugaggugguuugucauuaauaaacauccauacccugauuuuaccccuaagcaacacugcagagugggagucugggaauauuuuauuuccuaugaaaauauaaauggaugaucagcaaagcuuagaucuaaacaaagcuaaacgcccuauuccuucauuucuuucccaucacccucccuucucccccugccaccccaccucacauuucccugaaagaucuucuuuuucuccacugggugguaguuggcuuguaagucuggcuugcacaacaucaguguacaugacaugucuaaggugaaagagagugggaaauguuucuguuugaaacaugcaacauauuuaaauuuaaugaugugggugugguauaugacuuacaccuuuuggaacaugccuaugaguucaaauuuggaauacuaucguauuuuuuaauauacacuaauacauauguuuuuaauaauuucuguuuugaauaacaaaugccacuauauacaaaaguaacuaauaucuuugauauuacacaguaaaaaaaaacuuuucauuguugguaacagugauaaauucuuugucacagagaggauauaaauuaagccuguauuuucucuuuauguuaaguuuguuuuagaaguuugaacaacagugguaagggcaagacacuaucuucagagauugcaaacacauaucaugggagcugcaauauguauuuuuguagcaagcaacauauugcuuauuuguagugagcauuaccauuuccacccuaaaggguuuaggagacugcuuuucuuucaauaauguauccuggcauuugguuucccaaacaaacaacaauuuaauaaauacuaugguuagugaagauagcuggacccacauucugcuuccaggagacccauguuuaguucacucauugcuuccaacaguggagcuucccuaauauguggggaccauauauuuccaguguuguugguuuggugcaguccuuguuuacuuugugugcucuguaccucauccauuuugaugcuauaucccgcauuuugugauacugagggaacuugacuuucaaacuucuuaaagagaacagagucucugugucuucucaauaauguuucuaacaaauuagauuuuaguuuuuaaauuuuuuuaucauaugaaauagaaauuugaacugcauuacuuuuacucaaagcaauuugcuuacaguaauucugaaauucucuaagaauuauccaguuguugaacuucuuacauugucuguagguuuuaaacuaauuuaacguauccauuuauaagaaauucucucuccauuagaaaauguuaaauauugucaguuauuuuuuucuugacucuucucuacagcugguaauuuccucugaucauagaccauuacagauagagcuuaaggacuaauugaguauaggcaacucaggugaugcaucguuuuuuaaucaagaguaauguuacaguuauauuuuguuuuuucuuuguauacuuaaaaccauaucuguuguuauucucuaacucacuagaaaacaaaacaaaauucuacccuucaaacauaugcccuugucccaucaaaauacaugaaugaagugcucaagagaacacuuaaccaaauuacauaucauucaucaagcuuagcccaauauauucuauuuuuaauguaacauauuccucacagugucuuuaauaaaaaacaaauaguggcauaacaguuaucaaauaauuuuaagugcuaaaggccauaaagugcaaacaugccagucagugacucuguugcuugugguuacacuaauaaaacagaaguuuaaaggucaaaugauacauuucugucuccuaagugccagaauaucuguuuuugagaagaggaucaugaaaaacaaaacuuuccuuaaguggaguuauaauacccaagggaaauucauucuguuaucuaacuguaucuaucauuuuguaaaucaucuuuucuguuuagcuuaaauacaggauuuaugaugacauuccacuuaauaauuuuaauauuuuuaucauuuuaacuuugucuuuuaggguuagugaagccauauauaugaaguguaaagauguuucuuacuuuuaauaauguuauucugugcuaaauuucugaaugauucacuugaauuauuuggaccuucuugauaaaguauuuaaugauacagauauucaauauaguaauguuugauauuucccuuucuuaagcuuuguauuuaaaaaauauaugaugucuaaaauacauuguaauuugcuauaaacacaaacuguugccauuaacuuauuaaauauagacuuuaauugcuacuacauuuaauauauacaguauuuuauucuuaacagaacuuguuaaucuuguauggagacauuuacuuuuuuuccauguuuugaguugcauuuugugaacauggaagaucugaguuaaugugucaugggcugaucuaguagagaacaggaagugcuagaaccacauugguuaugcuucaguacccaguguuucuagaacuggagaauucaggggaauauaacucugcucuagaacaauacauaaauuucaggagacuuaaaaaaaucauuuugcagucacuuuaauaugaaccaguugcuuuauucuuaccuuauuaacaaauacuguuauguaaacauaucaaaaauguuuaauaccccuuggaaacaauacuacgaacauucucauuuacauucucccagugccugcacauuuuuaaaacacgguuauuuuuaagcuaauuuuuucaaucuguuucuuauucagcccuucucuaugaaguuuguacuuuuuuagccgccuuucugauaugaauucaaaauaugcuauuaucugcuugucaugcuuuaaucgaagaaaggaagaaagauucuuuccuuaauugugauaucuucuuuuacuuuagcagaguuaaacacaacucuugucauuuuaaugcaauagauuugaauggaaguuaugugauauccuacuaugauacucuaauacggaagaagccuuuugcuuagggcguauuucuacacuauuggaaacugcaaaacuuuuacaaguaaauuuaugaaugaauaugacaaguauuuauuauugcuuauccuauuuguucacaacauuugccuuuuuauuagacuacauuaacuaguuaugauuugaaaugcaugcuguuaguuacaauaaaauaaaugauuucuguaugagaauacagaauuaccaauagcaguaaaaaucaauuaugguguacuuuuggaauaauauucaagacucacauuuucuguugaguuauuccuacacauugaugcauuauaccuuccaaauacacaguucaacuuuaccgauauuuucaauuuaggacauuaaggcacuauuuuaaaaccuauauguuuauuaaauaguauuaugaagaaauaguuuuaaaauccugaguuuuuucucuuuuuaaaaagagcagggauaaugaauuaucagaauggucaaucuggaaaaauauguucuaggauauguaauaaaugcuaaauguuaccuauauugauuugcagaacuguucuauuggcaagauauauuacuugauacauuaguacacaacuauuaauaaaaguauaauguuuuuaauuuucuagaugaauguauuuugcccgaucuuuuuaguucagaagaauucaaaagcccauguaguuguauagaucuuugaacacaagcguguuaaugcacuacuuguuuuaaauagauagacuuugcaauuaaaucacuccguggaauaaguuaauacugcaauaccugacuucuaaagaauuuacagaaauguucacaucauggucugugucaguucuaggccugauuggccagacccauacuuuguccaucugcuauucuguguuauggggguggaggggggucugcggguggaggcuggagcuaaucccucaagcuacauuucccagucuuccuugccaaguaucuucaggcugucguuagccaauggaaaguagucuuuggugaagggacaacaucaugaauugaggggcuagggcauuucucccuucuuucauuguuuugggcaguguauaucacuguauucaucucccacuggaaccuuuuuuguuccaacuuccaacugauaacuagcuccuguguuucucuuuacugcuuuaucccuuuauuccuucaaccuaggaguaguaguggcuuccugauguuacuaaccacuggguuaucuuaccaccuucuauuuggcuucccagguauuccaucuccuuuaaaauacauuuccugcauuaaauucucccauuuuaaauauccaaaacgguuuaaguguuguuuguagaaccuugauagaugcauagugaaaagugguaguuuuugugauuuaauuauauuugauugagugacugcuuugccaguggcaccauaaguguugcucgccagcacuggauguaauaguuuuuuaaggaaacacgcauagaaguuaaaccauaagaauauugaggcauauuacaaagaaaaaagaagaggcuuuauaauccauacacagauuauguuaauaaaccaaaugaauaaauggaauauugaauucauauaucauuuaauaauuucaguaggaaaauauauaacguucuuauguguggaaaauaaauugaugaacauuuauugaugagauucaauaacaguguuauauuuuugacugagccaaaaauaacuaugauuaaacccugcuuguagaugugugaucagaaugcuaagacaauucauacaguguugccuauugaauuuaauaaaaauuaaagaucuuucuuuauauagaguaacaucugaggugauaaugaaaguuucuaguuuuuaugaaguaugugaccauaacaauaucccuaauugaaccauuugacuguuguaggaauuagucucucaaaccaguggaaucuuuugauuaaaaaucagaucauuuuucuaccauaucuuguuucaaaauugcagaaauuagaacaguauagacaucacaugacuuacacuuuucuuuucuuuucuuuuucugagauggagucucacucugucccccaagcuggagcgaaguggcacaaucauagcucagugcagccucuagauccuugggcucaagugauccucuugccuuagcccucugaguagcugggacuacaggugugugcuaacauaccuggcuaauuuauuuuuauuuuuagagauggugucuuacuguguugcccagacuggucucaaacuccuggccucaagccauccuuaugccucaagcucucaaguagccagaguuauagauaaaagccaccucucccucuuaacuguauaucagaugauguggugaccuucucguuuacuucuguaaaacaauuucuaaaagacacuuauguuugugucuggcucauauauaaauaagcgauugucauugaguccuacuauugguacauuuuucuguaauuauucaggagaaaugauaauuuaagacugucguuaaaugacucucucagggaugcucuagagaggauuucugaauuuggaaggaaguuaaauuucuugauaucauucauuacauuucucuggaagcuugcugauagauuaaagauugucauuggcacuuucugugcauauaaaaaaauaaaauuuauuguuuuuuuucccuaggaguauccuauuaccugucuuuuugcuuuucuaaaggaaauguuaaauugguucacauuuuauuuugucagguauuuuauguguuucagauuaaccaguagaaacaaaaauuaccguaugacuagagacuaaaaucucagauuuuucuacagucauaaucauuaucaaauugaguuuuaauuacucugcuguaucuauuacagaaaaaaaugugguauaacuuuuaagaucauuaugaauaaauaauagaaauuuuuugauauuuugugaagauguauuuucuguuuuucuuugucauuuuaauuucaauuagaaaaacacauggguggcaucguacgugcgggaaauaaagaucuggcuuucuguucccaagucuuucgguaucaggaggucacuggugcuaacaaauuucugcucaguugguuccaagagcuccaaagcuggucugauuuccuucucaggcuccuugguuuccacagucguacuaacuauggcaauguacuucccuugugcugcuacaucgugcgcaaaggagaucaugcagacguagauaucugacuuucgauugacuugguucuguggaauaaugaucuggcaggaguuggcaucauugguguucuugaugggguggcugaggaugcaaauaacucugaucaccuggcccacuuuuucuacccgaucuuuuacacagcuggggucacagaugaacugcuuacagcaagcaauuucuccuuccgauuuuacuccaauuacuuuuccauucugcacaaugauuucuucaauggguuuuuucagcauauagguaccuccauaaauagcacuuagccuugcaaauccuuggggcaguucuccaaggccauagagugguuaaagguaugggcuuucgccauaucuugccaaagacucacuguaaaguuuaauuggaucaguuuuaaacaaacauugggauaccgauacagacaacuugagacaguuuaucuuuuaaucaguguagcuaugugcuucugcugcucaagagcuggauccauacaguugugugccaucuguccucuugagguucaggagauucuaaauugaauaguccacgguuugggauggcauccagaaguuuucccuaugacuuuauauuuuguguuaugucaaauguuauggcagggcccaaauagccuagccacaaguuugguuuaugugggcauaaaauucuaaccaaacuccagacaauagggagucauuuggagaaagccuguaugugguguuuuaaccuaauaaaguugaugagagaaaaggggagaggaaucgaacauaaagcggguaaaguguagcacaucuuuuguaucucaggcauggcuucuucaguggaccaagcugcaaugcaguauugacuugacagagccucuacuucugucucaaaauggcuccaaaugauuucuauacugcaaaauaaagccaaauucuggaaacuaaaaaaaaaaaaaaagaacaacacguggguuuguagugguaaaaugcucauucagcuaucccuagggccuuagcacagaagcuuucauguaucaggccaauaucuacuaauuuuugaauuaaugaaucaauggaaggguaagugaagaaaugaauguauuuaaguguuuuuuuuuuuaaauccauauaucaacagucccugccuuaaauaauuccugcagucuuagugguuuaagagauauacauuggaaauauuauuuaaauuauuuaaauuacaggacacagucuacuuugaagaaaauguacuuuuugcuaaagguauuauuaaauaaaauguacuaaaauauaaggcauuuuacauaauaaagguaaaguauucuuugauuaacuucuauuuuguguguacuugcguguguguguguaugugcuauguuaagauuucaaggguauucuuacugucgguuuaagcagaaaaguuugaagugcaaugaccuaguuguuguaagauuuugaaaugugguuauaauuuuaagaagaucccagauuuuaaauuauaugggaaggcuuuugcccuugacaauuauaaucaacagauaacaggaacaguucaaaauagcaaaaugucuauugugaccuccuaacauuuauuucuguuucuaccucgacuuauggagccuucucuuccuuucuccuaaagcuuuaauuaaacaaaaucaauaaggauauagagguagaaagaauuugcuguuaauauggaugaauaacucaauuguaaaaaguagcuacaugccccaaaccagagcauaacuuuuguaucauuuuaaccaucuccuagagguaggucagcaguacuuuauaaaccacaguguauugauacuagcugauagaauuuuaauguggucauauggcuuugauuuauaauguugaggauguuaucuauugguguagugguuucuaagccauaucagguucugaauucugacagaggaccuuugaugcucuuauaagcauucagcuggcaugggaauuggucucuuaaucacuuucucuaagaaaaggagaauagaggaaaggaggaauuuggcaguguugccagaauuaaauguugcucuuuugaauaaaagccaauauauuguacuuuccaaauagcugguaauuuacucaauuuagggaagaugcuuauaacccuuuucaguccagaacaaaguuguucuuuacugaauuuuucuaagucauuuggacauagguccagugcucaugcucaugcuguugauagaguuuguguguguauuagcguauguuuaaagcuguggcuacugccauaaaauauguaaagguuuuagauaacuuaaagggccauggaaaauauguguuccauugucuucagaaaccccuuucuuuucaugcaacuaaguuaaauuuagagguauuaaugaauuuaagagauauugugaauauaagagcuauaaucagaagauauuuuauguauuuucucuaauaacauuuauccuguuauauaaggguaucuaauaaacagaucauaaaguuuuucuaauuuaauaaauagaauauuucuuacaguagaauauauuuagauacauaauauuugauuugaaaguauuuucaaauuaauauauuuggucauugaucaguugaauagaaaaugacauguagacuacuuaguuagugcuugguagguuauuagcguucaaaaccugaauguugagugaaagaaucagaguagagauggggaggaagggaagaggaagaaagggagggaggaaagcauuuuaagcuguauuagugacuucucaucaaauuaccuuaaacuuuagaucacuugggaugacauagaauuaagcccagaaauuucauuauuuagaacuauaauaagagaaaauauauuuaguuucuuauaauuuauuacauaacugaaaaauucuaaacccauaauuuucuguauuagucuguuuucauacugcugguaaagacauacacgagacugggaagaaaaagagguuuaauuggacuuacaguuccacauggcuggugaagccucagaaucauggcaggaggcaaaaagcacuucuuacaugguggcaggaagagaaaaugaggaagaagcaaaagcagaaggcccugauaaacccgucagauguugugauacuuauucauuaucaugagaauagcaugggaaagaccgccucucaugauucaguuacuuccccuaggucccucccacaacacgugggaauucugggacaacacgugggaauucugggauauacaacuccaguugaaauuuggguggaugcacagccaaaccauauaaccuuuccaugaugaagugauauacacuguacguauugaaguuugaaaauuauauuuuucauccaaguguauaucuuccuucuuaguuacuagucuauauuuauuuuagaacauagauagcagcuuuauaccuuggccugcaauugggucaggggccauuuuuuggaauaaguucacagaaggauauuauauauacaguaagugcucauuuaauguuguugauaaguuuuuagaaacucugacuuaagcaaaaugauguauaaugaaaauaaccuuucuucccuccucagcauuauaaggaagcaacauggaacaaaaugauguuauucaaucaccuguuguacauuguuucacuuaaaguugcagcuuccaagaaccuauucacaucguugagggauuauaauacaucuuugaaaaaucuucugcaucucuuucuugagcuuauguuacuuauuuuuguucaacaauuauuaauucuagacgugaaguugcuuuugcuuauuugcaaaguuuaucaucuaucaugauugcuuaguuuuauugaaauuguucaugcuuugaggcauccagaauggaaguaaccagagcuugaguuccugcuucucuacuuacuggcuaugugaccuugaacaaaagccuugucuccacaacagaaguacacggauuaaaugagacauuacauguaaaaugcuaacaguacauaacauauaguaaguacuaaaaguacauuaacuaauaauuuuaugcugcuuuuuuucugcuaaucucacuuugaaauuuauuggcacuuggcuucacauuuggaaguagaaacacacuaaaacguguuuuagcuguuggggugcagacccagagcacucaaaagaaauggaaucacaaauuuuaugcucagcagacugauggugauuugauucacuuacuugaagugagagaucacuauaauuggguggucacaugaaacauugaggacauaagugagaaauggaaagaaacagaagagaggaaguaagacuaauuagaaauauguaaugacagugaaagagucagaggaugaagaugaacauuuguggcaguuuagaauggaagauacgacagcuggugauaauauuggaauaguugauaagaggacuagcauuaaaaacuuagcaaacucuggauucuggauaguguagcaaauaauuauugaggauuagauauguucuuaugguuccuuggagcaucuguagguuaugcugaaggcaaugcaguucagaagcaguagguaugggcaagaacuuucccuauacauugccauuguugccuaggcaauauacugaauaaaagcucggaauuauguaugaaugcuuguccuaauucugcauauuugcaaaaugcauagcauaguguuuuauagucaugaugauggagccaucaucaagaucaugauucagauugaauccacagucccagaacaucuaccauauaugacauacauucacagcuguguacaauaagcuauuucuuucccacucuuauagccaaguaguuuggcaagggaagguaacuugacccagguggaacaguuaggcaguggcugagccacaauuacaauccaaguccuuuaucccaagcccagugccuuucucauuaucuuguaacucuuacuaaaagagaucaaaacaauugauagauuuauuggcuauucauuuauuacgcauuuacucggcaccaacugccuuuuagcuucuaagucuacagugauuaaaaacaucgagaaaguauguucuauaguugaagaaacgugaaauuguuuaaaugagauuacauauuuggcauauuaaauguacaugcuauauauuauauaugcauauauauuaaaaggucacaugcauuuacuagauaggaaaauuuugaauuuuuaaaacuacuauagauauucugaaaaaaaccucucauccauaaaugauuccaucccuaaugauuacaagcuauugauaacagaaaaaaauaaacagcuauugaacaucacuuagaguuagguauaauguauuggucacugcaaugaauccucacaacaaacuauacuuuuucuacuuuacaaauggggaaacaaccucauagaagcugaguaauuuuccgaacuuuauuacagcuauuaaugcauaaccaugauuugauccuaggccugugugucuccaaagcucagacucauuuccuuucaaaagccgcaauauguccugaagcuuuuuugugcacucuaguccuuaaaagaaaugaaaaucaguaguuccuuguuauaguauuccaagucccuaguuuaaucaucugaaugcccauccugauauaacccugaacagcugaaucaccuugauucacuccuuugaaagggguuaggcagccaauaauuuuaagcaccauuauuucccaagauaggaagauccaaagauucagagaccuauaaaaguuccuuguacuccaauuucaauaacaugucaguaguaaguuauagagucuuaaguuuaauugccaucaaugaauaaaaucaaacauauuagauauguugccuuuuucugcuagcugguagaaguaguuuauauaguuuauagccuaauugagugaaaacuuguuuguauccaauagcacauaauuuaagaaucuuuuaaaaugugcuuauauauccgucuucuagagacuuugcauguguacccaagagaaguguaaauuuuaugauggcuguggcugcuuuacauauccaaagcuuuuccagugcaguacuauuuuucucucauauuguuaaaaaaggcuuucaaaccuuuauaacccauuucuagcuccuucuucgcguucuuaaacccuuccauuuuauauuguucuaucaauuuuauauuagucuguuaucucauuuggcuauacauaagaauguaacagacauagucaacagcauugauuuauauuauuuaaaauuauuaauccuguauauuuguauagaauauguuuacuaaauucuagaauccuugaauugauuuuuaauuuuucuuucuuuguaaauuuauauuuuuccauucauuguacaguuuuuccuauagguaaucuguuauuucaggaguucauucacccaauuucagcauuuaugcauugagucccuguaguaugcuauccacuuucugugaguuuaagauccaaugaugauaagagauaaguucccaucuauugaauuuacauuguaauucagucuauauucuuaaacacuguuguguguuacaaaaaacuuacgugcggauuucugcuucacuaacucuuagcucagcggccacagcaaguuauuugguuuuucugagacucaguuuucuugucuguaaaauggaaauacugagagcuacucccauacuuauugugaacacuauaauaauauacgugaaugugccaaaagcagugucagacacaguucauguucuuucauuaucaguuuucuuucuuaugcugccuuccuccucuuccuuuaauauagcuauaauuuauggccagaaaaauuuaguuaaagaauuuguuacauguuauauuguauuugguguauucuguuugcucccuaauaacgucucagguucaccucuuuuaaauucaagacagcuuucugauaccgugaagaguagaguaugucugaagacauggcgaccucacacauauuguuucuacuucuuggacuuauuuuuuuuuccaucugggaugcuuuucuuucauacuguuuucucuguaauacuuuuauacauggauuuuccucuaaauuuaucaucaguuuuugacauauucugaaagucuaugaagguuuauuuucuucaucauuucuucuguuagcaucauaaucuucuuaccaucauuauguguuucuccuacuauacuacgcuuuuuucaauagacuuguguuuuccuuuuuucuugguugaaauauguguaagggacaucugaugcuuuauuuuaccaacaaagcaaacgauauuuuuaauucuuuugcaaauaauucuucauugaaauagcacuuucaugcuucugugauuuuauuuuaucaauuauuuuaacaugccuaugcacaauggaauggaugacacuucucucuagcaauuucaauaauuggugaguugauuuucugaauauucuuguggcauucaaaaauuaucuuaauauuugauacauauaacuauuuucuuacagacaauaucuggacuuuuccguauuaucuagcuuuaaguagggcacaauguauauaauuuuaguauggggaaaucccuaaaaugaaaauucuugauaauauucuuuuuucacauuaaaauuccuguucaccuuucuucuccuauauaagaauauauuauucuugcuauuucaaauuucucauaaaacccuuuaauagccucaucauuuuucuacuuaaaauuacauaugcauuguauguaagaugggguccuugcaaauaguggcauauuucuaugaauuauuuuaaaaauugggucaggaaacugauuccgauugguuaccucacuguaaaauggguuaaugauaaugccuaaccuauagguucuaagaauuaaaaaagguaaacguuggaagcuccucaacaucaugccugguacaaaauaaacaaauguugccaguaagauuuuuagaaauauuaacaauaaaccuucaucgauauuauaaggaauuagcugauagcaaucaacaucaaaguuuucugauaacaugauuacuucuuuacccuccgguaugcuuuagggacuuauuaauuauucuuuauuucagauaggacuuuuugcuauugcccugucuugugugggacauuuuccuccucaucaauugauuuucaaaaaaaaggguuuuaauaauuuucaaguucuauuuauucucugaauuuagcucaaugguguuuuuuucucauuuccaaauugguguguguguguguguguguguguguguguguguguguguuuaucugucuauauauauauacacacacacuugguacauuuuuuagauuuuuauguauguauauacauacacacauuugugaauguauuuaccuagugaauuuauuuaccuugcauuuaauacaggauuugauaaaauguguuuggucaauauaaagaaguuccuuucuuguauuuuaguuaauuauauacauauuuuauaaaagacuucuacccagccauagaccuggugcuguuaccuuaauugccuuuguaucucuuaaggccuugaacaggcuugguguguagaaaugaguaagugaaucuauaaaaaacuuguuucucucaguagaauccuuuacugaggauuaguacuacuauuaguacugaggauuaaacuacuguuuaguuugacaguguauguacuuaugguacauaugcauuuuuaauuuauuaaguuauuaaaauuuguuauuaguuaacauaguuuacauagauccauuuggaauauauguugagguaaauauguauuggcaucuccuucuuagaguucauuacaauguuaugucaauuacucaccagaaguuuugugaggccaagggcacacuuuucuguaaauauaacugccauacucccagaaaauguuaauaucaauaacauuaugaugauguaauaacauggaugggaaauauucucacaaacgaugaucuuaggaguuuaguaaggugcuauauuuuaaaaauuuaaugcuaucucaaaguaagauuauuuuuggaauuuuacuuaauaaaaucacuucaauucuagaguacauacuguaguauuuuuuugaauaggggaguauaaaauaggacaucacaagugaggaagaagaauuaaguccuaucuaguaggacuaaucaaauaaacuucagaguuggaaaauuauuuugaauauucuguuaugauaaugaugacaguccuaugauuuguauaaccuauuaagaaaauuauuuuuaaaauuuauaaaaauaggaagcucauugaagauuuuucaaauaucuuuuaaguucuuagcagguaugcuuaauagugcaugccuuagagauuuaagaaacaaauaauucuuaguuugguuuuaaagguaaaaacuuuuaguuucuggugccuacaggguauauuaccauuuaguggggaauucaauaaauaguuuauugauugcauauauuucauuuucuugaaagcuuaaaauacacuuaacaauugacuuguuauucuguaguauauuaguuacauacuuuaggcucaaauuaauucuuaguuauuuaauuaaauuggguguuuacauuucaguuauuuuucuuggagaaaaaauguaaaagaggaaguuugauguacucaaagauuaauagaaauauugaaacugauugaccuuacuaucacaaaauuaauuaaaauuaaaggcuaacaaaacuaucuuccuaaugaaagagucaaucuauuauaaauuuugaaugauuuucauuuggcaucaucagauagguuggugguuaaacaggcaaacagcuaucaucaguuaugcauaauuaaaacaaaaagauuguccaagaguuuaguguaaguguaggcuagagaaaaaaaaucugcuacguaagguauacagaaauuaguagugugauauaguuauucaacuuugauuaauuagaaaauguuaaauuauuugcaaccauugaacuaucuuaugaagaaaugacaguuaaauaaauaaccggaaauuuauucaguacaguaauuuauaauaauuauaaauuuauuauauuaacauaaucuucaaaaugacauaaauaaaauaauuuauuguuaauguguuuuccaucuguagaaaacuuaaacuuugguacauuauuuuagauuucucuuuauguucaaaaagguaguuuucuacgaagaaauaaaacauuaucauuuuaaaugaugauuauuacugagaaagucuaugcauuauuaaacguuuuguacgaguuaguaggggcuguauuuucugucauuaaaaguaauucauuuaaauaucauaaaauauuuaaaaaguuuuuaagaacuaaaauacuacucuaaaauuauuuaguuuccauauauauguuauuuuaauuuggauaacaaauaauagaagacauuguagcauaagauaucaacaaagaaauaugacuuuauuguucaaaauauaaucauuuauagugacuaauuucuauauuuaaaacuuaaauauagaauaucuagcuauuuaaugcgacuaaauaaucccauuaaaauagcaucaagauauaauuguaaauauuuauuacaaauuuuaaauuuaaauuuaaacauauuucuuucauaucuuugaaauaauauuuguaucuuaaaauguuguauuguuuauauauuaucuuaaauaucacaacagccuuaugagggaaggagaacaaguguuaaaauuccaguuuuacaaaugaauaaacacaggcuuagauggugaaagaccucuuuuuuguuaugaauaauaaaugucuuguaaacaucaaagcuuggauuggaacucaaucugauuucuuauucuguauacuugucuccauauuaaugauuacacagauauaaacuacucagaguuacagauuuuauuucauuuucaguggacuccagaacagcuuuugauuuuauuuuagccuccauauugaauaugccugucauaguuagugauaccucuaauuuccagagaacaccguuuccccuuuugugcuccauuccccaucauauuuuacucuuuccagugaauauauguauuacauaaaugauggaaacaucuaaggggaaaugaaucuacauagggauaagaaaaucagggaaaguaugauauauugaaaauuaaucuuuucccaccacauaccaucaacaucuuuuuucauugucauuuuuaauuuuuuuuguuuguuuaucacuucacuuaauuugggacauaagagguaagagagaguuuuuuugugugugugugccaaaagauaugccuacauagcaguaauucaagaaaguuagaacagcaacuauucaaguauagauaacuuuagauucuaaaaauucucuuuguuuuguuuggacugacuacauucaucacaacuuuuaagaagcaauuuuaaggucgcuuuuauuaagcguauauuuaacuauaacagcagauuuuauucacuccagagaacuaaaacauccaacuugcauagguaauuucaaagaaugacgaaauagagcucuuugaucacucuugaugaacauuuuuccaaaugauguuucuuggggacugcuaaugggaaugcuuauccaucuacaugauguuaauaaaaauauuuaagaaaucucccucagcugacuuauauaugaucagcacucuuuuaaaaaaaucugaugccuacagcauguaaguaaacuucucuuuaauaugacuauaaacuuguuaauugccuuuugagauuagcagagucuguuuaauaugaauguguugagaaagacuuuuguuucuacaaaguugaauucuuugaaaauacuagauaaagguaauuuuuaaaaauaacuauuuuuaauaauauuuaaguauauguagaugggguaacuaaaaaauuuggaggaaaauaauuaaaaccuagaugacuucuacacucagaaugcuucacaaaugucuuuaaauagucauuccucuuugaagaacaagaaacugaaaauaugguaaucuuaguggaagcuguaugugauagaagaaauacaguguggaauuuuagucccuuaguuacuugcuaacaaaagaugcugaccugacguuuuaagacugguacauaaauauacacuuacauauuuuaaguaaaaauaaaauauuuaugguaugcacauaauaaauuacuuuuugguuaacugaccaacaugaucuucagauuuuuuuuauaagagauugcuuuaaaaagcauuauaugcuguugcgaauaauuuuagaagacaaauaucuucaaauaauguaccacuaauuaagcauauauguaccuuuauugcacauucauggagauacauuuaaaugauaauuugauauuuauaaaccucuuugcuuuuugagugaaggagauaauaaugauuuauucauugauacaacuaauagugcuugagcauuuaguauaugagaguagucuauuagaugacugagauccacuagaaaaaacaaaaacgaaaaaucucuuguccucaaaagcuuauuauauacgucagguaaacaaguggaaacaggaaaaacagacaacaacagaagaaaauaguuuuuaauaaggacaaaaguaaugaacccuguguauucuucucccauuguguuccaauuagauuucuuuugucacuauaaaggaaaccagugcuauuugagcuuucacuucaggagaaggcuuccagaacucaggcagggcacagcuucaucucccaaugcacucccuuuauagaaaucauaauuucuacauauauuauuccacuucacuuuccaaaccuuauguaaguaagggaaauaccauucuggcuuuguuggccacucacguuuccgaguaaaagguuccuucucagcaagcaggcccugccacccaguuauccaaucuaggauagcuucccagugaaaugcuaagaugcccauuuucccccacgugauaugcucuuucaugauacuguauuuauugucuuucuucccuucuuuuuaaaacaaauagauuuagggggugcaagugcaauuuuguuacauagagauacuguguaauggcaaagucuaggcauuuaguguauacaucacccaaauaaaguacauuguaccuaauagguaauuuuuuaucccucaccugguccuacccuuacaccuuuugggaucuccaaugucuaucauuccacucuguauguucauguuacacauuguuuaacugucacuucuaagugagaacaugugguauuuaacuuucuguuucugaauuauuucaccuaggauaauggccuccaguuucauccauguuguaaagacuugauuucauucuuucuguggcugaguaguaucccacuaccucuguguaagaacagggaccuugcaugcuuuaugccaagcguugccaaaguggugccggacaccacaauuugugcucaaugaaauuuuguucauggaaaaaaaaguuuuauaaacauuuuuuuaauuacaaggccuuucaguauuuaauaugacaauguuaaauauccauuuuggcaaaucuauaguguuaacaaauauauaguuuuaauaaaacuauuuuggauuuuuuucugagaaguauuucuuuaaaccaguguucugcauaaugaaguuugagaaacaugcuuauacauuuauuagaagauuugccuauuaaauuucuauuuuaaaaugugacagaauugaaaauauuuauaauacauuauguuagguguuaaaaccacacuguuggucuccaaauugguuaugaacuuaagugacaauaaauguaaauaugugaaaggguagugaaaaagcuauacauuuuuauggucucaucauuuauaguaccaacuuaaugucagguuauucuguggccaucuguuuaggcucauauucugacuuguuuacuucugcuauuacuguaaaacaugauuuuuuccuccuagaacaaaaauguuaaaaugauuuuuuauaacaugcucauuugugauccuucuaaaauucaacuaacuguauaauauaaacaaaagccauaacuauaucuagaauauuucagaaauaucuauauuaauauggacagacauuuuauguuuacauuucugcuuauuuuguuaaucuucaacaauuguuuauauuuugcuccuagacuaauuuuuguaauucguucacuuuucagaaagaaauguaauuaugcaaucugcauguaaaugucagcuuuuaagaauuugguuuccuuauguaggaugaaauacugaaucaagugugaauuuguauugaauuucaacugggauucauuuaaaauauuauauuccaauuugagcaacuauuuagaaaauuuguauuucauucauagcccauuuuacuggggcaaguuagucaguuugaaaaguaucugacagaguaauaguggaacauacuuauguguagugucaucucuagaguuaacugcuucauuuuaaaucacaaucuugcuaccaccuuucggacaaagugcuuaacccuaugugccaauagugcauauuuuauagaaugguuugaggacuuauuuuuauaaaauguguguauucuaaaaacagugccugacucauaguaagcgcuuaguaagcacgaguaaauuauuuuauguuguuuacaaauauagauuguauaauuuaaugaaugagaagaaaguuucuguucagaaauauccuuuguaaaaauugggcuuaucaauagagaauaaaauccugauuuuggcugaaaccaaggauggaggaugucuuuauacuauauaaaaacccuuugcgggaagcuaaaauuuuuaaguucacagauuucaaagucagaguaaucuagauucuuucacuuucuaaugugacuuuaggcaacuuuaccucucaaagccaugguucaaaaugauaaaaugagaaugacuccauacuucuuaggguuacucuaaggagcagaaaggaaauuuguauaaagcacuuagugcagugcacaguacauaguaaaugauuaaguuuuuguuacuguuuuaaaguuauauuucagcugauuauuuuagaaaucacuuuaaaugagaaaaauaaacacaacaaaaaucaucugauaaaaauuggaguaauuacuacugaaauagaggaauaagaauaguaaaagaaaaggugagcauuaacaaaagauaaacucuaccugcauagcgauuuugccugcgauagaaccauauacaagaauaguuuuauguguaccucauuauugucaaagaacaauuauucgucuuccccauguucauacucuuguaaggaucuauuaacuagacaugauacccuuuagaaggauauaaugagauguauuuucuccauguauaagcucccuuuccauaauagcuuugauucauugagaacaugcacugcauugcuguggaauauaauacacuaguaaaacuuuuuucucuaauuacagauggaaaaaacuuucccucugauuuugagauguagcuuuuaaauacuaaaaaccacuaucauaauuuagaugauggcuugauaaccaaaaaaauauuucuucagaugucacaaagagucguuauuguguacaggagaaagggaguuugaagaacauauaauaaauaucaauguauagaaggagaagaggaguaaaacagcauauaaaggagauuauccaccuuagauggcaccuagacucauacucgauuuauccuuauccguuaaccaucucuucaggaagcuuguugugugcuuggcaccuagcacagugccugaauuaaugucgacugaauugaauugaguuacaaucuauagcuccuuguuuuuaauguaauuuucuaauauugauacuauauacuugguaacuacugacauauccuacacugcaaacuuuagccugauaguaccaggucauaaaacauuuuguuuggucuugucauaguucagaucacaugaugcaaacagaagaacaaaaauaauuuuaaaauguguaagaguaaaaggcuuggaagucagcagaaaaccauauuuuauauugaggugccuuuuuaaagaccuuccauacuuuuuucuuccuguucuuaaugaauugcuuaaugaagguauguggagaauuauaaauuaaaagaugaccaacgucauguagcuauuuaguaagcaaacuaaaagaagauuuuauuggcuccuauauauuguuccuuucaugaaaauaaaaaagcaauuggugaauuuuaguuuguaaaaauacauuaguauauuuauagguagauuuauagaaaauuuauaaauagauuaguuuucaauuguaagcuauuucucaguacucauuaucauuuugaauuuuuaagguagaguuucaaaacaguugagggcuuacauucuguauauaugcauuacauucauuacaaacauauauaauaauuuaguuauuuaauugccccguggaauccagugucuagcuaauuuuauuuucuaaaugucaauagcuuauuuauguauaauguauuucuucuuuucuucuuugucucugcucuauuuucuacagcuuuuuucacucuaagucagcgauaauuaaacauuugggggacauauuuauucucaauaaccuuaaugaaacaaugcccuucuaggguuuacugaaugaucacucacacacacgacaaucauguaccucuaaaagcccauuccaugguuucugaauuucagggcuauugauauuucuagccauauaauucuuaguugugggaucuguccuguguguugaugauguuuagcaguauccuuagccucuauccacuugguaucaguagcaccuaccaccuccuugaguuuugaaaaccaaaaaagaaaucuagguauugucaaauguccccagguagacaaaaucacccugaguugagaacuacugagucauagcccaguggcccuugauucauggaacacaaauuaagaauaccggcaugaauggagauuagggaaggauugauaauauuagggaauaucugugauccuuuuggcaauagaucuauugccauccucaacuuaggacacuucacacuucuuaucucaucuuugccauaaaacaaugacuaaaauaaacuuuuuccaaguuagagaaguuuagaugcauuuauuuuucacagaauguucagagauuuaucugggggaagagauucuuaaguauguaauauuuggauuuucauucuuuaugaauuuaagauaucugaucuucacaggguuugauuccaagggaagaaugaucagguaaguaauugauguagccucagauuaugguuaacauuucucaggacugggaagauaaaauaggucacaaaagagacguguaccgccaaagcagugaauaaaaaguaaauacuccgguagagguggucauuaaguuaccuucuccuuuugccccuucacuuuauucauguuggagaaaauuacuaauuauaaaaaggaaauaaauauaaguagaucuuuaaauauauggaggaggggcauuugagacagaggacacacauaucaacauguuacguauguauauuucuauaaaaaucagugaugacaauaauaagcuaccauuuuuuaagugcuuccuauuugcuaagaagaguguaaaucaacucacacauuuuuuucucccucaguucucaucuaaccuuguuagauaagaaauguuaugugcuauucuuuuuuuuuuuuuuuuuuuuuuugagacagagucucgcucugucgcccaggcuggagugcaguggcgggaucucggcucacugcaagcuccgccucccggguucacgccauucuccugccucagccucccaaguagcugggacuacaggcgcccgccacuacgcccggcuaauauuuuguauuuuuaguagagacgggguuucaccguuuuagccgggauggucucaaucuccugaccucgugauccgcccgccucggccucccaaagugcugggauuacaggcgugagccaccgcgcccggccuaugugcuauucuuaacaguuuggccaaagaaaaugcagauuaagaagucaaaccacagaucuuaauuugaguuuaaaugaguguuuguguuacuucuagaaacuauucuguuaaccaugccguuacauggauuuuauaugcacauuccaaguuaaaccacagaucuuaauuuugguuuaaauuaguauuuguguuacuuuagaagcuauucuguuuaccaugucauuacauggauuuuauaugcacauuccauuuuuauuucucauuuaauaaagauucaaauuuauauaguuaagcuguauucucuaauaagguaaacaaaauuugauaacagcaaauagcacuaacauuuuuguuuaugcacagauuauauauucuaguuuuuacauauauuuuagcucauuaauuuucuucuccuucucugaacugcaauaaugaauuacauguuaggaaacaaauuaaguuugauauauauaaaguaaugaacuuacaugguuagggugauuauaauucauaauucaauuuuaauuucaaauguguauuuucuaccaccucaucaauuuaaacuagauaaacuugauacacaaauaaacaaaaagcacaaucuuguuuucuucuguugagaguuggguagaggaaaacgaucuggccagcuggugcauagauacaauuuucaauaaauggcagugaaaacagacuuguuuggaaucuccagcuggaugagcauugugucaacacuuuugugauauuucuugaugauauccuguuagucugaagagcacuuagcagauauuaauuaucaucuggugaacucucuucaguugaaaaggugaaaaucuauucaguaugugcaaugcaugcucaguugucaaccuaaacugcaagcuacuaagacuuaauuuuuggcaaucauguagguguaaaggaaacagaugcuguguauuguucuauaaaguauauguuaccaggcaauuggauuccaauuuuuaauauuuuuauuaaugagugcauuaaauaauuuagcucuauuuguugcugauccuuuuauuguacaauuaccauauaaaacaugacauacaaacuucuagauugggacuucaauaucauuuuaagcuauuauuuaauuuggagcaaauguaauguuuucuacauuuccauguaagcuuuagugguuuaaaauuaagauguauuggcuggccauaguggcucaugccuguaaucccagcacuuugggaggccaaggcguguggaucacgaggucaggagauagagaccauccuggccaacauggugaaaccccgucucuacuaaaauacaaaagaauugcugggugugguggugcaugccuguagucccagcuacccagggaggcugaggcugggaauugcuugaacccgggagggcggagguugcagugagcugagaucaugccacugcacuccagccugggcaaacagagcaagacuccaucucaaaaaaaaaaaaaaaaaaagaaguauuuuugauaaaccauaguaggcauucuuaaauaaguaaaucuuaaguaccacacaagggucagaguauaucaacacccaggaugaaugaagauacuguugugcuuucuugcauucugaauauacauucauucaguaaauaucuauucaacaacuacuauauaccaguugugucaacuaucauuuaguguugcuuggcauaaaauaauagguguucaugaauucugaauuaagauuugugcuauuuauuauuuuuauuucaacuauuuguaaguaaaauaaaauacucugcaguaaaugaaagucuacuaguaauggugugcauaauagauuaacacacaaagagagcauuuaacuuaucuguacuuccuaguaaaaaaugucccuguucacagguucauuuuucauaauacaucaacuucauuucagggcaugcuaauagugaugaaccauaaauagaauugacagacugacuuaaugaaauauugucugagcauuugagaaaauagaaaaucuaauguggauaauggguggaaaacacauaaagaacaaauauauugaaauguagauagacauauauaaauuuuuaauacaucuauugagcuggguguguaaauauucuaaggggguauauaaagaaauaagaacagcuguaagguuucuggaaaaaaaaucagcuauaaauaauaugaaagagacaaguuuuuaaacaaagaauggauauaacuuaucuuggaaguauauggaaagaaaagcauuucauguaaaaugucaacguuguccuggcuauugaaaaauauugaaccauauaauaaauaaaaugcuuuuuuuuuuuuuuuuuuuagacagagucucgcuguguugcccaggcuggagugcaguggcgcuaucucagcucacuucaagcuccuccuccuggguucacaccauucuccugccucagccuccugaguagcugggacuacagacacccaccaccacacccagcuaauuuuuuguauuuuuaguagagaugggguuucaucguguuagucaggauggucacgauauccugaccucgugauccgcccgccucggccuccuaaagugcugggaucacaggcgugagccaccacgccuggccuaauaugcuuuuucuuaauguguacaugaagugggagcgauggugucauuuuugaaagcacaacgaucuuccagaacuuuaacuugacuucaaaggcagcaaagcuucuccuucauuuauugcaucuaggcugcaagcauuuuuagagcaucuucuaaauacauacaguucuacuaggacaaauuguagcagccauaaauacaccuacgaaagauauuaguguacuacauaauaagcacauuacaaagacaauacauaauacuucagacaaguaguacaugugauauagaaacagagaagugugaaauuugaauugggucuuggguuauguauagaauuuggguuaggagguaauguaggccauucuaguuacuguuagaggaugucauccagcucugcuuuggaaaauguauucauugaccuggggaaaaucauuuguaaucacuucacauuuuauuuuauuaccuguaaguuggugggauuuaaaaaauuauaugacuuauuaaguuaaucuugcguuucagcuucaguuagugucuauuuacugauuaucuuuuccuccaacaacacauccaagauccaauuucaguuccuugaaaucuccauuucaauaucauugaugcacuauugcuaaucucuucuaauaucuuguaauucaaauaauauuuuuauugauuucaauuaaaugcauccaucauuggauuaguuuuuccuauacuuuauuucuuauaccuauuugauuagcauugccuuggaaaugucuuguagauuccucauuuucauuucuauugguaacaguauuccagcauuuaucacuuucugcaugaacacuuacuuauuccuagcuuauuuuccuguuucuuucuucauacucucuuuuucugcaguugaauggaaaagacccauaauuggcuauguuccaagauauagcagaaauaauaauauauugaagcaaugaugaguguugauuuauuauuuaaucccucuucaggcuuauugccacuccauaaaaguauugugauucugugauuugaucugaaauucacugucugacuucccugccugagcuucugggcaucuagccuaaugagauggaaagauuuccuagagagucccaaaagcaucuuaaugugaacuuuucaauucuucaacuauuuccaaaagagagagaaugaaaauagaacuauuagagauucuuuguugacaauaggaagagaugacaaaugaggcaauggaacauuauguuguccaguaucuuaaaaaaacccucuguccaucaaaucagugcaaauucugaagccauguuaucaaauaauuugaacaauuucaacaucuucaggucuaaaagagccaaugcacccaacuaaaggaagucuucucagugucuauacuuaucaaacuauuucuugaggcaaaagauccuuuaaaugaaaacagcagcagcaccaacaaaacaaccugcaaauuuauaucucucuuaguaagcaacaucaauucauuuuuccuucgcaauguaauugcuuucuaaacuucgaaaauuucaccuugcccuguucagaggugugaacagaaugauauggagauauauacuauuagauccauaaauuuauauguuaaauaguauaaaucauauacugcuuucagagagucuguacccccaaauggacauggguccuaaugaauuuggaaugcccaagaaacacuacauugaaacuaucuucucucucucuuacucucuccgucucucucucccucauguaaacgugcgcauacaaauauuccucaccuucuuugcaaauguuucuaaaguuaauauauguacuauagaguccacucaaguaauauaacuuaguuguagaggaagagauaucaacaacuguguuacagauauguacuagaauauugagaugugaguuuaucaaaccaaauuugugguuuuaggacuugauaugcuauaguuugaaauauuuuugagcuuugggaggaauuuaacauuaaguccacagaggcauaaaauauuauuucuugaauaaacucccugacuucccuagacaaaccuuuaagaaguaaggcugaaggcugggcgcaauggcucaugccuguaauccuagcacuuugggaggcugagguggguggaucacguuaggucagacguuugagaccagccugacccacauggagaaauccugucucuacucaaaauacaaaauuagccgagcaugguggcacaugccuauaaucccagcuacaucgccccauugcacuccagccuggaaaacaagagcaaaacucugucuaaaaaaagaaaaaaaaaguuagguugcauacauuuucauguaaaaaauucacaaauggaugcuuuaggaagauucaaauaaaauaaauaaaaucugauuaaugaagaaauguacucuuauauagucaauuacuuguaaccaagaugcuaugauagccauacauuaaaaaguaaugugcugaaaguuuucuaaagaaaacugucuucucugaucagugguuuuucugagggaguaaacaaguaaguuuggccaaaaugugcccuguagaacaaauaaaaauugccuugaagaaauaucauaagaaaaauauuuuauuauaaagguauaaugaaaucaaacaaaauaauguguacaaucaguccuuuguggguuccucauuggcaaauucaaccauggauccaaaauaucuggaaaaaaaacaaugauuauguauguacugaguauguacagacuuuuuuccuugccauuauucccuaaacaauacaguauaacaaugauugacauagcauuuacauuggauuagguauuauaagaaaucuagagaugaaguacauggaaggaugaggguagguuauaugcgaauauuaugccguuuuauauaagagacuugagcaucagauuuugcuaucuccaggaguuucugaaacuaaccccguauggauaccgagggaugacauaauuuguguuuguccuuuaugugguuuugaguaagucuguuucugaaauacuuuguaauuauuaucuauuaauguuuauacuaauuuaauuuuuguaauggauaugauucguuggaaaaauaucuacauaauacauuaagcauauuuuguuuaaaguaguuacuucaaaaaucaguguaaaacuacuaaagaaaaauacaugguggauuaacuauauuauaugauaucuuuaaggugcacuacagccuagaaagcuguacuaugucauagucuacuuuuuaucauacacagucacaagagaauuucuaguaaacaggagucaguuucaauaucccauuacucuccccacacauuuucuauuuugccaaaggaucuucacauaggcauaagaaauccucuggugaauucgacuggggguucccuacaagaaaagaauucaugaguucauaaauuuuucagucccuucaguuuaucuggagaguuauggauagcaugcugggcaguaguacauagagcagaucaucuugaaaaauaaugccaucuccauaauggggagguugcuauuucccagugggggugagcuguuuaggcuguauagauacagcccuauugcggauugcugcuggcagggaaaaucacauucuucuugguuuccauauugcuuugaauauauuucaguggcugagauuuuaauuaugucaaaaagagcacauguaaucacccuuaagauauugauaaaaauggacaaagaaaagaauuucacgguuaacuaucauuuucuuauuaaagccccuuuaauguaugaagauauuacaggauucugggauuuuuaaacaauaugcuaugccauguaugcucuauucuuagccacaguggcaaaugaaaguagauugacuuaauuguuuuucauauuucuuuuaaauuccauuauuuacuauuugaaggcaauaacuauuucauuguuuguuccuaguuaaacaaauuagcagcugcauuuacaaacagucauuuuuuuccuaacauauuauaucauaauaugcuuguauauguuaagcuuaaaauaguuuucucugacuagguagggaaaacaguaaugcuagaaagguaaggguaguauauuagucagaguuccccaggggaagagaaucaauugaagauguggguggggcuuggggggugcuguugggaagggagagaagaagugagaacaauuuaaggaauugucuuaugauacugugggacuagagacucaggcuggguuuguauguugcaguauugagaaggauuucuucuucuuugggaaaacucaauaauugcucugauagucuucaauugauggaacuguggaagaggccaaugugaccuacccacauuauacuuuacgcacauuuuauugauuuaaauguuaaucacauccuaaaaguaucuucacagcaaaaucuagacugccuagccaaguuaaaacauaaaacuagccauuccauauagugaaagggagguuuuugucauuacugguacaaauacagagcuaucaaauguugcuugaagaucugaggcauuuguaacaaaaaugagucaugugcaaaauaauaguugcuuuauauucguugagaaagauaucagaauaacuuccuuccaggcaauauguguauuauucccuuuucuuucccuguucuucuuugccgggaacugcaucucuccucccucuuucuccuuucaaaaacucaauccaguuuaaauuucauaacaaaugucaaguuuuauuuaauauucuauucucacauucaucucccuuuuugugaaauccuuuaguaccuauaaucuuggccacauggauaaguauuuaauugucacuugcuuuguuucuuaucuugccuuucauguguuagcaucuaaauuucuuugggucagaagcuugacuucauauuuccucucuagcccauauauauaguuccuugcucauguuaagcucauaauuagcuaccaggaaauauuuguggaauuacuuauuucacaucauauuuuuacauaucuacugaggcugaugagacaaaucauaagaagaauaaacauauuuuagcccaucugugcugcuauaacaaaaauaccgugaacuggguagguuuuaaauagcagaaauuuauuucuaacaguuuuagaagcugagaaguucacuaucaagguuccagcagaucagagugucuagugaugauacauuuucucauucauaauugauaccuucuagcuguguucucacaugguggaagggacaaaggguuucucaugggccuuuuuuuuauaaaggcacugaugucauucaugagggcucugcucccaugacauaauuaccucccaaugguucaacuuccugauacccucacauaggugauggguuucaacauaugaauuuugggggacacaaucauuaagacccuagcaauaugucauauuuaauuugaagauguaaaaaugaauaauggaguagcaaucaagucuaacuuuacagauaauaugguuaaaauuauagaauacaauaaugcauuuaaacucuuguaggguuauguaauaauaauaagugguucaugccuguuaucccagcacuuugggaggucaaggcggguggaucaccugaggucagaaguucaagaccagccuggccaacauggcgaaaccauguuucuacuaaaaauagaaaaauuagccagguguguuggugcucaccuguagucccagcuacuagggaggcugagaacccaggaagcagacguugcagugggccaagauugcaccacuauacugcagccuggcaacagagcgagacucugucuaaaauaauaauaauaauaauaauaauaauaauaauaauaauaaauaaaaauagaagucucaggcugggcgugguggcucacgccuguaaucccagcacuuugagaggcugagauggguggaucaccugaggucaggagaucgggaccagccuggccaacauggcgaaaccccaucuaucuuaaaaauacaaauauuagccaggcguggugacaagcgccaauaauccuagcuacucgggaggcugagggaggagaauugcuugaacccggaaggcggagguugcagugugcugagaucaugccacugcacacuagccuaggggacagagugagacuccaugucaaaaaauaaaugaaauacaagucuuagaugagaaagucaaagacugaguaucuauugguuaauuaguucucuuauugagauauaguuuguauguuuguuccugcccaaaucucauacugaauuauaauccucagugcuggaaguggggcuggugagagguguuugggucaugcaggcggaucccucauggcuuggugcugucuucacagcagugagcaacuucucacaaaagcuagucauuuaagucugugguaccucucccugccgacgcacacucucgcuccugcuuucaccacgugaugcaccugcuacuuuuugccuuccaccaugauuguaagcuucccgaugccuccccagaauccaagcggauguuggcaccaugcuucuuaaaaagccugcagaacugugagccgauuaagccccuccucuuuauaaauuacucagucucagguauuucuuucuagcaacacaagaauggccuaauacagaaaauugguacuguaggugggacaauaauguaaagauaccugaaaacguggaaugggcagagguuggaagaguuuggagggcucagaagaagacaggaagaagggaaaauauggaacuucuuagagacuuguuacaugguuaugaccaaaaugcugauagaaauauggacaugaagaccaagauggugaggucucagaaaugaggaaguuauugggaacuggaguaaaggucauguguguuagccuuagcaaagaacuuggcugcacugugccccugcccuagagaucuguggauguuugaaggucagagugaugauuuaaaguaucuggugaaagaaauuucuagcaguaaaggguuugagaugugacuuggcugcuuccaacaaccuaugcucaaaugcaggagcaaacaagugacuuaaauuuggauuuuguauuuaaacagaaagcaaagcauaaacguuuggaaaauuagcagccuggccacgugucaaggaaagaaaaagcuuucuuuuucuuuaaagaaauuuaaacuggcuuuggagcaaccaccuucagagauauucacauaaccaaaagggagcaaggugugaauaccaaagagaauggggaaaggccucaaaggcauuuuagagaccuuaaugacagccccucucaucacaggcccagaggccuaggaagacagaaugguuuuguaggccagccccaggguccuucugcccuaugcagccuugagacacugcucccuacauccuggcuauucccauucuauccacggcucacagaagcccagguacagcucgggcugcuacuuuggagaaugcaagacauaagccuuggcggcuuccaagugauguuaacccuguaugugugcagaauguaagaauuaagaacacuuggcagccucugccuagauuucagaggauauaugagaaagccuguuuguccagaaagaagccuuuguaagggcagagcccucauagauggcugcguacuagggcagugccaaggggaaaugggagguuggagcucccacacagaguccccagugggccacuaccuaguggagcuguaggaaugggacugcugcccucccaauugcagaauuguagagccaucagcagcuugcaagacuuauugcaauaagauacucuuaagucauuuggaaauguauuccuauauaaaaaaggcaauggcaaauagauguuaaaaguucugaagugaaagaugaucaacauauuucuuaagguggucaaaguuuacagagaagaaaaugcuuaagcugauuuuuaaaugggcuaucuuuaggcaggcuaaaggacaaggaauucuaaaguggaugcauggcauggaggcauaaaaacuagcaugauuuggagugaauuaaauuugcuacauuauuguuagagcacagugcauagaggaggcaaaucaggagguaaggauugaaaacuagacacgauguuaucauaaaaggauguuuaagauucauuuauacaauacaaugggaauacaauauaaauggcgauaauuuggauuuuauuuuguuggcuggcuguaaauuguuucaaccaucuagucaggaaagugauggaaagagagagaaaaagacuggaaguaaaauuauuaguuuagguuauugcaagcaggcaaugaacagauaaaaugccuuuuguuuuuuugaaugggaugaaaacuuucugcaguaagguaacuguaauucaacucauucuaacaauggaacucaaaaaauucaagagaagacaaauacugguaagaauauuaguagaguauuaaauaauuaauauuuagauauuuuuuaaauguuguauuuaauucacauggccuauugaauuaucugcacuuaggaguuaguugucacauacaguuuuaugucauuaaauuuuugaaacuuuuguuaagaguacuagauugcaaaacaauuuuugaagcauguauuagaagugugaaauauguaguugguuuuggauuaauggaauauuuacuuaguaauuucauugaaauaaaucauuauuauauuucauuacuguuuauggaaagaauuuuaugcaaaguugaaauguuucucucauuuaaauacauuucucuuauguuuaaaauuaguguuugaaucuucuaaaugaauagccaaacauuuuuauuuucuuacagccaaaaauauuauucuucuauauuaguuugaaaugaugugauuuaaaaguugaugccuaguugagaauuugcaaaauauaucugaauuauuaaaacaugaguugaugccauaguaucuuaacguguacugcaugcuuucaggaaucacuaauugugcccugaccaugccacugacucagaaguugaauagaauaugcaaguggaagaaacucuuccugaggguacuuagacuacuucaauagaaauaguauuauaaaucuuuuggaccuauacauuucuuuaauugauauuaguugacauacugaauaaauuauuuaaaauuuagucuaauaaugucucaaccaauuacauuuuguugggcuaaaugaucaguccagcauggaaaugcucacaacauguagccaguccucauucuuuguagguuucauauuggugaagucacuauaauuuuuugugaucacccaaaucuguaucucugacaauuucauggaaauauaaagagcagcaaaaauuuuacguugaccaauacgguuguccugucuuaggucaaaaaaggcaaugcucucucuucuuguuucaacucucguacuauaaauacaugcucuuuacggucuaacuagugcuauguuuuuguauuuuugugcuuuucgucggugauuucacuauuuacaauggccccaaacauuauacagaagcacuaugugguguuccucagaacaaaaaggcuuugauguaucuuaacagagaaaaugcauguguuagauaagcuuuaggccugaguuguagugcuguugaccauuacuuucaauguuaaugaacaauucgauauauuaaauaagauaucuuuaaauagaaagacauauagaauaauguuauauauuuauugauugacaaauaugugaccagagacucauaggagccuaacaggagauacaggacucuaacucuauaugucccccggggaacaaugguguaguauucacugaugcaguguugcagugacuucauagagcauaacuaccacaaauaauaagaauugacuguauuuacaauuaccaaaugggagucuugguaauacgaaauaaaagaugcauaaacaauauguauauauguguguguuuacauacauauauacauguuuuucaacauuugcauacacuuacauauauguguauauguguauguaaacauacauauguauguacauauugaaaaacauguaugaguuaauauuguuggguagaaauauccugaauuauguaccauccuguauagauaggaaagauuuacaaaaucuaacagaucuaacauuucuuaauuucuucgauaguugaccuuaaauaaguuauuuaagagacgaaaauuccaaaagguguauaucuuacaauuaauaaauaaaaagcuaaggcauuaauagcagccuagauccaguaauacuuuuuuaugauggaauauaugaaaucacauguauacugaaagauguucucuaccauauaucgucaaaacagaacaaaagaagaaugcugaauaaaauaaauaaauaaugaggcagaauuaacuguggaucaggaacuaaauacgguguacuagaaaaucagauuaagaugcuauacuuagauaaaccugaaaggauaaaucuagcuuucucuauaaaucaccuauuaaccuaaaacaaaaauaauuuaauuuucauguuuaaauuuaagaccuugaucaaguauauucuaauagcagauugcuauguaucaaaaccucaugccauaaagaaauuaauauacuuauuuuuagaaauaauuugaagugucauaaaacaggcacuauagguaaugcauaugaggcucuuaaugcauauaaucagguaaugagaguuaauaauuauaguugauauaauccagcaaauguauucacaucacagacuuugguuuuauaauuuguuauaauuguaaucaauuuguaguuuuuguuuuuucacucauuauagggaaaaaacuuuauuaaugaacuuaaauauacucaauaucaagacugguuggacaggagcacagaaaugugacugugacagacucugcugcaaaguccagugguaaaaacagacauauaaaucauucuuuuuauuuccaacuuuuauuuuagauucaagggguacaugugcagauuugucacauggguaaauugcgugucacaggggauaaaccauucuuaaaauuccugauuauguacuauuuaauccucaaaacaaaccuaugagauagauaacgauuuuugcuucucauuuauacagaagaggaaauugaagauuauuuauccuccuaccuaagaggcuuauccuucuaaggaacugaaguagcccuuuuaaguuuaguauuuguaugaacacauucagugauuuuaauugagaugagaaguguaccuucaugguguacaaauaauuauuuaaaagaguuguaugacuuacccucauuaauacaauugaauuauuaaauauuuacucuaaauauuaugaagaccauaauuaaaaagauuuagaacauguuauuaaaauauuuuaaguuaaauaaauaauacagaaaugauagcagauuuuauuuacuuuuuauuauucugucuucaaugaauguaucuguuauaaagacauaauaugaguacaauuaauauuacuuuuauuaaacauauuacaugauuuccaaauaugaaauuaauaaaaagcaaguuuuucccucuucucugcaccuauaacacuaugcuauagugcagggccgacucaacaaugagacaacucaaaucucagcuuucucauuuauuaauuagugacuuugcauaauaugauuaagccaucuguacuuugauuuacucaucagacaaaugaaaauuauaauaaaguaguacauagcuuuguggugggauuaaauuaaagaacacauguaaagaacuaagucucuggcacauaagugccugauaaauguuagcaauuauuauuaauauaaguauacuuuauauauaauaucaugaguaaauuauugguuuauaguaacagaauuuguuaaaccccucagauguucacuaaaccucuguuaaaugaauaaaugaaugaaagcucuuaucuagcauagggaccuaaaaucagucaagagauauuuauugagucgcuaugcauaacugaggccugaaaauagcucagugaacaggguagauauggucucugccauuuaaauaugaguacuaaaauucuauuaaugaaaauaaaaugaaauauacacagacacacacauauacaugcaaaaauuacauuuaugugacuuaauaaauuuuuuauagcuuaauuuuuucucauuacaggucaaauuuuuagcaucccaacucauuauacugccaaaucaaaguguagaaguuguuuucagagcaaugauauucaagaggauaauaauuuaauuuguaauucacuuugaaaaauaugaaugcaacauaacaagaauaauaauuuagcaucaaggauauucuaugauaaugacaccauaauuucaccauuaauguauuugucaucaccuccuuauuaauaguuuguguuagaaaaacacauaauuauuguuuccauccuucuuugucuuuugggaaaggaaagcagauacagguuucaaacuguaggguaugguaaacacucauucacccauuucacagaucguuuaaguaauuuucacuagauagacuuaucuugcagguuuagaaguuauuauacuggcuauucauuaguuaauucaacaguuauauacaaguauuaauauaaaaucuaaaauuauguuacaucuguguuguuacuuuuuuuuccaguuuaugaugaaagugauuuguaauuugggugauuucuagguaacugcucagaaaaaaaaaagaaguugaaggaauauauaccuggaauauauaauaucacugcacuucuucaugugaucaugcaacuauuguuugcugauugucuaaccaaaggaugguuucagggucuuucgcaacacaacaccuaggcagacucuagccauuagucacaguuacuguguaagaauaaaaggauuuguggacucuguugcauacuuuuuacaaaacaugaguaguuaguuuaugguacuaacauuaccauuuucuuuugaccauuagaggucauugaccauuuucuuuugaccucuaauggucaaaagaaaaaaacaaagcccuuucuaaaguucucacagagaauuaacuaauuaaaaccauguuagcaacuauaguggacagggaauaucagguauccacaaaucuggacccuucugaauauuugcuauuuaaauuuaaugaauucacuuaaucucugggacugcuuuuuugucucucaaaacaaauaagagaaguucuuauuuccaaagcuguauucauaaugauuccuuaaauguagcaauaaauuauuaucuaacuuccaaauaaaacuacaaggagacuucagaaauaccauugaaaaaugacauuagcgauaaaaauuaaaauacaaacuugucaacauaagcuccaucaaguuaaaccacuuuuguaaacaaugauaccagccauuuaguccaucucuaaagaacugagcauccugggacuuuaauccugucaaugcaguuuuuuuaucuaauuuuauuuuuacauuauuaacugaagaaaagcaggugucuuuuaaagacuguuuaaaguuaggaaacaauaagaaaucagaaggaggcuaaucaguacuauaagauuaauaccuacagauuuaucaucaaaacucacacaguugcccuuguuuaaugagaauaaugaucaggagcauggucauguuggaaaagaacucucuggugaagccaucccaggaguuuuucuacaaaagcuuuggcuaacuuucucaaaaccaaacagauguuaccauuuuuuggcccuuugaaauaucaacaggcaaaacacuugagcaucucaaaacacuguugucaugaucauugcucuugacugguccaguuugcuuugauugggccacuuccaccucuugguagccauuguuuugauugugcuuugucuuuagggucauacugguguagccaaguuuuaucuccuguuacaauucuuugaagaaaugcuugggaucuuguuuaaaauuuucauugagaucucugcucuugucuguagcugaucuggaugcaguaguuuuggcacccauuaaaugggaaguuugcuuauuuaacuuuucagucaaaacucugaaagcugaaccauuugagaugucuaagguguuagcuauuguuuaugcuguuaaucuuugguccucuuuaauuagggcacaaacuagauacuuucuuuucauugcaaauugauguggauggucugcuguuauggacuucaucuucaacauugucucaucccuucuuaacccaaguuguuuaucuguaaacugcugauuucuuuggauaauuuugcccauaaacauuuuuuaagcauuagcgaugucaccauuauuccacucaauuuuaauguuuguucuugcuucaaguuuagcagaauucauguugccaugagaggggcucuuuucaaggugaagucuuaaccuucuuacugccucacacuagaccuuguucagaguaugauuacuuuggugcaaaaauuuuggggguuuuguguaguuuuuucauaauacacauuuuccaugaccuuuuugaggacacuuuguaccauuucauagaauauuucucauauuaaaaucaauuuuuaaauaaaaucaucggaguucaauuuucauuucaauucuuuuaauacaguauuuaugugcagaaggagucagauuuuucucauucaauuuuuuuuggaaguuuuacugaaugaaaaguaaauucuaauuccuuucuaguauuccuucuagaaggcacaaaaugauggaaagcuguuaggcaauuuucagguaaauacuauccuuaauuuaaaugguuuauccuguaauauauuuuuuaucguuauauugagaaacuuugcaauuuucuugaaaugaaaauuuuguaguuucacuucaaauugcauuuuuagauuucaguuucagaauauuaugucacuaccccaaacaauaaauauucugugagcaacaaaacuaaguagcauuaaacaaaugauuaauaaaucauucuguugaaauacuuaaaacacuguuuauauuauuuuuauguauucaaacaaaacaaguaaaauacaaacaaaaucagcacagugguuguuugaagaaauaauuuuaggaaaaauaucaacuaaacagaauuugaugauuaauugaagauuaugucuuguuuuccugacgcagagaguugauugccuuuauuugcaguuugauauacuuagggauaaagcaucuuugaucaugaaaaaauacaaaaauuucagaagucuauucuccuuauaucaaaacuguaguuucuguuucaaaaaguggcugguugacauuggcaucuuugaauuuauuguuuuuauuuuuuucuuauuugaaaaaugggacaauuauucuugaauggaccacuucuuugacccaaaagucaugugaaguaagauaucucucaauaguuuggaagaccaugaguguagaaugugacacccaugaaaaaugcucaggaaggaaaaauacaaugaagacucucagaaaaagcaucuuauugugaugugucuuuuauuccauaaguaugauccccgguucccugguaugaggcacauugaaaguucuucugugccacagcuuugauauuguccaauuuugguacuuuaaauuccucuucuaugccuucuuugcauuuucuguaguuuugggaaaccaaguaucuuucugaacugcacuagcaugaagcuuuuuaggaagagugggaggagaagcccaugagugauuauuccaguugaaauacaauaggguuauauaauagaauugcacaaaggaaagaggacaguaggauccaaggauuucuaucacaagucaccuugcuagauuuccagugccagguugaaggugccucaggaggaugguacucacauuucugagucaaguacugcauucagucaaggagguuugaauuaaugacuauuagagcagugggcugucauuaaggucccugaaaccuaauggccuuguagggacugugucuuuuaaaaaaaaugucauaagccuaacacauugaagguaauaaguaaauauuuccugaaucaauucgauauacauguuuuauauaguuuacagaauacacuguaaaauuaaggaagauuuuaaacuuuacauguauuuuaauuauuaccauuauucaaucauauuuuauuuauuuauauuccuaucucuccuucuagaaacugagauucuucagggcagggcuugguauuguuaacacucaucacagugccaagggaaucauuauuguuugauaaaggaggaaagaggaagauacaagaaaauccccauaguguucuuacuggauggguuguauaguaaagguagggauuuuauauuugucauagaaauugaugaaaguuaaucaauuacagauuaucagacauuuaaaucacauaaaaacuuauguaguaagacaagaaaugaaauaugguuuucaaggugggagggaaagaaagaaguagggagaacaauauuuagugaaaacccacuaugcaccuccugcuguauugcaacuuugcuaaguuaucucauuuaauguucacaaaaacccugcauaaggcuguuauuaacucaauuguacauaugcauuauuugugauguaacuugucuaaggccaugugacuaguuuaugucaaaacuaaaaugagagcacaguucuguaggccuccaaaauuuuucuauaccacccagcuucccuaauaaaauauucugcaaagaaagggucuaauaaaagaaaaucacagacauuuuguuauccaacuuuuaguuauuggaaacugaguuacagaugccucucauuuuauaaugcucuggaauaugugcacaucaaauuuauuucauccaguugacauuuaauuuuugauauuuaauuggcuaugaucugaauauuuguguccuguccaaaauucuuauguugaaaucuuaagccugaaggugacgguaguagaagguggagcauuuugggagaaguaauggccuacgaacuaggaaacaaacccccaaccaaacaacaaaucuguuggugccuuuauguuggacuucucaggcuccagaacugugagaaauaaguguuuuuauaagcuacccaguuuaugguguuugagguuuuguauuauugacuaagacaauuaguuuugauuuaaaauauaugauucucugguuuaagaauccuaucagguuccugcuaaucuauaaaugaacuucaaauguaguaggguacuccacuauuuuaagaaaguaaauuauuaaauuacacuugcuuuguaugauuuguaauucugggauauaccucuaauaggccucuaguaaaccuauauggugauaggaacuuuucucuacuuuaaccuuuagaauuugugaacauauuuuuaaaaauucuugaaagauaauauguuaaauaauaaauaaaauuccgauaauuaaggcagacauuuuucacuuuuuaauuaaacucaagaauguauuuuuuauuugaaaaaucagcauaguauugaaaauguuuucuaacuauccucaauaauacaaaauggaauuaacgcaaaauauuuuaacccugguuuagaauccuagcacacacagucacuugacucuuaacagcucuaucugccuaacagaaaucucuauagauuauuuuauauaucuaaacuaaaauuuuacuguaaacuacaggaaaaaugaauuauaucaucaaaaacagccaagacaacuaaagugauuuguucagacauucaaguauuucaauaaaagagaccccaaauauaaagguguuaaugcccuuuauuccaguuauuccucuuuuacagaauggaaaguaccuuuacaauaagaaauagcccacaacuaguaggcaauacugaaaugauaaaaauaauaauuuacacaugauugagucacaaaggaggaccaacuauuguuuauuuccaaugaugaacuagacauuaguacaggcacuucaaaauuguuucgauucaaaguuuucacauuuggcuuuuugcauuuuuuucuucuucuucuuuuuuuuauuauacuuuaaguucugggauacaugugcagaacgcgcagguuuguuacacagguguacaagugccaugugguuugcugcaccuaucaacuuguuaucuacauuagguauuucuccuaaagguaucccuccucuaucuccccaccccucaaaaguccccagugugugauguuccccucccuguguccauguguucucauuguucaaaucccacuaaugagugagaauaugugguguuugguuuucuguuccuauguuaguuugcugagaaggaugguuuccagcuucauccauguuccugcaaauggcaugaacucauccuuuuuauggcugcauaguauuccaugguguauaugugccacauuuucuuuacccagucuaucauugaugggcauuuggguugguuccaugucuuugcuauugugaacagugcugcaauaaacauacauuugcaugugccuuuauaguagaaugauuuauaauccuuugggcuuuuugaguuuuacuaccucacuuuaaaaaauucacuuucauaaauacauuuugcuuaagauuauguugguuuacauucucuuaaaaucguaugccuugcuaacaacccuaauuuuuugauaauucuccaaauucuuaacuguuucaaauguuacaucucaacacacaauuuaaaucauguuacuuccugcacaagacccuagaauggcuuccuauuaacaauaaaauuaguaguggacacuuuagaacucacuuuuuucacuuuucccauuguucuuuauuaagucaauucuauuuucaauaaguacuuuuccuuacuauuuuaaauaacauguuuccuccuuccagauuuuacucauuuuuguuucuucuuacugaaaauuuuagaauuguuuuacacauuguuuauauuuccuauuuuacaaaauacuuuuacaaguaugauuuaauuucauauccccuugcuacccucaaguucauccuguauucuacuuaccuggauuugagaaugcaaaucuuuccgcccuuuuccccauucgaaaacuaucagugaauuuccauugccugauuucuuacugugaaguuucaaaguucuaccacaauuucccucaaaaugccccuccagguuaaucuucacccaccacucuucacaagcgcucuguguuguaaccacauuauauguuauucuaucccaaggacgucugugcuuuccugacgcuugcacguuaacucacaaucuucugucuucugaaauuugcggugauaccuuucucccacuauuuauuuuccauguucuuucauauucaacauguuguuuuaggccaagaggaaacucacccuccuuuauaaaacuuuuccugcauaguaucucccaugguguauauauaacauauuuucuuuauccagucugucauuauugggcagguuaauuccaugucuuugcuaauuuaaauaguguugcagugaacauacacauacaugugucuucauaauagacugaauuauauuccuuuggguauauacccaguaaugggauuucugauuuuaaguaucugaggaauugccacucugucuuccacaaugguugaacuaauuuaaacucccacuaauaguguauaaguuuuccuuuuucuauacaaccugaccagcaucuauuuuuuugacuuuuuaguaauaaccauucugaugggugugagaugguaucucauugugguuuugguuugcauuucucuaaugaucgguaauauugaucuuuuauuaauaugauaguuggccagaugugugucuuauuuugaaaaguaucuguucauguccuuugccuuugcccaguuuuuagugggguuguuuguuuuuuucuugucaauuuguuuaaguuccuuauagauacuggauauuagaccuuugucagaugcauagcuugcaaaaauuuucucccaucuguaaguuggcgguucacuuuguugauaguuuucuuugcuguaaagaagcuccuugguuuaauuaggucccagaucccauuucuaaauuuuugauauuguugcaauugcuuuuggcaucugcucaugaaauuuuugccaguucacguguccagaauggaauacuauauagccauaaaaaagaacaagacuauauccuuugcaggaacauggauggagccagagaccauuaucuuuagcaaacuaacacaggaacagaaaaccaaauaccccauguucucgcuuacuagugggagcuaaaugaugagaauacaugaacgcauggaggagaacaacacacacuggugucuaucagaguguggagguugaaaggugagagaggaucaggaaaaauaacuaauggguacuaggcuuaauaccuggguaagcgaauacuuuguauaacaaacccccaugacacaaguuuaccuaugcaacaaaccugcacauguaccccugaacuuaaaauaaaagauaauuuuuuuuaagguaaaaaaauaacagcuuuuggggaagcuguggcuacagagaaaagggaaagcuuauacacaguuggugggaauguaaauuaguucagccacuuuggcaggcaguuuggagauuucucaaaccacuaaaaccagaaauaccauuuagcccagcaauacuauuacuggguauauacccaaagggaacuaaaucauucuaccaaaaagacacucacauuuauauggucauugaagugcuauuuacaauagcaaagacacaaaaucaaccuaggugcucaucaauaauggauuggauauagaaaaugugguauguauacauccuagaauacuauguagccaugaaaagaaugaaaucuuguccuucgcagcaacauacuugcagcuggaggccauuauccuaaaugaacuaaagcagaaacagaaaacuaaauaccacauuuuuuuacuuauaagcaugagguaaguguuggguacacauagcauaaagacaggaacaauagacacuggggacuccagaaggauggagggagagaaggacagggcugaaaaacuuccuauuguguacuaugcucacuaccugauugacaguaucauucacacccaaaaccucaguguuaugcaauauaaccuugaaacaaaccugcauaugcacccuguuaaucuaaaauaaaaguuguaauuauaaaauuuaaaaaauuaauaaaguuucccugguaagggcagccauaguggauugcuacucccuacucaagacugucuuagcuuuuauguauuguucuuaacaggaaccacaccuugauauauagguguguauguguguuuucuuauuguguguuuucauuuccuuggguauagaagcuguauuaccuuucucuguauuucaguguauuuacauuuuucuguauguagucagauuauaagugcuugcuaaaauugagugaaaaaauaggacagagguaucuuuacccaauaacugucuggauugugagaugaaaauacagcucucuagccaguuggcuauuuuucaagacuuuacuguguacaucuuuccguuuacuuucaucuuccuaccguuuuagaugucucauguccuucuguuguuuucucuagaggacaaaaaagaggcucugaggagguuacauaauuaacucaaacuuaugugguaacaauaaaauucuuggaaauacaaggauggcuaaugaccuauauuguuuuaaucaccuauuuucucuauaauuauccucugcccaaggcaacagaauggagugcauuuuacccguccuuccagauaaacaaaaaaacacuugauaaaagugaaaaaaagggcccuaugauacaauuaaaaugauugcuauuacacuaaaagaaaaaaaauauugcuuaaccugucacaacauaguuuuuuuagcauuguuuaucaaggccagacuauagcaaguuauguccaugguaauaguugcuaacuuggcucauucugcuaccugaggauauuuuucuaucuaaccucuuuaaggaaggagaauauacuaacuuaaauggauuaaaauguagcauauacuugguuuguaugcuugauuguaaauuaacuuaccagucaaagcugcugcugcuuuuuuuuuuuugacagaaucuggcucugucacccaggcuggagucaguggugugaucucagcucacugcaaccuccgccucccggguucaagugauucuccugccuuagccuuccgaguagcugggauuacaggcacgcaccaccacgcccagauaauuuuuuuuguauuuuugguagagaugggguuucaccauaucggccaagcuggucucgaauuccugaccuugugauccgcccgccucagccucccaaagugcugggauuacauuugugagcuacugugcccggccccaaagcuucuuaaaauaaagauuccaaggcuacucuaagaaauccuaauucaguagcugugaguugaauuuuuaaaaauguccccauaugagcuaaaugcaggcaauuuguaaaccaauauguuguauauuuccucugcaucuauaugaguaagacuguauauuggcgaauuuucugaagaccuuaccaaauuuaugcuaaaagcaaaaccaaaaucuuacuuucuuugugaagcucuacccuauucauuucuucauuucuucuauuugccauuuuucccaaaaguaaaauuaacuaauuauguaagcaccaucuacacucggaaaaucaugugauaauguaacauggcuccuguuuucaaguuauuugcaguauagagaaccucacaaauuaaugaacaaaauuauuauaaagguguauauucuggaauggaucauuacaaagucauuggggaaaaauaaugauaaauuaaucacaugucaacguggguuagauaaaucaugacaucaauaauuauaagaaaauuaauaucaaacacauaauacuauaguuguaaguacacuucuuacauuaacuuaucuaauauucagagcaauucugagauagguacuaucauuguccccauguaaauaugaggaaucugauacaaaacaaugucacuuacuugucccagaucaugguucuugaaugguggaguaagguucauauccaggcauucuugauucagaguuuguccucuuaaucaaaauaauuaauagaggaggcaacuuuuaaaagguuguaaagaggaggaaaaaucauuucacagaaugaaaaaagacaaauggagaggcaaguguuguggcaaagaagcuauggaagcuguugacagcaaucuucaggagucagucugaaggaguugaugugaaacgaguaaaaguacagugacaaucuaucacuuucuuccaucugccuacuuucucauguugcuucucuagccaacaacuuucaugcauucauuuaucaugcacuugccauguuaaucuaggcaggacaugaaucauugauguggacacuccuggacaccuuuggaguccuuccaugaccuuuagaaaucacauaaaaguuuuuagaaauacugaugauuguuagaaaagugcacaucuuuuuugaagagcuuaguaauauauauuugugaaugacucaguguugacuuaaaaugccauguugaaucaugaauggcaggauguaguuccagaaucaguauuauuucauauaauuuauuauuugggaggcuaaaacaagagcgugcuuauuaaguuuugguugacaggauguuggacaugguugguagaauuuuggauauaauaggauuagaauucaaauuaacuuugacaaaucagagaaauauucagauuuauauuagcugcauaagaccaauucagaguguacuuugguuauaagagaaauuaaaagauggaaaguugcuggcuaagugcaguauuugagaaggacauuugagauccaaggacuagcuaaagggcauagugcuuucuuuauauucauucagcaaagucuaguuuucuguuuguaaugaggaacagcauaauuugauuuacauuuuggaggacuugugaaaugaauuugaaaccuguccagguuuaucuuauaucaguaaaucaguuucuagcaacaaagcuguaaaaauaacuuuauagauuccauuuguacuaaucagcacaacuuuuucaaaaguuagauauuaguugaaaauaauuuuauaaucaauuauuauauuagaccaaagauaauuuuucuaucuaaccuucuuuuuaaggaaggagaauguacuaacuuaaguggauuaaaauguagcauguacuuggugaauuuagaauuugugagggagauagguaacuccauucugaaggagcagcauuuaacuuuuggcaugaacuuuggacugcuugcuugcuagaauuacauuggcagaugauucaugugauauuuccagcaguagaaucugcaaaguauccuacccaaugugguugccuaaacaguuaaauccugugcaaucagagaacucccacugaaccagugauuaucuguaugauauauucuaauguacugagcaacuguguaaagaucauguggauugauuguucauuuuacuaacuucuuaaagggauugaguggaaaaauuauacauugcacuguucauuguacuaacucugcuuuuugauaaaagcagaauguggaauuuagaaauguaauuuuaauuacuuguuggaacagauuuucuuauuaggagagaacaccuuugaaaucagagagugaaucuaauucucuaaaaaaguuuaauuuuacagacuuuuggaaauauauuggaaacuuuguucauuagaucucuuuauaaaucaacuuaccaaaaaaagaaaacagaauagaaagauauauugauuaccauaagcaugacacucaaggacuuaacaauuauuuuaaguauauuuuccagauuauaaucuggaaaauuauauauuauauauauugccaagacuugaaugcuguuuuugcaauaaaaauuuaaaacauaauguauaaauauuuaaauuagauuaacuuuagaaaauuuugaauuuuauuauauaauuauuauuuaaaaauuuaaaugauagaaugugcuauugauaccuaaaauaucauuuaaaaucaaaauauuauauuuuauuacauucuaucuuaaauauuauauuauauuuuaauauaauauaauuuguacuuaucuguguguaauuacauuacuguaaaccaaaaaugucaauuagagguaauauauggauuccaggaucaaccuaaucauuguaguagaaugugauguuacuauuugugucaagacuccauagacuuguuuacaaauggaguugggaaacuaauuuuaguaaugguuucuaauacuguaaaauugaugauuuaguaaccuacauauaacggaaugccagcuccaacauuuuuucauccaauuuggaauuuaauuuuacugaaugccugcauugugacuugugagagagagaggcauggaacaggauggauuaaagcuaaauaauacucagacccuucuuugacauuuuuaaaaauucugguaguagagaugguuauuaguaacauagugauagcaguauuccuaggaaaaugaauuuuugucaugauucucuugcucuauuuuccauugcucuaauucugaccucccuccuuaagaagcuaaauuguaagaagcaaaacuuuguauuaaaaugccacagaauuagacuauuuaacuuucauuuuccucaaagaaguacagcugaaugaaaacaugagcacauuaccauucaaaagucccuggucaucuuuuggucuauagauguauccauacuuccuuuugauguaucagagagcuccaggccacuuaguauaucuuacuuaggucauaauaaaagcuaccauucuuugugccaaaaucuguacugauuaggguucuccauagaaacagaaccaauaggagauauaugugaagagauuuauuaugaggaaauugacucauucaguuauugggccugagaagucccacaauccaccuucuguuagcuggaaacacaggaaagcuaguggugugauugcaguuugaggcugaaggugugaaaaccaggggagauaaugguguaacucucaguccaaggcagaaaaagacugaugauccagcucaagcagguaugcgggaagcaaaaggaacucauugcuccuuccuccaacuuuuguucucuuaaggcccucaaacagaugggcugaugcccacccauguugggaaugucaaacuguuuuuccgaguccaccaauuuaaaugcauaccuuguccagaaacacucucacaaacacacccagaaauaaugcuuuaucugggcacccuguggcaaagucaaguugacacagaaaauucaccauuacauggaggcucagcgggaggcuuuccuaauaguagccuguauuuaaagaucucucugugugcaaggcaucuuucuaagggcauuucauauauuaacucauuaauaccaauaacguuauuagucaggugcuauuauugcuuuauuaugaugaggaaacugagcagagaagguaaguaacuugcccagggaaacaccauaauagaagaaggcaguguucuauuucaggcagucuggcuccaguguuugaaauauuacucacuugcgcucuggguaacacuagcugaaauuccagaaccgcauucugugaaauucaaagcugucucuaauacuuuaugaauugccaaucaugcuuuuuuuauggucaucuugacuccuuugcaaacaugcaaucacuuauguauaccauaucaaaccagugucuuuucguugguuuucagaagggaaaaacccugcuuuacaaaaaaguuucuauauaugguaaaggaagagucuaagcuuaguaaaagccaaacacuuccaaugaaauauaaacauucccauucucagauuuuuuaaacucucuuacuccugguaauauucagcccuguuccuccucaccgucugcuguuuuuuaucauccugauuuucucaguucuucccucuuugaggcaaaaugguucccccugcuucucuugcaaagcaguuuuucuucauggaucauucuugcuuuuagaucacaucuuuugucucaguccaccuacucuuaaaguauuuucccaggcaagcacuucccacccuagaggacucuaggaauagcagccaggaugauacaauuuuaaacuccuuucccuaccgccuauuugaugcucauuauuuaugaggcauuauguuucauaacauuacuuuuaauucucaugacuuucccaugagguagauuuuuaucauuaccauuuuagagaugaggaaacugaguuccaagaaaauuaacucauuuuuuguggauucaaagacauuaaaugcaagagagcacaucccagcucugauuccaaaguccauauuuuuccaauggcacuuucucauuuagauuguggauauucuuaaauucauuauuuaaacauaguauuugaugauuaaauguuuugcauguauauagguuccauuuuguucugaaagagaucagcuugguagcuaugcugugaaaauggaauggauggucauuuuuccuacucuaauaugacaauaauugaacuaucacauuucuuaguaccauuuuuaaaguugcagaauagaaguguaauggaaagaagaauguuuugcuuuguuuccuaugaagcucagaaaaauaaaaguaaauauacguauaaaaauaauuuguuuucugaaucacuuuucugaguuucaaaaaagcauuauggaugggaauaccauuuuuaucaaugaauaauauuugaggaacauacugggaauauacugguaaauauuuacuucugauagcuguaagugaugguuaucaccaauggccgaaucaaauuuuuaauguaacuugcaaauuuugaauguacauauuuauacaugaagucaaauguaaguucuccuuggacaguuaggaauugaaggcuauaauauuugccauugagaagauaauuauuuucucaauauucucuagaaauuugauaaagucaauacccugugacacugaugauucagaaaguagguauauguccucuauaagguacuggcuuugaaaacaaagauggcacacauaugucauuuguaaaacguaacuuuugaauaagauuucuaauugaucucacacucauauaggcauugauucuugauauucuuacauuuuaaaagaccuguguuauuaaaguaacauuguguaauaugauuaugacuucccuuuucuauaaauaaauuuccucuuuaacaauaagaaauccagacuguguaauuuuauuuuagcaauauagguaauacauguuuccaaaaaguuuagaucuugauuaagccaguagauuuuuugaagauaauguuauuauuucacuuccacccuaacaauauauauggcuauuucgauuacagugcauuuaaaccauaaauuuauuuauuucugaacuucaucuucugaaguuuuuugucuacgacauacuuuuuccugcuaaguuaccuccuaauaacuuauauuuacauaguaauguaccccauuagucuucaaaaacauuaucuucaaaaauaauaaaaaaucaauucacuuucaucaaaagugacagauuuguaccaaacguaauugugauucuugugaauaauaguagucuuaccuaaaguaguuuaauuugauuucucuuucugucuuacaugaagcuaauuuagaaaugaucacuuccaaaaauaaauaaaaauuauuuaucaggauagauuaucuauuaaaauuuaguucagguaucaguuaaaaauguacuaaaugcccauuaaugauguugaauauaugccuaauauacauauucaugaauaggaucuauuuagaauagucucaguuauuuaaauauauauuuuucuuaguauuagcccuauauuaauggcacaauuaugaaugcuagaagaauuuugguaaguauuuauaaagucaauacuucauaaaaucauuauuccuuuuaaauacauugaaaaauaauuuuuauguaaaauaugaauauuaagauauuuuauaauacaaaacucauauuuaaagaaaauaaaaguuuguuuuauauuuuaguuuuugacaauaacuaacuuuauuauaaaagauauaccaugaucuuaccucauuuaauucaaaucugaugagaaaugaaggauauuguuauguggguaauaauuuacagauacucaaaucaggaggacuuguauucaaauaaaauugucauuuuuuuacucacuaggauaaguuacuucucugauucucugggcuauaugauauagauucuggucugaaggccucagcuacauguguuggaaaaaaaacaugggcauucacugauuccauuaaugucuguuagauuccugaggucuaaugaagacagaaggagcaaaaagacucagauuugcaaucaguucucccuugguguucagaugucuucauucacuuccuuauucaagacuauuaggaaaguccaaaauacauugaaaugcauaguuuguaaagccauugaaauaacuauaaccuauaacauaauucaugauguuaauuaaauuaauaauuauaagaauuaugcguaucuuugcauaaugcaguuugcuuaacuaaucuuguauuacacuagcuuaaaccuagaaacaaacugacuauagaucaggcaaaaaaauucaaguauauuuugaauaaacuagugaguuucucaguuuuacuccaaaauuggagguaguauuguuuuguggcuaauaacaugacgucauuuaaaaaaaaaaguuaaagaaaagcuacuuuuuaaaauccagacucugcaauacucuaccugaguaaccuuggguaagaugcaaguuaguuauuuaagcuuggccaugcauuccgacaugcaagcuuacaaugaauaagaaucauaauagcacccaccucauggggaaguuaugagaauuacauaaaauauugcguguaaacagcaaauaauuuagugcauuugcauuugugugucuugugcauggaacucuuuucccacaaauaugcaaggcccuucaucagaaagaauuuuccuaaccccauuuuuaauagcauccuucacuuuccuaucuccccucaucacaucucaaauaauauggucaugcauuagaaaaaaaaaaaaagucaaagaaucugacagcuuuccuaaacaguuuucuuacaggucauccuuacugacauaguucucaagauaaauuuuaauaaagaggaaucuucuuuuuagaacuuagacaguaaauguugaaugucauacaucaaugaaagccugaguucuugggggacaggcacuucuguagucauuuugguauacuucagaauacaauaguuuucuaaucuucaaaaauauuuuuaauuaaagcaauugucaugcaacugugauguugucacuuaucagcauaaugaauuuaaacugaaggccacucuuacugugaagaugaguugauaagcuggagggacugcauugguaauaauuagucagaaaagugcaguggugcaaaucaauauauuggugcugagacuuuccuuggggaaucuaaaccguaacaaagcugucaagcugcugggagauggggauguugcugauuuguguugcuaauuuauucucgauauuuuaaauauaaauacugaauacauaaaaauccaaagaagauauuugacuuaauaaauaguauuuaagcguuauuugaucaccgaaucaugaucuuuuuugagaggagacgaggaaggauuaucagaauuauuguaauuuauuuuggucaguguuuagcaaauagcaucacuugcuauuuaguguuauaacuuguauagaguaauuuuauuucaacuuuuugcauuuauaaggagagacaauauaaaauaggcaggacauucucuugacuaguggaauuauagucacggccacuuaaacagcauacuucaagaaugcuucauguagaagagaacugucucacucaucauagauuuuuagguuaucaaguauaauaacauuauccaaagaguccauuuaugguaggauuuucaaaagucuuuguccuguauuaugcucuaagcuuuucugcaaaucagacacagaauuuugugcaaagcacaauuuugggggcucaguuugcuuauauuaagcgauuggaauuugguuccaguuauauugcugccuaccaaauuacuccaaauuuuguugaguuaaugcaaaaaugcucauggaaucuguaggucauaaauguggaacugguaaaacaggaugacuuguguuuugcuccauguuuucugggaagucaucggaggguaaugcaaaugaugguuaggggcuagaauuauuugcccacugcucaauaaaguagucacuauuuaucuuuaaauauacauuaauuaaaaugaaauacaauuaauaauugaaucauucagucacauuagccauauuuuaaauguccaguaggcacaacauaguggcucccagguagacaguuuagauauagagaacauuuccaacaucauagggagcucuuuaaacuguacuaaucuagagacaucuucacucacaugucugacaccuggguugggaaugacucaagucuggaacaacugggauuguugauguaaguguguagaugcaacauucccauuaugguuucuuagagcauggaagcugaauucuaggaagauuuucaagagcaugcauuccaagagaaccaggcagaaacuguuugaccuuuuugccucagcuucugaagucacguaggauuaucucagcauaccuuauuggacacauagugaaccuaaccaccauuaacauaccuguccagauuucagguguaaggauagagaaccucacuaccucuagaagcuugcugaguuuccuuaaaacaaugauuuuacauuguuggucaggaaguuuauacauccccaugucuuuaugauugguuacugguuacugauguuuuauuuuauuucuucaaugauuucauguuacucugauuguuuuuaaucuuugugacuagcuguugguguccaugcaucugaagaaguagagauuuauucuagucuuugcagacuggcuuguuugggaaagcccuucacagagauuuugaguaggcuggcuaaugugguccaugagcgugcuugcagcuagaguccucaugcaagcuggccuuuugcaggugcccacugggguagaccuguuuuuuagguuugcaggggugggccugaagccuggguuugcaaguaugagccugcagccuguauccacaggggcuggccugaagccuauuuccauaggggcugacauggugcuaaggaaggcuuuugaucugcaagggucauccaggugcugggauggaccuguucucugugucuacaggggccagccuguagguuggguucacagguacuggccugaugacuaccagcccagugucagggucagucuggagacuggggccacuggguccacccuugcuccucggugggccuagggacugagucuugggggugggccuagaacauauaucugugggucuuggcuuuauguuggagcagccugaagcuugaggcugguugugccauguuagacccuaccucuaagugggagaaauaucaaagauccuguggcuaugauuuaaaaacaccacagacuaaaucuuguaucauaauuggugcuuuagaaaacuauuuauagacgugauggaaaaggacugaaugauccaauaaagaagacuugguguaaaaaaaauuaauaggacuucaggauuuuuugaggauuuuagucaacuaauguuuaaggcuacuuucuggggugguauuguaugucauguuuaccaauuguauuucaucauggcacauuuuauuaaauuaucacuucuucauauccgauaauauuaaaguuccacagaaaaaaauuaggaaaugcuggacugaguuuccuuuaauuucuaaaauucugugauuuuguuauugcucaugcuucccgaagaagucuauuuaauacauaaacuuuuauauuauuugaauuaaaauuaauugacaaucauccgagauuuagauaaauacaauaauuuauucuacuugauugaacagugucuccccaauauucacauucaccugaaacuggugaaugggaccucauuuggaaauaggagcuuuccaguaaucaaauuaugauaagguuguccuggauuaaaguguacaguaauaucaaugauuagaauccuuaaaagagaaauuuggacauaggaauauagaggauacauagaggaaagaaggccauaugaugauaagagaccgaguuauagcuguaggccaaggaaugccaacuauaggaagauaugagaauggcguagaacagauuauuucuuggaggcuuaagaaagaaccaaccaugcugacaucuuuauuucacauuucuaacuuccagaagucugagaguauaaauuugucauguuuuaagccaccuagauuaugguaauuuuauaugucagcucuagcaaacaaaugcauugcucuuuguuauuaaaaaaaaaaaaaaaaacuuuagguagguagaaguaacuuuuugucaaaaucuaaaagauaauuauaagaaaaauucuuuuuacaaugaagugcuauaacaaauuaagcuuauucuuuaguuuuaguguguucuuucagugcucagaguauuuuacuuuuacaguuuaaauaguaguucauuuccaaacuagcuccuacaaaguccuaaauaauuggcccauuuaauuuauuauuuaauaucccuuauauucugaauaucuuaauucuguuacaggaauguugaaaaauuugaaauuauauagaaauucaguuaguaaguacuauaucacaaauuugguuauaauucaggccaauucauauuaccgauaugcauagaauuuucccauucuuucuuugguacaguaccacaaauaauuagaaaagcaauguuauaaguaaucuacugauuuuggucaauuaauggagaaaaauacauuuacuuugugccagaaaggaagagggaagagaagaggagaggacagggaggggaggggaggggacaauucauaugguccccgguaacuacugagauucugauucuucaguaaaacuuaguuuuacauuccugccuuuggauucugagagauaucccuguguuuuacacacacacauaaaaagggggagagagagagagagaauuuuauuuaauucagcuggguagaguagggaauuuuuuuaucuuaaaaauuauuuuucacaaaauuauuguauucauuuuuuucugagauuuaauugguaauuguaacuauagagaguuguuacauguuuuaaaauaaugugaguuuauuaguaaaaucaaucaguaggcaguuaaagugacuauuaauauuaacaugggaaauaguuuccaagaugaaucuaugugcacaacagggauucaguaaguauauauucagugaaauuuuggacaguagguagaucuuaccugaagaaauaguaaaaauaguguaucuguagagcaaggaacuguagguaacaaccauuaauauuauuuucuauuuguacaaccaaaauaaauaacuuguugcaaacuauauacauaauagaugcaaucuucacuaugugaaaagugauuguuagcugguuuguaaacuuuaaaauugaagauaguuauguccaugcacuauuuucagcauuaaccuaaucauaacaacagucaaauuugggauugauaauauuguggcuauauguaagauccuuuuaauuuaauuauaaacauaucuauugauuguacauguaugguguuuggagguaauagugcuguguaauaaaucaaaucauguauuaguuauagacagacaacuuucuaaaauuuuaauauguuugaauauauaucauaagcuaguauuuuucccauggcagacauggauauaacucagaguggaauugcuuaaauuaauuucaaacuaaaaauaaaauaguucuaaaaugccaagcuugccuuggcacuguaaagaaaauacucauuauauauaacauuauuguuacauaugaguaauuacauaacaauuucaaaacauugcauaaugugaccauuaugauaaauaucaauuuuaauuaauacucuaagaacauacaaaaauggcaagcccuuuaccaucacuguuuauuauugauggcaacaagucaaagcuagauauauuuuauuugcuuugagaugauuuuuugguuaugauuuuauagccagcaaugcuuguuaugcauccaucaacaaaaaguuguuaaccaccuacugccaaagaaaaaucaaaaugucaccaucaaggccaucaugguguaagaaaacagaccuauacucaggcaacuucaguucaguaugauggauacuguauuagaaaaaguaucugggcgcuuuguaugaggaaggacaugucauuguguggagaagaugaagcuucacugaggagagagugcccuggucaguccuaacauuuguucuugugugcauuugugaauucaguggucauuacaacuagauuuccucucugcaaacagcaaccuuuucuuuuugugguagauuguggaaguuuuugggggcuuuacacaugcauuucaagacugcaacaaauagggcucucuuuauauuuuaaauucuuuuaacugucacauccuccccuuaucuuacccacuacuaagcuucuucuuucacacuugucuuuuuaauauuuuucuuuucauucucuuaauccuucaaaagucagaggagaaucaguacucuguguugugaugagucuggcaucucgaucucuguuauaucgucucauaggaaaaaaaaacaacucccuauaacucaagaaacauauauucauugauucuauuugaauuuauauguuaauucaguuuuugcuuacuacacacauuuuguacauuuaagaaagauacauuauuuuuauuuaccauaaaauaguacgguguagaaaacauuugauggucaacauauaccauaaacacaauagugaguuguucauaaaauaauuuuauugagcuuauuuuauauuuugagaaucuuacuuuuuuuucuuacuugacuucaauaaaaaguaguuacgucauaaccuacaaguaaagauuuuauaaaauccucguuggaacuuaauuuuagacccaauauauuauacauauguauagaucuggcuaaugacaauuuaugucuuccaaauaagaacaaauucaugacaauagccucaaaugugucacaauaggucauccuagugaacuuauggaauuuaaguaguuuuaguaaaaacaggauucucagauuucccuuuuuauuuuaaagguaaagaaaaauuuuaaaggaaacauuggcagcaguaauauuacugcauauuaaccuaauuauaacaggaaaaauccaaaguuuuacuguauaaagaauuucuucaauuaaaauauuauuaauuaaaacuauaaauuacucagcuaaaugauaacaugcccaacuacauauuaucuugucuauuauaauaccaucuuucuuaguuggagauauagaagacuaaacuggccuaagagaaaacuuuucuuauuauauguacuuugguagcuaacacuuuauaaaaucaaguuugugcuuauuuuuugcaaguuuaucaaaucauaaaaguuuuauaacuacuuuaucuuauccacaagucauuuacuuccacuguuagggcuguuucacuguuuugcacaaagacaaaucauuauuuaaauguaaccaaauugauacuuuucuaccucagucucaauauguuacacaagauacaugauuauuucugauguaaccuuaauuauauagaauauaugauuauuucacauuuugugguaacuguuuauuggcacuuaauaucuaauacaguuauugccaaguaaugcuguuuuuucccauugcuaccaaguauuaauauuuuugccagaagaaaucauauuggcauuaaccuuaucucagaaaguccuuacuuauuauuaaauugauuuuauugcuuaaaaaaagccacucaagauuaaaagguugauuuguuuaacauugauauauuauaaaaggcucugaaaagacuacaacuauuuuuguugaaaaaguucaauuuuaaaugugaaauuuuuuuauuaugccuuggguuuaaaauguuuauuuucauaauugaaacaucauaaucugauauuucaccuaacaauuuauucuguuguuauaaacaaagggcuguauuaauuuuugccauacgcuuacuauaacucaauuccauggugccuaaaaagauuguucucaacaauggcuuucagaaaaauacaagcuaaguaaauucaagauuuuaaaauuggggauacuauuguuuaaucuggauacuaauauaauuuauagaagauauaguugaaaccuuacagauaaagaggcuuaauaaaaguguuuuaacaaagcugcauuagaaaaaucaauuguaaauauaaauauuaaauauauaaauacugaauaaauuaaguauauaaagaaugacaagaacuaucuaaaggaaagucugguuaauauuuuuauagcacuuuaaaucaguuuaagguauauauaugauagauucuauaaucaucaucauaauaauaacuaacuuuuauuauguucuagacacuauuauaaauacccuaaauguauuaccuuucauuuaacccucucaauaaucacauuaauuuauuauucagaagugcuuuagaaauucugugacucacuggcauagugaucaaagaauauucugaaauuucagaaauguaaaaauuguuuugaacuuuauuuuaacuuuauguuuucaaaguuaauaauuuauaugugguaaauccuaauuggccacaauauuugauaauuagauaaaacuauucaaguuacuuugucauuauuaucuauuuggaaauaauaauuacaucuuuaaaaaugauuauucauaaaugaaaauauauuuuauauuuccacuagcuacauauauauauauguguguauauagauauacauauauauauauauguauauauauauauauauguauauauauauaacuuccaaguucuaggauauauaugugcagaaccugcagguuuguuacauagguauacaugugucacggugguuugcugaaccugucaacccaucaucuagguuuuaagccccacaugcauuagguauuuguccuaaugcucucccuccccuugccugccaccccugacauaccccggugggugauguuaccuuccuguguccaagcauucucguuguacgacuuccaauuaugagugagaacaugcaguguuugcuuuucuguuccuguguuaguuugcugagaaugauggcuuccagcuucauccaugucccugcaaacgacaugaacucauccuuuuuuauaacugcauaguauucagugguguauaugugccacauuuccuaaucccaucuaucauugaugggcauuuggguugguuccaagucuuugcuauugucaacagugcugcaauaaacauacgugugcaugggucuuuauaguacaaugauuuauaauacuuaggguauauacccaguaaugagauugcuuggucaaauaguauuucugguuauagauccuugaggaaucaccacacugucuucuacaacgguugaacuaauuuacagucccaccaagaguguaaaaguguuccuauuucuccacagccucaccaacaucuguuauuuccugacuuuuuaauaauggccauucugauuggugugagaugguaucucauugugguuuugauuuguauuucucaaaugaccagugaugaugagcuuuuuucacauuuguuggccacauaaauaucuucuuuugagaagugucuauucauauccuuugcccacuuuuugaucggguuguuuguuuuuuucuuuuaaauuuaaauuccuuguagauucuggauacuagaccuuugucugaugguuagauugcaaaaauuuucucccaaucuguagguugccuguccacucugauaauaauuucuguuacugugcagaagcucuuuaguuuaauuagauaccauuuuucaauuuuggcuuuuguugccauugcuuuugguguuuuaguuaugaagucuuugcccgugccuauguccugaaugguauuuccuagguuuucuucuaggauuuuuaugguuugggguuuuacauuuaagucucuaauccaucuugaguuaauuuuuguaugaggucuaaggaagggguccaguuucuauuuucugcauauggcuagccaguuuucccagcaccauuuauuaaauagggaauccuuuccccauuacuuguuuuugucagguuuguugaagaucaauuggugguaaaugugugguguuauuucugaggucucuguucaguuucauuggucucuguaucuguuuugguacgaguaccaugcuguuuugguuacuguaacauuguaguuugaauucagguagcaugaugccuccaguuuuguucuuuuugcuuaggauuguauuggcuauacagacucuuuuuugguuccauaugaaauuuacauuaguauuuuuuuuuuuuucgcuaauucugagaagaaauucaaugguagcuugaugggaauagcauugaaucuauaaauuacuuugggcaguauggccauuuacaugauauugauucuuccuauaagcauggaauguuuugcuguuuguuuguguccucucuuauuuccuucagcaguggcuuguaguacuccuugaagagguccuucaugugccuuguaaguuguauuccuagguauuuuauucucuuuguagcaauugugaaugggaguucccucaugauuuggcucucugucuauuauugguguauaggaaugcuugugauuuuugcacaucaauuuuguauccugagacuuugcugaaguugcuuaucagcuuaaggaguuuuugugcugagacaaugggguuuuucuaaauauacaaucauguuaucugcaagcagagauaauuugacuuccucucuuccuauuugaauaccuuuauuucauucucuugccugauugcccuggccagaacuuccaguaauacguugaauaggaguggugagagagggcauccuugucuugugccgguuuucaaaaggaauccuuccagcuuuugcccauucaguaugauauuggcugugugugugucauaaauagcucuuaguauuuugagauacauuccaucaauauauaguuuauugagaguuuuuaucaugaagggguguugaauuuuauugaaggcuuuuuccgaaucuacugagauaauaauuuuguuuuugucauuguuucuguucaugugauggauuauguuuauugauuugcguauguugaaccagccuugccucccacggaugaagcugacuugauugugguggaucagcuuuuugaugugccgcuagauucauuuugccaguguuuuauugaggauuuucucaucgauguucaucagggauauuggccugaaauuuucuuuuuuuguugugucucugccaggauuugguaucaggaugaugcuggccucauaaaaugaauuagggagaaguuccucuuuuucuauuguugggauaguuucggaaggaaugcuaccagcuccucuuugucccucugguagaauucagcugugaaucugucuggucuugggcuuuuuuugguugguagucuauuaauuacagccucaauuucagaacuuguauucagggauuuaacuuuaccugguuuagucuugggaggguaacuagcaauauuuugggacuucuggguugaccacauuuuguuugaaacauuuuacuuuuuauauccccuuucuccucauaauauaauauagcugacacuuucugguagaaaguuuauuuaacaggucguaaucacugaagauaugauugaaaguagaaguguuucuuuuauaaauuaccuggaugaauguuuucauaauaucuaauaugaaacuuuuuauugaagauuuuuuaaacugcauaauuuaucacuaugucaaauccauguggaauuuguugagaagaacaaaaaguaaaacaaaaaaaaucuucuaagcauauggaaagacugaguccauuuugcaaaaguuuuacaaaaaucaacaggacaaaaauauaucuggcuguaaaacacugaauuaauccucauucguaucugcggauuacaccuugcauucauaauaugcccaccuugucuucugcuccuauaucaauaugaaaauuaauaacuuuagaauuuuauauguccuugaguucuucagcagaguaaucugaaagaugcaauauuuauucuuuuucaucagaaaaauaaugcuuauuuuaugcuuauuuucaugccuuuaacuaugccuuucaugucaaauacccucccuccacugcuucucaccccuacuccauaaccuuccugaguaccuaccgcaaauggcuugucuugcuuacauagucuucucugacugcucucucauaguacuucaucuuuaucauacacuugacacauagggugaucuccuguuuaaagacuacuuuuuuuuugcauuuuuacaucaacuuauuuauuucuguugaaauguugcuggcuuaugaagugcaguauuuuauauuucuuuuuaucuagcucauggcaaguucuguuucccaauccuauugaauaagcagaaaaaauuuuagaauagcuguuugaucuuuucuaaauuccuacuguuaucuuccacauaguuuccaugugguuacuauuuggauuauuacuucuuuauugcuuuuuaccacaugguuagacagaauaguuuaugaacaauuaaauuaucaaaauguaagugacaucuaaaggugaauauaagcagugcucuggauuauaagaauauccucagaaauuguacauuuguguuuuuauagguaaucuuggcuuugauuguuguugggcuuuugauaaauuugguguccugcugcccaccaccaaccuuggcuuccugagacaaguuccagccaauguuuuaauuugguccuguccauuucaggauaacgcuuaaccaaugagccaucugccacccuggauauaagaaagacagaaaaaaugauuacaaagcauaacaugacaaaggagaauaugaccuuuucaguauuauauaggcaaaaagaucauuuaauaaaguuaauugauuguaauuuuacaacaucaauugauaaaguuuaacacaauuuaucuuguuuuucugcaaaauucuaaaccugauucuuuuaguuuacuuaaauccuaacguugagugaaucaaaacagcauaaacaucuuugccaauauaaucacaaggugauuggcaggaaucagaacacaucuaucaugagcauauuccuuuaggaguaggcauuucaucugauaacucuguuuuuguauucuacacuuacauauuuuauauuaaaaacauuuuccaaaaucugguucauuuaccacuuugcauugcagaugagucuuagaaaaaagccuuuguaaaggaggcagugaggaacuaagagauauuuuuauaaggcagagucuaugguuuaucucuuccuagagugacuguuuuauagagugagguacaguggcaguucucaggcauuuuuugugucuucaccuuuacauucuuaaaaaaaaauuuagaacaucaaacagauucuauuuauguaguuaggucuaucaauauuuaucuuacuggaaauuagaauggagaacuuuaaaacauuuauuauuaguucauuuauaaaugacaaacccauuacauauuaauguauaauaaaaauaauauauauauuuaaaauaaaaugaaugccauuguccuacauuuuuugcauaucuacuuaaugaaugaauuaauagaagacagcuggcuuguauucugacucugcauucaaccugugacuauauauuugguuagauacggaaagaaaaucuuggcucaccauauauaacugauaacucuguuuuuguauucuacaguuacauauuuuauauuaaaaacauuuuccaaaaucugguucauuuaccacuuugcauugcagaugggucuuagaaaaaagccuuuauaaaggcuuuauaaaggcuccuuuuuaaaggaggcauguaaaugagugggauagguguucagagugcuagauuuuuuuguuguuguuguucauuuaagguauuaccaugauaugguacauaauuuuaguagauuuacccaacaaauauauuggaaggaagagagaaagcaagagacugauuagaauccuauugauggagucugaaaaauggcacugaugaaagaggaugagcaugucaauagcuuuuucagaaaauugugaauauucuuuuuaaaacagcuuuguggagguauaauugauguacaaaaaacugugcauguuuauuguauauaauuucaugaguuuggagauacacauauacccuugauaccauuaccaccaucaagguaauaaacacauccacgauucuucuuuuguacuacaccaaaacuugacaacuggugaugucuaaaugguuaauuacaguauggaaucucaaacuguaucagugaaccuuguuuuuuacucuguuauauuaaaauacguugguuuauauugcacuuugaauacaucuuucaccauguaugauuugaauuagaaaauacugguucacugguuaugcaaauauuccacaacuccauuaacaauaucauaaaagauucacauuucuuaguaucaccacacauauucucuaaaaauacuaugagaacuagaaagcuuucaaguucacagcggcagaaucaagaugucagaaauucaaaucuucaacuuugcaacaaaaauugucaugaagucugagugauuuauuuucaagcaaaugucugccaaaugccugccucuguuuaacuuugauuuuuuccaucaguuauuccuuaaaguaauaaugguuuuccaugaaaaauguggcucauucugcuugcguuucaaucacccaaguguuuuauuugagacaacaacuguacuuagaaaugcaacagaaguguuuuauguguuuguuuuauuucaacaccuagaauauuaaaaauauguguacucaaggcuuucaguagucuuuucaacucagugaugucgcacuaugccacugaguugguuuuugcugaaauuccugacguuuuauccaccacugcuucugcaaugucagugcaaaugccauaauaguaaaaaagacaagaucucaaacuauuuaugaaaauaguuuuuauuuauggaguaaaugaaauucagagaccccuagaugucacaccauggagcacaguuggagaacugcaaaacuaaagaaaauaaacuuuguuacuguaauuucaagaauaucuuccaaagccuaguuuauuccuuuaucauccgcauuuuauuuuauacaagugaauaaugagucuaaaaaaucaaaugcaauucaauaaauaugaaaugucuguaguuuaauuagcauaggaaaauauccugaaauaauaguuguuauuauuguauuuauagcuauaauuacuauuuagugugugugucugucacauagaucuagcugcuauaaaauucauugauuccuuaugaccaccuauaaaguuaguaccauaguuguccguuuguuacagauaaacugugguagauuaagauacaugcguguaucuccagagucuaugaauucaauauuuacuuugaaagacaauguuaaaagaaguaaauauuuagccauauuuuuaagauuuuuaaauguacacauauaauuaucauagaaaugucauaucgguaguacaaaaauaaaaauugucgaaauuuagaaaauauuucuuacauuauggcugaaguggucaagggaaucuucacugaaugagugggauagguguucagaguucuagaauuuuuuuucuuguuuaagguauuuccaugauaugggacauaauuuuaguagauuuauccaagaaauguauuggaaggaagagagaaaucaagagaccaauuagaaucauauugcuggagucugaaaaauggcacugauauuagaaauauaauuuggugaaucaaggagauaugacaaagaucugaaagauaugauaaauauuugggagauaaagagucaaauauauuuucagguuuugaguacagguucauagaaacauuuguaucuguuauaaaugagaucauauacuauuuuucuaauucacaauuuuuguacauugucucgauggaaugcuagauaauuauuaguaaaauuaaaagaguuuaauaauaagaaaaaaaaucuaaaucucuugguguugaaaaggaguaucuccacauacuugccugaaaguguccaguuacuucaaaauaauuacaucuguuuuuuguuuggcuuuguaucuucacaagauaaaugcaaagguaaaauuugcaaaaacucuagaaaagaagagacaagcaagaaacuuacaauauuuuuuucuauuuuuuuaacugaugaaucacccauucuuuuaaaaauucuugcaauacauuuccuuauagauguaacuugacuguuugauuucugucuguaaucaaaaguaccaaauuauuuccuagagucauugaauguaaaaugucuagcacuuuguuaagauguuuaaacaaaguagccuaaauaaacucuuuaaaucauugcagcauuaucaaaaggaaauaauaauaauauauuuguauuugaaauaaaguugccuuuaggaaacuaguguagaccguagagaaaaauguuuccucagugcuaacgugagccuuguuuuuauaggugugcuuuaauuauaaucuacuuuauuguaauauaccgaucaugucuaaaucacuauauuuuugacuuaaagaagccuuauuagagaugccaguauagauauuuaaguucuucuacauaaaaaaaaaauuauacgggaagaaaaacuaucugcagauuucuuuggagagccaaaaauauguaacucugguuuauuaguugagugaauaaaucuaaugugcaguaaaacugagucccauuucuauucagagaguuaauaacagaauauuuucauaauuugacagaaaugcauuggcauaaaacuaaugguauaguugcucugauuuaucuguacuuuggcauuuaaauugcauaaacugauuuuugaaauuuauaucacuguuucauaguuuuccacauuauuuaaucacaugaagacacacacacaugcaugcaggcacaaugcacacacauguauauguauauucauucuauucuauuacugcuagccauacauucuuuaauguguacuauaugcccagaugacaggaucucucuuuuacaaaugaggaaaaaccgaucaacuuuuuuuuucuagaauaugcagaauuauucuuacaaucauguggaauggaauugugucaguuuacuuauaguucacuuucuuuugauugccuuguuaaaucgucaccuuuaucaguauaaucaaaauuauugaaaaauuuuuaugaagcagacuguucaaauugcucuuuuuuguacuauaaauuguuagaacauuugucuaaaaugugaguauguguaaauuauugaguaaaagcuaacuaguuguacuugcuaauaaaugcguuuuuuaaucucaugaauuuuaauuggcauuuauucaaauaaguauuuaucuaaaaaugaccauagccagauacugagcacgaugauacauuaaauccaguaugucucaacguuuuuccaacaaacaacuuucccaaacaaaagauuaaucuuuuguuagacuccauguaucuguaauguuuguuaaauaaguguaaaauaguauacauaggauaugaacaguaaugaauucuuacuagcuauaguuuaacaaugauuugcuuucaggaaaacuuguuugcuacuucuuauuguuuuauccacaaaggcuccucuaaauuuuaauucuccaaguucccaaauuuuucuccauucuuucuauauauaaaaagaagacuuucauuuuuuauuuuaauuagaaguucaaagugagagcacauacauugcccuaaacuucuuuacuguauguuugaucuuugcccuagccccuuucuucuguuuaucugguguuaaauucuuugaguaugcacuuaauccuaugaaguaagauaagauuuuccuuaucugauauuugcuucuugaaauaauuguuuccauaucuacuuuacgauaaacauguuugagguacauauauauugacuuuuguuuuuuuuuaacuuuucuuuuuucacaaacuuacaucuuucuuuguagccuguuauaucagaauaguauuuuucauucagugcuuuuuuuuuuuuucauccuaaacauguucuucaaacacuuauuuccaauuccucaugggccugccacuuguuaggaauaacuuaugucucuaauauuuauacuuucaaaaaguaccccuucuuauguaaauuugucuucucuguuagucuuugugauuaauucuacugguucucuuacuuuucauaccacugcaaucucuuugauauuuguacuguuuguuuuuucugcucccucccuauaauaaaauuagguauauccucaaauacccaucuuuagccuucuuuaggacuuucugaaauuuuagcuauuuuagaguucaccuuuauguugauguuuagcaaaucuacaucucuagccauagucuuucaugggugaaaaugaaaugcaacuugaggucauaaaaugaaacaugacuuguuuccuucugcauuuguuuaauggucuugacuaugagaacccagccuuuuuggucucuaauuuauuagucaucccuauuuucugaaaaaaaucaccuuauagagugagaacaaaguacaaugucaagguuagcucauuggaagaaguggccauuaaauaagaucaagauuguaaauguagaaaaauagcaaguuguauaaauagcagcaucaaauuaugaagcacuuuaacauccugugcaaaauuaauaucacugaauacuuacaaugaacuuuagggcaugguauuucuuggauauucaaguuugcuauuaguucagguauuuucauaaauguuaaaguuauuuguguuuucuucucacaguaagccacauuuucaaaaauauauuugugccaaggcucaaauauaaucaucugguaauaauguguauuugauguuuuuaaaaauagcauuucccauacacauucacacaauuuccugaccuuccucuuccaaauaauuaaucaugccaucuguacucacaucauauuuaaccaaauuucuaauauaauauuuagcacauuacauuauauuagaguuagcuguauaucucuuugcuuucuccaccaaaccauguaccccagauaguagauaucuuauucauuucuguauccucagccacuugcuacauguuugacacauacuagauauucucuaaguaauuaucuguauuuucuuuuuuuuuuuugagacagaguccugcucuuucgcccaagcugaaguguggugguguaaucuuggcucauugcagccucgaccucccuggcccaagcacuccucccaacuuggccuccugaguagccaggccuaccaggcuugcaccaccaugccugacuaauuuuuguauuuuuuuuuuuuuuuuuuuuuuuuuuuuguagaaaugggguuuugccauuugcccgggcuggucuugagcuccugggcucaauccacucacgcacacuccucggccucccagugugcuaggauuauaggcaugagccaucauguccaguggaaguauuuuuuuuuaguuaacaaaaauuaucuauuaccuguuaaaccugaguguaaaguuuaaguugauuaaaaaaaaaaaaaauguagcaaggcauugugaguggaaaaaaucuuagaagacuauaacaaguuucauguucuaauuccagucuaauauaaauauagguaggcuugaauaugcaguuuuauucugcuugguccauguuacuugguaaucuagagauuaccaaggcaaucucuagauaaaggccugagaaucagucccuuacuccucugacucuuagagucuugcugugucaacccaauuugguuuuuccauacuuuaagcuucaaguaguggccauagaguuaagagacucucugauauuaauauguggguuggguaagaauggaggaguaacaggaagucagaagaaccuagucacuacaaguugacccuggauaauauaaaaccacuuuuaaauuccauauuagcaauuuaaucaaggugcuuuuuucccgaaauaagaugauuuuuuuuguuuuguuuccaauuguaauccugugacaggagauccuacauuugcaauguaauacaguuuuucauaccucuaagcacuuaguuuugauuccaucaguaaaguuucauguuugcuuuuuguuuuauaucauauuccacagggcauaugauuuuauuuuuuaagcauuguugugugcccuuccauaucuaacaaugugauuuagauuugccaugacaaguuguggaagggagacuggaaauaauuucaguguugcuuacgauucagaauuggaggcuuuaaccuauuaacauauuuaauuacaaaacauuuuauucucauuuggaaauuaaacauaaggucuuaauuguucuguauaauggauuugaaguaaacaugaguauccauguauauuauuuauauuuaaggcucauuaacacugccuugauuauuuuaauagaguuuuuuuuguguguccuuauaacccaaacuauaauaauacuugaaggaagucagcauguaauuugucuggauauuugaaaaacagacugcauuguuuucacaugcugugaaugagagcaaagcaccaacaguauuucucccucaaagcucagcauucuugacuuuucaaacaucacugcuuggggaacugagaaacacagaaguucuacugauacgaugacuauugacugaaauggcuguauuuguuagcauuuauuggcugauggcuuaccucucuaaaaauucuuuuacuccuaaaaucaauuuuaaucuuauuuggauugcacagguuggagagggaaaaaauggugaggaaggaggaaauggauauuuuuuucucauuaauuagggaguuuaguagaucuaaagaugauuacaaggaaccaauugaauaaucuuugugauuauagucaagaaauguauuauguagucacccauuuaauucaggcuaucacaaaguugucacgguguaacuuuguuugaugcaauuucaaguuccuagcauuuugguucuuguugaaacauuucacucuagaagcuuaccuuggaaauauugugggcaugguucuagaucaccacaauaaagcaaauaucgcaauacugcuagugacauuuugguuucucagugcccacaaaacuuguguuuauacuacacugaagucuauuaaguguacaauagcauuaugucuagaaaaagcucacaacuuaauuuaaaaauacuugaauauuuauuaauugcuuuauugcuaaaaagaugcuaacaauccucugagccuucaauaagucauaaucguuuuucuguuggagggucuugccuugauguuaauggcugcugauugaaaaagguuagugguuacuuaauauagaaauggcuggggaaauuucuucaaauaagaggauaaugaaguuugacacauuaauugauucucaccaaauauuuuuccacagcaugugaugguguuugauagcauuuuacccacacuagcauuucuucaccauuggagucauuuuucucaaacugugccacuguuguaucaacuaaguuuuauguaaauauucuaaaaccuuuauuguaauugcaauaauguucacacaucaucaccaggaguagauuccaucucaagaaaccacuaucuuugcucaucuauaagaagcaacuuaucauucauucaaguuuuauuauaagauugcagcaauucagucauaccuucagccuccacuucuauuucuaguuaucuugugauuuccaccacuucugcauuuacuuccuccaguggagauuugaacugcucaaagucacccauaagaguuggagacaacuucuuccaaacuccuguucacacugauauuuugacuucccccaaugaauuacaaauguccuuaauuacagcugaaauggugaauauuuuccagaaaguuuucaauuuccuuuacucagauccaucaguggaaucacugucuaugacaucuauagccuugcaaaauguauuucuuaaauuauaagauuugaaugucaaaaucacucuuucaucuaugggaugcagaguggaugcuguguuaguaggcaaguaaacaauauuaaucucuuuguacaucuccaucagaacucuggggugacuaaguguauugucauugagcaguaauauuuaaaacgauuuuuuuuucugagaaguagucucaacugugggcuuaaauauucaguaaaccauacuguaaacagaugugcuuucguccaggcuuuguucuauuuauaggacacaagcagaguugauugagcauaauucuuaaaggcucuaaaauuuucagaaugauaaaugagcauuggcuucaacuuaaugucaccagcugcauuagccaccaagcuaacagagucacccuguccuuugaagcuuuguugccuggcauugacuucucuucuuuagcuaugaaaguucuagauagcauucuucaccucuccuagccuucacugaauugaagagauaagcccuugcucuggauuaagcuuugguuuaagggaaugcugugguuggcuuaaccuucuauccagaccacuaaaacacucuuuauauccauaauaaagcuauugcacuuuaucacuuguguucagugagcuagcauuuuuaauuuucuucaggaauuuauccuuucuauuacaacuuggcuauuuugcucaagagaucuagucuuuagagucucaguuuuggacaugucuuccucauuaagguuaaucauuucuagcuuuugauuugaagugagagguaugugaucauuucuuuuacuuuaacacucagaggcuguuuuuggguuauuaacuggccuaauuuuaauauuguugugucucagggaguagggaagacugaggggaaagauagguauggaggaauggcugauaaguggagcaggcagaacauacacaucauuuaucgauuaaguuuucugucauauaugagcaugguucaugauucucuagaaguuacaauaguaacauaaaauaucacuaauuacagauuacuguaacagauauaaugauaauuaaaauguuugacuuaccgcaggaauuaccaaaauggguaauuuugguaauccagguaacucaugacccagagacaugaaguaaguacgugauguuggaaaaaugguaccaaaagacuuauucaaagcaaggaugccacaaaacuucaauuugugaaaaaugcaauaucugcaaagcauaacaaagaaaaguacaauaaaauucugugugcuuguauaaauauuugguaggaucaaggcagagucauauuaagguugguugaucuaguuauuaggaccauuccaauuuuauauucucauaccuuuuuacuaaaauuacauguuucauuaagauaaauuuaaucaacuuuuagacaugaaauaggacaucuguuugguaaaaucacauacccugaauuucacugauucuaagacacuuccaccccccccaccacauuuuaacaucuuugaaauuauaauacauccuaaaauucgugugauuuuaaccuuugugguuuguaagcaagagaaacaacacaguuguccuugcaugugucuguacaaacuucguccaagcuguccauauuuuucucauuuuacuugaguuacgugcauuguuaagaguacaagcauguaauuuacuugccauuaaaauaucuugaacuauuauacacuaauaugugauauaaaagugaaauuaugaauauuaugcucucagaaacucugagacaaauaaaauacugauauuuuguaucacuauaguuuuauguaaauaugauguaaaauaaaauaaauauaaaauaaaauaaaauauaaaaaaauuauuuuuuauauuauacuagugaagcaaauauuuaauauuggaugaauuaauauacuuuauuucaaagcuauaaccaaguacuuuauaagaccuaacaaaggaagauacuuuuaaaugaaauguguuguuuuguugcuaaaauguauguaauacaauuaucugucauuuccacacaauguaaaaugaaggcauuagaaauuuuccaauccuuuggaguaaaugagagagauuuucaagugaguagagucuacauuacccauucauauaucaaauacaacuuuuguuaaaucauuuuauaauaguauauaaggagaauguuuaucacuaauaguacaugauuuuugucacuuaucauauauaaaggugcaucuuucaguuaaagacaacuuauuauuaguaaaguauauaaucuagcaaauacauauaagugcuaaaauaaaauacacucuuucugaacacauucuuuauugaaaaguuagguugaaaacgugucauaacucaaaguagcacucaaucuuacauuggaguggaaauccuuagcuacuucuaauuucuaaauauuuggagugagacuauugcuuauuaaaauuccaauuguauuuuuaaggaaaaucuacaugucauauuuagacacuuuucuuuucuuuucuacuuuuacuuuagguuuggggguacauguacagguuuuuuacacggguacauuucauaucccugaggcuugguguauuaaugaucccuucacaaagauagugagcauagugcucaauacguagccuucccugcucaaugagucuacaauaucuauuguugccaucuuuguguccauguguauucaauguuuagcucccaccuguaagugagaacaugcaaucuuuaguuuccuguuccugcccuaguuugcuuggauaauggcucccagcaacauccauggagcuucagaggacaugauuucauucuuuuuuauggcuacauaguauuucaugguguauauguaauaaauuuucuuuaucgagcccacugcugaugggcaccuagguugauucuaugacuuugauauugugaauagcacugugaugcacauagugcaugugacuuuuugguggaacaauuuauuuuccuuugcauaaauacccaauaguaggauugcuaggucaaauuauaguucuaaguucuuugagaaacuuccacauuguuuucuacagugacugaacuaauuuacauuccuaccagcacuguauaagcauucuauuuucuuggcaccucaccugccucugucacuuuuugauguuuugauuauaaccauucugacuggugugagauggugucucauugugguuuugauuugcacuucucuaaugauuagcaaugaugagcauuuuuucauauauuuguuggcuccauguauguguuucugagaagugccuguucauguccuuugcccauuuuuuaaugggguuguuuuuugugugcuguuuuauuuaaguuccucauagauuuuugguauuagacauuuguuagauguguaguuucuguuuuaaugaacauuuuauguuuaaaaaguggauugaaaauaguaaaaaaugcaguaggucucugagcuagaaauuaaauuuaaaaaugcauauugcaauuucauagauuuguuuuuaagguagggacauuuauagauuauguaauccacuucuaugauuucauggaugcacaaaaagagguccagagagauugacuuauuuaaugucaaucacccaguuuguugggauaagaauuguguucucauagcugguuaaaugggauaggaaaccugcgaauuugaagugucucuaauugcacagucccuguaacuacaaucucaauuucuccacuuauuagcuuugugcucuuuuaagguuacuuaagcucuuuguccucaaugcccauauuuuuaaaauagggauauuuauauugucuaccuucuagagauguugugauaauuaaacaaguugauagauaagcauauaaauaguaccuggcacagcaaugugcauggcaccccccccagaguagcgcaguauacauguuaugcagccccuuuacaguauacauguuaugcagcccccaagauacauauuauguagucucucucucucucucucucucucucucucucucugucugucuaucuagauagaucuccaauguacuaaauacuauaugauauucuggauuggauccuugaagggcaaaaggacauuaguggcaaaacaggugacauccagauaaauucugaggcuuaguuaauaguaaugcaccaacguuguuuucauaauuuuuaaaaauguacuguggugauauaugauguuaacauuaggggagacuggguaaggaauauaagaggaacuuaaacauagaacaaaauaucacaaucaauuuuuaaauauauucaauugauauuugucaauuaaagaaauaaaguaaaaauaaggaaaacuuauuuuaagauaaauauuugaggcaaucuuuaauucauaucacauucuuguuuaaguguaagaugucauucucuguuacucuugcugacccgcaauuucuccacauuuaucagauuauuuucucuacuggaaugauguguaauuucuucuaguuguuauuauaaucaaagagagcauacaauuuaaaaagaucaaagaagaguauuauaaaucagaaaaaaacaguaucaggacaaucaaauucagcauucuccuuguaucaggaauagauauggcuguacguuaaaaaagaaaacaacuaaauaacaguuguuaaaauaacauagaaauuuuuuuuuccacacauuaccuuccagagguuaguaauccagggcuaguaugguuuuccuaucacaaagucaggcuccuuccaccuuguugcuaggacaaugugcaucuucccuauccucaaaguugucucauggcuuaagucuuuucaguucccauauuacaucucaugucagcuacuaggaauaggaaagagaacuggaaaaggcaaagucauauagucuucuuguaaaaugcuugccagacaaacggucuuuuuccuuuccacuaccuccagucuuuuggccagaauuuaguuauauguacgcuccuagcuaucaaggaggcuagaaauaugguauuuauuuugggcaaccgucuaaaaagugaagguaccuuuucaguuccacaggaagaaaacuacuuggggaaauaccagcagccuccgccuauucucccaccaauuauagaucuuucagcaaccaggagagagcaauggaacauuauauucuccaagacaaaagccuuuuucucucugaaaaacugacagaguugugcaauacaguggccuugacacauacaacaaaaaaugcaaaggaaaauacugaauuaaaauuuaauuggguucauccgaaaaaucuaaacugacuguuucuuaacccagggcuaaugaaagucuuauuuuguuuuuaaaucauagaaucuuaccaaauguagaaguggcuugcuccauuuuuuuggcaauauauuuuaauuuauuccuuugcuagggucuucuauuuuuaggucuguagguugggaaucuaaaugcuuucgcugguuguaauauuauaugaaagagaauuuauuuugcagaugaaaauggagaaacguuucagcauuuggaaauauauauugucaagcauuggacuguugguugugccugugcuagugaauaaaguggcauguuuauaauucuauguuguuaaucaauuuaugaaugauugccuuuuaaaaacucauuuuuaaauauuugaucucuaguguacaauaaucuaguucauuuauuauagagauagcucauuggcuaucaaguuacgugauagacuaaaacaguuauuuuugcaaaguucaaaauauaaaauauaauauauugaagucuaaaggcaaaaugacaaaaguagugcuucuguuaauaaaccuauauuugcaaccauucugcuuugcaaaauuaagacugaauaaaugagaggcaucuaagcaguguuccgauacucauuuuuaaauacuaaagaauaugauuuucuaauaguuggucacuguagugauuaaaauuaacuuuuaggacuuauuuauuuguauuuugccaucuaucacuuuggggguaggaacaauaaaacauugacuucuaguggaacauaaaaauccaugauacauaacucuuuguguauucuucaauuuccuguggcucagguaacaucacaaaaauuuucagauaauuuuauuuuggaauauucuacugaaauagaaaucagaggcuagauaauuuuggacaaccugauuaguuguccaaaauuauaugauaaguuguccuaaaucuacuugccacuguaacauggcacacaggaaaauuagaaaaugguuauuaaaauuuuaauuucauucucaauuauuaaaaugacuuuuuguggcacuaugccuuauuaucucaauuugccagaaauccuuuuauuguaguuacauguaagucauuuuuucucuuguagugauuuuuuuuuuuuuuuaauggagucucucuuugcacuccaaggcugaagugcaguggcaugaucuuggcucacuacaaucucagccaccccgguucaagugaucauccuugaucacuuguaacugggauuacaggcaugugccacuacgccucgcuaauuuuguuauuuuuaguagagauggaguuucaccauauugacuaggcuggucuugaacuccugaccucaggugaucugccugccucggacucccaaagugcugggauuauaggcaugggccacugugcccagccagcgauuauuuuucuaaguauaaaauugcauuuuuuccuauaauguucuaauaggugcauauuuuaguaagcguuuuagcaugaguuaagacaaaagcaaauaaaaaaugaaguugaaaccuaaaacaaauucauguugaaaaucucuuaucugaaaugcuuggcacagaaauguuuuuuauuuagaguuuuuucagauuuugaaauuuuugcaauauacagguugagcaucccuaauuuaaaaaucccaaauccaaaauguuccagugagcauuuucuuugagcaucauguuggugcucaaaaaguuuugaaaguuggaacauuucagauuuuggcuuuucagauuugggauguucaacuuauuuagcauuauuaggaaucuccuuuuuacuucuccacaauacgcuccuuucauugucauaaaacaaauuuuuuuaaagauugugcauagauucuaguaauaccuaacucauucaaaggaagaaaaaagaagggagugagugaaccugagggaggaaggcacuaauuuaccuaguuaaugcagaaaaugccuuuggguugagucuacaaaacugcucucaguuuuccccaaacuuacaucaguaccaucacaauaacaacaagaaaaauugcagcuugguguuaauuuuuaguacacuauauauaacaccuuauaauguaauggccacacaaggcaugcaguaucuuacaagguguauauaaaagguaucaaucauuccuaaaucugucuguacuuucaggaauuuuacauuggauauggucccuggauaugauauagaguaauaaagcuauauggcuguuaagccaaaaaaaaaaaaucuuaacuuccugaccauauccaguagggcuuugcagaaacauacaaauaaauauuuuguguuuuuuuauaugucuaugaaaauacaucauguuuaugucuaagaaaaaaaucuugguguaucauugucaaauugcuauuuuuuuuaaaugaagacauuacauuauguaauaagaaaaaaaucugaauuauuacauuucggaagaauaauuucaauuaaaauuaacguggacuuuuaaaagaauuuuaugcuuggcaacaaaaauguagaagcaguuuaggcccaccacuuuauaggaaaacaauuaauuugaacuauguacggcccauuaagaaugcauugguagagucaugagugguaaaaccugaaacuauuaggaaaguaauaaacaacacuaagagcaguagcucuuuauccucaagugauaacucuagcuuuucuaauguacuuuuguugugguuguuuaaaaauauuauaauaaugaacguccuucaguuagguuauuggcuuguuucaauggcuaagcauggauauugaauguagagcuaugugacaaucuuugauaaauccuugugccucauugucaugaugcauaaugguaagauugacagaaagaugccaacaaacacaugcaugagggagaagccuucuuucauguucaagauacaacaugcugugcacauacugugcuugggcuguaugcauauguaagucaccgugcauggcagaugacacaguaggcaucauccccauuugaaacccaucuugcauggccuuucaagaugugcagaagagcugaggccaaugaaaacaucugauacaacaugaauguccaauuagaaacucugaaaagcuacuuuugccuuucaugugacauguggucaugaauuaagaaucuuuagaugaauagacagaaggaagacaaauauaaaauccccuuugugaaaagcaaauucaauuucccaaaauccuuucuagaucuucacauuuauuagaugcuuucaugguaucaucaucuccagugugcuguggaaaacaguguuuacugugagguuaaggagcuuccugguuauuuucaguuuuuacuaucccccagaagguaaaauguuuaagccuauuucugagugaaauaauugaucuucauguuuuugagagaaacagcuagggaaucuuggcaacuuuccugagcauguuugcuguggacuuucacucuaacagcgguuacuuccugauaaaaauguucuuacuuuugagacucaaaguuugauggaaaauaaaauauuuauauaauacaccaugauacuacuaaaaauaaaaacuucucauuuguuucagccuccugaauaguaccuuauacaaaguauacuugcaaaaauauuagcucccuuuucccuuuaucauucugagagagauauuauauaauauauauuaucagggucacuguuuucacauacacagagaaguaagacaaacauuuggucaaauauuaaugccauuuauuguguucaaauccuuucuguaaauucaauuguuuaauuuucaugugacuuuuguagauuugccaacuauaugcucuuuaaauuuuaauaauucuaaaaaauuuaccuucaguauuuuuaaaauuuuguauaaaguuguugcucauugaaugacagcaaugaucugauaccuuagaucaagaucauuaauaauuugcauaucaucccuauauuuuaucucuaacuguguguauauacuaugaaugugaaaccuugggguuaaucuauagggcuaaguccuacaaaauuaaaaugguguaugggaggcaggcuuucaggguuauaauuugaucugggauacaccuuaauaugauuaaaaaugaacacuuuaaaaauauucuuuuuauauuuuuaaaaauauacauguaaugccuacagauuguauguaucuguauaaaaguauacagaaaauaauagcauauaauuaaaaaugaauauauaauaugaaaaauauauauauuucuuauacugaguuagaaaauuaaauaauaucuguggccuuaaaauauauuuugaucuuuuaaggauccuuuguuucuaauucuuuguuccaagucaucccagcaagauggaugcuuaagggagugaugguguugauaucaggagcuaacauucacucuaaucuuguuuuauaauuagcuuuauaaugcacgaccacaaauuuggcagauucauauagucccuaaauuuuccauuuugaaucacuaucauaucaauuauauuaaagagauauuccugauugugugcuuguuuuacugauacuuuaugcacauuauauuaguacugauuaauagauuuuuuucuggacuagaacuuucuugaucauucuguaugaaauuauugcaaagauagaaaaggaaacacuuguuuugcuuuucaauuauaaagcaucaguguuaccuuggugacaucgacaaaacaauagcuguacacauucaaucaucugcaaaaucugacaaauauuaauuauauugauuuuucuauugucuuauggagguagugcuccuuuuauccaaggagcagaaaaguuaauuauauacuuaaaacccaaauuagugagugguuccaucauuuacuaguauuucucuccuuuguccugguauucaaaaaucagagcucaaaauuaaaugcugcuuucuuuuaaaguguguuaaauauuauugguguacugaauaagaaaaagaaacaaauaagacaugaucaggccaucaauaaccuaauugcuuauaaguauuacacauagaaaaagaaacuguaaaaagcaggaucucaaaaagaggggaaccauccuaccauuuaaugauauuuauaaauaucuggauaugauaaacucuauaauccauaaacuauaaccugguagguaaaauaacaucuagaagaagcccaccauucuaaucuggcaauaugcaauuugauauaauagugguaauacauggaauauuggaagcuuaauuaguauuucaguuaccuaagugaaauauuauucuuacugaaucauugcuaaaaauacaucucauaaagucaugugcauaugcccuccuagacuguaauuuagauuuuuaauauuuauacuuugcaauuagcacuaucauuaccuuuuauuugggaagguauguggaaucaguacucuuaaaauuuuaagaaaaaauccauauuuucugauguuguuccuagaguauauuauacagugauguauuuuacuaucugccaaaacugcucuuuuuuacagcagaagauaaauuguucuuuaucucugagcagugccuuuuugccauagccagugggauucaauaccacugauucuuuuuacaaucuugguuuagaaaauuaaagaaacucaaguagcacugcugcaauucauucauggcuaauacaucuugucgcacaugacugaggacaagugcccuccagauuaaauuuugcugcucagcacccugcauuuucauaaaauauaguccuuacauagcucuaugaauaucccaagcaugugguuuaauuuaaaccaacaugcuugagucacccauuuaaauaaaauguuuauaauguuccaaaacuauuuuauaaauguacuuucuucaaauaaaacaaguaaagacuauaauuuuauaugagauaaaacaguauugauacucagugauaaguagagaucuucggggagaauugccuggguuaccuuagggaacagacauuugcuucugaguauugauuugugagaggaagauggcacugccaacuggugcuaaaagucccugcaaguguuggaucaauccacccuguuucccucuaccccauggccuaggcaagauagauacaguugauaugaauggccuuacaaaagguuaccuucuccugugaugcucuuuuuagguugccugcugccucauuuguaaucacaguuuaaagguggacuuugauaugcauugugaaaaauuuaucauaaaauaaauguaugaauuugguaaggguaaaugagagaaaaagggauucuagaaugaauuaaaacagucucuaucagggaguuauuuauaaugaaguauacacauacccuauggauguuuauuaucauaagaaacauauccugaagucuaagaaaagauuuuagauuauuaugggauuaacaaaaaccaguugaaguaagcaucugaugcuacaaauuucucuucucucucugucugucucucauucucccuuuguguguauguguguguauuaugaucucagcauaaacuaucagguauugccucauaaugauaaagauuuacuuuuggaacuauucauggaacuuuuaaccacauagaaacgauguugagaucaaaaggaaccuaaaacuuuagggagaaagaaucaauccacacucucaugauauguacauauuuaauaauacucuaugaaucaguuggaagagcaaugugaucucuaguuaucuggagaauguuacuagaacauuaugcauucaguauccuguagguaugaugggaguuuuagggaucacaucaaaugaucuguaggcuuagggauuaaucaauacugaaucauuauauaaaccuuuacuauaaguaaaacuuuuaccaacauaaaaaaaaacuauaaaauuaagccacuguuuacacaugguucagagugucaaaaaccagcaaaaugacaaaaaauaaguagcagaauccaugugaaauaaaaacuaaagaguaaacacagacuaguuaauggguugaaguucuuucaacauuacauaguauauauguuaugucaauauuguaaguuaauuuuugcauacauaucaaaaauuauuuaguuauguucccuaaugagaguggcaggucauuuauuuccaaagagcaguuuaguggcccuaguuuucuuauacauaaucauuagcuauucagguacauuaucaaauguauacuuucuugccucuauaaaaaguuuaaucaaaauguuaaugucauagacauagaaauuugauauauuaauaaauagaaacaaaauuaaauugaaguauauguuuaggaauaccauuucuuuguugacagaaaguaaaauugugugauuaucugugugcauuauggauugauaaacaacuauuccaauaaaaauggaacauuaaaauuaaauaucuccauuccauauagauaccuaaagccauguuugcucaguucuauguaauucaucgcuaauuaucaguaagcguuuuucaugcauuuuacaauuaucaagggauuucauguaaauuagauccuagaugcucacaaauaccuguauacaauuauuaugcuaaauauuuucuauagaaguaaacauauauacacacaaguaagugucuguacacacacauacaaauacaaauaacugauaauugaagggguuaaauuaacuuucuucagaaaauaugugcagcauuugguacaguuuugacauguauggauggauguauucugacuacuuaucaaguugugauuaauauagcuauauaugacaaauggaauuaaaauuuuucauucauguguacguggcuaguaugccaauauuuuucccuguuacuaaaauauuuuaacuauuaaauuuagagauucuaggucgaugacuucuuagugcuauuaauuaaagaaauaaguaaaugaggauugggaaaagagaguaggaaaaguaggaaagaaaugaaaggauauucacgguacauuuuaccacuugacacuaaugaucaagguccagucauuaggucacacagcccuacauuugaauuucuucuauuucuuuuaucaucuguguucuucagcaaaugacuugaagauaacaaucuuguaucaugaacaauauaauaccaguugucuuauugugugccugguuauuacuauaucuacuugcuuuguagaaagaaauguauaaaacagaaauaucucucaagcaauguaaccucuuaaccucuaucuucuuaugcaggggauaauuuaugguuucauuagccaaucauuaaacaaacaacauuucuaagggccuacuuuggacucccauaguacuagucacucaagauauagauacgaauaaaaugcauccaagcauuuaagaguuccuuaucaaggacgaaagacauauauacagugaggagagacaacacaauuuugggagcucagaacagagguaccacagcauggaaagucaagaagauguuuucaaacauuugacaucuacucagcugagcuggguuugaaagauacauugaaauuuucuagcuucuugugggaaagaguauaagauuaauaugaguaaacuugaagaagugagaagaagucugaaauuccaaguacaucaguuguacuucauaguaaauuagguuucacagagagguaagaaaauaauugcuacauuguuuggcuuuugggagagaacauuccaagaaugaguacauagcucaaaaacguaauuacauauuuaaaaggaaaauaaaauaagagauuuuuauuaugugccaaaagugcaauuuaucauuugaauagggagacugucuuccugcagugaaaaaaugagacagugggcaucaagcuggcuguugacaaacuauugaaagugaaugugcaaaugcguuacuuuuacaaaauacaauauacuuucacauuagaugauaagaaaaagauucuuccuaaugggcauauauuuauggauauaagaauagauauugaagaaagaguaaagguuaagaauuaaucccuuucuuguuuuguuuuuaucugcaauccagagcuggcuauaagucauucaaaauugaagugaccuuccuaacuugauggccuuacuauuguuuaaauaagaucauaauaauuguuuaauucuuauuagaacaguaguaguguagaacucagggaauuguuuuuaaaucuaaauuuaauaacacugugaagcagauaaggagaugauuccauuuaauaugucagcuaacaauugucuccugagauuuuuguguaccaauugcaaacaguauacaauuuacaaauaucuccuaggaugaguaauaauaauuguaaaggacucuucuuguuuaagcagaagguuauaagcacuaucugagauauacaacagaagucaguguugauuuuaaaucaaacauugugaagaaaacacauuuuuaaaaguauaggcucuaaaagaauauguauaauuauuuccaauuaauaagcuguugcaaagaauuaaacagugccauuucuacaagugugaauuaaccugcaggcaccuaaaguauuaaauacacagaaugcgaagauugaaaagaagugucauugguaggcacauuaaaggaaaaauuuauguucauaaauucuagguaaaaucccaaccuucuugaucucuacaaguuuauaauuuacugauaaaacugagccuuuugaaagguucaucuuucaaaaauauucuggcuuugaaauuuaauuaugauauuuucaagcacagcuacaacuagagaauggcacagaguugcuagguugagucccuuuauauucaucucaugagaguaaagagaucagcauuuaacaucaguuuaacauuccuuuagcuuaaggaaccaaaacuauucuaauccuuagaaugauuugaauaugggugagaguauuaaacucuuccuuaugcauugauuaaauucuccggaguagaguggugagaaggaucauuacaugaaucauacauguaaguuaagaaaguguaucauaguaauuaagauugugugcuagagccagacaugccugaauuugaauaguggcucuacuaccacugaauuucuuuaagucucaguuacguauccuucaaaaaaggauaaaaacagugccuaaccuaacgggguuguggugaagaucaauaaagaucaugcaucaauauaggacucuucuuggccugugguccaggacaugauagcugcuauuauuauuauuauuaauguuauaccuaaaaaaauauaccagguuuggauugucuguuucaacauggcauguuuagaaagaaauauuuuuaagguuuagaguaguuuguuuguuuguuuugguccugggcauucaauacaaaagaaaaagaaaguagagcaacucaaagucuuauaggcugagcccaggaaaacagcaaaauagauuaguuugaauuuucagugaucuguuaugaguagcauucaaagaugcucugaugcuaaauucuugguuuaauugaucaaauaaauuaagaauugagauuaaacauuuaauacuaaacauauuuugaauacuguguuaggauauuuccuauguuguuucaauaaauauuuucuaggaaaaaagucuaauacaaauuaaacagaaauguggcgaaaaaaauaugaaguuuacugauaaacuuuugaaguuuaagaaauuuugauauuaaaggcugagcuuuauagagggaagaaauaucaacugguaacuugcuaagaaugaagauaaacccuaaauaaagaaaagucucuuccagcuaaagagaaaagcacuagaaagcauagcaucccuucucugauaaaaggagaaaguacauuaucagcccauuuugagauuggccaccuaaaauguugacauccuaaaagauugucuuugaagcaaaggaaaaaaagaaaauugaccaagguguuuucccccuuuugaagagaaaaauuagcaagcauuugacuuucaagggagagaaaaguaacaauauggauaucacuucccucuaguggugaaugaagaucccacaaagcauaccauggaguauccugucagaagacugaugauaaucuuuugcagaaaaauuacaguuuucagaguucuucuaaauguuuuaccucauugaauucucaaaguacucuaugagaauuuaucauuccuguuuuaaaagaagcaguagauucuuaacacagaacgcaaugaaauucuaacauuaauacauugagaauugggaagccucagauugagaccagauuuuaauagugauuagcuuucugauuuuauugagcuuauauaaugagguagaauagucuggauaguaucuuaaggccuauuagaauuaugaaguuaugucagcuuuucuguuuuauaucuaguaaguaguuaaacugagacuuuagcauugguaccauaucaucuggcccaguccucuuuucuccuggggcugccccucuugaauggcuuaugguaugcauuacuuuagucaugacuuaaugcaauguccaagaugcaucauaauuaaagauauaaacucucuaaugagauccacuuagauugaguagggaagaaaacagaaugagugggaaguagacuauggauauuaagaaauuaugaacagaguaaaacuuguagaaaacuugauuauaguuaauguuuuacaaaucauguuggaaguuggcaaauggcauguuaaauuucagcugacugggacaaaucaacagguggcaaaugauguaaacuuuguuacaugauauuuuccaaguuacauaugaacaagaguggcuacuacuagagagaaagaucuauuuccuuuacaaauuugaggguugacaaauuacagaaugaguaauagcuaacuacuuugaugaucuugaaagcugaaacuaguguuuacuagauuuuuaaaucuggaaacucauuuuauaauauuuucuauauuucacaguaaauuacaucuaaagaauaaagacaugcaaugccaaaauagagcauuuguauuuuccccuauaugggugaauauaguauuuguguagccuuuaaguugaccagugauacaaagguuuuauauaccaucuuauuugcauugggugcgggacaacuuaacauaaauguggauguuuggcaccucuacauuuguuauagaccugagcaacaucuuaaacauccaaacaguaacuugagaacaauuuccacaagacacugcuuuucaacucagguucugauguaauaaaauauuagauguauuuuaauguuuuucaucuagucgcucccccauguuggugaccucaaguaguaaauauaauuuuaaugguagaaaacccuauuuaaugcaugguaacaucucaaugaauuccauuuccauuuguguagcuuuuuucucagcauuaucgcucagccauucuacagcucuccugggaaaaggcagcccuuauuguuucucaauuuucagacucugcacaaggaauugcuaaguuuaugaagucagucacaagagguguauucauauuuaauggauuguuuggagaguucagcucuuggauuaugucauauuuuguugaacuauuaugcacagucuucacuuuacucacaguucuuuagagcaaagggaaauauaacuaacagaaagacugcauaauuuaauugcucuuauucuaaacacuauucaaauuauggucucuucuuuaauaauugcauauauaagauuaaucuaguuacaaaauaauaaugauaauaauaauagcaauaauugaggaagaagaaggaagagugagggauuagaagaaagaagaaaagcauguauggauaaccugccauguuccaggugccaggccaauugcuuuaugcucauugucucucaucuuuacagcaugaaaauaguguuguuuauccuggcuuuaaaaauaagauguuugagguuuauagaguuuuuguaacuuacuagugauaauuaaacuauuaauaauagcuaacauuuguugagaauguccuauaugcuauaucugagcuaaaacacuuuuucauguucucucauuuaauccuuagaauaacccuauaagguaagcauuguuuuuauccaccuguagagguuaggaaacuaccacauagaaaguguaaauaauugccaggauugacaaacuaauaaguaauucagcaggaauucagagcuggaacuuggauucaguagguaguacuaugaccggaugguucauaaguaucaaccaaacauuucaggauacgugcugaaguuagccugauaaaacuauaauauuauggaccuaaaauuuugagugaauuguacacaacuaacauguuuuuuaucuaaucaucuucuucugucauucuuaguguauugcaugaagcuuacuaacccucugcucauuuacucuggccccaaccacuuacuguucucucaugugugauuuccuuuucagagcuauaauucauuauacucucucuuaguucauggagcuuauucuuuguuuuuuccugugaaaagcucuugcacauuuuuccuuugauucugccaacuuucucucuagcuaccuuauuugguaccuccuuugcgaaaugucuuucugcugccuacuugcaaauaucuucugcguucugcagucugaacacccucuuuguugccaguaauguugcuguuguugcuacugacuucacugagcacagagaagaaucacuaugcuaaacuuacucucuguuucuuuuauucuugcauauggcauauaaaacucugacuuucccucaaagcuccuucuaacaacaguccccaaacuucccuuucccauaaagucugggauucugcagagaagguacauuuaucugucaagacaacuaagaaaaacuaugaugugcccuuggaaacaucuuauauacggcuguucaauuacaguucuacaauaaguuaaacuuguuggauuugccuuuaacaugucauuuauauucaagcagcuuugucuauauucaugcuaaucuuucuguuuggaaugcucucuuccaaccugcuuucccaucaguauuuuccauuaaaaaaauauuacucauacuugaaggccaaucucaaaugucagcucauuugugaaaucuuuuauagcuccuccagcagaagaaauaacauccucucaaguucuuauacauuuuguagaccucuggauuacaggauuuagcaaauuguacugaagguaauacaaacaacaauuaccaauacuaaauauugagcucuucaaguuagggaaguuuuucuuauguauaguaauauccucaacaccuggcauuagauagucacaguugaugaucagcagacuuuuaaaucauuuguuuauaguguuucaguuuagauuuuccaagaagcaguuaucaauauagaauuugauuacaguauuuauaggggaaacaagaaagaugaaagggauggagcagaacagacaggaagagacuuuaggcacuuauacucaucugaugucuguggaaggagagacagaggaaggaggauugaagaaaaccuucaaaaugcaguauaguucuuaggcagucuuugccuggcugauaggaaguucuugagcaaagaucagaagaaaccccaaacaauaagaaaugucucaguucuaguaccccuaugcucaaucacuuaaagaagccugggaaaguccggccuuggcaaagauacuguguuggaugugaaagugcacaacuggaggcugacagucagcuaugcucccugaaguagggucucuuaaagagagguuucagugguccacuuuucccagcaccaugcagugcuuuaauaagcauacuucucuuuucagucucauuaagucaauguacuggaggagaggggcuuaccauuaaaaucauuaugccaguaauacugaauaaggagacaagagaucuagauuuuagucuuaguuuugguacuuagaugaaugacuucuucaugucacccuugcaugugugaauuucauucuguaugauauuaugugaaacuuuuuuguuuucauuuuaaggaaaauaugaagugucacaaauagaacuugcuaaaaagcaaaccugugggaugggucuuuuauuaacuauauauguauauauguacacacacacauauacacauacaaacauauauauauauauauauauacacacgcacacacagauacucauauauaucagucaauacaauuauaaaauuuuaauuucaucauauauaacacaauuauaauuauauaauuguuauuucaaaaugucuuucaauuuagaccuuauaaagccagguuuaagaacuguguaguacacuuauuauuuauuuggguauauacuuccuugggaaguugcuucauuaggaaugcauuuuuuuacuaaaagacccaaaauggaaauauaaauuauaaccugaacauuuuauuuguauguauuuauuuuauuuugagacagagucuugcucugucacucagccuggaaugcaguggcaugaucuuggcucacugcaaccuccaccccccggguucaaaugauuccccuggcucagccucccaaguaacugacuaacaggcaugugccuccauggccagcuaauuuuuguauuuucaguagagacaggguuucaccauguuggucaggcugguuuugagcuccuggccucaagugacccgccugccucggucucccaaagugcugggauuacaggcaaaagccauugugcccagcuaaccugaacauuuuaaaaagacaaauuguguauauuuaagguauacaacaggauauuaugggauacauauagauaguaauaagcuuacuauacuaaagcaaguuaauauauccauuaugucacacaauuacccauuuuuuguauuugcuuuuguagcaaugacagcaaaaccucuauuaaauuaguaugaauuccacauacagugaaauuuuauuaccucugguccgcauauuguacauuacaucucuagacuuguucauucuacacaucugcuacuuuguauccucugagauacaccucuccauuuuauuuucuccccucuguccuucucccaaccucugguaacugcuguuucauucucuuuguauauuugaauuuuuuaagacuccacauauaagugauaucaugcucuauuuuucccucaguguuuggcuuauuucccuuagcauaauguccucuggguucauccaucuugugacaaauggcaagaucucuuucuuuuacacauucuuuacccauucaucuauccacagacgccuagguugcuucccucucuaggcuauugugaauuaugcuggaaugaacauguuaaugcaguuaucuuuaugagauggugauuucauuuuggggaguaggguggguauaugccucaaagugagauuucugcaucauauggugguucuauguuugcuuguuuauuuuuagaacauuccauaguguuuuucauaauggcuauaccagucuacauucccaccccaagaguauacguauucccucuucuccacacacucacuaggugugagcagcuauagcauggacaaagaaagugcaagagugacaccaagagaugacuuccagaugauguagagggacaauugaagagaauaaagaccauccagguuguccucucuagcagcauucugcccaaccuuaucuugugcuucaggguuauuaucugaaguacaguugaagauaaagagcaaaacagcugccccauguuguugcaacuguuaaucaaacugaaacccugcucagaagcccauggacauucaaugucaaauaaacucaucuaaaauaucagucauucuaaaaccuuaaaggccaaugccuaugguucuaguguguucuuuaccacuguccuuccuccucuucauuuauugcuucgucucaagaacacuacagucaacaccaucauuucgccgguugauaccacugaagguauucccaucagacauggugcaccaucagcaccacagucaccauuuugcucaaagaaacagcugugaggaggaagcuauagaaaaaaaaaucccaaacuaacugcugcaaggauccagaggaggaagucagaaucuguaacagaaaacaaagcagagccucccugagacaguuuuaaacccuagggcucuuauaacauuuuguuaguggccauucuaaugggguugaggugguaucucauaguaguuuugauuaguauuuccgucaugauuaaugaugagcacuuuuucauauaucuuuuggccauauuuacgucuuauucggagaaaugucuguucgggaaauuugcucauuuuuuaauugggugauuuuuuucacuauugaauuguaugaguucuucauaaauuuugaauauuaaccccuuaucagauauauuguuuauaaauagcuuuucccaauccauaccucuguuucauuuuguugauuguuuccuuuacuaugcagaagauuuuuaguuuuuguaauucuauuuauuuauuuuugcuuuuguggccugagauuuugguauuuuuuuuuuuaaauaucacuuccauggccaaugcccagaaguuuuucccaugcauucucuuuuaugaauguuauaguuuuugguuuuauguuugggucuuuuauccguuuugaauugauauuugugcaugauauaagaguacaguuucauucacuuuauauccuuuuugugccuuucucaauaauuaguuaacuaucuagguuuagauuuguuucuugacucuucauucuuuuccacuggacuguuucuauuuugugccaguaaaauacuguuuugaauacuaugucuuuguaauauaauuuuaaaucaguaagugugaugccuccaacuuuuucuuucuucuuggaauuguuuuggcuacuuggagucuuuuacgguucuaugcaaauuuuaggauuuuuuucuauuucuguuauaaaugccauugggauuuugauggguauuccauugaaucugcagauauuuugcauaguauugacauuuuaacaacacuaauuuuuugauacauuggcaagggauaucuuuccauuuauauauuucuucuucuaugucuuucaucaauguuuuauaguuuucagugugcagguauuucacuuccuugguuaaauuuauuccuaggguuuuuuuuaagcuauuguuaauaggacuguuuucuugauuuauuuuacaguuaggucauuauuuauguauaaaaaugcuacuuauuuuugucuauugguuuuguacacugcaaccucaucuuaugauugaaaaaauuagaauaaaaugccuaguacuuuaugccaaguuagucaauaugcuuauagauauuuauuaaacuuuccuuugcaaaacacaguucuuagaauucuaaaagugcaaaugcaaauaacuaaauaauuacuuaauacuuacuggacacauacagugugcuaggcacuguucugagcauuucaccugagcuaaugaauuucuccuuaccacccugcaucaguuaauuauugccacaagaauacuauguaacaaauaacugcagaaucucaauaacauucaaaacagcaugguauuggaacaaaaccagacacauaaagcaauggaacaggugagagaacccagaaauaaagcugcacaccuacaaccaucugauuuucaacaaaggugacaaaaaaaagcaauggggaaaggacacccuauucaauaaaugcugcugggauaacugacuaagccauaugcaggauugaaagggaacuccuaccuuucacuguauacaaaaaucaacucaagauggauuaaagauuuaaauguaaaaccucucacuauaaauaccuuagaagaaaaucuaggaaauaccauucuggacaucagcucaggcagagacgucaugaugaagacaaaagcaauuaugaaaaaaccucuaaaauugggaagugucaacagagaaaacagacaaccuauagaaugggagaagauauuuacaaacuaugcaucugacaaaugucuaauauccagaaucuauaagcaacucaaacaaauuaacaagcagaaccaaccccauuaaaaaaaugagcaaagggcaugaacagacauuucucaaaagaagacauacacacagccaacaaguauaugaagaaaagcucaauaucaguaaguauuagggaaaugcaaaugaaaaccaaaaugagauaccaucucacaccagucagaaaggcuacuauuaaauuaaaaaaaacaaaacaaaacaaacaaacaaaaaaaaacagacgcuggcaagguugcagaaaagggaacgcuuauacacugcuggugggaauguaaguuaguuagucauguuuaauugaaauaauuauuagagcuagggauucuccuaaccaaaggagaaaaagaaaugucauagaauuccuagauacagucuaagcauuaagagcuguaaaaggccucucaagucucugugagucauugguguccuaauuuagccuaguuuuuuaugugagcugucaagcagaauagguagagggcaagggaauugcugugacagugugccacuaagaacagaguuaauuggaauuccgcaagccaaugaaugugugacauucagagaagaaguggaccaauaaauguaguauacucuguuuagggacugacuguaaaacucacagaauacaacuggcuauuggucacaaauucaacauauaugauuuuuuauaauuaacugucaauaaaauaauagggaaugcaauggucauuauuucaauuaaacaugacagauuguuccuuugaguauaaacccauccugcuaaaaaaaaagaacaaaaacaaaauaaggaaaaauaugcaauuuaauaucuuugacugccaguuuuacuguuuaaaaugaauucuuuguagucuguuaaauaaacacuccuuuuaaagacaucugagaacuagguuaauauuguccucuauuuguaagcccuugagauucuagacacauaugacuuuuucaaaacccauauuuaggaucuaaaaagcagccagcugugcuucaucucugagucauucugcucuucucaauggagaccuuauuggcccuuccuugugcugucuguguuggagguguucccuagucauuguaaaaauaaccugugaguguauugaaauuuuuagaaggcuugaacaacagcaaaaaaaaaaaaacaaaaacaaaauauguguucuauaauuacguuuaaauggcauuuugaaauuuucagaaggcuugaacaauaguaacaaaaagauguauucuacaauuacauuuaaauggugguguuguuuuucuaaaaggucagaauauuaauguuuuauguaagaaaauuaaaaaauaggcaguaugaauaaguuuuuuagaggaacuuugauauauguuguugaagacuaaaauuacguguauuaauuuccauaaaaagaagauaauucaaaacauggaauuguauauguacaaugauguucaauguacuauuaguuauaauaaauuauuagaaaaaugaaauaaauguucaguaauaggaaaaugguuaaacugugauacacauuaaaccacucauaugugauucucaguuggagccacugcauucugguaaauuuagcuagaaacuaggcauuuugcaugauucuucccacuuccuuacucaucacaucauaucaccugugccuggcuuugaauccuuacucugucgguugcuaaaaauauaccaugaguaaaguugcauaccuucuucuugccucaguuucuucauuugugaaauaguaguaacagugguaucuaucuuauuugguuaaccaagaucauauaacuacuacaacacuuagaucgauuucugacaaauaauagguccacaaugaauauuagauuuucacuauugugaagaugaugauauaauuauuucuuuagucauuccauuuuaugugaaaauguucauugaauucaucuugagucuauggccauacaacccugaacgcgcucgaucucaucugaauuuaucuugaaacugacuccuuacuauucccagauuuugauuccuuuuccacugaaauccagcuccuauuuuguagccacuaauauaagcuaucuacaucuggccauuucauuucccuaauuaaaaccgggcauugaucuccccuggcauauauaccuuaucgaggcauagaggcuucccaugauuuguuccugcuuacaaaugcaagcucauuucucaccacucuaccuuccauuuuguauccuagccaucccacagugguuuuguuuguuuguuuguuuguuuccccucauacaauuccaggcuguuuucauuaagccacuuucauuauccaagucuccuguaccugagaauacucauccagugcuaacauugauuaacuuuuauucauccaugaacaauuagaucagugagugugacauccuucuggagcuagauuuaguccuucucuggacccucauaauaaugugugucuauauuucaucgacuaccuugcauuuuaauuauccauuuugguauucuucuccauuagaguuugaauauauugauggcaaagucuuaagauuguguaucucuggcuccugguaaaacauuagcacagugauuggucuaugaaugcuuugaacaaauaaauguuaaauuaauauaauuguaaacauuuuaaaacucuuacaaaaaguuauauagucacagagaaaaguuugugacauccucugagguaagaaaaaucaacauacaaaauuuugcauaaaauucuacauaccauugcuagaacugugcaaaaaauaucauaggaaaaaagaugacugacuuauggaaauguguuguauuaacuuuccuauuaauuuccaaaaaaacuuuauaauucaguacuagugcaauuuguauugcuuucugagaaagucuucauaaaagagucauucaguucugaauuuuagcugucuucuaaggcuugcaaaguaucuuacaguguuuauaagucuucacuucccugacauuaugcagauuuaaaagcuacauacuuacauucaaaccacugacauaaaauaguuuuauuuauaauguccaugccucaaugcaaggcuaguuuaagcuguggaguuuguggaauaugccaguuuuaaaaacauaagaaaccguuuguggaaaagcagcugugauuccaaauuuugcugucugguucuguaauacuucuaaaauuauuauuaauaauuuucuuacagauggagaauauugguacuuguguucacauguguuuuuuuuuuaauuuaccccuaguuuaaacacaugcuugaaacauacaccuaauuuuauuuuccaacauaaaucaucacuuuuaccucagcccuuugacuaauggaacuguuuccuagacaccucaaugcaaucgugaugccauuguagucauugcacuaguagcaauuuuagauuuuuuuaaagaggaagggcgaacauuuugcauuuaagugacuuuugaaaaccacaugugaaagcccaauuagacucuuaaauuuaucacuaucauaaguagaggaaaaaucaggauugauagaacauuaauuggaaucuggagaccagugauaacuucuagauaugacuuaccuucucuguagguuaauuuuggaugauagcuucuggaaaauuuguaagcauaaccugaauccacuuauaaacuaucuucaucuguuguugauggguagaugagcauccacagcuaauaaucuaaugaucuguuauauuuaaaagaacuuuauaauuugcaagauaauuuaaaaugcaccauaucugugucuaaucuacacaguuuugguugauugaaaauaucgggggaaggggggagggauagcauuaggagauacagcuaaugcuaaaugacgaguuaaugggugcagcacaccagcauggcacauguauacauauguaacuaaccugcucauugugcacauguacccuaaaacuuaaaguauaauaauaauaaaauaaaauaaaauaaaaagaaaauaucauacacauuauagauaaaaugacuaagucucagagaguuuaaacaacuugucaaagcugagugaacacuugacuucuaauucuguguuuuuuguuuuuguuuuuacuauccuucguugccucccuuagauugugauaauacaauguuauagaggcauaaagccgaaaauuuuuuuuaaauuuuuuuuaauuuuauaagaaauaacuuccugcucuuuuggcccauuaacauuaggaugcaagcuuauaacauuauuuggaaagaguaaugugggaucuuuguucuaauucaaauccagacaugaggcuugcuaagugacuugaugaauaucagugaaucacucaggucucaguuaacuuacguguaaaacagaauuuaaaaaugccuaaaguagcaaaacucuggagacaguaaaaggaucaauguuuacucagaguuggaggggagaaagaaaugaauagacagcacacagaggaauuuuaaagcaauuucccugcucuauaauacuauaaugguggauacaugucauuauacauuuauccaaacauauagaaucuccaacuccaagagaaagcccuaauauaaauuaugaacuuugggugauaaccguaggucaauguagguucauucauuguagcaaaugcaccacucugguggggaauauugauaguaaaagagacugugcauguauaggggaaagcggcauaugggacuucuguacuuuccacucaguuuggcugugaaccuaaaacuucucuaaaaaacagucuacguuaagaaaguugcaagauaaugaaauuuacaucuucauaccaguaaauuuaaaagcauaaauaaaauugacaguuuuuuuaaaaaaaacaaacgauugggauguccauguuagaagauuguugugaaacaaaaugagaaaaugagaaaguaguuugauuauuauaagcauuccaggaaguuacaacuuuauuagcauugccacuaucauuauuauuauuauuauuauugagauaagagucucacucuguagcccaggcuagagugcaguggcaugaucuuggcucacugcaaucuccaccucccggguucaagcaauucuccugccucaaccuccugaguagcugggaugacaggugccugccaccacguccagcuaauuuuuuguauuuuuuaguagagacaggguuucaccauguuggccaggcuugucucgaacuccucaccucaggugaucugccugcccuggccuccaaaaguuaugggauuacaugugugagccaccaugucggucuucauauuauuuucaucuauccuuuauuauuuaguagagcaggaauaacaaugaaaagauguaaggagauguguaaucaagaucuggagauuaggccauuagaaauuagauagcuuaaaaagugaggagggaaagucuaguucauuacuguagacuuuuucuuuaaaaaauuaacuuuucaaacgcuuauucuaaagaacauguuuaugauuguuucauucgaggugauaauccaacauuaaauugcacugcauuaaaauaaauuuaaucccuggaacaugugaauaugaauauauuaauuuuccuagcaaaagcagcagaugaaaauaagauugcuaacaauuugaccuucaggcuggugugguggcucaugccuguaauccuagcacuuuagaaggcccaggcuagcagauugcuugaacucaggaguuugagaccauucugggcaacauggcaaaacccugucucuauaaaaaauucaaaaaauuagccaggugugcuggcacacaccuguagucccagcuacuugugagacugaggugagaggauugcuugagugcaggagguccaggcugcagugagccaagaccaugccacuacacuccagccugggugacaaaaugagacccugucucaauaaaaaauaaauaaauaaaauaaaaaugaaaaaacuugaccuugggaugguccgugaauucuccuggauuauucaggugggcacaagguaaucacaagggaagagagacauagaagagaaagaaccagagagaaccagagagauggcaauauggaaagacgugguucaacaugucuggcuuuaaaaggggaggaagggucaugagccaaauaaggugggcagccucuaaaagcugaaaaacacaaggaaacagauuccgucucagagccuccagaaggaaugcaaaucugcgaacaccuugauuuuagcccagugagacccauuucagacuugugacuucauaacugcaauguuuguguuguuuuaagccacugaauuugugguaaauuguuaacagcaacaacaggaaacgauuacaauauguuucacuugacaaggaaagaauaccauuuuuuugaaauccauuuuuuaugaugaaaaauggauuuuuaaaccuauugugaaguguuuuagggacuauuagagcugcuugcauuuaaugaugggcccuuuauuuauggagaagacaaucauguccucauuauuaauauuauauuuaugaauuauauuuggauaugaaguuuuuaaaagugucuuuuaagguugcauguugguauggucaugcuaucuccuguuuuuugaagaagaguacauuguggcaaauggaaguagcugccaacaaugguguuugguucuaaugacaaaauuauugaaauaauguagaaaaggaacuaguagaaauauuuuauuauaccugccuaagguggaagaaauucuauuucgggcucuuuuauugaaaaagcaaucauauugguuuuauuaaaaaaugaaaauacugcaucauuaauauucuauaauuuuacaucuuggaccucuccauccuuccaccuacugcugauucauaauaucaaaauguuuaguuccaagccacuacuuuuuuccuucaauuuccuguuuagacaacuuuacuuuaaaauuaauggccugacaaggaaggucuccaguugacuuucuagaagagucauuugacauuacaaaacuuuaauuauagaaaauacuggguucccaaacauaacaacuguuuaaugaccugagaaaaaaauguuuaguuguugaaggaauaguuuaagauuuuuauauccauuuaaaacauuauuugguguuuccucauaaaacuucacaaaacaauaauguuucaauaacuguucuuagaaauauauugauuuuucucuugauuaaagagggggaaugaaguugauucugaauaguuuacucaaaauucaagcauuaaaguuuuuauacauaacuuauuuuucacauaggucagauauugcuaauauuuaucgaguaaauuuugacaauauacuauuuauggcaaaaaagacaaagcauuggaaggaaaucauuuaaaguaacagcagacaaagaacucacagcgaaaaauaacuugacuaaacuucaaaagcccuuagaaucucagccgaagguucuuguauguaaacauguagcuaucggugauauuucuacuugagagcagcuucugaacuuuucuuuucuccauguuucuuugauagaaucccaauaggugccagaaagggcaaagggauacuuuuaugugcucuuacaccaugagcgucuguagauuuuugauguuccauguaugcacacaaauuuagagagauauagcauucuaauaucuuuauauugagauugauguaacucuaguaauauuuauagcuacuguuagauuguuuguauuggauggcuguuuguucuuuuaauuuuugauucuuccacaucaaauuagcucagagaaaaauuccuuccugcucuggaaaggggagggaaaaacagccauucugaaauacacccagagcguuguguucuucuuaacaaggccuacccucauagccuauuuuggcagagccuaccaugugggguuuuauucaagaccaaagggaaaaggaaauaccaauagccugcuguaaccuuucugucucaucuaacaguggggaaaagagggcacugagaagcauuuaugaaggucaaagcccaggagcacagacuaacuaaaacauugagaacaaagcauaaggcuaucccacaccuuacacucaaauuaguaggggucuuguauaauaacagguuaauggaauuuaaaggacugcacaucuaagacuuuauuuaggaagaaguccuuaaggaaacccaaaaacaacagugaauacaaaaacaaggaccacagaagaaauguuagccucugauaucuacaguuacaucaaacuguaaacaugucacauaagcaaacuugguuguuucagcuacaauuguaaacaaaugaauuugcucuguugcucauugaaaaucaacauaggacuugcaaggacaaacauuugaaagauuaccucuuuuucuggcuuagcaucaccccaaaagcuucugaauuucaagaaugauaaagcuuacauuuagcugcucauuccagauuccauuuugaauaccuaucaugugccagacacuaguauuacugcagacaauacaacacaaaucccuguccauagggagcuuuuacauuccagcugagggagacaaacaauggacaaauaagaagaacuuacaguguguuaaaugauaauaauugcuauaaaaauaaaucagggaaaacaauaagaaugaguuggcaaaacuucaaauauuaucauugaaaaagugauauuuaaggaaaggccugaaauauagauucaugucaauuaaaaacuaacugauauaaaagaagcauuuauuccuucauucaaaaaauauuugagugcagguaugagcccugagcgcuguggaggaacacagaacuaucuaaaacaggagaaagauuucugaacacuuaggaaauauacuuagaauuuuauaaaagauguuuuaaagagguacacauuuucuauaggcaucuaauugaaauaauauauaguacugaguguaaggaaaucuagauuuaaauuuccugauuuacuguaaacucccaaaacugguauuaaugaucacauacuuuuauuauuucuuucaauauggugguuucaagcgauaucuuacucauuuuccacagaacauuaguguguuaagucuuucauuugucuuucuacucaccucccauuugucagugaaccuuuaacugacauuuauuaaaguucacuaaauuuggaaaagauucucaagcauuaggaagugucagacauaauuuuguguuaaaaacagugggucagaaggaaaggcucaucaguauagauccauuuaauggagaguuuggcauaaauucuguaucacauaaaaaccuuuucagaaaaagcacuauuugcauaaagagaaccauuggagaauuuauacuucauuaaccuguugaaucuuguaaaaguucagaagccgaaauaauauucaaaaccauaaagaagaauucaguggagacaauauacuuaauuccuaaauuauaagauuauacacuaaguucagccugaggcaaaauaucuuauaauagacaauuaacuuaaaaucagaauugaaaugcuauagagcaauauagccacuauuaaauuaauauauaguguaauaaauuguuuauuaagcuuuuaaaguccaguagguugauaucuaauagaaugugcugaaaguuacaucuugcugauuuuucacaaaaagauagcuaaaagacauaaaaauaugauuuugaaagaucugauuuacaucugaugcuuuccuaauacagacauuguaagaauuuuguucaacaacauuuaauauccuuugcugauaaugagcuauugaauauguauggauaucugacuccuugaauuuuccaacuaauuaucaugauuuuuuguauggagaaaauaauuaauacauuuuucuuaugauauuaaauuuaaaaauuguuauaucuucuuucuuaugguugucucccaucauuuucugguucacgcuaauuauuuuagcuacuaugcauuugauaaaguuuccaaaaccuucaccaaauuugcaguuacuuuuuguacgcacauucuaguuucuuaguuuuuguuuguuuguuuucucucuuuugaagacagggucucucucugucuccuaggcuggagugcaguggggugaucucagcucacugcagccucugccucuugaacucaagugauccucccaccucagccuccugaguagcuaggacuacaggcgcaagccaccacaccuggcgaauuaauuuuuuauuuuuuaauuuuugcagagacagguuuuugccuuguugcccaggcuugucucgaacaccugggcucaagcgaucugccugccuuggcuucccaaagugcugggauuacagacacgagccacugcucccagccugucagugcucuauagacugaaguuacuuucauggcuauuacaugguagagugggauguuuuuuuccuuuggccugaaaaagauauucccacuaauuccacuuaaaaauguuaacuugaagaaaacccaccagaaaaucuucauuuucuuaacuuucaaaauuguuccuguguacauaccuguguguguggguuuaggcaaaagaggaauaggaagaaagaaagaggacauggaagggggagugaaaaaaaaaggacuggcucuccucuaacaaguuucucuuaaaauuuuaauauaaacaccuggccagguuuugugguucaugccuauaaucccagcacuuugggaggcugaggcugguggaucaccugaggucagaccagccuggucagcauggagaaaccccaucucacuaaaaauacaaaaauuaacuggguguggcagcacaugccuguagucccagcaacuugguagacugagacaggagaaucacuugaacccuugaaccugggagguggagguugcaguuagccgagaucacgccacugcacuccagccugggugacagagugagaugcuugucucagaaaaaaaaaaaaaaauaauaauaauaauauaacuaccuuauuaaucaugacauuauuugucuauuucugguacagacuuuuuguaaaauuuuuacaaagucucauuuguaauuuggaauaauuaaugcuuuagagaugaguuuuauaaacuaauaaauguagaaugacacauuaguugaagaaagcgauugauccaaaacucagaauaacauguaauccuuaacauuuuacagaaggauauuaagugaacaucucucagggccugucuaaauuuaguuucacaaagaaagcucaacuaaaaacagcuauagcuucagggaaaaaagaaaagacaguuuuguuaaacuguuuuuguuguuguugaaaauacucaagaaaucucaaaucagaggacaguucuacagugacaauaagaaauaauagaaauaaaaauaccauuuugcuuuaucccauuuauuuagauuaauguagucauuuuauuuguacaaguacucauauguuauauaacacuauauaugauuucuuuguuuuacuaauaaaaacaaugguauuuuauuaaguuuauaaaaguuauauuuacuuagaaaauaugauaauauugugagaauuauuaaauucucacuuauaauucaguuauuuaaauuuguguuuucugaguuuuaaaaucucuaucuuauacauaaauaggaguauguuaaagaauguguuuacauucuaugaguuuuuucuuauucuuuauacucuaaagagguaagcuuaaggaaaucauggacaaaggaaauggcuggaagguggcuuugauuuuaauacagguuguguagugaaacauuauuguuuacccugacaaaauguuuuuuucuuauuuuuggaacagcaucuuguuuuaagauuuugcaucucaucugaaacuaaggauacugucugaguggcaguggccauucuuuuauaaaauuuuaucucuguaccuucagggauuggccuagguguuagcuucaggcucaggcuaggcaaaucauuucacuugaccacuacuggccauaaagauuaauucaggagucugucacuucaaucaagccauuuaaguauucucuggaauauuauuuuauacuuuguuuuuguuuuuaagugguaaauuauaauuguguauauauauauacacaaauacuacauguaugcauaggauacacuaugauauuaugauauauguauaaauuuaaaauaaugcagucaagcuaauuaacacauccauccgucuuccccagauccuggccucugguaaccauaauaauacucucugcuuuuaugagaacaacucuuauaaguucaacauaagugagaucaugcaguauuuguccucucuugccugccuuaauucacuuaacauaauguccuccaggaaaugacagaauuuccuucuucuuuaaggcugaaugguaugccagugugcauauuaccacauuuucuuuauccauuugucugcugguagacacugagguugaguccauaucuuggcuauugugaauagcgcagcaaugaacaugagagugcagacaucuucuuuuugaaauacugauuucauuuucuuuggauauauacucagcaguaggauugcuggaucagaugguaguucuguuuuuaguuucugaggaaccuccauacaguuuuucauguuggcuaauuuacaugucuaccaacaguguacaaggguucucuuuucuucacauccucaccaacacuuaucuuucaucuuuuugauaauagcuauuuugacagguaugaggcgauauuuuuuuuaaccugaaacuuggcaguaaaagucucuuuuauuuuugguagcaaaauuaaaguugugcgcucaaagauucccuggcuguauguuuugggaaaaaagguauauauuuugagauuucuuguuugaaagauaaaggcacauagauaaaaggagauaaauagagaaagaggugcccggucucuaauuccagucuauucuaccuauacauugcccuuuccuauuauauaaacucuuauugccuaacguaguucaaguugaauuucugacacugcaauccaaagaguucuaagacagacaaauaaaaauauaacauauucauucaugccuaaucaaaaaccaaugugagagaggagaagauagauacuuagaaauuauucauaguccuccuuuccuuuuugcuaccuaucuccuaaacuaguagcacuuaaaguuuaagaauaguggaaagcauacuuuccagaucagagaagauauuuuacucaacuaccauaguuugauggauaguuuuauaaguauuuagaugccgagaauggacaccaugccuugcuacaaaaucgauuucaaauuucaauaagcuaguugguaagaaggggcacuugauggauugaaugagaagggagaaggaaagaguauggcaauggaagaaacaaagaauaggaaaugcuucuuuuccugcugcaagcacaaauaacaccuaaaggaaacacuauuuguaaugcuucauccucuccagaauucccuggauaugcuguuggauuaaugaucuaggaaacuaggugucauagcuucaguagaaucaucagaucuaaaacugcugauagcaacuugugcauauccucuuucuggcuuaucuuuaugaaauaauuuuauuaguuaauguugacaucuuuguuuaaaauguuguuugaccaacuauuuugcuucuuacuaaacaguguaucuucuguauaucaaaauaugguucaccgcuaagcuauguucugaacauuugugaccacuguaauuaaaauuucuaaugcuauauuucauguaacagagaaagcuguuguugauguuaugcucuucuccucuccaauauucuuucacuaauuguaauuuucuacacagauauuguucugauaaaucacaauuguuuaauauaauaccaaugauaauagauccaacauaaugaacuaugucaaggcucauaccuucugcugcagcagccccaaggagaaaaaaaggaaauggucaugaaaaaaaaauuaucaagggucauauuuuaaaggauacucuaaaggguauuuguaagacuugaaagcaaacauuugauuuggaaguuagcuauggugauacuuagcauacaaaaaugacauuuuaaaaauauuccucugccccaucuuauuuuucagaguuauacccauuaaucuaaccacugcauuauuuaaaaaucccaaauauauacacuuuauuugguuccuccaccuuaauuuucuuucuauaaugauaaaggaagcaagaaaaaaaagugaagacaacaaaacaaaaacagagagcugugaauguaaauauucaagacacugauggucuagaaaauuaaguguuagguccucuacagaagaaguguaaaaauucugaaagcaaagaaaauauuuaaggaguacaaauuguuagauuuuuacuuuaauuugaaaacacuuguauuaguaaaaugacaaauguuuggaaguugaaaauaaagauuggauauuauuugaagugcagauacacagcauaaagugaaaauuuggggaauauuaaagcugauucagagguuugugugacagugcuugagacugguugaccuuaagguugaagagcagguagagacuugcuaaacagauagcaauaccuggucuuagacuauauuccugcuucuaucacaaaauaaauaaauaaauaaaaauuuaaaaaaaaaacaguuuucaagucaauggguuacauucuaaacauaagcuaccuucuuuuaagaaagacuagggccuuuucaacggucguuaaagguucagagcaguuguucacaacaagguaaacuguagcuugaaggaaauaauaauuuccucccaaagcugaaggaacuuuuguuuccauagucugcauacuuuucucagugaccugaaaacuuacugauggaagccuccuuucccauccaaccuucuuguuucugcuuuuacuuuacuuuaaaaaaaaaaaauacuugucugaagauguaugcaagcuaaaauuaguuuauacuuccuguauucugggaacauucaguuucaugguaucucuuaauuucaaguguaauuuuacuuacaauaaaauacucauuuucuuugauaccauucuuauuuuguauuuuauaauuauuuucaguuacuaauggaaaauaugaccuaugugccauaauuuaauauuauauuucuacuuucuaauguuaagaacuuaaacauaucuaaaucuauaucuaucuaucuaucuaucuaucuaucuaucuauuagauaucugucuauguaaucuagcuaucugggcauauauuauuugccuugacauuguuucagaaaaggacaaaauuaauguuuagaaguuuugaccuggcuucuauauggaggcaccuucagauaauuuaauuaaauuagauaacauguacuaaaucuauacugagccuaguuuaacaacuaaauuguucuaaaacuacauucucaugucuccauuugcuuuacuuguucuucagauuuauagcuugacuacauuuacuaguuaauccuuucuaauuauauguuuguguuuaucauguagcgcaugguagaaagaaagcaaguaaaagaaaaagcaaaaaauaacaucaguaauacuuuaaaugcauacaguaguuaauaaaaagauuuuauuguuaacuucacgucauagguuagcagaauagacucuggagguauagguuuggauuuguauuuuaucacuuacuaaauugaugaccuuauuuacguuauauauuacuuauuguaaaagaaauguaaucuggaaaacuaaauagcauaauuaaauucgggauggcagcaggauagaauacuguuaaauaacugcacugcaacaauuuagugaaucucacaagaucuuuauaaucccuuuuccaagaaaaacugccauuuaauaaauguuauacaugauuuuauuuaauaaauaaaaacugaaggaaagauaaccuaaaucuauuuuuuuaaacaccagcaaucuguaacaucccuagaaaauugucuagaacacagcauuccuaccuuauaacgaaacuguaucucuugcaagcaacaagaaauuucuguuuauaauuuucuaauuccuagggcucagaacauugcuuauuauagagauaugcaaaaaaguauuuguuguuuaaugaacagucacuuaaauacugcuauccucugcagucugcaugaaaucacauaauaagaccaugauuguucuuauguccaagucaauacuucauuggucuaacugcaucagcuugucugcaggggauuucuggagguuugggggcuuguuucauguauuuucaauaaccaauuuaucacuuguuguucuacucuggaacccuguuuucuuggcuauguuguguuugcuauaugugugacacaaagaugucacugcuuuacuaagcauggcaguuuuaaugaugacugucacucugaacuuagggcaaugguguaagucuuccuguuuuauuuugcuuuguuuguuuuucuuuuguuuguuuguuuguuuguuuguuuggcuuccucuguagccuaggcuggagugcaguggcacgaucucggcuggcuuacugcaaccucugccucccggguucaagcaauucugccucagccucccaaguagcugggauuacaggcaccuaucaccacacccagcuaauuuauuuuuuauuuuuauuuuuuuuuaguagaggcaggguuucacuguguuggccaggcugguuucgaacuccugaccucaggugauccacccgccucggccucucaaagugcugagauuaaaggcgugagccacugcaccuggccuuuuuguuguuuuuaugucauuuucuugugcacuuaauuaauacauaguuuaguuaaacugaauuaaauuaucuaaaacugguuaagguaauuaccuuuuccauaacuucuaacagcacaaccacacccaaucuguaacuuuuagcauugguugaaugaaaaauuuagaauaaugcauggccaggcaugguggcucaugccuguaaucccagcacuuugggaggcagaggcaaguggaucacuugaggucaguuguuaagagaucagcuuggccaacacagugaaaacccaucuccauuaaaauacaaaacaaaacaaaacaaaaauuagccaggcaugcuggcauacuuguagucccagcuacuugggaggcugaggcaggaggaucgcuugaacccaggaagcaaagguugcagugagccaagaucugccacugcacaccagccugggugacagagcaagacuacaucucaaaaaaaaaaaaaaaaaaaaagaaagaaagaaagaaaaaauaaauaauuaauaauaacaacagaaaaacucacaaaacacagauagguaaaauaccuggcuuacaucuaggguaggguuucacaacauuuguccucuugauauuuuggaggauagucuuugaauaauccuacccguacauuguaggauguauaacagcaucucuggucuccacucacuacaucacuguaacacucuucuaauuauggcaaucaacgaugccuccagacaaaugcccccuggggggcaaaaucuccaugguugaaauacaccauggagauuuugaacucaccuaggguaaaauguaccagcuaacuucuaacaccagaaauacuccaagccaccacaaaccuaaaucuagaugcacacuucuacaaaggauauuaaagagguucaucucgcaccuguccaccaccugguaucuucuucagugccccaggaauggccuuuuuccauacagcuaggguaugcuugugcucuuuaaaaccaguuucuuuacaaaucuguccuagauuaugaugaaggaacucucagagcugcguucucuuuggcaguaauuauuuccuuucaaguucuggaguuccugaaacaacugcucaaagugauaacauacaacucaguaaauauguaauuaaagaauccaccuaauugccccuauuaaacacagaaguucuggguuauuucacagaauucaaucagccaggaaacauggauagauccuugcuauguaauaacuuaaauaauaguuuuuuauuuauauaucccuaagaaccaaaggauugacaacaaaaauuaaaauccaaaucuuagcccuugaaggcagaaccuacuuguacauuuuuauaaggcauuuuucuaccuucagguaaucuuaaauucuagccucaaaaggaaugcccuguuacauaaaguaguaauuuuuagcauucugauaaagcuccauuuauauaaaagccuuacugaugaucuuuccagaaaaacgaugcaaauauaauccccuuuguuaguauuuucaggagcgagaaucaugauagaaucuauguauauaguauuggaaauuagaauuauuauaaaguuccaaauuuggauuucaauacuugaacuauuugacuuauuucugcugcuccuuuggucuuucuguaauugaaaauugacuuuuuaguuaaaaauauuuuuauguuuagucacauaaacaauacaauuccugaaauauaauauccuuuuaaaguuguaauucuaauaguugcauauuguauuuguaaggagaagaagaacuaaugaaacuauugagauauuuuuaguuuucuuaauguuuaauuugccuucccaccugggcacuuuagggaauuugaaaguauuuugauauaauauuccagugagaaaagucaucaccaaauggucuguccuuuuugugcuaauauuguucacgcaucaacuccuguuucuucugagaugguagcagcuguuugaguuggaaaaaggaaugaaaccuugauaguuucacacucaguucugcuguauaaugaacuaagcuagcuucugaauauccagcuuauauuuuagaggaaagugagauauugcuugcagaaacuuugguuauuugcuaaaaacccaauaguuaucaaaaguaugcagacacauuuucaaaaauauauauggaaugaaccaauuuauaaaaucuauuuaauuuaacuuuggcuacaaauuauuuuuguaucaaagagucaagaaacuguuauaauacaccuuaauuuuagaucaguuuauaauauguauaguuuguguguuuguuuuuauuuaaaagcuaaauuaacuaaaagauacaaaaugugaacccuaaaguguucuucuauacauaagauuugugcauuuaucaucgauaucuuuuuacaucuuauuuaaauaugaguaaucguaucccccaaaaguucuuagaaaauaaucgcagcagcaaguaaauuauauucaaauaaaauauaugguaucagacacaaagaaaguuggaauacuuaaugucuaagcaaagcuuugcauucuucuauguucuuuaaguucauggaaaccaaauauuuuaauuuguguagaauagguaugugacacugcuugcuauauguaauauuuaaaguuagcuagugauuuuccucuuuacugaaguauaauacuuuauacuuggaguuguccuugaagaccacagggagguuuuacauugugcagaaucuagugacccauuuacucacuaaugugaauccaauguuguaccuauguucugcugugccuguuuuaccucugagugauauucagggucuuguguuuaaucaaccaagacuuacgugguuuggccuauuguuuucucacaggugacaguuucuacuaacuuacgaggauagagguuacggaacggcaaggagacuauugcaaagacucuucuuacucuuaaauacucugcuucucuggcagaaauaaaaguuuacagcugaaaauauaaccugcauagauuuuaaaaccgaaguaucaaaaucagcauagcaguggacaucuacaagcacagaagaaaaugcucaugucuaaacuuuaguagauauguaggaucuaguacacaaauuucacauuauugaggcaaaguacucaccaucagcagucucagcagauguuuuauucagccucgcaaggaucaaagaacuguguuugauuucauuuuagauucaguuuaacauguugaauuagaucuuaggucugaucuuuaucaacugaauucuucuuacaaaauguuaaugauuuaaaagaugagcaauaucuccauuucaauuauagucaucauauuuuuaaaguccaccagaguaauggccuuggaucacuagaucaacuaagauaugcuuuagaucauaaguuuuauuauucauuuucacaugauagcucaguuuauuguacaaauugucuuucaaucugauauauggugaccuagaaaaagggcuuuauuuucaugucuauauagauaacucugugccaguucugucugacuuaaaauugcauccaaaauuuaagaagcaaaugcaucuggcacagacagaggagaaggaaaguaagaacagaaaaugccagggaucauugagugaucuguugaguggagcugguugggccacuguguggucuguugaguggaguugguugggccacugugucacaugaaaaguguaagacuauuugaggcagugaccccuuccacugcaucaguagcaaaguggacccugcuaccugugagccugccauagggcagcugggcaagagcuacaccagcacuugagagcuacacuaaaaggaacaauuccauagaauauccuacuuucuguauuaggucacugaagagacauuacagcuugccaauauuacagaauauuauauucauagaauauuccucaggaugucuuuugacccaaagccuacauuucagacaaguuaccugcccaucuuucacaagugacagcguaccacuaucucaaguggcagagaaugccuggcucucacguagagcuucucacauaugcugcuggaggaaauuucaaaauuacugaucccuuccauggcuaaucucagcaugcuuuuucccauauagaccuguauuauagcuuuagggagucccuggcucuaucuuccaguacuuccaugaauuggauggugaaaaugggagagauuugcucaagcaaauaaucccugauguuugcacugacaacagcuaccaccuguccucuuagacagggucucauaguguguaguuuuauucuuaaguagguaugcagcaguaauuuugucuaucagguugacuuguguucuuggccuguacaaggaauggaaaaggcuucaaagggaauuagauaaccuguaugucaguuuaaugacucgcaguccucacaugaugaagugguauugccuuggauucauagugagcaguggcuauggguauggccccaguagguuuucuuugucuuuauuuggaaaugauauacucauaccagauaggauguuuaaucuagccuggcucagauuuaagagauaaccucuucauauuaaaaacaaugcuuuuauaaucaugcaccagcuguaagugugaagacagccuuacaaggggcacaaugguuaaacucccagucuuacauacauaucugucuauaagaaauauaugugagaguuacaaaaugcagaaucuggaacccacugucauaaaagcaagucaucaaaaugcugaaauuagggaugaauuaacauuuauacuaaauguaucuuuuaucauaaugucuaucacugauguaugaauaaaaauacuuuuauauuuuggaagugaauugaagcauuuguauuaaucuccaauacaauauaaaacacacaaacaaacagggcuggacaugguggcucacgcuuguaaucccaacacuuugggaggccaaagcaggaggaucacuugaggccagggguuugaggccggccugagcaacauagugagacccuaucucuacaaaaacaaaacgaaacaaaaacauagccagacaagguggcauaugccuauagucccagcuacucaggaagcugagguaggaggauugcuugagcugaggagguggaggcucuuaugagcuaggauuguaccacugccuuccagccuggauaacggagagacacugucucaaaaacacacaaacagacaacaacaacaacaacaacaacaaaacacauacaagcaagcccuguuuuauuaauauauagaauagaaugaguaaucuggaagguaggaaauuucacaugaauugagauuuagauaauuucuuucuuauauuuaaaaagcagacaguaauacaaaaaauuuuguguucaaauuaaacaagaaaaacauuuaucaauuuauuuauguauuugugugaaacuuuuccccuuccauguauuuuagucuaucaauucugcuuuacauugggcagaaauuaugaaaugaaagcaggaccaucacagaaacacuguaguuccuugguuugaggaaugaaaaaagacuaugguagcaacagcaaugacaaaaaauagcaauacagauguaacuuugcauuuauugaagaaauauuuuguaugcauagcaucugccauagauaguacaauucugucaacaaaagucaaucucucacuuagaaaaauaauauuuugcuuaacagugaaguucauuugaaguguaaaacuaauagaaauuagaugauucuuucuacugcuuucaaaaaugugguuuguguucuuguucaagacauauuuugagacauuuuuuugaaaccuugugaaauggagcugguagccuuguugacucccaagccccaaaauagugcugagagcugaagagugauuuuauauuucaguaguugaagauuuacaacaggaauccaaaggauuauucauaauaguacauaaaaagcauaaaaaugauuauucaaacagauagagucagaacacguuacaucugugaaaauuucuaaaauauuuuacuccuaugcuauugcauacacauauaauauaguaccguucuuccagaagaaucauguuaacuucuuguaagagguuguaggccuuuuucaaauguuauggcuuagaucauuuucuuguaugugaaacuguugaaguaucaaaagcacacuucaacuacuuuccaguauuguugcagaccacccuguuucuuggauaagucaaaugugacauuucauugagaccugcuuccuuacuuuuucuccauauuuccugucaauuuaauguuuguuguaucauguuaauagcuacucacuauuggacaacuguguguuagacaccaaugucacauugccuuuaugaucacauucagugucugugaaguacuugucgucauccccauuuugcagguaaggaaaccuaggcuuauuuuagauaggaaauuugucugaggucuauucucugaaauucaauauaucauucugccuguaaagaucuugaaagccuaaauuggcuuuauuaauauuggaauagauucugcaugguucaguaaauguuaaaaauauuuuauaucauaggacaaugaagauacauauuuuauuuucaauuaauaaccugagaagugaaaaugcccaaauaucuuauaaaucaaauauaauuaaugcaucuuuuuuugagaauuugggucaugauuaaauuacuagguauaaagagauaucauccuugccaaaauguuaauuauuucaaaauugaaaucugauuguucuuaggauaauugacaaagccacuagguuauaugauuuggcuacucaugacauugcuuuccuuaacuugugauuuggacauauuaugaaggaugggauucuuccucuaaaguuaauaguuaauuuuucauuguccuuuaacugcuaacauuugaagugaacaguuuuauuacuaaagagagaugcuuuuggaaccacuagugggauaaaagucguagugguuuuaucaaugaugaaaagguuagaacaauuagaaaguacucaaggcguaauugagauguaugaacuucugguacaccgugaaacuguuuuaaaugguugcaaaaaaaguagaaucagaauuauaaaaagaaaacuaaauacagaguucauuuaaggauugcuauuuucuaccauguauuuuuuucacuaggggacaagaauuugcagaguuuuucuauaauauguaucauuguauauauuguaauuuauauuuacuauuguauucaaacaauaaguuuacucauagacuugccucuaaugauagucucaucuuuuaucuacccuguucaaaugugacuucugaccuucauccugaaggauaauguauuaauguauugauguacucagugaccuguagacauuuaguaacuuccaaagcaacaaggcucagauuugcccuguaagucauguguaaagaauauuaaccuaaagguauguacgaucuuaagauguaauaagaauaugucauuauaaagugcuuuauaaacuuugaaugcacauguucauauucugagugaaguaaaauuuuuuccaugaaguguacagucucuaacacuuuguuaauguuugaaccagcuaaaaauauuuccuauuuggugaguucguacuugcauugggcauuccuagaaucguucucauucaaaggauuuuuuuaaugcuuuugcucuagaaauuuauguagcccauugugacaugaaggaaagugagagcuuuccgaguuacacugauaacagaaauuuauuuuggaagagguucugagaacacuggcucaacaacaauuagccauucauggaccagagaccagaauaauauaaaacaaaaaaugaaaauuuggggaggggucuugauuugaaugucuagugaauucgguugaaauacauuccugacaucucaggaacuucaccucaucccuuaaaauguucacuucugugucuuaauugucucccucuucauugcaucaaaccuauuggcguguauacaugcucaucucuugccaaaaguaaacacaaccaaauucacaaaacaauugucucucaggcccaaaucuauccagguuacaucuccccacgcaucugcaaugagauacucacauuugcugucuccacucauucaacacucuuuuauuugucaauuuuuuuauaagaugacauauacuucaaucacuacccagaaacuuauuucaccgagaguaccaucugcuuucuacuauacuaaucaaugagcaacuuucagcccuuaguuuguuuaaauuauaagaauuucauaccucaagaccaccuuucuucuuggaauuccuuuauucuuguuuccaugcuaccgugaguuaguagauuuuauuccauucuucugccuuuuucuucuuagucuacuucaguaucuuuuccacuuaucuuuuaaaagcuauuauucauccagguucuguuuuuaggucugauuuucuucucacucuaaaugagucuaugaauaauuucuuucauaugagugguuucaaucacuauuuauacacuaauauagagagacagauagauaauagauacauauuauuuaacucuaucauguaucaucaccaccacuuaucuaaauucugacuuucaguucuauauauuuaacugcuuuuuugaaaucuucauccagaaucacaauauaaauuuguauauauucaaacauaugauaauaauaauauuucuccaaauuuuaguuuuuaacuugggucuuuguauuuaaaaaauacugcuaucaugauacaguuuggaaacaauauaucuguguuauuuuagacuuugcauucuaaauagugugugcuuuuguauuugugugugccuuuucuccuuuuuccugauaaaucucacuauaguuuuauuccacugaauuagucuuuucaagaagccaucugugggcauaauugaucaucucuaucaugucuuuguuuccuauuucauuaauuauuucuuugcagcuuugcuuuguuuucuuacuucuuaaguuggaugccuuuuuguucuuuaauuuuuuaauugaacuuuuauuuuagauacagaggguacaugugcagguuugguacaugggaacaaugcaugaugcugagguuuaggguauggauccuauuaccaagguagugaauauaguaccgaauauguaguuuuucaaaccacaccucccuuucucucaguaaucuccagugucuauuguuuccauauugauguucaugugugccugauguuuagcucacacuuacaaguaagaacacaugguauuuaguuuucugucccugcguuaauuuacuuaggauuugaccccugacugcauccauguuucugcaaaggacauaauuucauucuuuuuuuaugaaaauauuuuuaugguuguauuccaugguguaaauguaucacauuuucuuuauccauucuaccauugaugggcaccuggguugauuccacaucuuugcuauuugaauagaacagcuaugaacauauaaguacaugcuuauuuuugguagaaugauuuuccuuuggguauauaauuccgaguaggauugcugggucaaaugguagcucuguuuuaaguucuuugauaaaucuucagauugcuuuccacagugguggacaaauuuacauuugcaacaacagucuauaagcauuccuuuuucugugcagcuuuaucaacaacaacucuuguuuuuugacuuuuuauuaauagccauucugacuggugugagaagauaucucacugugguuuugauuuguauuucuuccaguauauuuacuuaaagcaauaaaugccucuucaaauaucacuuucacuaaguucauuagcauucuauguguaguauuuuuguuauuuaauuacaaguguuugaaaaaccccauuaugguuucuucuuuaacgaaauauuguuaauuacuauuuuaauuuuugaauguauaauuauuuuaauauuccuuucauuuguuuacuuuuuaauuuaauuagauuauggucaaagaauaugauuuuuacuauuucuuuagauccauuuuaugcuuaaguucuaauauguaaucauuuuaaaauugcuucauauaagcuugcguaggauguguaauccuugucuguuguaugcaguauuccauauguguucaucaaaucuauucuauuaauuguucuacaaaaauucuguaucuauuauuuuaauagagcauccauauuaagagaaacaaauccaaauauucuacuuuaauauuacuaugucaaauucaccuuguucuguuaauuuuauguauacaauuuuggcuauucuauuaggugucuacaucuuugggauuacuauauauuaugaaugaauugauccuuuuauuauauaaagacacucaugauguggaaacauuuauaaaauuuuuaugauuugcuugauuuuugucuuuugaagaaaucaauuuuuuucuuagaucauagaaguauuuuuauauucucagagaaaauggcaauuuuguuugucuuuuacaauuauuauauuucccguugacuucucuuauugcauugacugaaacuuccaguaaauuuugcauaguaauaaugagaguaaaguguccuuauucuuuuaaaguguuuaccauuaacuuuaaaggguuuuuaauauuuuauuauugauuaucauguauauguguguauguaugugggggugucgcuauacauaauuugcauccuauuguauuaucauuucuuguuuaucuguccaaaaaccuauugaguguaaauuccuuaaagggaaaucugcuuuaaaaaaucaaaaacaaaaaacauuauaucuccguugcuuaguauaaugccuaaaauuaguauaaugccuaaaauauauuauguagauuaaauaaguauauuuaauaauuuaaguauuuauuaaacuaaauuauauuuauuaaauuuaaaaugaguaaaucaauaaauauguacugccagaagcaaacauuuaugcauuaaagaauaaauaaggagaaaaccauugugcaaaccuuuuguucuucauuucguuucuuguuuguuucucuauauuguaagaaauuccuccucgaaauuuguuaaaauuauuauucuaugaggacgauguuuggugggucaguuagauggcuuuggcuguuauuuuucucuuuuuucauuuuuccuuucuguuguuuauuuguuuauuuuuuaauaacaauugcuaaaggaguccaaggaguuguuguugggccauuaccuaaaacaagcaagcaaaaggcaagaugagucaggaagauugugauuauguaagcuuuguguuguuauuauaauauuuuuguuuuucaaguuguagaaugacauugcaaaaaauaugugaauaaguaaaauuaccauuuuuuggcuuuguaaaaugcuggaaucucauauuauagacuguaauauaaaugugcauauuuuaaaaaccuaaaauucaccagcaaaucuucacuguugacagcuuucuggucaguguggcuacagaaguccaggcuuuuccauaaauuaaaaucaguuauacucuagauccauucauuuuacaaaguggcugcuagucaaauaccauaaaaaaaagucacuguucaaaauuuaagauuugaaacagacacuguauuuucauguaucaucuuuaauauuugcuaagaucccagguaaacucauuuaguuugguuugacaaccaucaaagagucaucagaaauaucuuccucaaauucauuucaguuuauuuuuucaaugguuguauuuacuuauuguagaagcaacaauuucuauaguagccccuuaaccuuuacaccuucaagaggaaaucucaaccagauuuucucuuuuauuauauauuccuuuuuaaaagaagugauaaaugacucuacuuuccaagucaauaugugacaguuacaaauucauaguauauuuguaguuugaaagacugugcuucaugacagguggcaggauugguggugauucaaauuaauacuaaagaauaauaaaugaauggcagagaaagucugcaaaaucuuugucuuaagacacucaguuuuggaaauuuaaugcccauaaaaugaauugcuacuaggcaaauuaggaagggauucggaauagugauaugugaagacaacaacaugaagauaugugugacaggcuuuuucaacauaagucugauauucaaguuauaaacuggucucaucuuaaacuuacuauauaaggauacuuguccuugguguuuuuuuuucuuucuuuuuucuuucuuucuuucuuuuuuuuuuuuuuuuuuuuuugacagaguuuuguucuuguugcccaggcuggagugcaauggcaacaucucggcucaccacaaccuccgccucccagguucaagcgauucuucugccucaccuccugaguagcuggcguuacagucaugugccacuaugcccggcuaauuuuguauuuuuaguaguggugggguuucuccacguuggucagucuggucucgaacucccgacuucaggugaucugcccaccucagccucccaaaguucugggauuacaagcaugagccacugcacccggccuacuugguggauuuaauauacuaacuuuauagauugaauuaauugauugugcuucaugguuccuugagaaauguauguguuaaaauagacuauaucucaaugucuauuuuaaauuuaguguauaauagcauaugacauagaacggaagauuuuaagaagcuucuucgucugcuuuacaauuucagaaaucucaaugcagauucuuuuuaugaacugauaugauuuggcuguguccccacccaaaucuaaacuugaauuauaucucccagaauucccacauguagugggagggacccagggggagguaguugaaucauggggacuguucuuucccauacuauucucgugauagugaauaagucucacgauaucugauggguuuaucagggguuuccgcuuuugcuucuuccucacuuuuuuucuugcugccccccauguaagaagugucuuucgcauccugccaugauucugaggccuccccagccauguggaaauguaaguccaauuaaauaucuuuuuguucccaguuauugguaugucuuuaucagcagcaugaaagugaacuaauagaguaaauugguaccaguaaaguugcagggggguugcugaaaagauaacugaaacuguggaagugacuuuggaacuggauaacaggcagaggcuggaacaguuuggagggcucagaagaagacaggaaaauuugggaaacuuuggaaccuccuacaaacuuguugaauggcuuugcaaaaaugcugaaggcgauauaaacaauaagguccagccugagguggucucagauggagcugaggaacuuguugggaaccggagcaaaggugauuguuguuauguuuuaucaaagagacuggcggcauuuugccccugccuuagagauuuguggaaacuuuaacuugagagagaugauuuaggguaucuggcggaagaaauuucuaaggagcaaagcauuugaaaggugacuugggugcuguuaaaagcuuuccauuuuaaaagggaaacagagcauaaaauuucagaaaauuugcagccugaugaugcaguagaaaagaaaaacccauuuuuuuuugaggggaaauucaagccagcugcagaaacuugcauaaguaacaaggagccuaauguuaguccccaacaccauggggaaaaugucucuaggcuauaucagaaaacuucacgaccuagagacuuagaccccuaggucccagccacucgagccaucacugaaaggggccaauguagagcucaggcuguugcuucagaggguggaagccacaagccuucgcagcuucuaugugguguugagccugcgggugcacaggucaagaauuggagguuugggaaccuccgucuagauuucaaaggauguauggaaaugccuggaugcccaggcaaaaguuugcugcaggggcgggguccucguggagcaucucugcuaggacagugcagaagggaaauguggagucugagccccuacacagagucucuacugugguacagccuaguggagcugugagaagagggucaccauccuccaaaccccagaaugguagaucuaccaacagcuugcaccaugcaccuggaaaagccacagacacucaaugccagcccaugaaagcaaccaggagggaggcuguacccugcuaagccacaggcguggagccacccaagaccaugggaacccaccucuugcaucagugugaccuggaugugagaccuggagucaaaggaaaucauuuuagagcuuuaaaauuugacugccccgcuggauuucagacuugugugggcccuguaacccauuuguuuuggccaauuucucccauuuggaacugcuauauuuacccaauaccugcaaccccauuguauuuaggaaguaaguaccuugcuuuugauuuuuacaggcucaggaggaagggacuugucuugucucagucagacuuuggacuguggacauuuagauuaaugcugaaauacuaagacuuuaggggaauguuggaaggcaugauugguuuugaaauaugagaacaugagauuuggaggggccaggggugaaaugauaugguuugccuguguccccaccuaaauaucaacuugcaugguaugucccagaauucccauguguccugggagggaccuagguguagguaguugaaucaugggggcuggccuuuuccuugcuauucuugugauagugaauaagucuuacgaaaucugauggguuuaucagggguuccauuuuugcuuuuuccucauuuuucucuuguugcugccauguaagaagugccuuucacugccugccaugauucugaggucucuccagccauguggaacuguaaguccaauuaaaucucauuuuguucccaguuucggguaugucuuuauaagcagcaugaaaacgaacuaauaaaugaacacauauacaucuaaauuuuuacuuuuaaaauaaaauuuuuauugccuuauaugacuuaugcccgauacauacaaacacaaagacgcacauaugugcauacacaacaaauacacauugugcuguuuccuuauaguaaaagagaugggcuaagucagacacaaccaaaauucauuuauuauaaguguauguaggucaaugaagagaauauagucccuaugauuuugaaagcaauuguacaucaagacauaguaggaaaugcaaccuuccccaaaauuucacuauagauucuacuuauuaauguagccacuuaauuaugugauuaccuguaaauggcauuugcugugugcacuuaggcaaccuacugagguguuaaaacagcaaauuaaaucagcuuuacagauacaauagagguugaguaacgcuuauucaacauacuuaagaccugaaauguaucugaauuugauucuuuucagauuuuuguauauuugcauauauguaaagagauaucuuggggauggaacccaagucuaaacacaaaauuuauuuauguuucauguauaucuuauaaauauggccuggagauaauuuuacacaauauuaaaaaaaaacuugugcaugaaacaaaguuuguauauaugggaccauugcaaagugaaggugucaucauccagccacccaugugugcaaucugugguugguuggcaucaccaucauuucuaacucuaaauuuacaagcuacggagaagaaaucauuuucuuacacuuacucauauagaguacuuaccaguaaaaaaaguaugacauggcauuaauagagugaaaaauaauguguucaggguaauggagcagcacagcagcaucaccagaauaccugcaucgcucuuaaacaacaacagacgauggcaggcuuucuggcuccacuuaagauguuguguuuaauuaaaaaguuauuguacacuuguggcauuauuucagugcauuuggggcauuucagauuuuaacuuuugaauugaagaggcucaaccuguguugcuauugacacagugaaagaacgugcuuuugcccaaaaauauaguauagugaaaacauaguauugugaagacaucucacucccccugccccaccaccacaacagccaaaagaaaagaggagagaaauacacagcaugugaaaacagaggaaacucugagaaugcugcucaauaauguccuuuaacuuuuaaagaaaaacuauaagguauguaauucauauccaaaacaauaggucacagcagauggaguucuuccauauggauggaguuaguaaaaagaagcccuaauuggagugucaaucaccaagaaaaaaauauuuuaagaaaaucaguagaaugacauguuaguaguauugcuuuaugauaauucugaguaaagaaaauaaggaaaaauaaugaagguagagauaaagauuggaguggaaucauucagagaaacagugucaaaacaauuauccuaggauaucaacugucuugugagaugugucuuauacaacuaaaugccgcuuaccuauggaggggcaaaaaugcaaucucuacccccuaguccaaccauacuuaacaccaaaacaacccauuucaucgaguggacaaaaacaauguagaaaagcaagaugcaugcacauucacuugucaacuuuaaguuugcacaugauugcuucagugcccuaaacaaaauucuguuucacaccaucuugcaaacucuauuuucugcuauuacauuuaguguucacaaguaacaaaaaugcuguucaacaacucaauucacuugaaguaaacucuaaaugauuaauguacuuggaauaaaaauaaaacuacaugggaauacuuuaaugaagucagaagaacacacacaauagaaaugauaguugacucugaggaugcauuuuuugagcauaucuuucuacuuacuauucagauaauugacauguauuaguguuaucuuaucccagauauuuaaggaggucuuauaguauguaauuucacugaauuuuuuucccuuugagggccagguagacauuuuuuuaaaaccucacucuuuauaaaacuccagauucauuauuauuaaggaaauacuucagaugucuuccaaacaguuccuuguuaaaucugacaacugcaugacugacaugcuuuuaacaaggguuucuguugcaaguacauagguaagguauccagaauauggaaggacaaugcaagcccuggagacugaguugcauaucuauauuuggaugaaagaccaagaucaaaucuccucuuguaauuuucuaaagggagagauauugcaaggaaaucagagaaaaaucuuuauguugguuuuaagauacauggggguacagucagggaagcaagaagauauuucaaaagaagacagauuucucccuuugaaguauggaguuccacuagacccuguuccacacuacacuuccuucuuucuugucucugaaauuuggacauucauuagagaagugagauugugucuuugggaaaaguguucaaaaucuaaacagcuuagcuauaaaugguggacauuuaaggaacaucaauggugaaacucuacaauguuguuuugcuucuucacacguaaaauauaugucucucuaaucaugaauguaugcuccaugcacauauuaauuauauguccugaauuaaauucauaucccauagcauuuacaguuuaugugcauauauguaguuuguuaucuguuuuuaacaguguuucuuauaguuuuaugauugcauccucuuuacauuaguagaauacaccucaaaggcaaauagcauuggaaaauuaugauaauauuagauaauuauguuuuuucacucacuauuauauccccuuauguauacccauagucuaguacaaaccuggcuaaucaauaacuaucuguuuagaaagugaaugaacgaaugauugggagugccugcaagaccuauauguuuuaaguaauuuagaaugaacauaaagaucuuguauguuucuggaacauucuacucaaaauuggugauauacuuguuuucuggaaucuuauucaauuaagcaguaauuuuccuuuuuuaaaaaaaaaaucuuaccucacagcauuugagggauauaauacuucuucaucaauaauauaauugaugcaaaagaggaaaaggcauugagaccaucucaggucuuucuuacaaaucucuccccaguugaaaauacugaauggaugaauauauauauauauauauauauauauuauauauaucauauauauaauauauauauaugaauauaugauauauaugauauauuuagaaccaucuucuuuguuaucaguacauuuuccugaauugaagacacagcucaauuuaaaauaugagauaauaaaaggcccauauucaauaaaauguguauauagaucaaaauuuuucuauuuaauaauuauuuaaauuauacucacuauugaguggaaaguaucuguuuuagaugacauccuuaagugcaucagaaaaaguagauauuuaaucaugagaugcaccaacugcaaaaaaguuaaucagaaaaauaaugaauuaauauaauuuuugcaaauuacacacauuuaaaaaucuaaaauuauuuauauuuuauuaggaauuuccauugaguucagagucuuuuaauguuuagccacauugauuccuuauuucccacucaugauauuucuuucaggauuaaaggacaucaguuuauguaucuuuauccucuccucacucucucauucacucuuugccuuaggugcaucaugacugucuugauuugugaacauggaaggaauauuugggcaugacuggcucaggccaaucuuggggaaaucuaguuguaaaacuuuaucauauucugggguucggacuuaguaaaaauaauugcuggcauauauaaacaaaguucuucuuaaucaacuuuaaagauuucucuuugacuuauuuuuuaaguaauuuagaaugggagcaggagagacagaaauaauaauuuuugagccucucggcuuccaacauuuuuacugccaaaacagagaaauaauuuauuuuaaaagagagaaagaagauuuuguuuugaguuuuuucaucagaacaguauugcucacaaauuuuagcaaauugacuucaaucagcuuucuacagauuuucauuaaacuuuuauagaaauuucuccuuugguuucaaggaaugaccuuacacaucccuucaugcuguagcaaaauguaccuuccaaagcaaauauauaaucagaauaaugcaauuaauuugaauguauuagauacauucuaauaggugcccuugaguccugucuuucuuucuagggaucaucaugauuucaagaaaaggaauaggguuucauguaggaucacuggaccugaaacaaacaaacaaacaaaaaaacaaaaacuaaauucugccucaguauucgagccacugaugcuguuagaauucaaugagauuguauauguaagguagccuggaagauaauagauauuaucaaauugguuauuuugcuuaaaugagacaagauauaugaggguauguuuauacuacauagugauauuauguucuaucacuaucugucuaucuaucuaucuaucuaucuaucuaucuaucuaucuaucaucuaucuagguaucagauuauuguggcuaguaauuggcuuaucuuguugccuaacuuaaguggccuuggucaugagaaaaucugucuuuuuugaugaaauauaggacaaauguuuugguagcaugaaauucauuauaacuuaaaauuauauucaauagcugaaaauugguuuacuuaugugaaagaucaaucucacauuuuuuauguccauguaucuuuauuugcaugugucucagauaaucuuucagaauugcguuuugcuuaguagaaaugaaaaaaaucacacucugacauaguagaaccuccuuaacgaagcauuaaauuauaaaaucuaaguaccaauuaccuccuuggucaggagggcauggaguuggagucuagugagguagaaugaaugaugaaguacgggccuucuccagcuucugcagucugauucucugauacggagaugcuuuguuaaagggauaguuacucuauugguuuauuuaugaugauugccuggguacaguguucaugcagcuacuucauucuuuuucuuuauuagcugcugacuuuuuuauuaucaugcuuuuccuuuuugcuauaaauuguuaauuauuaccuucaugacacuggguaaaacuucuauuaacugucauuguuugacuggcaguuauggagauuuacuuuugcuaaaccccuaccauacuagacagucauaaacuacaaggcacagugcauuagagaaaagacuuucugcuuuuguccuucagcccaauguaauuuguauguuuccagcuuuauaaagaaccuguuuauugagguccuguauauuuuaucauagagguguauuuaccuguuuaccaucauuuaaacaaagaauuccaucaaucaaauccuaaagaaauacauugccuuaaucagacugucacucuuugaccaacauuacugucacugauuuguuaaaaugaacuuuaauaagagguaccaauaaauugaguggugcucccauuugauugcauaguauuuuaagaagaugauaacucauucaaauuacaguaaccaacuuccaaauauaguucaggauaauauacacuauaagguuggauguuugauucuauuuauggaauguaugauuuugguauuuuuuauucuaguucccugguauaaauucauaccaugucaugacuggaaaaucuggacaaaauauagcauuuguauuuuuuauaauuucuuagaaaugacauaugcauacauuuugccucuuuacaaaguguucuuauaucuccacaggauggguccauguguuuccccuugcaucuuugguguuuauggccuauauuauaauaaugcuaaaccacucauggcucccuaaguccaccauauuacacacugagucucuucuuaaaaugccucuuuccuuucccuuuucucauauaccauucuuaaucuacuaugcuccccaacacuuuguacauuuuucgguuuuaggauuuacuacauuauaucauaucauguuaguguacacaaugucaggguuuacaucucuaaucuuuacauucauaucauucagcaaauuaucuaacacauauuagguaaugcuauauaaauuuucuagaaaaaaugaguaacuuuaacucccuuuucauaucuaaauauaaauuccuuuuggaaaguaauccugaaugagugaaugaguaaauaggugaaaaaguucuuccuuaauuaaauauaauaauuaugaauaauauaucaaguccaauuauuaaugucuaaaaauuacauacguauaauuuugaguauauucuucacuaacauuuaacaaaauauauuuuaguuuacaugaaagaaaauauuuuauuucgauugaaaaacaacugacuaaagaaaaaauuuuuauauugcucauacuacuuugcaugguuugaauauuuguccccuccaaaacucauguugacauuuauuugucacugugacagcguuaagaagugagacccuuaagaggugauuaggucaucugggcuucaucuucaugggugugaucacugccauuauaaaaaggagacuuuggacccuucuugcucuuucuugcccuuucuugcccucuuguugucugccaugugaugacucagcaggaaggcucucaccagaugccagcaucuugauauuggacuuccuagccuccagaacugugagccaguaaauuuauuuucauuguaaauuaccuguucuuagauauucuguuauaccgucaaaaauaaacuaacacauaauccuuuaaaaaacaacuguaacaacaacaacaacaacaacaacaacaaaaacaguuaucuuaaguccugaagagcaggucagaaaagaaauuaaggcuaggaaauugauagagugacauaaggauucagaaauuaauuccagccucuucaaccaguuucucuguguguaucauguugauaguuucaugagaacuagagguguucucucaaaaugaccugaccauuuaaucuuuuaugauuggauauggaauuguagugugauuauucuaggcacgagcaagcaaagauggagugguaaacucaucuaauggcuggaucccaaauaccaaagaaaguggaguagcugcugcuucucccaguucacaccuggcuguugucaaaagaggaagaaaaaacagagaagaaauagcacaauugagauaacuugcaauauauuacauauaauacaaccaugaauccauccaucauacaaucaagauaguaaacauauccaucauccucaaaugcuucccuaggcucccuguuaauuucacucuuucaucccucccugcuacaauugcauguuuccaguuaaacacugaucgacuuuuuauugauagauugguuuucauuuucuagaauuuuacauaaaugauuuuuuacaguaugugcuuuguuagauauagggauauucagguugucugccuaugagugugcuuucauauuuuguuucuuuaaaagaguuaauucauuucaucaaacuuguuaaauuuguuggcauaaauuuguucuuaauauucccuaguuauacauuuaaaaucuauagaaucugaguaauauuacuacauauuucuugauaaugaucaaauauuuuuauuuuuuucugaucaguaugauuaaaaguuuaacaguugcauuaauuuucuugcaucacuaacuuuuguuuguuguuuuuucuauuaucuauuuuauugauuucuaugcugaucuguauuauuuccuaucuucuguuuaauucgaguuucuuuuuuuuuuuuucgcuuuuucugguuucuuaagggggagguugaagucauuugguucagacccuuucuaaaaaauuacuaaucuaggccauuaaugcuauaaaauuucccuaaauacugcucuagccacauuggaaacauuuguaauucaccuuugauuuuuuuuuuugacucaugagcuauuuagauauguguuuccaauauuuaggaauuuuucaaauaucuuucuuuauuugaaugguuauuuaauuuuauuguggaaugagaacauacuuucuaugacuugaauuuauucuaauuuauugagacauuuuuaugacccagaauaugguguaucuuuauacauaauucauguguacuugaaagaauguacagcaugcuguuguuugguaggguauucuauaaaugugaaauuauauaaaguugguugaguuagaguuuuucauaugcuugcugauauuuuaucuaauugaaagauggauauuuaaaucuccaacuauaauugugaauuuuccucuuuaugcuugcaguuuuagcaguuuuugcuucauguauuuugaacauuuguuccuaagugaaacaguuuaagauugaauugcuguguaaucuuaauuggccacuuuauaguuaugaaaucaccuuuuuuaucucaguuuuucuuugcucugaaauaaccuuuuuucuauuauuaauacagucauuccaacuuucuuuugauuaguauucauagcauauauuuuauuauucuuuuacuuuuaacuuauuuaugucuuucuauuuaaaguauauuucuucuuggcagcacauauuuggccuugcuuuucaaaucaaauuugacaaucuuugccucugaaucaagguauuuagaacacuuguauuuagugugauuacucauauaauuacauuuagguuuaucacccugcuuuguaguuuucauuuguccucuuuguuguuuauuucccuuuuccuuuuuuucugccuucuuuuugacuauuggagugguuuuuuauuguuacauuuuaauuguuuuuuaaaaaaauaauuaguuguaugaacuaaaauaaaaugugcauuguaaaagucauaacauauguauaagaaaaaucuuacauauacuccaucauguuacccuuucuacuccuccuuauuccuuuauguauaucuguauuuccauuuguuauaauauuccuuaugccugaaguacuuuuuuuucagcauaucuuggagugugaugagucugccaguggugaauucuuucagccuuucugugucugaagaacucuuaauuuugucuuuguuuuuaagauauauuuuaaaugguuauagaacucuagguugacuuuucugucaguauuuuaaagaucuugcuccacugucuucugccuuacauaguuuugacaagaaaucugcugucauuuauaacacaaguggucuucuguaugcaaugugcuguuuuucucuggcuuuuaaaaaaguuucucuaucacuaguuuugagaaauauguuuauaauguaccugagcaccguauucuuuuuuauuuuuuuauuauaguuuaaguucugggguacaugugcagguuuguuacauaggucuacaugugccauguugguuugcugcacucaucaacuugucauuuacauuagauauuucuccuaaugcuaucccucccccagcccccacccccagucugugauguuccccucccuguguacauguguucuuauuguucaacucccacuuaugagugacaacaugcaguguuugguuuucucuucuuguguuacuuugcugagaaugaugguuuccaguuucauucaugucccugcagaggacacaaacucauccuuuuuuauggcugcauaguauuccaugguguaugugugccacauuuucuuuaucuagucuaucacugguuggaauuuggguugauuccaagacuuuucuauugugaacagugcugcaauaaacauacugugcaugugucuuuacaguggaaugauuuauaauccuuuggguauauacccaguaaugggauugcugggucaaaugguauuucuuguucuagauccuuggggaguagccacacugucuuccacaaugguugaacuaauuuacacucccauaaugaguguaaaaguguuccuguuucuucacauccucuccagcaucuguuguuuccugacuuuuuaaugaucgccauucuaauuggugugagaugguaucucauugugguuuugauuugcauuuaucugaugaccagugaugaugagcauuuuuucauaaguuuguuggcugcauaaaugucuucuucugagaagugucuguuaauauccuucguccacuuuuugaugggguuguuuguuuuuuuucuuguauuguuucaguucuuuguagauucuggauauuagcccuuugucagauggauagauuucaaaaauuuucucccauucuguagguugccuauuaacucugcugauaguuucuuuugcugugcagaagcucuuuaguuuaauuagaucccauuugucuauuuuggcuuuuguugccauugcuuuugguauuuuagucaugaagucuuugcccaucuugugcuuggauuuuuuuuuuuuugccuuuuuuuuuggacaaauugaguaauuuuuuuuuuuauuguuucaguucauuuuuuuugcuggcuaagaccuguggaguaauagcuuuauaaagucuggccauuuuuacucauuauuucuggaagucauuuuuuuuuguucucucacuccuguuuuggagauccuacuuaaaauuuuauuagggcuguugaaguuguucccaagcucauuuauacuuuuucauuauuuuaaauuauuucuucucuguauauuucauuuugggugguuucuauuacugugucuucaagacauugauccuuuuuacuuaaaacugcaaucgacugcuaaucuuauuuugugcauuuuucagcuuuuacauucuaauauaauaauuguauauccucuauaucuuuucacuuauuggacaucugaaauacaacaauaauaacugcuuaauacaugugcuuucucauccuaacauuuuauuucagagucaauuuugauugauauauuuuccuucauuacgguuuuuauugcuuuuuuuucuauguaauguguuuauugaaugaauguuagacagugugaauuuuauguuguuguuugccugacauuuuuaauccuauaacauuuuugugcuuucuuauuagaaguacuuuaguuacuuggaaauuguuucaucauuuaccaucuuuuaaagucuguugggcacauuagagcaauguucaaucuugggcaaauuauucuccaacacuaaggcaaaucuauugugaacauuauauguguaggugccuugugaauuaugagauuucaagucuagcuacuaaaaguagucacucuauugcauguagaugugauaccagguauuaagcuuuuuaauuuuguucagauaguuauuuucucuuccuugguuaguugccugaaauuccuggacugaucaguacuuugcugaauacuuuaggagacccuguugcaaauauugggguccuuucucugugaaauuccguugucucugauccucucuuggaaacugcaucauaaucccagucucacaguucuuucuucucaauaaaggaaguuugcugagcucugucuggguuugcuuuuccugugcugcagccuggaaacucuccaaggcaauaauugaugcauucauagaucuaacucauuuguuuuccaucucccagagaucacuguccuucagucccuaaaucucaugugucuggaagaaaguuauuucuuuuuuuuuuuuuuuuugguuuuguuuuuuuuuuuguuuuuuguuuuuuguuuuuuuuuuuuuugagacggagucucgcucugucacccaggcuggaaugcaguggcgagaucucggcucacugcaagcuccgccucccggguucacaccuuucuccugccucagccucccgaguagcugggacuacaggagcccgccaccacgccuggcuaauuuuuuguauuuuuaguacagacgggguuucaccguguuagccgggauggucucgaucuccugaccucgugauccucccaucucggccucccaaagugcugggauuacaggccugagccaccacgcccggccgaaaguuauuucuuacauacugucugauuguuuugguuacuuuauaaauucaaucucgggccaggcgcaguggcucacgccuguaaucccagcacuuugggaggccgagguaggcaguuuaccagaggucgggaguucaagacuagccugaccaacauggagaaaccccgucucuacuaaaaauacaaaauuagcuggguguuauggaacaugccugugaucucagcuacucgggaggcugaggcaggagaaucgcuugaacccaggaggcggagguuguggucagcugagaacgugccauugcacuccauccugggcaacaagagcgaaacuccaucucaaaaaauaaaugaauaaauaauaaauaaauaaauuaaauaucuuuuacuucaucuuggccugagggaaauccucauuuauuguuuugaguaguuaaaaaaaaaaaaaaaaggaaaccucuaaucuuaucuagaucuuauauaaaauaaaaacuagaauaaauguugguuuaggcaugaaauugccauuguauauauaaugucaauguuauauauugagucugaauaaauuuuucauauuuccccaaaaaauagccaggugcgguggcucacgcuuguaaucccagcacuuugggaggccgaggcggguggaauaugaggucaggagaucgagaccauccuggcuaacacggugaaacccugucucuacuaaaaauacaaaacauuagcgggcgugguggcgggcgccuguagucccagcuacucaggaggcuaaggcaggagaauggcgugaacccgggagguggagcuugcagugagccaagaucgugacacacuccagccugggcaacagagcaagacuccaucucaaaaaaaaaaaaagaaaaaaaaaacguauuuccccccaaaauaaucaucaucauugacacugaugugguugcaugguuuucaguaauacuuaaauacaucuuucaauaaaaagaaagaggaauaggugaugaauuaacaagcauuuaaaugcaauugauaaauuuugauggcaaaaauuauuuaguacuuaaagugcuaaauaccaucuuaauuuuuuuuccuguaugauauuucaauagaucuuauauaacaaaguuaugguuuuaugaaacacaugauuuuucaucaaauuuaaaaauuaaaacauucuuugugcagaauuuggaaauaugcaaacauugaauaguacuguaaaacucgauuauuaaaauauucauaugaaauuuacuuuuauaauuuauuuuauuuaaaugggauaauauaugacugaaauauaauauauaauuaauuauuuuuucuauauuaacuacaaaaguuuaagcugaugacauucuuuuuuugcuacuuaugugcuaaugaaucucugcuaaaauauuuucaguuuuuaccuaaaaauauuuguuucauauuccuuugccuuauaaaaaguugacuuauuuaaacauugauuuuaguucaaauaugagggaauuucaaccacaaugucacuuuuuuaauuaacaaguuacuauugaguaucaaagcuuauauaguacauuugagcaauuuugauaacauagaucugagugaaguguuuccauugcuuaauacaaaccaaaauuauauuuuacuacauagaacaaaauaguuuuuccuauuuuuucccuuuccuuaccuucauaaaagagaauuucuuacagaaaacacauauuucccauugcauuacauauuuucucauuaaaugggcaguaguguguuaaaaauauauucugcauguacaaaguaaauuuagcaauucaccaaugcauaucaaaagauuuuguuucuaggcaacaaauuagguuguaggaacucuacauuuaaauuuaaucgaauuuaugguaauuuuuuucuacauauauuacaucaguaccaaagcagauaauuugcagauauggauugauuuacagguauagauugauuaguaacagugguuauaagucuuuauucuuaaaugaguauuguuaugacaaaaugauugucacauuuuaaaggagugguagcuaaccauuguagaagccagaauuguuucaaugucuuauuauuuuuucagaaaaaaagaagcuaaaagagaaauuagcuagccuaucucuuugcuucaaagauaaauagcaucucaagaauaacuugaagaaaacaacacaacuguuuaauauggaaaaaaaaucauucaacucuacuccacucuugauuagucauaacuuuacuaauauaucuuuaaaauccucuagucuuugcauuaugcacuuuagauuccauuuucaguuuuaaaauaauccuauuuuaauuuuacauucaccauaaauuacuuauauggaagaucacaauuggcuuaacauaccauguaucuuauuuuuaugcuugauuauuauaaaaucagagagaaguagguauugcucuucucacuuauugugguuacaagucacccuacgguaauagugaagugcacaaauagcaguaucauauuuauuaaagaaaugucauuucaaaaaauuaccaucacaucuucaccaucacauucuucauucaaacccaaguuuuuuguuuguuuauuuuguuuguuuguuuucaugaauggcuuuaaggcuuagcugcaaaaacuccauaaggauucaacuuucaacaugcuuauuuuuagggauuuuuccaaggcucaggcuccuccugaacuuguuagaagauauccuugccugcucccuuuuuucugaccucagguuuucuucuucuaaacugggcuacuucaugacacuaugggcagaaugaccuaugcaaucaaauuuaauucucuauggacaguaaauaaauuugaauuucuaacuucauaguaacguuaucaagauauuguggaaaucacauuaguuuaccguuccaguuguguccuauuuaugugcauguauacugggaauaaaauacauuuuuaaaauuuauuuuauuuuauuuuauuguuuugagacagagucuugcucucucaccgaggcuggaguacagugguggaaucuaggcucacuguacccuccaccucccaaguuaaagcgauucuccugccucaggaccccaaguagguggcucuauaggcaugugcuaccacgccuggcuaauuuuuuuguauuuuuaguagagacaggguuucaccauguuggccaggcuggucucaaacucauggccucaggugauccucccaucucagccucccaaagugcugggauuacaggugugagccaccacgcucagccaauacugggaguaaaauacccuuaaggauaacuaauauuguauauauugguucacuaauguagacauaaccuguaaaugcauauguaguacauuccuagguuuaucaccuaauuuacauuuaacauuauaagguuaucuugaaaaaucuauuuauuagauguauuuuuacgcuugauuuaaacagucuucucugagaauaacagacuacugaaaauuaucuuguuaucguauuuggacuuccuaaaaauguugugcuaguuccacaguuacauaauuuucaagcuguccccaaauccacaagugcuuuguuugagaauaagauauuugugagaauauuaugcccuuguuucucuuuguuuagaaaccccuaaucucaucuuugcuggaauuuaauuguuucuuuaccuuaauuuguacauuguuuguuguauucuaccuugauguaugugugcauaucuuguucuccuauuauaauauuauaagauccuuuagaaaaucauuuuuucuugacuuauuucuaaaauaucaaaauaccugacacaacuuaauaaguauguaaugcauaguuguuggauauguauuuucagauauauuaaaaguuagguaccugcagcgggugguuucuagauguuaaauuauacaaaguuaaucuuauccauaagcuugaucaagaaaaagggaaauauuuuaacaaguuggucaggagacuuagaagacagaacuuaaaauguaaaaguauuugccaauuaaguggauauaaauaugaccuuacaacaugagcaauagaaauuuugugcuauaacaacuggaucccuguagauacauguuucucuauuaagcaauuucccuaucauuucucucuuuuuccuaauucuauuccucauccguuaauccuucccuccauuuuucuuuccuucuuuucuuccuccuuucauccaaaaaauauuuuuaaaguuuguacucauuaacaggaaugauuauagauaauauagagauagcauaaauauucaugcccucauggagcuuauauucuauugcggauaugaggcaugaauuuagggauauuuugcguuggcugaggaggucagaauggcuagaauaagcaggaaauuaauaggagaugaggucucagagguaauggagacugaggagcaugacuuaaauguucugauuguccaagcacgugacuggagucacccuaaaagcaguagcgagggaguuucugcaagggacugccccaaauugucuggagaugggccaguuuugauuccaaaaaagcacuaaacgccagguucaucaguuuaaagcauuuauuagggaaacuugacaucauacagagggcuucagcuuccucaugacagacguaagaaaagugacguuguacuccaguauaucuggaaggaaaggguuguuacuuaaaagaacggaaguuauaaaagguuuaaugauuuugucucagggcaggggcucauuuauacuuguuuagcaaccugguugauauuucaguguuucgggcaaaaaaccuaaacaacuuuaucugugccugagaauguucaaggcccuggguuggguucaagccuguaguuaaaaacaugcagcucgcuggaucacugaaugguuaggcuauuauguguguuuucucaggcaggacaaagaaaaaagcguaaguaauuggaggaccauacauugggcuaucuguccaccauaguaaggaggggaauuugacucaaagugaaaauaugaagcauuaagagacuuagcagaggagugacaguaucuggguuauuuauuaacaguaauauuuuggaaccuggguuaagaaguguaucuagggggugaaacucucaaagcaaggguacugaauagcaguguauuacuuuaaucugggcaaaggcaauggugaauuaguacagguuauuaacaguccagauagugaaaagugguuguauuuugaauuuauuuugaaggcagaugugacaauauuuucuuaaauugaauagaguaugagaacaaaagcagugagggaugacccaaagcuauuucuucugagcaacuuugaauggcauagaaaugucauuaacuaccuauuuccauuccuuuucauucauucauuuagaccuugucauuuggaauuaaccccaaauacauaaauuagaccccuaaacaucucccuacuugccuuccuugcaacauuuuauuacuuuuaucuguuugucuucuuggaaacucuuuucucccuaaacuucaauauuacuguuuguagcuuguucgcccaaaaacucuuuucuucauauuuuguucuacucuccacuuguggucccacucccacuagcucugguauauaagaagcaauuaacaaagcuguauaucuauuaauaaauaaggcaauuguaacuuuuguauuaacuagauguaguuucuuuuauuuugcucuagguuauauauugccauuagcaugauuaaauauagaaaaguaaauacguuuuggucaaggaacuaaauuuuagauuaaucaauaacauaaaugugacuuuggaaacagauuuauuaaugaaguuuaacaauaguaucuaaaaggacugaauaugcuuauauuacucaggguucuguagaguaacagaaacaguaacauauaugugcauauauauaaauaccuuuauuauaaggaguugucucacacuauuaagggggcugaaaaguuccacaaucugacaucugugagccggaaaccuaggaaagccagugguguaguucaaguccucauccacaggccugaaaacaaggugaaccacucugucucaaguccaaaagccagagaaccuggagcacuuggugguguaagucugaaucugaagucaugaggucucagcucaagcagucaggcagauugaaccaguccucccuuccuucucuuuuuuguuccauuuaggcuauuaacauuuugaaugauacccacucauauugaggagggauaucuguguaccaauuuaaauguuaaucuaauugagaaacaccaucacgggcauacccagaaauaauguuuaccgaaaauauuugggcaauguuaaccaaauauugggcacccaaauauuugggcaccccuugguucggugaaguugacacguuacauuaaccauuauaauagugaauuuagaguaauauuaauaaaauuaauauaauacauuuaugacucuuuguaaaauaauguuauuuaaacauacauagaauuuccaaaccuauuccaguuuuagcuuagucauuuuuauauaacuaccauauuuauucauaacucuggaaaucuuauuucacauaacuugugaauauuaucuauuauuguguuucaauuucaaauuauuacuguuagauagcacuucuguuuauuauacuucacacucugaggacagcaauucaauuuuucagauguacaaguuucaugauuuauugcugcacuuuaauacuuucugucuugcuuucccaaauguuccacaccugcucuuugccaauauaugcuaucuuuaaagggauuuaacaccauugcaaaucuuuaauggaaugcauuaucaugauccaaagugauuauacuguauaauacaaucuuaguuuuuuuauauuuuuacacuccugaauuguuaaaagccuguaucuuguagcaaaugggaaauauuucaugcuuuacuuacuguggucaucaaaggcaauaugauuuuuauccagauaauuuuaaggucagauuaaauaauucuuuaagaauuugcuaagaguguguaagaucauuauuuucauuuuagagacuuaguuauauuaguuuuauucauuuuacugauagacuguguauucucauaucuucuuucuuccuacaauauuauucuaacauauaaacauuuauuuucuuuuuuguuuguuuuguuuuuuccacaaccaauuagaaauaauguuuacuucugucuucucuuucauacuuugaaaaagaugacaaaagauuaugaacaaauaguuguauaugaagauacuggcuuccccuuuuagaauuagaaccauugugaguccauuuauaucugauugugaugaacuaugugucuuccagagucuuuuuaucaaagauguagaugcgcugaagacagucaacuacuacuuguugaucuauuuauuuuguaaauaaaacacauauguuuaaggugucaggcuuuauugagaauuacuuaauaaauuaggcuuuuauaccaccuuuagaugcuuuuaauuuuuagcaugucauuauaugaaagcuuuuuuaaaguuuauagaggugauaaauaauauuauauaacaaauugcaauucucccuuuuuuuuuuuuuuuuuuuuuuuuuuugagacagagccuugcucugucgcccaggcuggagugcaguguugugaucucggcucacugcaaccuccgccucccggguucacgccauucuccugccucagccuccuggguagcugggacuacaggcgcccgccaccaccccuggcuaauuuuuuguuuuuuuaguagagacaggguuucaccguguuagccaggauggucucaaucuccugacgucgugaucuucccgccucggccucccaaaguaccgggauuacgggcggauuacaggcgugagccaccgcgccuggccgcaauucucacuuuuuaaagugccauuguuuauacauuauugcugucaguauucaccaagauggugcuauuaccuguuguggggcaauuuuccuugucauuucuacauaucuuggaacagcuuuuguccuuauauuuucaagaauguucuaaagcagacagccuuggaggagagacagauagugacucccuccagggaaaaagucggauuugugugcagaccaguauaaucaaaauaaagucucucuuuggggcaaauguugagcagaaauaccuuuuauaagaugguguuuucuaaguugugggauccucaguuaugagacaaaccuacaacagcauccucugggccuuuugggaucaucuuauucguucuuggguuagaaggagaacuuaugaggacaugaagcucaugcaaugaauaauaaaguucucugugucugacucaagagucuugugucuacugucagucuuuaugaaaaugugacaggcugacaugauagcuuucaagaaggauaaaaaucucugacccuucagaauucuugacacuaccaacauuuuauggaggaaauggcucagggauggugaaaaacugucccaaagccuuaguaaccaagaagguagaacuugaaaucugguuuuacguuugugucauaguauggugcugcuucuacugagugugcuuucugccaaaaaauauuaaauuuaccuccuggaaguaauugaaaccaaauguaguuagaaauuuuuguuuuaguaguaaauacuuaaucagaaauaaauaauacguauccaucuagauuccauuacaucuucgauauagcaaacuaaaaacuuuuuaagaaaguuauuacaauuguucauauuuuuguaaauuuuguuuuguaauuguaguuuaaugcaaaaagauguucuuggaguuugcaaaggucagggaauaauauagaaauaguaauagaaaaauugccauuuccaacacugucucuucauaaaaugcguucucucucccucucuccguuccucucucuuucucugucuuucacacacacacacacacacacacacacacacacacacacacacauacuuuucucuaaugacucauaagggaaucacgucacaugguaaacuaucccuaacagucuugguagauuuuuaaaagaauuuaguguuauugcuauucgcaaaccagaauuauuuauuuuguugggaaagcagucucugagggacaccagaauguaauaaaaauucuagacugagagucuggacaccuggcuucuguucuuuccugugucacuagccauaugaccacuguaaaaucucuuaagcuuauuguuucuuacuuuguucuggugggaaaaagaauauuaauuacuuucaauaauuuaagagggucuguccaauucaaaaaucuauuuuuuuauuuuaugugagaaauacaaaaauguucaaaauuaacauagucuuuauuauccuaccucauuacuucauacuuugaauacaauaagcgugagcugcuauauuugguccauuuaauacacuaucugugcucuguguauaucccuuuauaguaauaauauuuccuuauuaucuuuaugaugaaaguuccauuguauuuuaaagcugacauuucauaauaaugugauuuacaaauuacuuacaaauaauaagccuaugcaauucaguauauagcuuauggacuaauuuuuuuuuauuuggccacguuuucuauugcauuuuauaacuuuguacauagcguggcauacuauaaguaaugauagaguguuaugaauauuucauuauucuguuauugcuauuuuagaguaugugaaucauuuuaaaaucaaaauauuuuuaauuucaaaaggcagaaguaacugaaauacaugugcccauguagccuuuuauuugauacguucaauuuuucucaguaagauugaagcuuuuuauauuucuugcacaguaauauuuguguauuuuucuuagauagauacgaacuuugaaugaggugugaucacaaguguuauucuagcaauaccauuuucauaaaauuuuuaauaacuuucauguuuuccuagaugucacucuuuacaaccuaauucuuuacugaaguuguuuuugagugacguacagugaugacaaaagacuuaagaacuaaguaaguuagaguaacuuuugacuuuuauauacgccauaaaauuuuuaucaucauuaguaaauauuuuuguuaagaaaaaauacuacucacuuuaaaauucaauguguauguuaucaaaugagaaauuauagucuuuuaaaaucauauaggugacuuuguaauuucaaaugaaguuauuuuaccaauauuuuuaauggugaaaaugcuggccugaaauuaauuugacagucauccucaguuuuuuauuagcaauucuucuauaaaauccaaacucuaccaaugaaaaguauccaaugccgaacagccaacaccugcaauuuccaccacuagcauacauaagauaguuauuaaccuaacauaguguggaugauagaauuaggucccugcuaauuuuuuaucuuuauacagguaucccagauuaauuuuaguucaaauaaucccaaauuugugagccauuuggucuuugcuuuccaguaauauaugccuaaaauuacggggucccgggaaccuuuccuuauuugccauaucgcucgaguguuuguugcugucauuguuuggcuguucuguugccuuguauauuuuuucugcccuagucuuaauaucuuagguuuugcucugggcugaucuuuuuuucaguucucuuuaacucuagggauuuuuccaaaaucuuuguggguaagcagggccauaauaguaggagaagucuaccuagggaauuuaccuugacucugaaguuagcauagaaggcacacuguauuuacuuaaauauauguuugcuuaggacuggagagggucauggagaugauaggagagcugaaaaccuccuuggugauggcuuggaaauacucuuauuuucuuacuuucuuaguccuaaucaucaagaaaacucaaggcaagagaugagcaagccagcagcuucugagguugaaggaagaaauauguuuucaaucccuuucaauucuugaaacauuaccucucagauuauacaaacuauauaaaugauagauuucuaauuucaaaacggugauuuauacauaacucuaaaagaacauuauugcuuaaaguggcugaagcagcaccagugcuaacugaaacagaaucaucccccaggccaacaguuguacuucacuucucuaauuuuacauuugcaguucauaccaaauaaaucaauuuucccuuuugcuuuuauagguguucagugcucagaaacuugaauacagacauuguaauaaagaagcuauugaauuccaucuuuuaaaucaauuauauaaaauaauauguuaccucauccuuuuugauaaugauuuguucauacuuaagacuaauuuuuuuaagcugagauacaaaugagguaaagcuucuuuaccuaugacauguccucccacagagcuuuucuauugucuaaaaccugugagaagcuauuauauuuuuaaaauuuuauguuucuugguaacuuuuugaaaacuuauuaucuaguauugaauucuucauccauuugccauaaaggcaaauguuuuauuugccuuuaucuccauaugaaugaccaccuguaguugcaauuucucaucauuaugauccuggaacauuuuuaaagcaauuuuaguuauacgguuuuaaacaaaagguauuucucagcaugcucaugugcuccuacagggauuuuuuuuuucuuucuacauguuauauacaguugcaugaauuauacuaauacaaugucaagauuaucuacuauacauuuaaacugauauggaaaugauuuuauucauaaguaacuuuucauuuauaauggucaaauuugguuuuuaaaccaucauuucauuauagccaaauaugcaugaaaaugaacacagacagaaacaauuaaaauagaagaucugagggucuaugauucuaaauaaauucuuauucgcuuaagaaacuucacauggagauugacuagugcucccuaaauaaaauuucuggcaugaaacagauuuaauaacauggaaaacaaugaacaaauauuuuaaaaggguauuccaggaauguuacauguucucaauauaucccauuauuuagacauauucaaaauaugucuagaaccuacauggugccguuauggaauauagaguuguuuuauuuugucuuuugaaaauacuguguuccaguuuaaucgugaucuaacacugcugcuagaccucacuguuuuauguuaggguggugguggaauuacagagaacugcauuccaaagugauaaauauuuguuuuuuguacacuuagauaguauuaaaaauguuaguauucuuuaaaaauugcuaccaugggaguuaaccacuccacccugcauaguuucacuccauuuuaugacaugcugauauuuucuauaaacagcucauugugcaaucccuaagaacugcuguugaaucccuuauuuauguaauaaauauacaaauaauauaugauuaauauacacacauacauaacauaaucaaauagaugcauauauacacauauaucacauacauuuucuauauaauucucauaaauguacccagggucacaaguuuauguaugugaaaaagcauaaaguuacuaaauggauugggaauaaaauucacaaguuuuuuuugccaaauaugaaaucgcguauuuguacauguucuugcaaaggccauuucuuuacaaauaggguccugggggauuguuaacacucgaugaagcuuccuguuuauucacucacucugggauuucccauuugccaacacaacaaauggauuguguuauaaaugagaacagcuuguugagagcugugguuuaauguuuucuggaaauagaugaagacagcauguucuaauuuaucuguagcaaaauccaguuaggaacuuauugaguaugggaguuuugguguuuuugauuugaacaagcauagaaaauauguucuugcaguauaucauugauaauuacaaauucuuccuaaaguuguaauuaugcauauuuuaggguaaaucucuuuuuagggaaacaaucgguauuuaguuugguaucuggguaaacaguauuuacauaaaauauuauaaaguuauuugcauaugaaccuuaaaauuaucugcauugccccacaaaaggagcuaaaguuguaauuuuuuaauugauauguugucauauaaauuuaaaaaaagaugaucaguaauggaggugcuaacacaaugagacgcaauucaccucagaaaguuacaacaaauguuugcacuuuuauguauaucgacucuauuuaaacauugaauuuugguguguacagaggugauuuuucuuucacaguguagucauuuucuuacaguucuuacagaucaauugauagacucaucauauuuuuauacaucuauccugaugaauuuuaaauagauuucuaguaaauaacaguuuuucuguaacaaggagagaggguaaaagagggucuauucuacuuugucugcugacauguuuuucuuucuguaccuuuacacucuugccuauaucacaaucccgagacauuuacuucuuaagagauguugacuaaugacauuagggaaagcuuaguuacaguuuuauuucuaucuucucauagauagaaaaguaaaaccuaugcuuagguaugauacauuuguuauagcuguauuauauaucuaaaguagaaguucgaauaucccauggcaaacuuacguacuuauaguauugucuucuuggaaguauggacucagaauucuaugcaauuaauuuuuaaaauguucagugauauuaaaaaguaacauuggagguuuaaauauuugauaggugacaaaaagauugacuuuggcuuugggguguguaugcagcagguaaggguuguuugcacaugucauuguaaaagauguaacacaauaaaauaguaaaauuugcgguaaaguauuuuauacaaaaaguacaaaaaagaacuguaagaaaaugacuacacugugaaagaaaaauaaccucuguacaccccaaaauucaauguuuaaauagagucaaucuacauaaaagugcaaacauuuguuguaaauuuccacagugaauugugucuuacugaguguuggcaccuucauuacugauccuuuuuuuuaaacaaaauuuuauaugacaacauuguaugugaaagcaaguuauuuuaaauaaugcagcuucagaaugauauaucauucacuaaaaauugcaaaccauaagcaaaacaaugaaugaauuuauaauagaccucaauuucaucuuuuaaaaauaguguuuguuaaaugagcaucucacucauaggugggaauugaacaaugagaucacauagacacaggaaggggaauaucacacucuggggacuguugugggguggagguaguggggagggauagcauugggagauacaccuaaugcuagaugacgaguuagugggugcagcgcaccagcauggcacauguauacauauguaacuaaccugcacaaugugcacauguacccuaaaacuuaaaguaugauaaaaaaaagaaagaaaaaaaaagaaguguuaaauugugcagauauauaaaacauuaauaggauggauauuuguauuugguggcuaauuucauccuuaauugcugaguuuauuuacagaauacaugguaccauugcaguuuucuuuuuuagcuauacucuucaauaauucauaaauuuuaaaaauauucuauuucagcagcaaauaauucuuucuauuauaaaauauauuuuguagauugacccucuccuuuuuacaaugcagucaaauaauuuuuggauuugaggaaaacauguuuaacucuuuaucuaauaugcuuuuuaccaucacauauuuaugaaaaauuuuucaaauucucacauuucccaaagguucacugacauagacucuguguguuuguuaucaauacuauucugaaaauagguuagcuaugagauaaccuaaaggauuacuugauuaaaauuauguaaaacccaaaagguucugaccuugccaguuuaugccucaagauuucauauucauuugagucauuuuucguaauuaaucauuuauacaucauuuauuuuaaacucacuauaagacccaguuaaaggaagcuugucucuuccagcauaaccagacauuucagaagaugugaguguaaccaagugucuauugucuacaaauucccuaugagaagccuucuuugaagauauucuaggacuuuucaaccucaacacuauugacauuuugggcugaauaauuacuuguuuugggaggcuguccuggucauugugggacauuuaacaguauccacuacaugccaagaacaacccccugccagcuguggcaacuaaaaauaucucuagacauguccaaaugccucauguggggagaguggggauuaaaucauccccauuugagaaguacuaagaucaucugauauacacgacaauaugaauacuaccuuuugacauauuucugccaauaugauaaccuaugcaguauuguguaucauacaaguaauguggcuuucuucuaccucaggaugcuuuuuuauucuuaugccccccucauuuuuuuaauacuaaggcauuauagccucuuaaaauaaaugugugcuaaauauaauaucaugcuaauuuccaguuuugucucauacagaccauauacuacucaauuagaaacaaaagaaaaagcaguguguucuaguggaagcaucacuaauuccucaguuugcuauucagcucgcucacugugugacauuaggaaagcccuuaacuucucuuaucaucaacuauuagcauaugaauuuauauauuaaugcucacuuucuuccagaggauuaaacauugucaaacugcaaacaccuagcuuaaugucugacauaguaguaaugcaagaaauguuacuguaaaucauaucuaaaguacgaaacaugaugaagaaaauaauuagaauaaguaaaguaacaguuaauauuuuuaucuuggaaaagguuggauaucuaaauauacuauauauaauaaaaucaauucuaucugguauauaauaucugcauuaaaauuuuucaccaauaaccagaaaaaugcaaguuuuuuuaauauuguggggaauggaaauuuaagauaauugcuuaagaaauaaaauauuucuuguuaacaucuacauuuauuuaaaauuugguugaaaauagugcccgaaauagaacauagaaaauauagaaaauaaacaauagaaaauuguuuauuuauagaaguuauuuauauacacauaaauacauuccagucaggguucggcuaaaguaauagaaaccacuauaacaauuuuaagcagaaauugaauuaauuuaggaaacuggguacuuaaaaguacuggaagggccagagaaucagacucugggaaaacccuccaguaaugacuccuagagcaauauugcagaaugaccaauguacaacaaucagaaagccaaggaaacaggauacagcuuuacugacugucuuccaggaucacaccaccuuagcuguugcccuaauuauugccacuugagccacaacacacccgcuggauccucacaacccaaaugaauaaaguauggcccaccaucuguccucccauuuaacucaguuucucagucacugcuggagucuuugcuguaagaaauaugggauuuaaaaaacccuccacaucugcacaguacaaaauaguacaaaaaggaaauugaagaaagacugaggaaaccagucuuccagaugugcuacagcuuguaggugccagaguugggguuuggccacaaguaauguuauuccaggaccaguguuuuauagcacaccuaauaagggguauuucaaagacuaugcuauaucuccuuaaucaaguccacauauuauuaugcacuagccacacagcucaguguuauagugggacacaaaucuuggggcacacauaagaauaaucucuuguccccaaaaauuauaucuagcuuugagaaguagaaggaacacaguaguuucuugcccaaagagaauuccagcaguguuugaugacuuccuuccauuucauccccagcaaagugaugcagaugacuuucuagagugaguagcugcaguguuuagauaguccucucuaaucacagaauuucuuugccauacuuuucaccacuucucuuaaauaacauuuggcugcaguuucuagagcagguggcacuugaggaucaaaaauaccuugaggcaagugaacaucccucugcuuacagucuggccuauauaaagaauguuaaacuagcagguguccacccccagacgcauucugccuacaaaccaaaaagagauauuuauuuuccauugcggaauaaaugucuggcucugggggacugguaaacagaggaagauuccugaaauauuagcaaugcuagggccauaguguguguaaguggacagguugucccaaauuccaugguauuacuguagcauauuuguccaggcaccacuggauuuauucccccuccccagagaacauaguuagauaucucauucuagauguuuuauaugugccuagaaugcuggcagauuaaagcacagaaauuggugugaguguugcuaaauucugguuuaccuuauagcuguauucucaaacagacaauucacugcuguguucagaacacugcugguaugaauaauagaggaacuaaugcagccagugaggcuugugcuuaaggaucacugaggacaaacaaacaaacaaacaaacaaaaaugcauaaacaucucuaguuuaaauaaaaguaacagauuuaauuagacaaauaacuaagaccauaaauaauauauugcgggagugugcauuaaaguauaugagaagaauggaccauuguugcuccacuguauuuuaacauguauuaguaaaacucaucaauuagauaugauagagaugaagccaagaaaacagagggaagaacuagauuaagcuuaaaauggcuugcagugccaucacuuuuuucugagccaaagcucacagaaaacuacuuaaacuuucauuugagcuuuuagaucagcaauaauaagcucagauaagacacauucucagagguguguggcacuaagcuauuaaugaacuauuuugaugucauauaauaaaacauuucaauuaauauucuuguuaucaaaaucagugaaaaaccuauaaaaauucauauagaugugaauauuggagggcauuuuaguguuagcaaauuguuucuaaagaaauagaugaaaauaaauaauguaaacacuuuuacagacuauuucauuugaaauaaaacuuuaaguguuaaaugcuacuuauuuauauaauagaaauguguuuuuaaguuuuaaguuaccuguaagucagaauaaauauuacacauaaagcaaauuaaaacuacuuuuuaagggggagaggguggaaaucauacugggauauuuuauuuucaugaaguagggauuaaauuaacuguaauuaacuuaaaaccacgacuauuuucauucaacuaauugauuaucuucuauagauagaacaaugcacuaaugauuaguucaaucaugaaguccgcauaugacuaaggaaauccagagugcuaaauguaaguuugcagauuggguguuacuguucacaauucaaagggaucucugcuucacaaagcaauucuuuuaaaaugccaucucuaaugcauuugcuacuuuacagaucauaguuacuuuucaaggagauugaauggauucauuuuaacuuaaaguuuauggcuuaacuuucuaaguaucuuuuaauaugcacaaaguuaaaaagauuuaaguacagaaugcuaguauauaaaaaguaaaagucuuauaucaugacucaacugauuguacuccccagaguggaacuuuuacuguaucucuuuuaagaaugaaaaucucuguuguccuucuauugaaccuccacacugauaauaauacaguaaugcugucuagggugaucuccuugcugacauaauauucaccuuuuguuuuaaagaggcuaauuaacauuugcauaaauguuuuaaauuuaggcuacacauaaaaguacaccuaauguugaaaugugacccagauacucuuaagucaacuccuauuucugguucaacccaaauugcuuucuucauuucaugggccuacauuaaaguuaucagaagugcuuuggcacccaccccaccauaaggauggcaccacagaagagguaagauaaaagacuuaacacccucaacacucauacuccaaauuugaaauucccuucccuuuaaugggugucccaugcuugauuuuagguuagucaguguauugucaccaggguacuucccguauacccacuaaauaccuggagagcucuccagccaagucaauuaaaaacacgaccuuuccccacuuuuccauacacacuuuaaagguauagcucccauuucagacucuuuugucaggcucaaaguacucaugucuguucuguccagcagcuaaugcuaauaucagauuuucuggcauaaguaaugucuucugaaucacuggcacuaguguuccaauggccuuaacaagauuacagagccccauugcugaggccaggcugaaacgcugaauaggacuuucuacacaauuguagggauuaaaaagagagauauaacacuaauaaacuuaaaacuugcuauugaacaccaguauaaaagcuaaugccagccacauuuucuuagaucuguucagaaugccuccaugccuaacuuuuggucugguuuauagaucuggagaaauagguuucucaacccagugcauuaugacauuauuuuauaugcuaaaugaaaaaauauauauauaaaagaccacaauuaacgcauuuuucacagcuucuuaggcacuugcauuccugagaauauucuuugccucacacugacauaaauaaaaggcuuacucaggaaguuuaacagagcaaaacucugaaccaaaguuucaguaucuaucuuucccaaaacaaaaucagcuuccagguuuagaaagccagauuuuucaagauucaauggaucccauuuugacauaaaaagcaauagugacaaauauaacacggugucuuguuacaauacucaacuuuguucaaaaagacaaacuuuuuaugaguacacuaacuucuuuuuacuuucaauuaauugcaaguucaguaaaauaaagcauaacuccuaugugagcaguuugcuccaaaggaaugugugcuuuguucuugaggauggaaggaaauggaaucaauuagauaaaagggugcucucaaaucugucuugcuuucuuuaaaaccaaaaauaaauaggguuuccggaauguguuccaacaccauuugaaauauuacaaggaagugaaaagcuucuuccaagcaaagcaucuauuuuugcuuauguaguuauuucaaguccuaauuuuaauucucaguguaugggucagauuucuucagagaaacagaaacaaauaucuuuaucucucagauagauagaugacaaaaaguaagagaaacggagcucuaucuagaucuauuaucuaucuaucuauuuaucuaucugucauuaucaucuauccuaucuaucaaaugagagagauaacgauuuauuuuaaggaauuggcucaugugauuguggaggcuuggucaguccaauaucuacaggauaggcaauuugaguccaaagguggucuacuggcagaauuucuucuugcuugggcugggcagagguguggggugauggggagggagaucagucuuuguucuauuaaggccuuuaacccauugaaugagguugaccauauuauggaggguaauaugcuuuacuuaaagucuccugauuuaaauguuaaucucaucuaaaaaaaaauacccucagagaaacauccaauaucacguuugaccaaauauacagguaccauagcccggcuaaguuaacacauacaauuaaccaucacacucaauacguugaucaauuuugaaaacacucaaguaccuguauuucaaauuuguaagcuauaugguuuuaugauuaguagaugauaacauaacauuacacaaguguuuauacauagaaaaguagaggaugugguuucaauaggcucuauggcaaaaguauaagaaacagcaacagugcccugauugauaaagcagucugugugaugcugucacgucacacacaagaguuaaauuaaguccuaaguguuguguuagguggcaauaacugagaaacugacagccugacaguauuuguagaaaaugaagucaccuaacuguuaggacaaauucuacagaaaauccaggauuaaggagagaaagaucacaguuugaaucugcuuagaaagaguaauuugaaauacuguacuaaaguagguacaauuccucagccuuacccauccuucaccacacuuuccuugugcucuuaucugcuuuucuauuuacuuuccauuuuccucuuccugacagugcuucugauauucuuccuuuucuaaacacacacacacacauacacacaaacacauauuucuaaacauauauauuucuaaguguauuuauauuucuaaauauauauauuuuuuuucuaaacacauauuuuuuuuuuguauaaaagcuuacucacuucuaacugccauucuccaaggauaacagcuauaauacaaucucaggugugcaauaaauacacuuucuuuacuuucucuacuguauuugcuuuucugauuuugagucuccauucaccuggguugucaauaaagccaguuuuucuucuggcuuuccccaacuccaaagcugauucacaguuuuagagucucauguagcaccaagacuuaggccuuugguccacauagcuugcuaguccguucauaaauucauaauacuggucaucaugaaaaacccuugggucuagugcucacugugcuucuaugugucagguuggacucuuaacucuguaccuaucuugaguaugcaauacugauuucucagguugcuggagaauaaauaaauuuaaauccaaaacacuaaauuguggaagucggagacuucuugccaaaaagaaguaguaaaaaaauagcugacaggugaacauggaggugguguuaaaaaggaggaauuugaggggaaggaaaaauaaaaagcaaugcuugaaaaaagucggggaaaagauuuugcaaaacaccaaauuccucccccaaaacccaugucaggggagcgcccagagaagcacaaccuguacuauggccaauggcaguagugagggagguggaguggagaaaggaugaugauuuuuaauagaaacauuguugaagccuacugguaaccuucagaucacucuuucuucauuuuuuuuucuuucccccucccuccagucuagggaaauuaucuuuuuagucugcaaaaaguauuuccuuuagggcuugugaccaagauccaugguuuauugaaucagucaacauagauuuggcuaucugcuucaauacaaggaggaagaaaccuaacaaucacaaauguaucauaauauuagucaagccauacaaauaauacauuguuucagaacaauuugagaucagaaaacauggugggaagaagaaaaaguaggauauuauaaaauaaaaugugaaaacaauggauauauuauggaaaaaauaaauuuuggaaaaaaugaaauaaguuauaaugaagaauaguauaaacgaagaacucugauuauuacuacuuuacauuuucagauaauuauguagagaaaaauaagccaaagggguagauuuuuuuuuuaaacguaaaaguguacaacucugagccaucaauauucuaaauuaaaaaaaaaaagugaagaaaauuaggucuauuuugcuaaugcuuacguuggagaaugaaaauggagaaauuaaauagguuucuuuauguuaugaauagaccauggaauguggaauaaaacauaaaugaauuuaaaauuucacucagcuucuuaggcacucuguggccuucuucauauuaacaauucugucccauuuuuugucugugaacuaaucucccuucacagaauuacuauaagaacuuaaugaucgucaccuaaguggaaacaacuuagcacaugguaaggugcucaggaaacaucuguuaccuucuuguuaauuaucuccuauguaggaggacaaggauguauguacaugcaaauuccugccacaaauauuucaggaaauuggacaaucaucuuugccauucucuccauuuccucuuuucaugacacccagaagcucaguugcaaagucgguaaaucucuuacucauaucaagaaaggguuuucauggaacaaaacguuuccaugacugcaaacuaugagaauuucaaaauucucauuucgaaaaggaaagaaauuaauauucauuauuaaucauuugucauaaguguuuuuuaucuuagucaccauuaaacucugauaucuuugugaauccauguuguaucuuaucaucuuuaaaugucauacuaugucuaacacugugccuaauacuuauuaaaauuuaaaaugaauugauuuaauaagcagcacuuuaugcauguugguauaauuguauuaaugaaucuuuuuuucaugauauucagauacuuuucuguugugcuuugagaagagaaaaacaaaaugaagccaaaugguuaauuuuucuaaacccagaaugagaugcuaaaauaaaauauuaaaauuauaauagcuaauacucuuuaucucuagcugcuuuuuauuggcuaccugacuuaauccucacagcauuucaguggcaugggcacuaguguuaccuccacuguagagaggagaagacuaaagcuuagaaagguuuaauagccaaccccaaaucauggaacacauguucaguauccacgagaaccugagaaaugagaaaucugcauguguguguguguguauauauauacguguguguguguguguguguguguguauauauauauauguguauguauauaucuaaaaauuuaguguaauuaccuuuuucuccuucuccauaagacaaaacuaaagccaggaaaccaaguaaugcaugaaguaggauauaauaacuauuucauacauucuuuuuuucaauuuguuuucauguucccaaagaaaacaccuguauuuuuugacugacuguaucuugauuaugaauguaaguuucuauuuguaaauaauaaauugucggaauuuauauguggaaaaucacaaaucuuauauuuacauguaaaaaugaccagaaaaagugaaaauuggguaaaaagucgugaaaacaaggugugcaggauucuuuacauuuuucaagugugucuuauuucuaaguauguucguucagagguuaaacaauacccuccuaaauuucaaaauuaauggaauuacuuacuuugaaguaauuaaggguuaauuacauagcucuuuuagagaaaguuuuuucggguuuauaguauuuuuaauuuaugaauaaacugaaguuuuuaaaaauaauaauucagcguugaaaaguggcuaaugcuggaaaaucauuuuaucccuuagagagcagauaauuaccauggcuaccauaaaauaaacaggcaaaccuaagaaagacucuuucuuacuuuucuaucaguuuaauacuuuguuuuuacuuaaaccuaucaaguugucaagugcauucacuuuagugacuauacaucuauaauuaaaagaauuauucccaacagucauagucagucauguagcuacaaucuuguauaucacaggaaacaagauacuuguguguuguauauaauuuuuauacacacaauucuuuuuuuuuuuuuuuuuuuuuauuauacucuaaguuuuaggguacaugugcacauugugcaaguuaguuacauaugcauugcugguggaaauuacgugcguauaauacuuccuuuuugucuccacacuggucugaaaacuaaucuccugauguuuuacaguugcaugaucccucaugucuccccagccaggacaaguucuaaaaguuuucauuuuuaaaucuuugcuuuccuaucaggauaaauaauggaaauucuacacuguggauuccuaaauaggaacagcugugcuuucuuucuguuaucuacaugcuugauggggggaacaaacugaguaagaagguuuaauaauuuuauuuuaagaaucuccaaugauauaugcagccuuuuaaauauguaaaccagccccaauuuuucccauuguucaauuuuuuguuccuuuuuaaaacauaacaauaaauucauuguucuuugucagugcaaauguuggguggauuauuuaaagccaguuaggagcugaucacugaaguaugugaguuuuaauuuucuccuaguugucuugaucuuaagaaggaauuaaagaaaaucucaagugucugccuucauacuaagaacacaugaaauuucugaagcaaauagaaagaugaagaaauaauaauauauguucauacuuuuggaauaugaaaaggaucugcaggagaacaauuauuauaacauuugucucaaaagauaccauagaaucaguuggaaguuaauaagucucuguagacauuuuuuaggaaaaauuuuuaacaauacucaucucaguagguuuugaaagaaaaaguuuaagguaugaguccguuguacuuaucacauguuuagaauuaggugaaguaguuuuuauuuaugacucuucuuucucuuccucugaaccauuagccucaaucuucuuuggaauaaaaagaacucucagauaaaacggagagaaguaauagcaaauaauauauuuuuucuuuauauucuuggagcuguauuuuaauauuuaacacaguuuuaaaguuuaauaucaccucuacuuuucuauaagcuugauauucuaggcuugcuacugucauauugagaaauuugucuacauaacuagaucauuaaauaauuuuauacuuuguuuagcugaaaauguguuuauguggaaaugagauuaagguaauagaauuacaccuguuuucuacacuugauaaccuugugugauaaugucacuugcuuacccgggaaguuauugacucacugcagccaggagaagacuuuaauauuagaaucuauuaaguagcguuguguuuuaaguaggaggaaguaaaagucuaaaguuaaaaaaaaaaguuagaaauuguuuaccugugacaaacuuggauuaaaauuaauaccuaacuuagagggguuuaaaguauuauagaaaagagcaacaugggcagaauuaggaggcucgguucauuguucuucuugcauccaguucuggggcuuugaauaccucuccagauuccuaaggaggucaagauaucugauuccuaaggucuauuauaaucucccguaaauuaugcuuucuuuagcuaauaauucuuuauauauucaugaauucuguaaagcaacuucucuaaauuaucaucuauuucuucugcuaaacaagucauaugccauugcaaugauauauuuauuuuauuaauauaaauagaaaugaauuaugaugagucauuuugauauauucugagagucuaggguuauguuauaaacuauaaauaguuuauuuuuaucuaccuacaaaccaauuaaucauauugcauauaugucauauuugccaguguaaugguaugauucugaaaguacucuagugacccugaggcaaaaugugaaaaauuacaacuauaggaaaugucuuauggaagaugacucuaauggacuuaggagagaauacuaagaguuaaugacauugaaauaaucaccuaaauaaugaacaccauauuuggugguaaaaaucagaaaaucugaaucuuuuugucauaaaauaucccaucuuauggauuuaugaguaccugagggcacagugcaaggugacuuuuaaaaauauuauuuguaaugacccauucaguuacuuuacuuacccauuaagauguucuagaaaaugcucagcugcaaauuucacauauuuuauccuggaagcuuuuauuuuuacugaagauuauacucuuuagaaaaccuggcugcacuuaaaaaaauuauuagacauagaguuuggcaaacauaaccacagauuucaggaaauagaauagaauaaaggcuuagccaaauguuuuuuuuuagcuuugaagaaaagugaccauguagaauggcacagacuuaagugguuauauguauauacccauguauauguguuuauuuguacauauauauucauuuacauauauaugcauauauauguacauccaccacacaugguggauguacguaugguguacauauauacacauacauauauauguacauauauacacuuaagucugugucauucuacauagucauuuuucuaauauauauaagauucuguugauaaaauaauuuauuuaaauaaacacauuagcuuuugagaagaaagauucguuuuagaguuuuuauggauaacaaaacauuuuuuaauccaaagcacaauagaugugacaucuuuuugccuaaaaaaaaucuaaaauuagcuuuucuuugaaaugaaauuagaaauccagccaaaagaaacauaacaaacuuggguuuaaguagguuaaaguguuuagcauauuuuaaaauuuaauguaaaaaguuucugaaaaaaaauuuauguaucuaucauacuuuucccaggcuaauuuuuuuuucauguuguucaauacaauguuuuuuccaaaguaagaccuuauacuccaguaguuagauagacuccacgguauaaauaggacuuaccaugaaguuuguguauuagaacauucuauucauaaguaugguuucagaaggguucagugugauaauuuuacauaaugaaauuuauaauauucucaauguaaguucauuucccuccucuguuaucauuucaauguagucuuucaaucaguugauucauuguaaccuacuuuuaagauuacgugugauuauuucucacccuaaagauauuucauuuaaaucauuguauacagaccuaauaacaagggaaauuuucucaucugaaaaauugguuucucaaagauguuauauaaaucaagcccaaacccuuuacaauucuaaauuuucuuggauuuguauuaaguagcuaaaugucuuuuaccugaauucaugacaugaaacaggaaauugucauauaucuauaucuguaucuauaucuauauuuaaaugacguuuugucuuugauauagagggaacacugaaaauuuugaugguacuucacucacaauugugucuaaaagauuuauccaaacuuuggaauuaguaaauuaaucuuuaauuuaccauugcucugggucagccaauuuugcuuuguugaaauguuugauggacuucuuauucuagauguauugucuuccuuagucaaauuucuauuauuaguuuuucauucaaggcaauaggaauaaauuuguaaucugucauuuuuaaggcauaauccaaucauccuagaaauuaaaaucuuauaauuuaaguucauuuuuuuuucucccagccuuuuuauuucauaguugggauugaaaauugauaucugaaauuuaguaugaguaacuuaagcuaagagagcuagcaauaucuacugaaguuuuuccuacuuaaugaggcaugccuaugaacaaagaacuuuggggaaguggacagugaaauuuucauuuugcaugucccugggucacugcuuuuucaaguugaauuugaggguucuaacaucucagcuuuucccugugccauaguguaagaggaaaaguaggaaaaauuaacuguaagacuucaaauauaccagugagaccaagcucccaauccuuuugucuaguaacuuuuuugauacagcuuacaaguaaugagucuuuuugacucuguguuaguguuacuauucuuaaauguucuuuaacuuugccauuauuauuuucuuguacuuaccuucacauuucuuuauguuuccuucaacugaaugcaauaacuuuagaaaaguuaucuaauuguuucuccuccucaaaaauuaaguuuagaucuuacuuauucuagggcaaagucauauuuaucuuaguuauaucuagguuuucacugccaucuggcaucucuuaugaauguuguauuuuguuuuccauuaaauguuuccaaaaaucuucugcucucaguaaacuuaacacugcccucuauucuguuaugaaaagcaacuuucuuuacuaaguuaguuaaagaccuuucauauaaacuugcuuaguauuucccuuucuugacuaugaaacaauggucuccaucuuuccuccuuccuuucccuacccauuccuuugaugcucgucugucagcauuacuugugugauugcaucucucucucucuccauguuugaaacuaucgucagguuuuccacauccuaaggaagacuucagcaaacauugcugaucccuaacauuguuuuuguuuuucugucaguuuuuuucuucauuucaaaaucuuucuauuuauuuauuuauuuauuuauuuacuguggagagaugagguaucgcuuuguuucccagacuuuucucaaacuccugggcccaagcaauccuccugccucggccccccaccaaagugcaggaauugcaggcuugagccagcacacucaaacacugagcccucaagacauuuuuaauaaauaaucuaugcauuuugacaagguuuucucauuacucacuuccuagagucagacuauugccuuuuacuucuacugaagugugaaggaagaaacaucucuuaaaaauucauguauaucugcaucaaacaaucuaguuuuuauucucaaaguggauuaguugaaggguuuaaugaugggaaugauguaaaaucagauacauguuuuagaaagaugauucuggcuguaguauagagaauaguuuggaggcaggaaagauugaauuuauugucuuuaacuauugugaugaaaacuaaagacagaucagacagauagagauacacaguuuugucucguuauugugaauuuacagaaaaaagucuuccaacaaacuuuccuuuaugccauuucugcugugaauggggucuggcuccauuucuuuuuaaaaacauacuagguuauaucuuagcacaaaaaaagugccacgugaacagacuguacucugauaaguccagucauuuuucuuucuacuuuuagaguuacauucuuacaaagaguaguuguguuuguuuacaaaugacaauuuaauuguuuuuauaauuagaaaauuuaauauugugcuaagcaaugagauacaaaggcaaaaaaguauuguuguuuuauaaaacuaaaucggacaauuuaaaaaacaaauucaaggcuccuacaagagucuaucaaauuaauuguggaugugauaauuguugaaaagacuggacagaaaaauauauugguuccugcuguuguguagcauauuacuacaauuacauuuucuuuuaaaauaaaaacuaguuauuaucuuaaaguuauggagaucagagguucaaaaucaggcucaaagggcuaaaauuaaggugucaaaggaccauauuccuucaggaagcucaaggauaaaauuuucuccuugccuuuuucaacugcugaaggcuuuccauguuuuuuggcucacagcucucuuccauccuaaaauccagcaaucacgucauuugggccucugcuuccgcggucacaucuccuucuaugaaugacucugaccuuacuacuuuuaucuuauaaaaacuuuuaugauuacauugggcccaaccagauaauccaagcuuaucucccaguaucacaacccuuaacuuaaucacaucuacagaguuacuuuugccauguaagguaacaauuggaaaguucuagggauuaggacauagacaucuuugggaggggcuuucagcauaccaaggggauaaaaacaaaaucuguaagcauucugcacucaaaacuuuauguucuccauggaaaaaaacaaauccaaaagcacauaaugaaugugguuuauaggaaggaaggaaccaaauuucaauucuuggagcacagucagaagccucaaagucauugguuauauaccaaaacauauggauuuuauaaauuaaaaucaaauauauuacuuuguaauccuucagaucuucuaaaaauuuugucuguauagcaucauuccuuguugaccuauaauaaucuacucgauccagagacagugaacgaucauuaaaauacgucccuaagaguuuuccuacuucuuuaucacuccugucaacaccccacuucccuacuagggauggaucagacucugcuuguugaagggcggcaggaaaagugggagaaagagaaaauauaaaccugagaaauagagagaaacuaaccacucucuccucucauaucuuauuguaaauauuccagccugaaacaggucugaguccagggaaaacguagcuuaacacaaaauuaaauccagauccuuaguuaauauuuuagacaugauuauuauuucuuagugaauugagagggugacauaaugacugccuauuuucugugaauaagcagagaagucaagaagcauacugcauauuucauccaguagcaggggaagauuuuccuuacuaaauaaaguuagaaggaauuggugggagacagaauguaaaguuguaucuucaucacauccugaauugcuuuuuauuaaaucauuaauuaugcucugucaacauaccauauucuaaaaagaggguuggucccaucaaacaaaagaaggauuuauauuucauuuuaaaauguucuucauuaacagucuuuacucaaauagccucaguggagcauaguaccauauaaggaacaagcauauggaaucuuaagacuguaauggccaaauguccaugaucaguagaguuaauuaaacaacuuuauuucaccuguagcaaauacaaaacacaugguaugauguuguauacuuauagaaaaguacuuuuaaagggaagacaaaagauaaauaaaaauaaaaacagagugacaaaugauaaacauugcacaauagaacaaaaacaugguaauucgcauaagggugguugcuuaugauauguaucuuuauuccccuuaucuauugacuuuguuuugaucaaaagcaauugccauuccgcuaaccuagcaaaacuuuuaaaaaucguuucaugugcuacuuuacugcugaaguugcuugccucuuaaauauuucuagcauuuauugagagauacuuggauucauuugaauuucuguauuauuccuucagcaauaaaaugagcaauaauuaaguaaaaauaacuuuauaagugaauauaaauguaucaugauacuaaauaugaauguaaaaauguguauguguacaugcacauaauauuuuauuuguuuguuaccuuaauaagaugugacacuuuaguuugcuuucguaaguaugcagauagcaaaaaccuuacuuuaaaagcuuuucaguuacaccaucauuagcaaaaaguuacaaagccagcaugauuaccgaccuaggcuguuuuuaguaucuucccaguaugaguaguucauugaauuuaaaugcuauuuucucccauuuuauaggcacauggucagaguuauagcauauguuauuuccuguugcuaaauuucuuguaaaauagcaaaacuacaguauuuaugcuaaauuggcacuuuuuuuaauguagcauuuuaauguugaaggucacacuuauaaagaccauggagcuuucuuauuauuggacuucugaaauuuuuaaaguauaauugaauuauggggggguuggauaaaauaccagcuauaucauuuaauuuaucaugcaacauauacuaaauuuuuucaucauacaaauaaaacauuuuauaaguauacuucuuuccuaaaucuacuauagcguucuuuguaaggcaggcuugauugagaguuguugagaaacuuaaaugugucuuuaguuuucuuuagaguaagacaucucuucuagcgaucaaauacugcuuauuagaguugcagagucagcauaacaauucaggugggagccuuaggauuagauaagagaucaugagaaaauagaugggcagauggauagacagauauuaaaacauauguaaagaacuaacauguauuuaaagcagcaauauaauguuguuauaccucauuaaaccaaguaguauaaaaacagaaugaaaaccugcuauaaaacugguagcaauuucuaauuugacuucuagcauucauuuuaauggaucucuguauuaggagguccuugaaccugguuguuuacaaauggcccuagaguaagcagugccaguucuuugcuguguuugaagccagcauuugcuguuucugaaacaaucugagacaaaggucucaguuaugugauucuucauucugaauuaacccuaucucuuacucuuuuggccauuuaaaaaaaaaagucuacagucuucugaguuucugaaaauaaauuuaaaaaaagaagucuccuaaaaacuuuccugaaaucuuggugaauucaaacuguaugagauuauuuuauuuggugcaaaauugcacccugaaauaggaauacauaccuaguaauuugguuuuauuuuaauuugccaaacuucauuuggcacaguuuuuacauuccacauuuaccauugaacaauauuuuaaaagcauuccuuugcauucuucauguuaaguauauuauggucucuguugagcgaauuuuugcagcucaauaguucuuuuccuacuggguaauuauucaguauauuuguuuauuacuuaacuaguuuucacugugaugaaucuuagguuuuuauuuuguuacugauuuuguuagaaaacuacacagaugacuucuacugaauucuugcucauaaagauguuuuauaagagacaaagaaaaagacacagucaaacuuauaugcugugcuucaaaugguuguggacugcaauacguccccugugaaaauuccuguguccaagcccuaacucccaguguaaugguaaauggagauggggcuuuugacagauaaguaggguuagaugaggucaugugcgaggcucuggucugaugggauuauuguccuuacaaaagaggaagagacacuggagcucacuugcacaugaagaaaaggccaugugaggacacagagagaaggcagccaucugcaagccaggaauagagcccucaccagagaccuaauuugccagcaucuugaucauguacuuccagccuccagaacugugagaaaaugcauuucuguuguuaagccacccaaucuguggauuuuguuauggaagcccgagcaaacuaauacagguauacaguaggcacauaauugauaagauuuaacucuuagcuuguuuggcccucagaagacgagguucccuaucauaugagacacucaucaaauaauugcuaaauaauaaacaaauaauuuagaacuguuuuaugugcaugugaugaaaacuaugccacauuacuuccauaaaacuggaacaauugaaugaauugcaguuacauuaauguggucacuguuaguccagauuauguacuaaaacaucuauguucuagaguagaaucaaaacuuugaacuuucuaauacacugaauaaauacauuguuaacaaagucuuuugcugguucauuuuuauuaguugagguacaugaguugauagucuuggguguuugcaauaguaaaaacggaggaagcacugaaaucagagaaaaucaauuuuaagcaaaaacaaggacaugcauguaugugguuuucucagcaggggcuaguauagaaaguuuauguuauauuucuaaaacuuuccauggggacguuuuaaaauuaaguauugauuuguuuuuuaguuauaaucuuggauccuuuggugguagcuacaauucuaugucugucuuuuuauucuucagaaacagaaaaucaaucagacagaauuuacaagugcauuuuaaaaaguuacuuuaguccuuaaaagaaucaaauuacuuuauuuuugacauuauguuauuuaaauuccaaucuucuauguuggcaaugccaaaaucacuauuucuguuuuguuuauauuucaguugucaugcaaugguuaaauauaagaauguuugccacuuaagauuggauucuacauauguauguguauguguguguguguauauauauauauauggagagagagagaguauauauaauguauacauugaaauuuuuauuuuuuaagguuauaucaacuaaaaguacuuuauguaccauuugcagaugaaaauaauaaauuuauguagaacauguuuaaaauaaaaucuauuuuauuauuuaaaaaacaauuuagaugcuaacuacaucagaaagaauuaaauuggugagaaaaucaaaguuauaauguauaugaaauggcaaauuacugugcaaaauaaauauuagaccugugaggagaaaaguuuucaccaagucuacuuaccaggaccagagcgagugauaagucauuuacucuguacuacuaaagaagaaaauuuaugaguauaaaaguguuuuacucauuuaaaaaugcuuuuauauuaccaaguuagaaaauaagcaggccaaaugcuagaauaccauguguauuuuugcauuuuccauuuaagaagaaaaaucagaagcucaaaacuauuauaaugacuaaguaaugaagaguacauauuuuuuuaagcaucucacuuauauuuaagaaauaaaauacacuaaaauauacaaugaauguaagcuaggauaggaaaagcaauuguauucuuugaaauaaaaucaucuucacucuuagacauaaccaaggaauuuuaaaaucugagugauaacacggaauuuuuaaaaugcuaugaaaauuuauuauucaaaauagcccuauauuggaaauuuuccuaugaaacuuuaaaacauaaauuuuuaaauaaaauuagagauacucucuaauaauuaugaauuuucuuauucagaauaaauguuaauaaaauuugauuauauaauuaauaacaauuuaaaugaauuauuaaaagucgaguugaauauaauuauaauauucuaaauuccaaauuuuacauugcugcgaauuuuaguauaaaaucuguuaauaagcuuaaucauacucaaaaguuuauuuuaguuuuauuuuuuauuuaguuuuguauguuuuugagggaaaugccacuucauccagaaaagcugaaguuuaacacagauguaaacuuuugagaaaauuuuuauaguccaaaaaacaguaauauuuacuugcaguuuaccuguuauuagauguuauuaacuauagacuuccuacggcugcuagaaaaauuugcugaucaaguaaagcuaagauuuaguucaguaaggaaaaacacuaaguucagagauucuuuguagauacucaaaauaggaaaaugagaaagaguauuuagagauuuuacugucuguggugggugauuuuaacguaggucuugcaaaguagguaauugguugggacagggcagaguuaugacauaauaguuuuguaugggcgagcagagagugacagggucuugaaaugauucuugauaagcaauguguuuuaucuccaaggaacaagcauuuccuagagccagcaucuaugauuuuuaaaaaacagccuucguguuuggcagaaggacagaaaaauaggccugcacccuguauuauuuaacauaauggugggagaauaugacuguuuccaguauuguuuccuacagacaaaggaauuauguuguuuccguuuuaaauuuuuuuuuccagucauucuucagccuaaaguggacaauaaacuauuaugaucuggggacaugaucaguccaggucuauacaguuguuugauuugucauggucauagguagauuuucuaaggauguucgcucuccucccacugcuucuuguucuuuuuccuguuaaaagaucaauuauuccaucauuuuauaggacaggggcuaugcagcuguguuuaaaccucuggaggucacucuugacccuacaacacagacaaauauuaagagaagaauuaugaucagagguuuuaagccaggagccagauuugcuucaguguaaagaaagggaacagauuucauuuccaaugcaaagggcacacagaaagagauauggggguaucaaccaaauuacuuaaacuuucuugauuucuuugaucauuuucaaacauuuuaaugaucccagagaucucuguaauguguaaguacaacauucuuccccuaagaaugagucaacacgugaggccaauauuauauguaaagcagcuugucuaauuucaagaaacucucagccaaggcauugucaguucuuagagaaauuguaugauuucccugguuuucucugaaccacagcauguaauauucuucccacucuaugaaucuuuugcgaagcaugaaaugggaaggcaugggggcagaagaaaacagucuaaaauuuugcuuagugguuaacguuuuugaacuuaaggcccagauuauauuuuuuucuauuaauccauuuuagaucucuuuuucuaaaaaggaaauuuugggggguaaaguugacccuggguaauauuaugaaguacaaaucagaguccugugccauagaggaaaauagugaggcaggacguggaaagccuggcagucuuuccuaggcaauuuacauuaucaaauaaucuggauagauugacaacaauaguuaauacuuuauguguguaucagauauguuguagccacuuuucauauauuacucaacuaaucuucacaacaaccuuaaaagauagguauuguuacaguccaugccuuacugagacacagugagauuaaacaaguuaaaauauugauuagcuaguagauggugguggcaguggguuucaaacccagccucuggagccuuuacuuuuaaucauuauaaaauaccacuucucaaaagucaguaagacuuuaagagaaaauaaaaaguaaaacuaaguaaacuguguaagacuuuauaaaauuuuauuuugccugcaaauuuaaacuugaaagugcaaaauauuuaucuaguuacauggacuuuuaaaagauauaacuacagcugggugcgguggcucacaccuguaaucccagcacuuugggaggccgaggcaggcagaccacaaguucagaagaucgagaucauccuggcuaacauggugaaacucugucucuacuuaaaacaaaacaaaacaaaacaaaaaauacaaaaaaauagccgggcguuguggcgggcgccagcagucccagcuacucgggaggcugaggcaggagaauggugugaacccgggagguggagcugcagugagccaaaaucgcaccacugcacuccagccuggacgacagugugagacuccaucucaaaaaaauaaaauaaaauaaaauaaaauaaaaguaaaagauacaacuacaagaaaaucuggauuuuuauuuuauaugaaugaguuauuuuuugaaaugucaagcuauaaaaauguaugaaaguguaauuaauaguuauucagugacuaugauuuucugaucuauauacaaaaguauauuuuaauaagaaauuuuauauuagauuacauuuguuuugccuucauuuaguguaaaaaccaaacaaagauaaaauuugacaguuaacuucagaagaucacaccaaauuucacugaauuauccuauuaguuuaacuucuuauucauuauugagauucuuauguaauaaaauaauaaauaaucacuuacuuuacuaucuucucugcgcaaauuuugguuuaugcaaauucuaagggcuucauaaaccaaagaauugaauaaaugaagcauuuuccuuuuaaaaaacauuuaaaaugacaugaaguucauguucaccuugaaacaucaaacaccacuucuaguuauuugguguauuuucaauuuuaauuggaaaauugaucaucuaaagauuuuuauuugaaguauaaaaaaauguguccacagagagaagaaaaguacuacaaacuggguuugaggccucguaaagucuuagcaagauacuuuaucauacuuuaagaaucauacccuuuggaucaaagcuuaaaaaaaaggaaauauuuaauccacuauuuugaaaauugacugugggagugaggaaggcagagauuaaaaguggaaaggaaaagagaaaggaaaauacuuuucuuggcuagcuuggagggaaagaagagccauuccaauuucaucauaauucacccucguagguauuccuaaccugagauuggcuuggguuaaggcuugcuaucaaaaugccaguaguuuugaaguuaguggauuccaaaauuuuaguuuaucaaauacuuacaugggaaauaauugaaauaauagagaauuacauaaaauaucuaauaguuucuuuuuaaguuuaaaaaaauauauauauguauauguagaugacauggggaaggagagguuucgacuuucaaaaauguaagcagugugggaaacuuggcauuuaaaauagaauauaacaugauccaaacagagacuuuuauaacaaggaguagaggacaggggauucauaauuaauauaaggcauucaagagaaauauaucacacuaaucaauuaguauauagaaguguuuccacauagucugcuugauucuuauaauuaaagaauuauacucuugaaagcaauguaaauuuguccaaaagaauuaucaaauaagaaauuauugauaaaguaaggaaaauaugacuguacucucauauuaggcagcagguaauauguauccuuuuagauuuucaaaguaauauucauguuugagugcaaaauaaacaugaacuauuacuaaacuauuugaaaugcaguauuuuaaucaaaagucaccacuaauguauguauauauccuaaaaugugaauuuuaauggauauuuauauagacaauauaagaagccaagguuaaaaaauuaggcauaucaucauauuucaucuuccuguuuaggcgguaagauuucauuauuuuuaaguuguaaguuuuagcuuucaagcaucuucacuuguagaauaauuucucuuguguacuguagugguggggagaauaguggaauuugcuauauuaaaaaggaaaaucaccaguugaaauuauauuaccuucucauauaaccuuuuaggaguuuugaugcacuugcuauuuaugaauuggaauguuuaagguguauacauccaacauuuuguuuguuggaucaauuuacucauauuacuuuugguccacucacuguaauuaguguuaacaaaauaccagugagaucuacagaggcaaaaggagaacuuuauuuucuaaaaacaaucuucaguuuggguagacagcagguuucugugcaaaacaaaagugugcuccaagcagagguuggggagcuaaugaagauaaaggcaaaacauaggacagugguagggaguaaagagaagggacuugauugggaugaucuuuauaccccaaaucaccagucucucugaauuggaggguuccagguggacugucuguuggugguaaguuauggaauauccaucugcaguuguuuuugacguugaaaagaccaggcacuguucuuggacuugguuacagaaaaacauguuuugcaacaguuuucaagaacacagagaauagggacuucauuacugaccucguucagggccuuugcacaaguuauuuccucuguaagccauacucuuucccacuuuuucucuggcuccuacuuuuuauucuuugagaucuuagauuucuucauacucccccaccaaacauaaauguguuaucuuucauuuucuuuuaugacauaguucucugauaauuuucuuuauaacccuuuucuaauugugcaauuaggaauucauuugugagcuuauuuuuuaaguugguuuccccuacacuugagcaucaggaaagcaucagagcgcccaacacauacuauuauaaacuauguaaggccaugucugaucuuuuacuucaguaagaagugacaccacugauuauuaaauuguaaagaaaagggaugaaauaagucaaaauacuuacuucuggaugccuuauuauuauugaccauuaagcaacacauucuacaaaauguauuaugcuguucaauucuuuuuaaaaaaugaauuaaucacaucugugauuuccuaucuguuuugaagcuagacguucaucuucccagaagugcuaaaauguuugcugguugaacagcauacuaauuaacuaaccuuuucuauugcaaaaaguuuauuaagaagucagaacauuaaguugagaauauuuacugacaagaucuauaaaucccaucuaaucaagcugaaguguuaguaaaaugcuggcuuauaaguaaggccuaaaugagacucacuauuuuuugaacauauuucuagguuaaaaaaaagaagcacaucaccaauauaauacaauauuagaaaguucucauaucucauuagguuuugauauggaaauguaguuugcauuuggaauaauaaauaccugacauuacaggaacauaaugaccacagaauaaucuugccuuuccacauuugaaacuauugaugaguguuaaugacuugcaaauaauuucuuccccaaaacuaugagaacucagaagccaauuacauaaguuuuuugagagaauauuuguaugugaaauuguuaguuuaauaacuaaaauuuuuuugcuguuuauucuaacauuugagcaucuuuuuuuuuuuuuugaggcagagucuagcucuggcaccagacuggagugcaguggcacagucuuugcucacugcuaccucugccuccuggguucaagcaauucuccugccucagccuaccagcuagcagggacuacaggcaugcaccaccaugcucagcuaauuuuuauauuuuuauaagggacagaguuucaccacauuggccaggaugaucucgauguccugaccucgugaucugccugcuuugguaucccagagugcugggauuacagguaugagccaccguacccagccuugagucucucauuuuuaaggaacuuuuguaguagguacaaggcuuguaaaauauucaaaguaaaauuagacucaccaauaaugauaagaaguuaaggaggucagguacaguggcucacgcuucuaauccuaacacuuugggaggccgagacaggcauauaguuugaacccagaaauuugagaccagccugggcacaauggugaaaccuauucucuacaaaaaauacaaaaacuuagcugggacugguggugcacaucuguagucccagacacuugggaggcugaggugguaggaucacccaagccuggggaggucgaggcugcagugaacgaagauauacuacugcacuccagccugggcaaaagagugagacccugccucaaaagaaaaagaaaaggaaguuaaggaaauuauacauuguaguacaacaaugaagaacagcucaucucuaauguauucauuguggauugaaaaugagaaaaacaugauuaccuuugacucguggauuaugucauucauguuaaguaaaacuuugcuagauaagugaaaaucacagggcaacaugauuuuuaaaggcauguuuccuuccagaaaaaaaagucaauaaauagauaaauuucugguucagcuagaaauuuuccccaaaugccucuccaccuccuaguguguuguuuacaggagguggaacacaucaacucagaagcauuuuuucauguuugguagagagagaacauugacuagacugaaaguugcuauuaaacuuugccaaggauuguagcaggugcaggaugcccuccagccuccuaagaaagaugguucaggcuagucucuaccuuuccugucauuuaucugacacuuccagacauaccaccugcgcccuaguuguauggaacacaauuuuauuaugcaaaacagagaacccacccaccccaccacuacucacuuacacugauucaaugucuaccuuuuaaucaguguuauagacugaauguuugugucuucccaaaauucauauguugaaucccuaacccucacugugauuguauuuggagauaagauuauaaagaaguaauguuaagugaggucaaaagaauagggcccugauccaaugggauuaguguccuuauaauaagacacacacacacacacacguuaugugagggcacagugagauggcagcuucuuauaagccaagagaagagacuucagaaagaaaccuaccuuauuggcaucuugauauuggacuucuguguguccagggcugugagaaauuaaguuucuauuguuuaagucccauagucuaggguauuuuguggcaacgcaaacagaucuuagguuucauuauucuuuaugaauaagauaaguaaacucccucuguaaaguuucuggaguccuuuccacccuccauccaagcaaaaucaguucucccuacucugcaguccuaugggacuugaauacaacuauaguaugaucaugccuugucuauuauggauaaguauguauucauuccuggcucuccuauggggcugugauguacuugaagacgucaagcucauagucucauacaacgggagaaggaagggagggagggaguuagggauggaguuagggagggagggaaggagggaaggagagaaggaagggaggaagggagggagggaggaaaggaggaacggagggagggagggagggagggaaacugagagagagaaaaagagugguggaggaagaaaaaagaaucugauaaauaagaagucuauaauaucgucauugucaccaucauuguagauauauaaugugcaugaccauguaugucuuuacauaucugagugcauaucauuucaaacacugaagagugucauguucucuuacuggacaggcaguagcuucaugcucauccccagucccuaguaaaaugagucuaaaugucuagaggguuggaaaacucugaccgaacccaucuuuugcaauuuuggaggaguggaauugucuaauaaauuugaaaaaucaucauuuaucagaugcaggugaugauauauguuuucacaaaaagcuucauagcuggggauugcaucugcauguacacugcaagcuauuaaguacccccaaaaagaacccugaaauguuuucggagacauuaugguauuuuauggaauaucagcuuaacagcacuuuggagacuggccuagucccuuguuuuuccagaugugaaaacuaggucuagagggcacaugacuuacucaaaaccccacagcucucuaguuuacccagggagaaaacaagcaggcaggugucccaaauucaugugaguaggccuaacgccugccgagacugugcucguuuuaauuuucaugaaucuagaguugucauuagggaagcuuagcaaauguguucagugaggaaacuugcuuccuguuuaaaaaaaaaauuauccaaauuaucagguagaugacccuggaguuauuuuaauuaaaggcaauggagaaaaaaauuaggcacuuagauagguuucuugaacucauaaaauuaaagagccuuuucugucaauauguggguuagagguaauuccuguaaaugugaauguaaauuaacuguguaaauucccauacauauuaauuacaaaagaaaucuucgcuacuuuagucuuuauuucuauagugggagcucuuuuuuuuuuuuuuuuuaagaaaaaaagaauuauuuuauaaacugaaguuggaaaauuuuagauauuuuucuguuuugauccucccuggcccccaucaccuagauacagaauuacuuuuugguggacguuuugccuuaagucauuccauuaauauaaugauuauaauaugccuaaaugacucugugugucaauagcccaggggaaaugauuaaaucuacaggaacuucugcucauagguauauuuaagaaaugaauacccaacuaucuucuuacuaagaaaaugugaacuaguuauuuggagcaaucagaaaugaggucauauuuuuaucuaauuuuuuugacaaagacuaaaaucuaacaacaagcuguuagucaucuggcaaaucccuaacuuccaaucuuuauuuccauuuugaccacuuacaugauuaaaaggcucauaaaauauaaucauuuuucuauuuaagaaauuauauaaaucuccguaccacaaaucccugaagugaggugugacucaguauuucuuaucucaacaaaauuuaaaauuaaucacugauuaauuaguuacauauauuuaauaguccauaauuuaaucuuuugucugcaaggcaagaaauuauuuaaagugccccaaguagacauaggcuauaauuaaugagauggaauuaaagaaaggaaagaagacuaucaggaaaaauaaaagguuuauauagaaguuauugauguuaucauugaugaggacaaauguaaguaccaagauaugugauuugacccagaaaucaaacauauuuccuaaaagaauaaaugcuauuauuuuacaaauuuaaaaauuaacucuuuuuucuacaggauguguugcuucaaauauaauauugguguuacuuuauacgaauuaaucaaucacaguuaugaucaugcuuggaaaugacauaagcuuugugguaauagguaaugcuuuuaaaaaauuauuagcuaaaaauuauuauauguuuaucaugagucagccacuguucuaagcauauugaacguauuaacucauuuagucugccagcccuuguaagauaggcacuauucuuauccucauuuuacagauggagaucagagagaggugcuaacucaaacucggguuguuauaagugguagcuagugguuccaucauggcuccagagguggccaucucaagcuuuuuauacaaguaugggucuuggcaaaacauuggaugguccauuggaugaucagcauccucuaagagcuuguuagaaaagcagaaucuguaccccaccucugccuaaugauucaacauuugcaguuuugaagauuuacuacgggauugaucaaaguuugagaagcauggcucuguuaauacugcuucuugguaaagcauuccuuuuaaaacuacauuguauaggccagacgcuguggcuaacaccuguaaucccagcacuuugggacacugagaagggacaaucacuugaacccggaugcggagguugcagugagcugagauugcaccacugaacuccaguuuggaugacagagugagaguccauuccgucucaaaaaaaaaaaaaaaaaaaaaaaaaaagagagagagagaacuacauuauacauuguuuuacagucuuaucauuguauguuuccauuuuuuaaagcaaacaaaaucuccuuagggucagugucuuuaaaacuguauauaaauucgaagguacgauuuaguguugaacacauuauacauuauucuaguauccuugauuuugcuauuuuaacgggaagaauggugaguaccaauuugaacuccuauuugaacuccuauuuaaggcagaucuggguucuccuggcucuacuucuuacuugcugguugaacaaaguuacuuacauuuucuuuccuauuguauaaaaucugaggugaauaaggcucuuuauuucugaaaugcaccauaugagcaccuacccucuuaaucacucguaauggucgucuacugugauagcccgaauaguaaauuuuuaaguuuaguuuuuaugaaaaucaccuguagaucuucuugaaccacagauuauugcuucacucccccaaaguuucugauuucaguaggucugacacuuugaguaagagcugacacuuugccuuucuaacaaguuguaggugauguucuuacugcuggucuagggaccacacuaacagguuaucuuccugcucuaugauuucaucuaugaugauuaauaggaguagcuccaaauuaauuuaauuagccaucaaagaaagacccagguuacacuaaucuguuacauaaaacaguucugaguauagaaaguuagugaaaagauuguccaaaacuuuuuagauuuauaccucaccaggugaaaacuuucuaggaguuugagaauccccuaauauuuuggaaagagauauucacuguuucuuuucagugugccauuuuguuuauucugccauaaagggcauuucuuccauauuaugcaguuaugcucuggcagggugcagugacucagaccuaaucucagcacuuugggaggccaaggcaagaggaucucuuuagugcaggaguucaaaaccagccugggcaacauagugagagccugucucuacauuaaaaaaaaaaaaaaaaaaaaaagcacaguggcacacaccuguugucccagcuacuuaggaggcugaggugggaggaucacugaguuaugguaucacagcgcucuagccugggcaacacagggggaucuugucucaguaaauaaauacauaaaaaaauacauaaauaaaauauaaaagaacacaaauauguucuuauagaguuauacuguuguuucuaucacuguaguucugauggguaaaugccauucuauuauuucauguuuugaacauaacuccugcauccugccuauaguuuugcuauacugagguuaaguaauaauauauauauauauauuuuuuuuuugagacagcaucucacucugucgcccaagcuggagugcaguggcgcaaucuuggcucacugcaaccuccgccucccggguucaagcgauucuccugccucagccucuggaguagcugggauuacagauccgcgccaccuugccuggcuaauuguguuguuguuauuguuguauuuuuaguagagacgggguuugaccauguuggucaggcuggccucaaacuccugaacucaugguuccccaccucagccucccaaagugcugggauuacagguguaagccacugugcccggccuagucauaauauucuaaguaauuguagaguuauagaauuuggagagccuuagaauuuaucuauccuguuuauguuuaagaugaaucuuccuaagaaccacacagcuuauccagcacauuguugaaguaaaaugaaauaacucuaacucaaauuuucuaaucucuaaccauguguuuuuuuaaucacucuauaauucaguguacugaaugauuuguuuguguugccauaagccuuuugcaacuaucuuuacauuaaaaguuaugacauaugcauugaaauaaaaguuuaaauauuuuagauuggaugauuaauaaauacuuuaaaaaguaaaaaauauaauuuuuaaaauguaucauaauaaauauaacacgaccuuauaucccaaaaugacucaugugauuuuaaauaaaucuauuaacaaauucaagaugcaagaaauaucagaucaaccggaacaacacuuauuauaaaggaaaccagacaccaaaucaaauaaccaaaguuauagcacugccuacucagcaaaacaaaaauugcagcacaagugcugauagcaguaagccuaacagguuaucugaguucaugugguaaacaaaguauucauucauguugugaauaaauuugggcacucaauauuccacacaacggaguaaucuagaaaagaaucagguucaccuuuaccuuuuucuuuuguucucucucauuuuuaauuuuguaaagcaccuuaaggauacuuaacagaaaucucuaagaaacaaacaacgugcaaaacaauagauaguguaaaaaaucagagcaaugccauguacguccuuacaaauucaggagaggcuggugucauacagucugucuugugcucauccacagaaaccauaucacccucuugacaaagcauauuaauugauaguuuugucaauaaugagucaugauuagugucacuaacguguaacuaguaauucaaauauguucauuauaauaucgaaauugcuauaaauaucauaugguugauaaucauacacuauuuuuguaggugauuuaugauaaauuacugcuguugaaguuaccagugaggacauuuugcucuaguaagcuuucaguguugcagguguaggcucuugaucagagguccuguuucugggaaucacucuuuuuuuuuuuuuuuuuuuuuugagacagagucucacucugucgccaggcuggaguacaguggugcaaucucugcucacugugaccuccaccucccagguucaagcgauucuccucccucagccucccgaguagcugggucuacaggugcacaccaccacucccagcuaauuuuuauauuuuuaguagagacaggguuuuuccauguuggucaggcugcucuugaacuuccaaccucaggugauccacccgccucagccucccaaagugcugggauuacaggcaugagccacugcgccuggccggaaucacauuucuuaagaaacauaaauuuuaagagcgaaauacuaauauuuauaauuuauuuuaguuccugauuacauuauuuguaguauucaguagcauuacauaauagggaauauggaaagacagcagaugcuuuuccucagagaacugauuaaaagaacaaagaaauaaaugugcagaacacaccuaguuugacaauugcaacugaggguaguaagaaaaacuuguuuaaaacauuuucaaaacaaaaacuacaaacuaagcagacucaauaauuggcuaugauaacaaauacucuuucacauaccagggacaacaauauuaacucuggaauauuauuuuaaacauuuucaaggcuaguacuacaaauauugcagacuuuuuccugcagaacuaaaccuucccagacacuguuauaacaaauacuaaucuuuguguauuuaucuauauaucugcauauguauauauauaugcgcauauacccauaauuaugcauuacaugcauuucugucuaauaaaaacauauuaccuuuauugaagcaguccugcuuauacaaaauaaucugguguaaucacuuggauuuuuuaaccucuuugggcaaucagcgggaagauaccuaaaaugagcuuuaugaaaacuugagcuuugaaaaugugcucaguucacaagugucucacguuuucauuuugucuguaaaucugucagaccauucccaaaaagguccuaaccugaaucauuauguugcuuucauuuaauuuaauacucacuuuuauaaucguuuccaucauuccaaugugcugcauuaucacuuuguaaucuuaguagcaugugacuuuuaacagauauuuuaguucauauacaaucaguuuuucuuuucauuuuuccauucaaauaauccaacaugaguuucucugaagguagguguuauuuccuggucacuaauuuagaaaauuuucuuaaauucuauuaguccuugcaaauacuauuagaaccacaguaaacauuuuuguaaauauuuaauuccuuuacucaacacaucaguauuaagcaaauaucauguuccaggcaguaaaagaggcucuggggugcagccaugaacaaacuagacaaaaaucccagcccucauggaacuugcuaucuaauacagggauacauagcaaaaaacaaaaaauaaguaaaacauaauguauuuugauuggugaucaauuacaguugaaaaauaauucaggaaagagcauuaaggguucuagagaaacguuugcaauuuuagaauuugaagugcaauguucagagaaugcugcaacaagaagguaagauuuaaauaaaacccugagaagggagccaugcugauaaguggagaaugugaauaacuugugcaucugugccuaggguaugugauggagucauuugcuuaaaacaucaggggccuauuuuguagagcugaaaguuuaagucaguuccuuccacaccccauagcugaaaauggggauggguagaccuuucaaaggaguguuuaaaauauugcuguaaaggcuaugugcucuauaauuucaaauauguuacuuccuguaaaagaaaaaaaaagaaaacuaugaagacgaugaaaagaucaguaggugccaggaguuaguagagaagcuggaggaacaggcagaacacaggaggauucugaggacaaugaaucuauucuguauugugguauaaugguggaugcagguuauuguacauugucaaagcccaccgaaugcucaccaagaaugaaccucaagacuaugcucuuugguugauaaugaagucaguguagauucacaaagucuuacagauauaccacucuggggcagaacguugauaguggagaggcuauccauguagagggaaaaugggcauaugggaacccacuguacuuuccacuccauuuugcugugaacugaaacuacccuaaaaaauaaaguccauuaaaaaaaaucaaaccuaggaaagaacuucccuccaaaauaaugcuaaugaaaugggagggaauguuuuugcugggaggcaauuaacaaaugccacuauuauuaaaauaaaaugggacaauauuuuucuuuuuuuucuaucgaauucuaacaguuacuuuuguauaucuaguuuuuacauuuauuuuuuaaagacaaacagagagagcugggcauagugguaugugccuguagucccaacuacuuuugaagcugaagcaggauaaacacuuaagcucaggauuucgagguucuaaugugcuaugauuucaccugugaacagccacugcauuccggccugggaaacauagcaauaaccuaucucuaaaaaaaugaaaaagacuaaaggaaaggaagaaagagaaggaagggaggagagagggaggaugggagagaaugagcgagggagggagggaaggaggcaggcaggcaggcaggaagggauggaagaagguagugagagaggaagacacacauagauacaaucaguuucuaaaguuuucuuccuuaucaguuaauacuaaauauuuuaauuauaaguagacaucacuagaaaauucagcauaauuaauuuguuucuauaauauagaaauauugauccaagauuuuaaaaucaugggguauugauauuuaauugauuucaggucaccuuuuaaaaagaaauucauagcauacuuuguguuuuagauaaaauaauugcuacaaugaagcaacugaccacuuauaacaaugguaagacauacacuccauaaucccguauuccaauauugaggcauacauuuuaauuuuuagauugcagcuugauuuugguuaccauuucuuuuguguuugagugaagaaaauuaagcuugaaauuaaugcaaaaauugguuaagaaaacauuuaauuaagugauaguuuauaugguacucuaacaacaaggcacuaaauaagaguaaagucucccucaggaugacccauuaguuuuuuuuuuuuuguuuuuuguuuuguuuuguuuuuucuaauugugguuuuguuguuuugaaagcauaaaauuuugucauguaugguagcaguguucauucuuaucagugaauaauccagggaaaaguuuugcugaagaaacaaaauaucaggauaaaagauugaagauuuccuuucuuccaguuuuacuuuuuguguguccucagauaauguaacuuauuuuaucucuaagauggcauuguuguugaagaaauaacaaauuucucuauguggaauguggauucuuauaugaccacaagcaauaaguaagcucuacuacauaaguuaauauauucauaaaaaugacauucgaauuaaaauaacauuauuauucuuuuucauuuuaaugucaucccuuacugucaucuucuuaagaaucaucaaauaguuacugaauugugugcauaauaauagcugucaauuuccaagggaaagacuauuaaggaucucuuuccuuucuucccccaccugccacccuccaugcuuaauccaguccuugcuguucaaauaaacucuuaaccuggaagaguggagaagacaaauagaaacucauucuucuuuugguuggaaaaugggcucacacauuuuauuuccacaaucauaggauggagauccugaauauaguucuaggucaaauugagaaauggaccaagcugguauuuaauauugucuuucaccauguauacagcuugcuacaccccuuacuaaaaucucccaauucagauauucucugaguauguuuaaccacagacuaaauaacuugauacagucauucgcauuaaaguuucagagacaucuaguaaggucucuuaaggaaguacuugucauugcuaagaggugucagggagggauaugauuaccuaacagugauauagugaagaugggagaaggcaguaggauaggaaucaagcgagcugcuuuuagguucaaauuuugccacucacuagccauguuaacuaaaacaaagcacaaaaacuucuaggccucaguuuuuucaucuauaauauacuccuucauuuauucauucauucaauuaauauucaccucuugagugcugggcacugugcuuauuucauaggauacaaugaugugcagaaaagaacacauuacuuacacucaugaugcucauagucuaguagacagagauagagauuaauaaauuacacagaaacauauaacuuuaaaauguggcaagugcaaagaaggaaaauuacagggagcuguaacugaaagucaucuguaauuugggguuauauaacuuaugaagcuucuuucagauguaaaauuuuguggaauaauaacuguagaaucuuugauucagagggagagauauuuauacaguaagugggagugggaaaacuuuaucaagcuccucuuauuccauucuuuagacaacccucauuagauagggcaagacuugaggagggcauguccuauccauuuacucuguaguuuuauuugauuucucuaggauguacugaauuuagaacuuaugauugcacuaccuuaucuuuaguuauuuccuaguaucuccuaaauugagcccaaguccugccucuguuuuucugaccaguacaacugaaaguauguaaaugacuagaacuuauccacagugcauuuuuccuucuauauuacagccucacaaaacuucuaauuguuucucuuauuuuuuuauguuucuguccuuuuugguuuaaccagucccuuaggcugaaauacccucucucaaccagaggcacauucauucauucauucguucauucauucauuccagucauagugcaagagcuagagccuaccaagucaugugcugagacuuuuaggaagcuuuucuucguucauccaggaaaauuugaguauacauacaauuuauuuagcuuuuuucuguaaaagucucugugauaagcacuugcaugccuucaucucauugaaagcuuccaacaacccuaugaggugguuucucuuauaauuuuuauuucacaaaugagaaaauugcagcccauagcucguauauggucagaacagaauacaacuccagguguauaauacuauaauuuuaacuuaaccagcauacuuccuuucugcauuugcauaauauuugauuuauuaucucaguguagugccuagugcauaauucacuauacuuuuagaaaauuuaaauauagcuuccauauuuaaauaugaaauucuuaucaacagguuccauauuacauauguucuuuuaauauucauaguaccuagaaaaauaguuuuugaaugcauaaauuaauacaucuuguauguuguccaagaacauaaaaaucauuaaauaauacgauaaaucuggaagauauauuucuggaaugagacuuuugucucaguaagaaacuaucuggaugcuuguacauaaaugcuuaauauauucaaaauacuauaagccuauaaagaugcaagauuauuuucaauaugacaugauaugaaauauuuauuuaaacuucaaaaucacccugauaauaaauuguagauuauuagagggauguauuauauucauaacaucaaauaucaguugugaagaccaacaauaauagcaccaaaauaugaacaucauggggauugcacauugucaaaaaaaggaagcccuuuuaauguuaggcugcuaaauaaaguauuucaaggguuauugacucaaaugagcuaaguaaugguucuucgucuggugaaagaagccuuagcaauuacugagaguuauucauucagauaggcaaauauaaucucggauucuguuaagccgucuaaaaugugaaaaccuuuuucugguucagugaucuccaaauuuuuuaauauaacaaauauauauuaaauguaauuaaaaugaguaaaacauuuuucacuugaaacuauuauagaacacuuuuaaauacauagaaacaucuuuuaguauucgaaagugaaaugugagauucucuuccauauaguagaauauuguggagguauauuuggucuucauuccuuaauuccucugaauuuaaaagaaaauugauuggcccaaguuuugaucauuuaaaaauaauucagaaauggcacaucuuaccuauauuuguguucauacauauugauuauaacgacugguauuguuuuacuugucauguucuuaagaaaaaauauggaauucucuucaguucauuuuuucuuuuguacuaagauuguuaaauaggacugauuuauucuaauaucuaauacugcuuucuauuuuuaaaaaauucaggaaaaaagugauuaccagcuaacauaauauuuuccuauggacuuuugauaacuggaacaacgacuuaaguguuauauuucuguucccacuggcauacuaauuaggugagauuuucuguaauaaagaauuaaugugauggauaguuguuuaugaagcuuagaucugauuauuaagcaacuauaugucacucagaacucaugcagcuauauucuuaaauaaacuaaugaguauuaagaaugcucaaauuacuuucacuuuuuaacuuaaauuaguauuauuuuaguuauagaaauuuggcacucauuuaauuuggagagauuauguauauaauauuauauauauauauauauauauauauucuguuaaauguaaccauugacauauaucuauuaaauuugcucauuuguuuaaaaucuaaauaaccucauuuaucauuugauuaaaugguauauucaguaauaggauuuauauguugaaauggagauaguuaaaauaucaauaaauaggcugggcgcaguggcucaugccuguaaucccagcacuuugggaggccgagguggacaggucaccugaggucaggaguucaagacuagccuggccaacauggugaaaccccucucuacuaagaauacaaaaaauuagcugggaaggguggugggcaccuguaaucccagcuauuugggaggcugaggcaggagaaucacuugaacccaggaggcagagauuacagugagccgaaaucacgccauugcacuccagccugggcaauaagaaugaaacuccaucucaaaaaaaaaaauaaauaaauauauauauauauauaugaguguauaugauaauuaauauacauauauuuauaucacuuuuaauuugcaaugacaguugcugaauuuuuacauguaauacauauucuucccacugguaucaguggaauuuguaaacacauaucuaacagcaaaaauagauucauaaaaguuuagacuucaagguuagaguguuuguaugugugugugaacauuuaguuuaugugcaugugcuuuucaaaagccauguaugaauuuuaaugaaauuuuuuagcucaaagguaaaagguugaaagacaguguguucagaauguuuuuagucauuuuuguggccuuuuaguaaggugaacucacugagauauuacggugcuauagcugcuuuuucugguuugauguuuacaugcaaauacacuacacuucacaucucugcugugucugauuuuuuacuauuugacuuagauaacucuuuagguuaauuuagggaguaauaaauuaguacuacuaguugauuauggaugaaaaaccaggcugacugacuaauggacaacaauaucagaauuauacuuucuugaaccaagacaauguuaguuccaaccuaauacacaaagaauaugcaucuuuucagcaggguagucauucaucguuccauauuuccacuuuguucugauuauuugaaauuauuuacuauacuacaauuguaccgaaauacaaaucaauugaugcuuuauccuaauuucuagggguuguugacuguucuuuucagguaauuucacuuuuaauucuuugugcuugauuugggaaauuuucauccccuuuuucuuuuuuuuauuugagacagggccucucucuaucacuugcuggagagcaauagcaaguucagggcuuacugcagccucaaccucccaggaucaaauguuccucccaccucagccucccuaggaccugggacuacaggcaugcgccacugcaccggccuauuuauuuauuuauuuauuuauuuauuuauuuauuuauuguagagacagaguuucaguguguugcccagccuggucucaaacucuugggcacaagccauaccccaacuucagccucccgaagugcugggauuacaggcaugaacuacugcacccagcaaaaauacaauuuuaaaguaauuauucaguaagucagauuuacccugagauggcaaagguuugauuuuauuuuccuuauaacuucuuuugguagaaguuuuaugacaagaaaaagggagcuucagugaugugguucaguuaacauugggucuagcugcaagugauagaaaguccccuccaccucuaaaaaacacuggcucauucuaucuuguuccaccaucuucaacacauugaugacaucccauuguucaacaugagugcuccgguugcauacaucacauucguguuccuuuaacauaaaaauagauaaaugagggccgggcacgguggcucaugucuguaaucccagcacuuugggaggccgaggcggauggaucacaaagucaaaagauccagaucauccuggccaacaugguagaaaccuuuucucuacuaaaaauacaaaaauuagacgggcaugguggcgggcaccuguagaccuaccuauucaggaggcugaggcaggagaaucacuugaacccagggggcggagguugcagugagccaagauugugccacugcacugcagccuagcaacagaccgacacucuguuuuccaaaaaaaaaaaaaaaaaaaaaggauaaaugagaaaaaagcacacauuuucuuguauucauuuuuguagacauuaaauaccaguuuugcuuuccucccauugacaaacuuuguuauauaauguauuagucaagauucuucagagaaacagagccaauagcauauggauacaguaugugugugugugcgcgugugcacgcauguguguauauauguauguacacacauauacauacacacacauacgcacacacggacacauauauauggagacugauuauauuaucguagaaauuggcucacuuguuauggaagaucaagauauacugucagccagccggagaauagcaucaccagugguguaauucagaucugagaaugagguuggugaggcaggggggguggggaugggggggaauguuucuguuguacucuguucaagcuguuaugacaaaaugccauaaauuggauagcuuauaagcaacagaaauguauuuaucauaguucuggaggcugggaagcccaagaucaagguguaggcaaauuuggugucuugcgagggucuguuuccuuguucguaaauggcuguauuugcacuauuaucuucacaucgugaaagaagcuaacucuccagggucucuuuuauagaggcacuaauuccuaucaugaggacucuacccuuaugacacaaucaccuccccaaagucccuaauacugucacauuaagauuccaacauaugaauuugggagggacacaaauauucaguccauugcauauggcuacaucuaguuguaacaaaugcuucucuauuuucuugaucaggcuuauaagaguauauuaagguuaucgauauuuauaaacagcuucugcuucuguuuuacuuauauuauuugguuugauuuguauaacagucuuguuagcuauuguuauccccaugaaaugugaagacauuggaguucauagaguuugagauuugcaaaaaucaacaacaaccacccagagaaguguuaaguucuaaaccaauccaagaacucuuacuccgaucuuaguucuguaauuuuuucaccaauuaucaggaacggaacugaugcucuuguucacagggcuaaaggaaacauaaguuaauauguagaggagaaauucuauauucaacauacccaggcacauuuccacuuuccagcauguugacaaauggacuuccuaaggcuaaaccaaaauauacuuuuucauagcagcaggcauaacuuuagcuucuguugaaaggaccuggguagucaucuguagcauucauucauccagauggucagcaccauaaaaacuuggaugaaaauuaggauaugcagaugagcuguagaugcuucacagcuugacacugcugaaauauuuuuuaaauugugccugagagcucagaauuuuucuuguuuugaaacauagaagccaguuuacauauuaguaguuuuaauuccaguauauagucuuaauaucuacauuguguaaugcuugaaggacaauuuuaagcuguuuuuaguaaauuagaauuuagaguaaaaggacucuaccucacuagacugacuugccuguuuucuguaacacuauggguaagcaugccuuuaaauaaaacagagaaaaagccaccuucuuucaagaaauuguaaaaacuguaccaucuauuugcucccuguauauuuucaaaacuuuaauuacaaaauaacuuguaaacauaaauauuuacuaagcuucucuauaucuauguggugguuugaaauauuguaauguuuccaaaaacaucuaaaauuguuuaaaauuaauuuauuaggaaaauugcuaaguuauuuuauuccaugguucaagugucauaucaguugggaauaagauuaauaaaagcuacaauauuuuaagcuaaagguugucuuuauuuauguccuuaaaauugcauuuagaaaugucagauaaaauauguacuaugugaaccagaugcugaaaacgauucccaccuauuuauauuagaaacauuaagagaggaaaaagacuuguuugaaaucauaacugaauuuaaaauaaaacauuguaagaccaaaaaauggagaaaucaucauuuucuuugguucuacaauaugagugauaauuuauguuuugcaaauucaauacuguauagaggcauauuugaaaauauagaaugaaguaaaaauaaaagcacauugggaaaguucaugaggcauuaauaauuuuaauaaaauuaugcuuaaucacaguuuuugaauagguauuauaggaguuuauuguaucauucucaaauaauacuugucaaauucauaacuuucacuuacgucgaaaagucaacgcuuuuuuaaugacguagaaguaggaguauagcaaaaguccuuuuucagugccaugaccgagagggaaaaaugguguagugccgauaaaaccuggaacagcaguggacagagauacacauuuuuuccuuucccaacugauauaugugauauauucgcacauaaaaaugaugauaaagaauaauauuaauauaaguauaacuaaacuauauaaauauuugaggcacguggaauuguaacaauuauuuuguagcaauucuuauauggaaaacuauauccugaauuauaaucaacugaccaacagacgaauauuaggaguaucaacauagucauucauacguuuaucagacccuuucagucuguuuuuuccucuaucaguuuuggagcuaauaacauauuucaucaaauccaagaugucaucuauuauaagacauauuguuuuauguaucaccaugaaaggaaaacaaaggguccaguuuaaugacccuuaauucuaaauucaauccuaauuucagaggugauaaaauaugaaauagcguaucauagaauugaugaaagauuuuauuuucuuaauaugcuaccugauauauuuaagcuuccauuuuuaaucucaaaacuuuuguauuucuauauuccugcauccaguaucauuugucauucugugauauuauuuugucuuucuuuuggcucaguaucauauaaaauccuacagcuaugucauuauuuuccauuuuucuuucuuaugucucuucuuguuuuuuauuuuuuuuuggaaaaaaaaugauuuacugcaguagccaucuaaugaaucuuaaggauaucucuuuccaagcuguagcuuaaguaaucuugaguccaucuaucuauuuuuaaaaaagaaaacuuugaccaugagcugguuuauuugaacacuguauuauuauugacauaguuuaagaaaguauauauguagcauugaacaugaaaucaauauguuguuuguuaaaaauguaaauauuauuuuaaauuuauguaucacauugugcauuucuuguaauuauaauuacaaaguccuuacaguguugcuaaguuuucuuagcuauaaacaucuccuuaucuccccuuaauacuuuaaaauagaucguugcacagauacauagagagauaauagaggaaauaaucacagagcacaagcaaaucaaaauuuagugacuauaauugaugcauuaccuagaucauuuuuaggaaugaaacauacuccucuaacuccuaggaguucugaugaaagauggcccuuagugucagcccacaaagcugccuugcugaaggucagacacccaucugugaaagucuucaucuauugaucgauccucagaaggcacauaaaggccuggugaccuugacccaaaugagaauaacuaugaaggccuauccugacuccauggcuccccaugaaguuagcuuaaggucuucuuuggacuguaucacugcucacauucucccuugacucaauccugcauccuuuuccucccucacauagguguuuaaugccaggagcauuccccaauaaauguccuauauacaaaucucuaucuugaagucugugucuaagggaacagauuggacagcagcuaaaccaaaauuuauaaauaaaguacauaaauguauuucuucauaaaguaguacaagacacaagauggugauuaauuugugacuauuaucuguauguggauggagaaucuaggcauauuuccccaccaauuauuuaacaauaauugaaugagaccgcauuggcagaucaugcuauuagcaacacaaagggaguucucuuucuauaaaccgaaggacagggagugcugagaaucaagcucagaucgaugccuuugcuagccagaagacucucagccuuuguguuacacagagagcccagauccaguuccuucagaggcuagaucaaacccauuauuuuuuucucagcuuuuauucugagggaaagauuauauugaaauauaauugcuuuuauuucucuaggauuuuguuugugaaacuguucacccagauaauugauggcuauaggaaaaguauauuagauccacuuuucaugcaggucugucugcaaauaaacuuuauuuguaaauugcauauuguguugauuuugaacacuauuuuauuagcauaaguauuuuaagagcugucccccggcaugagaaaaauauuuccuauuuaaucaccuauguuucugugacuauacuagguauuagaaauucagugaugauuaagacaucuccaguacucaccauauucaaacaucuggugauggagaugaauaauguagucuccuuacagcacaguauuuuaaagguauacuugaggaauguacaaaaagcaaaauauaauaggauuacaaaagauauaauaaauucagacuguuauauuagggauccuuauaacuaaggagaucauauuagagcuggauuguaaaauagaaauaggaaugugccauguguggaaguaggaaagucuauuucaauacuaaguaagagaggcuagaaaacauauaacacauucauauuaagaguuugcuuuuugcauaagugacugacaagaaauaagacuaacugaggaguuuggacuuuuucuaaaaucuauaggagcuauugaaaacuucuuaagcaggagagcacaauguuuacauuuguuucagaaagcaaagcuugugacacagaggaauacugggggagagaaggacuacagagugaagaagacacuaauuuugaggacaguguuugaaaugcuaacauagaaaaaagguuaggguuuccaacugaggaagugguuguggaaacaggaaaagaccccuuugaaagauauuucagugguagacucaaaagaaauaggagacuuaucaaacauagugcaaaagugggaugagagaggggacauuccacacuggcacuaaggucuuuuuugaguggaugauaaagaagaauauuuuauaaggguucaucacugguagcaggcauauauuagcaaacucuaauggggauggugacagguaagccaaaacaacaacuaaauuuuuugccuggaugaacauugauuuacauuccuagauuauugacaucuaaaauaagauuauugaaagaaaaguacauauguacugaccuaauuugggauacuuguuauucuacuaauauugccauuaaauugaauauuuuauaggcuggaauauauauucaaauuaauggcaauauugguagaauuaguagaauauacauuaacuuauuuuuaauauuuuccauuuuuuucuugcuguucacuggaugauuucuuuugauuuagcuuucauuucauguauuguuucuucaucuuagucuaauagaauauucaacaugucugacuuuuuuucucauuucaauaaacacuuuucuagcaguuccauuuggauuuuuucagauaugccugugguucuauuuuucauuucuuauguugcugaugagaacuuugagaauugaaucuucuguuuaauuuuuaggugcuguucucuaguuguuaauaaaaacuauguuccacuuacuuuuaugggacuacauaaaagaaaugcaaacagagauugggcuuuaggucaugggcuuuuagaaguuucaaggauggacauguuuacauaaaaugaaaaaaacauucuaaagguagagauagcauaaacuuaauaccuuuauuauaaaccaauauaacuuaauuuuugaaacaucuuaauuuccuaauaugcugucucccaugccauaaaaucaacuagacuuuuguuuaauauaguuaguagauaacaaguaucaaagaaacacaaccacaauguaguuggaugaguuuauaugacauguuauauauuuuccuugacuuuaugguggagucagggauugccaauacuaauguucacauacauggcguuagucuggguuuuaaugucauguugucauagaacuuaauuuuuuaaaccuuauauuuuacuguuuuuaucaaaaagaugaguuuagaaucuauacauuuuuauuacuucauaaauauagcucucuauuuuuuaucauuuccaaaacuucuacuacaugaagcaauaaaauugaaacaugggaaauuauaguauuaaacaugaaaacuuuuuucaccaaauuacuauugauaucuaauauugacaggacuuuaaauuagaauccuacuacuccuacgacucuuuaggggaaaagagagaacaaguacaagaaagccauuaggagagaaauuucaauuuugcaagugcaagaaagaaacauuaagcuauaauuuaaaaaaguuauugaauaccuccagaaaccuugaagcaaauuuaauuaaugcagccaaucuacuuuccuuuguagauuauauuuaaaagaucaguaaucugaggaucagcuuucaguuuauauaauucagugauauaauauuuuaaauauuaaauacauuuuuauuuucaaugguauuaauuuuuuaaaaaagucuuaaauguaugucuguaacaugagguucacuauuaauuauccuggguuauagauuaugguauaaauaaaucaucacaucacuaagaaccaugccuggucaugugaaaaguuaauacaauuuauuuugauagaaucaaaaaacagauagauauacuugaaauuauucuauaaacuuggauguccaugaagaaagagaauuacacugucaaaacugccaagaaacaggaauugcauauaaugccauucugagaagacuagaucauuagugugccacagguauucuuuuauguaugauuaguggaauauucaaaauuuauuucuaaagcuguuucaguguuaacacaauaggacucaauuuuagauacaaaaugaauucaucuuaauuggauaccaauuuccuuggccuauagaguguuauuucagugggaacuacugugaaggaauacugaauagagagauaaaaagacugugcauguguucuaugugugcauguguguguguaagagagagauaguggauauccauuucacagguaucaaaaguagauuuaugaccucuauauacaauaugauauaaaccaccuaccaucuuaaucaaaauucauacuuauaauaaguaaauaguuuacauacuuuuuuuuuuaacagagucuugcugugucacccaagcuggagugcaguggcccaauccugguacacugcaaccucugccuucugggcucaggugauccucccaccucagccuccacaguagcugggaccacaggagugugccuccaugccuggcuaugaguuuuuuuauuuguuuguuuguuuguuuuuguuuuuuguauuuuuaguagagacgggguuucuccauguugcccaggcuggucuugaacucuugagcucaaacaguggcuccaccuuggccucccaaagugcugggauuacacacaugagccaccacacccagccaucguuuacauacuuaaacugacacaaaagauauaugcuauaaagaaauccuuuuagguugauauuuaauuauugauuaaagucugaaaguuuauuagacaagagaguaaccagaaaacacaaugauuucucuaaggaaaauaauuauuuuuccgaguguuaauugaccaacauuuuacuuguuuaauauauauccuuaauuuuuucuuccuauuaaaugauauaauauucaugauaaacauguguuuuguuaaauuuaaaugauuacauauuuagcugcuacuauauccuuacaucuagaaaauuccucaagaauaauuccaaacuggcauuuagagacaauuuuaucuucuugguaagacaaaaucaccaauaguuauuaauucagguaaaguauuuacauagcugguacucuauuauauuaaaaucaguucugauuauauaacauucuauuuacuucaagaaguuuuauugccuuaugugaccuuuuuaaaacacugagguagaagcacacaugcuaaaauucaugaauuauccauuccaucauucuccuaucuguccauccacccauccacauaauguuaccuaaacaaacugcaucuguuuguacaugcacaagagaaagccaaacaccgaagcacuggguuuuugcaggagaaagguuuauugaguccacuggcagguagucagaggaaauggucauccagagcuaggggcuagaucagguuuuauaagcauaugguaaugaggugugaucugauuggaucuugcaaugaagggaugccagcaggcaugaucugacuggauccucucaugggacaaugccagggcucaaccagauuggauccuggauccugccaugugguguccacuucuuaguucguuuuccugauucaagcacuuagguuccaccugugauugaauacuugguucaucugggcaugcuuagauuaugugaccuucaaccuggggguccauaauaacugaauaacaacucaacauuguuacagaucagucuggaacaguuacaguaauguaguguuuuaaacuauaaucaaugaaccucuaauuuuauuuugugaagcuacuaauaaaaaagagaugcuccucccuuuuagagcuuauuuuccuuugcaguauggugugaaaggagaacuuggcaauauacauuucacaacugaauaccaaagccuauaaauaagauacaaaggaauaauauuuugguacauuccaguuggaaagcauccaccaaauauuuuauaaugaauauaaccuucaguaaugauaggaaguauacaugguugagccaaauuuagaaguggucaccagcuauuuauuccuaugucuuaagaaaaauaaaucaguuaaacaaguuuauauaaaugauauacuuuaagagcaguuuuuuuucccccaguauguuaaaucucuucaaauccacaaaccugauauuauuaugcaucacugacuaucuuucuuguuagaguggacaacaaaauugacaaacuagagcacagauuaggaaaguuacucaguguaaaacuacaguucaagcaagauuuggaucaaauaaguugucuguaaauuaugguaccuuaucuucaaaguuuuauaaauugaauaauuuguacuuccuaaaacuggaguagauaucuagucaauuauuuuucuguaguuaaaaauggguauacuguuagaauaugcauuuuaucuucuguuugcugcucuagguaugacgagaugcaucucacuuuuacauaaaaucaaaauucaguucacucugugaacuuuuuacaaaccaguuugagcagaacacucauuaaggguaauggaaauugaacauauacagacacuguuacaccacaacaaaauuuaaaucucuaauguauaggauauuaccaaacaugaaagauucaugagcugaguuggaaucuuaaaauuaaaagguauauaauuugguuuacaaaucaaaucgaucuuuuccauguuuauaguacuugcuauuuugucaccaaauguugcuacaacuagaaagguagaucuuuaccucuuuaaccacaugcaauacaccuaacaugaaauaaauguaagguacauuuaugcagauggaucauacuaggaacuuauggcaaaaauuuuauggcaaaaaaaaugaaugggcacugggagaaccuaaaacauacacuuuccugcucuggaaauauuucauuagcauucugucuggcuuuuacauuucucagaccuucucuuucaaucuuuaguuaccaaauuuuugacucggucagugucuuugucugauaggagcgccauaacaaaaugccacagacugggugucuuaaacagcaugacuuuauuuucucguaguucuggaggcugguggucuaagaucaaggugccggcaguggugguuucuccggaggccucuuccuagcuuguagacggcuguauucccauuauguccucacagggccuuuucucugugcaugugcauuccugguguuucucugucuucguguaaggacaccaggcacacuggauuacagcccaagcuuaugaccucauuuaaccuuaauuaccuccuuaaggaaucuaucuccaaauaaagucacauugagggucacggcuuccacauuuuucagaaggacacaaaucaguucauaacaguuaaucauuauuuauuauuucucuuguuacuauaaaaguuaaaauguggucuuaauuucaggccucuagaaguaggagacuaauucuguauauuuagacuuuauuuuacacaauuaugauguucucagaaaauguguaaguugaagugaauguuaaugaguaguguagcuuuguuaaauccauggaucuaggccacgcugccuggauuuguaucccagcuccaccacuuaucggcugagagaucaugggaaacuaacucaaccuuccgaugccucagucuucuuauguguauaauugguauaaauaucuuuaaaugcaauucaugacauauuggaaaaaccccuggcaacuaguaaaugccuuguaaguuauuaacuacuuuuauuauugagucuauauuucuauauauucugaguauugauaguuguacuuggauugcuuucuaaagggaaggggaauucuuaaaauuaguguuuuuaauugcaaguugguuaaauguauggacucuuuucucaggcuuucuugguuuguguauuuggcuauaucucuuccuggcuuaaugcccaauaacacaucauuuaauaaccucugguagccuaauuuugcuuaugggcaaaauuagaauuaaaagcagggucucauaguggugcugugagcauuauaugcaguaauguaaaugaagcucuuagagcauugauuaaugcaaaauaagaauucuuacccuugcuauuuuuagguauauaaauguuaauaugaugaugaccaaccuucaauuuaacuuuuuucuaaagguacacuucauacuuaauuuuauuuuguuugaagucagucaaccuuaacagaacaguggggcaaacuugucccaauuaccauugcuggaguucaaguccuuucuccuacuuuuccacacagcucuuaguagacauguggagaaggugcucuguucccagagaagccuuggcagauugauuuuauuuguuuguuuguuugucuauuucaaauuugggcagacaguuagcaaugucaguuucacaucuaaaucugugagggagaaauggaucaguagcuaccauauugugacaaaacaaaucaaaguuaccccauuuaggaccugacaguaaauuaugagggcaguagaggaaggauuucuaagaauacauaaauuuuaagaagaaauugggagauucaaaagcagguagauagacuugaaguuaaacaucuuguaauuuauccuuagaaaguaauaauacagugugcaaaauauacauaugaauaaagauguccaguaaaaaaaugaaaaguuguuuauggccuuguaugauuacacuuauuuguauuuuuacuuuuacuauguauguguaugaaaaaguauaccuuuauauauauccacacccuuacauaucaaaauaagaguuguuuucuuggaauacuugaaauuuguuuuacucaggaauauuugauauuugaauuacaguuagaugugaaaauaauaauaauaaaacagaacuggaguuaacaguaauuuauaauugagacacugcaacuaaaugucaugacccuaggccaagucacauacacuguguuucuuaaguuuccucauuuaauaaaauaaaccaaaaaaugaaaguacuuccucuaucucaagguuugcuguaggaaucauaugagaugaaaaauauaaaaacacuuugccaugcugaaagaacaauuuaaaugucagguaucaagguugguagcaauaaguaaaauaauaauaaugauucucauucuagaugauuaaugguugcaguguacauuuugcuuuucuguagagcauauccuuuugaaacauaaaaaguccauucugggaagaaauuuaaacuaaaugcuucauaaacugacaacaaggacuguauuuggacacacuguugaaagaauagggccagcauagugaaagccguuggugcucagggccacuguguucugauuugaucccagcggcugaaccacagaagcuuuugcacagacacuaucaacauauugcuuguucagucagaauuuaucuuguuucaguuauuggugcacuaacaaagcugcagagguaaaggauccucagcuccucuacaugccuggggagaggauuagaggcuuucuuuucuuuagguaacugugucugguuucaguauuuggagggcuuauuuuuaauaacugaagagaaaaagacgaaguaaaaauguuccuucugggagacuggaaaggcaauaugauuugugauaaaggcuccuuuuuucuacaaaauaaaugacacagaccuaauuacccaucacuucucugcauccgacuuaaaagccccauucuucuggccaguaugauucugaguaaaacaaaugcaagaagaaaguuuuuuuuuuccuuuuuuuaauaacuuuuacaaauuucuuuuuguucuaauauagaauaauuuauaaaaugcaucccuucaauuguuucuuaaacugaaauugaaacuguaagccaucccaucacugagcauuauuuuacgggauggaagcugucaaaaacuacuuuaaagcuaacacuuggccgacuacaucuuacagggggguucucugaguauuaagucuuagaggaagcacauagccauugugaucaagcacuacaaucuuggcuuuguagcuuguuacagcauugagggcuuaauagucaugauuaaaaauguguauaguguaugacucucuggauucuacuuuuaggauggcaugugagauaguuuugugaccugcuaaaaauuuuaaucuucauauuuaaguccaccuggucacaaaucauagaaaacacacccuagaugcacaguguacuggaaauaaaagugacuuuagaacaagugagauucagguucacauucuggcagagcuagaauaagugacucauucuaaagucacuguuauuuccaguacacugugcauaacuauaggugagugcaaaaguaauugcuguuuuugccguuacaauggcaaaaacgcaauuacuugugcaccgaccuaauaggugugacuucacuuuuauuuccauuacgccguacauaacuauaaguugguacacaaguaauugugguuuuugccauuacuuccaauggcaaaacccaccauuuuucaccaaccuaauaggugugaccuaaggcaagucaauuauauuaucugaacccaaguccucaucuuaccuugcaaggaaauuuagaggauuagaaaacacauguguaaaacaguguuuacaagcucagugcaaugauagauuauccaggaaaaauauuuaauuucaaaauauauaaauugaucuuauaaaaugauuuuuacugcuacaguuucagaaauaaacugggacugaacagauuuuuuuucaaaauaaauacuauaucauaaucuauucgagacuucuaaaaucaacgcuucuuuaaaaaugcaacauauagaaagaacuuccuucuuuuccuuuccucccacuaguuuuagugccauugauuuaugaagauucacucaauuuauguacuaacauguuaccuucugaacagagaagacugaagcugaaaaacuccuucugaaaguggcuauccauuucuuaauugguuaauaaugccaugugggcagucccugguuuccuuugcaagacaagcuaucuugggaaacacccacuucauauuucacaggcacagaucaccacaaucagcucagucaacaaguuagcuccugccccagaugcuggaguaccagcuagucuguacuuuccuuagauuagaaagcuauaugcaagcaagaggcuacuaaaccaugcacagagcccucagacuauaggaagauacacauguauuuugggaauucaucauuuuggucaccaagcaguauauguauguccucaaaguucuuuuuaaccacuuuauuucaugcucuaguuauguuuauugaacucaucgugcuucuucacacuauucuaggugaugggcauuuaaagaugaacaagaagucuuuuuccucuucaaagagagauagauauaaaugcauguaguacaagauauagcaccuaaggaauauugcuaauauugugugugguaggcacccuuauaaaaguacauaguaaauauuauggcaucuuagaaugaggagugauuaauucugccuggaggauucuggaaggcuucaaagaaugggugauauuggaaggaagcuuaccaauugaagaaaggugcuuagaaacugggaaaaacuuccaaaggggaggagacaaaauaaacagaggugaggaggaaggaaauuucauacuucuuagguauagccauacacacagacaguggaucuuguuuagauucaggaacauaaagcccaugccaauuuggaaaggaucuugaaugacaugcuaaguaacauggacuuuauuccugaugcaauaaagugcuggcuauuuggaaacugucauuagggaaagacaaggauaaauccauaugauggaaaaugaucucugguagcaaugugggaagaagucugggguuggauuauuggugagguggagacugcaggcagggagcccauuauaaaaaucauaaaauaaucugagaaaggaacacaaaagggugggcaucguucacaauccaguggcauaauggagugacuuuugcuucauagaauacaauuuuauugacuguaggucauaaagaaucaugaugaggcaagaaaaucuacaucaacaauagaaauauuuuuagauacauuacuuggagggggcugaaauuucugugagaauauuuuuugaaaauuauguuuuuaaaagcuauucccccuuccuucuuguuccagcuacauguuguuugguggauaaaagucugcuuauucaaucauuuacguggucuucauucaauuaaucuauauggauuaucugcauguguuagauauuaugcuaagugcuggguguugaauuagacacaacguuugucuaugggcaucucacuguuaaguggaugaaaaugauacuauguaucagaaaauguaaugauucuguguuuggaaauuggcauuucuggaaaaaaaucccauuaaauaucuaaaauaaaucuauuuuuaaauguaauuuuaggaugcauucccuauauauugggugagauaauugcacacugcugguaaugaaacagaugauauuguguuagaccaucaauacagucagauguuaauuaggucacugugcuccuuuguuuuugcuaauuuggaccagagaagacaguuuuuacaucuauaguucaguuugaaaacagagguuauuaucuuuuucuuuuuuauguuaaucuuuucuaagacauaaaacuagaauucugucucuagguauuaaacauuucacugaggaugaggaaguaguuaugucauagauucuagcccugagugaggaaauccacaagucucccuuuauuucccauuuugagacaggauauauucacacaacuaaaacuugugcucagcaaaaaauacaguuuuggaguaguucgaauauuucagaauauguuauggaaaacguuaugguaacuugcaccugcucuguugcugagggaaaaaaaaaucuaccucuaaaaaaacuaccuauccagaaaguaaaucaauuuuuuaaauccagucuugucaaaauagcccugcuuaaugaccagaagucuggaguuuacagaauggaacauaauggaugacacuaauguauccaucuuaguuaauuacauggaaacuuuuggaacuugaguaauguuuauuguuggugucugucuccugcugaguacuacucaaauugaaugucacagaauuuuauucauccccaauuuuaaaagagcauucuguaauccagagcuuaucguauuaacucuuccucuaaacaagggcagagaugcaaauaaagagguuauuaaaauuggccuuaaaagacauagaucuuucauuaaaaauuucuagacaagcagaaacacauaagcuuaacucaaggagauuaacaugguuagguuagaggcuaauuguguuuugcaucugaaauguaauaaaaguuuguacccuucggggggaaauacagcuaagguucaucaauuuuuaccaucuuuaauucugaaaaccuugaaaaacuaauucagagcaauaguacggcuaguuaagaugauaaaucucuaauuaaacaaggagcuaucuucuuaaaugaauaaucuguaucuagaucucaguguaucucagcauauuuaacugucugugugugagggaaaaaaaucaagauagguucauaaucuuggagguagaaagcuugaguuauuuuggaaaugcuauugacauggguguaaauuauuaauaucguaauuuccuaaaagcaauuuugccacuucaugaauaugaacuuuaugaaaauuuuauuauaauuuuuccagccaauuacuuugucagaggacugcaagauggauucuuuaaaaccugaguuuccaucuaaaucauguuaaacugaaaggcuucaggcacugucauggaggggcauuuggucugugugugaaacaaggauuacaaaucaagcagggauguuuccuuuguuuuccaaauguuacuuuugcugccuguuuuauguuuguaauaguuacuagugaaaauaugauuuaagauuuaacaugcauaauguauacauuuauuaaaaguaauugauuuuauaauuauuaaaucauguuuauugaaugaagauucauggauaauauuaauaugcaggagacuaaagcugagaauuaugccuaauauaagagcaacaccaaccaaaauagaggaaauuacuguuuuauuuuguuacuuguaaauaugaucauuaaacuauuaaaaucucuuuacuauuucaaaacuuguugucaggguuauccauguguuuauaauuguauauuggauagcuaguuaaaaucaacagugcaaaaaacaaacaguuuuaaacuucaaacaauuauuaaucauaaggcagaaugaguaaauaggauuucacuugaaagggugucuagaucuggcaagucacaacuugacacgucaaggcaaaggaacuuugcacuccccacaccccccagaaagaauaaauggucuauguaucuacagaagauauuuuuuaaaaagaaggagggucugcagcaugaggggugaucagaccauugauuguggacuuggauuacacacagaacuuuguggcguuggaugcacauaauccuuaauccuggggcuuaaaacuagaaaaucaaggacacuaauauauaaggcucaaguuuuaacuagaugcuguacucuaugcagcugcuuuguugacaccuugucacauuaaauucaguagaaguugaaaguaagagaaaagcaacaagaaaaauggaaacaaaaagaaaucaauguguugcaguggaucuggggaccaaucugaaagacaagguucuaguuguauuuccaaugcgcauuuuccauuuugugauguuguaaaaguaaagucuucauuagauaccucugauguuuacaauccccacaauagaaauaaagaggaaaugagauguuccauuuuuaauauuacacauacaaucauuuuacaguguggagguuaauuccgcucacaaaagugcaugaaaggaauuaaaggaaacaauuugaacauuuuaauucuuuucauauauuucaaggggaggaauuaggcaccaaaacacaaaacaauuauauguguaauuuaaaaugcauauugauuuuuuucacagcgauaaauaggcaauggcaguacaguguaaagcuuaccuugcauaaaugaaacauuugccuaccuaauaacacaaaacuuuaaagacagcuguagcagaugccuagcucaucaagauaauauugguauaauggcauuacccugguaauuguuauuugaaaaguacacaugaaacaaacuagacacagccaaaacuguggcuuaaauuuuccuucuuccucuucaccauuuucaaaauguacugcuauguuuauuuagagaacacuuaaauucuuagaaaccucuaacagaauaucaacaaccucauagaacccuuugacuugcugcuaacuggauaacaugccagauaucauaauaacuaaugggaacaugcuuucaguucuaauauuagagauuauuaagucagucuuucuuuugauacucugccaauuuucucuaccuuugagauuucaaauacaaaaaaaaaacuuauuagauacauuuagaauauuuauuucauuucuuuccaacuuacuugacugaguuauaucauaugcaaaguuccaucucauauuggucauggugaaguuucaugugaagggaaagcccagacccugagccucaaaggcacuguaauuugcagaacuugaauauggguccuguuaggucaguguucuucagauguuucccaacuaagucaguaaauaaucaggaaaaaaauguaggaaaaaaucagagggugcgccagggaccuaacugugaucccucaaagcucauaucuugaagcgccaaaccccaaugugacuauguuugcggauagggcuuuuaggaaguaauuaaaguuaaaugaggucauaaagaugagguccuaaucccauaggcuggugccauuauaagaagagaaaacagacaccagagcuuucugucucugccaugugagaacacaggaagaaggcauccaucugcaauccaaggagaggccuuaccagacaccaaccaugcuggcacauuuaucuugaauuuccagucuccagaacugugagaaaauaaaguuauauauguaaaccauucaauucaugguauuuuauuaugacaguccaagcagacuaauacaguguguguugaggggcuggaggggccccucgucuagaguuguguagaacugagaaagaugucucaugcuccuuauguccugccagcugucagccauaccugguggguaggaaguugagaauagaaagucucuuuucuuuuauuuucuggcaaacuauaaauuaauugaaucauagggcuauuccauaguugucaccaugaccuaaaaaaacugcaacuaugacgauaggagcauuuaaauguaugagaauccagcuacauggacuuguacagacuauuauacaugccaaucuaagguauagaaaacuaaauaauugcaaaaaaaaauuaaguuuggauuuaaaugcacuccaauaaugcacaauccaaauuuuguaaccaaaaaauuuaacaaggaguuuccuuccucaaguuuggacuguuguaaguaauuuguguaauuaauuauuuuauccaucuauuuauucuuccauucaaucaauaauaacauugugaaccaucaauaaugccaggcacuuggagaacuaaugaggcacugccaccgcuuucaagaacucucagcaguugugggaaagaaagagcuucuaaaacagagaaaacagcugaaauucaucaaguacuuuggggacacaaaggacagagaaauggcuuugcaucagugcaggaaaguuugggaaagacuguaccucaugaccaacaaguaauggggauggaaggauccauguguaauauaacuauguggaauuacacaaacaguucagaggcagaguuaguagauaucagugauuaaucggaugcuucagugggcaagcagagaaacuaugauaugaauagacuucaaaacaaaacuuucauguucuauuaguuauuacuuagaacacuguuguguguaaugaaaaggaacuaauucaauaaaaaugaauuacuggcuacuguacuacauuuuaaauguaauuagaggacagauuagugaaaauaauauuauaaaugggcauaaggagacauuuguuucuuaaaauaguaacuuagugcgaaucuguugauauucauaucccuuugaugagcuucuaaaguaaaucacuauaauuucagcaagaacuuuacuuacuagauagauuauucuaauuucaauucucauuacagaaucuggaaauacacuaacagcacuaacucugagaaguuuagaagaaaaagcuauucucuuauaauccuaaccaaauccagccaggaaucucucuuugauucucuaugcgaucauuagcaaaguaacccuccuuguauugccagaaaaaaaugcaauaaauaaugaaaaauaaauuuuucauuccucauuugugauguacaaaauuaaggucucucuauucacaaagccucucuccugaacugggugagacacaccaagauaaaaagaaaauuuugguuaacuucuuaagaguaguaaguuauuagcuaaaacaagaacaucaaguauuauugaauuucuuauacguaauuacacuuucuggaacugugagugauucaaauuccacaucauauguaguacuuagaucucucagagagcuaacugauuuaccaauuuggcaagaauaauaagaaauugagaagagaaauauacacauucaaaauauuaaauuauagaauuaauaccagaauuuuaggaauaauaaaguggaaaccagagagauugaguaguuuacuuaagguaacacagguaauuauuuuaagaacuaguaucuagaagccagauuuccaggugccuaauuuuuguuuguuuccuugugcuuuuuaucuugaaagagcuaaauaaaugaguuguacagauuauauauauauauaauauauauaauauauuauagauuacauacaguauaguaugacuguuauuuugcaaaaggauuuugaccaaacuguguuuuauauuuuuccaaauacaucugaauugcucuucauuuuuccaaauuguuauauuuuugacauaagcauuuaauguauuugugaauaggauagcacucguuuuccaaauaaaauuuugucaacaaauacuuucagaugcuucuaaauguuaaaaucaaggaauaaucuauguaccugcguguucaggcauauuucauuucccauuaucuuguuaaugaaguuaaaacaauuacacuuuaucuccaaaaggucaaaggaaagaacacauuuaaaugacaguaaauucuagaucaaguuaagcagcauuguaaaucacagugcagauagauacuaaauuaaaagaagauucuuuguucaauauaagggaguaauuuuauugaaauuagguucagguuauuaaaacuaacuguaaaugccuuguucaaaaggacaggccuauggcauuaaggacaaagaugauguaaacuuagucuuuaauguaaacuuucaaacuuuguuaaauauucuuauacauuagugaagccucaaaagauauucauaauaguaguagagauaaaaauauauaguauuuggcaucaguauugaaaaaauacauaaaaacuuuauuauaaaugaauuauuuuuuaaggaaaaacauguggucuacgucaccuauugaauguguuaacuugcuaauuacuuaauauuuggaaaaagcuuugaagaugagacgugcuauaaguguuaauauuauuauucgaguacuauagucuccauaaauugaaugcgcuugcacaugaaauaucaucccuuugaucccccaggauaauuagcaguuucugccuucuucuaaaauuauaaaucauaacuucucaaagguuauauuagaaucacagacuacuaaugcagagaaagaaauagauauauuuauuucuccccaauauccauauauauguggauauaugaauauuuggaagaaaaauuuuauguauaaaaaaugugguauuuuaauuguauagauaagauaaauggaaagucagauacuggauuaagucaacagcaaauuuguaaugagauaccaugugcuuuugguggacacuauccugagauggcaaagauuagaagacugauuuuacaaaauaagucugucaucaaaacaauuaaauacauaucuauugcuaaccagaguaccauaguauuuguagauauaaauugaauguguuuggugcaauauuuuaaaauaaaauuuauuucaaauguuaguuuuuugaaacuaugcacuguagcuuauagacuugagauagggaaguagaauaauaaucaguuccaaagaaucuacagucuaacacugaaggcucagaaaauaguucuaaaaagucaaaggaaagagagauagaagacaaagacagauggaaaaugcuaagauacagcuauagauguaaaaaugcacagagucaaaugcagcagucauuugcucagcaacagagaacuuccuaaggggcgucccugcaugcugaaggauuucugguuuaaggugaaaaagcucugaugauuuacuuuucacuaggguggaaaagacauuuccuuuagaauuuuauuuuugccacaugcucuauuuuuaugcaggagauauuuugcuguaauuuucucuagcuaauguaccuauuauuuuaaaauuauuccccagagcuaauuaagucuagcagguuuagauccuaucgucucaccuuauggcuuuauucucuucuaauugcuugaacaaugcuuucugucacaagagacggcuucauucugaauauuuggaguauuaaguucaacaaacaucuaguugagguucugauaugugugaguuuuuuuuuuuaaucuuaaaauuaaaauacaaaaaaguguucguuuuugagauacuuaaucuucugcaauugauauucuguugcaaauucaaaacaugaaacuaguguacuauuagguaagucucuaaagggcaaaaagggguggaaaacaaguucagugucuaaauaauuaagcauuucucauuuuucuuuaauuuaucuguauaaguuagcuaauuauagauauaauuuggcugaggauauguggccuuugaguuuaauguuaauuaccuuacuaugguuccuugcaauuaauuuuaaagaauggaucaagugaauuguaucuagagccaagcaugacuaacgugaugugaaaaaaauaaaaggucauuuucaaaagcaucuuuaugcuauauagauucuuaauuuaacuggcaagaguauaauuaugauuuuuccuauauauaggcuaagauucucauggaaauauuguauaaaguauauuuuuguaauuuaaaggugacagauuacuuguuguuaggugaaaaaaaaaaauccuaaauuauuacauauaauuuguugauauaucuuuuaccuuacccaguuaccaguuuucuuuuacuaagcaaugaauaagaugacaaugucuuuccacauugcugggagcccuacaaacacaggcuccuaaaaaaaaaucaaaacaaagaaaaggguauguuuauuugcauuuauucauuccugaaacuuuugugagcaccuacuguuugcaugacacuguacuaauuaauauguguccugacuacaaauuugaauauaugauuccuguccugaauaauaugauaaucuagugacaugaaaaaagaaaacuguaauaaaacuugauaagcauuaauauaguaauagaaacagagaguaguaggaaugcaaagugaagcaguguugacucaggcuuggaaaaucaaagcaagcuuuccuaagaggugagaugccugguucuuaauuaguacagucaccaaauccauugagaaucuaauggaaucaagggaggucccugcacuggacaaaugcaaauauaaacagaaaugaaaaauuguucauaaagucuauguaauaaauuagcaugcauuuuauucauaugcugaguuaaacuuuuauaaaauguuucacuauuuuuaugcaaaaguuaauagcucaauucaaaaaacaaguaaaaagagcaagaaucaaauuuguacaaauuaaaguaagugaaacuuugacuuuguucaaaauuaauuuauuugauaagacaccugcuugaauaugaauuuaaauuugugcauuuuugugaaaugugguuauguauacaucaccugugacaucaauugaaguuguccuguuuuugauuggaaauaugcaaaucuugacaauaauacgaaguggaauuagggcuucuuuugucagcucuguccaugagagguuaacuauuuucuaaaacaccagaauucuccaagauucuucauuuaaauucaugugagcaauuuuugcagucagauuuggccaggacugcuucacuaguguuuucuaugucaauaucagaauuaugcagccuguguucaauuuuaaagccaaaucagcaaaagcaauaaucaagaguucuguuggauuccagggcccaaaggcauuuuucuggaauaauuugacaaggcuuugucacuaucaacccugacgaagcacuuucuauagcauuugaaaguucauauaguuguccaccugcuaauuucucuccccaauuauuaauagcaacuuggauaaaauaguucuuaguuuaucaucauucucaagaacagugucacaggguucuaucugaaauagagaaauacccaccaaguuagucaagccaccaggaaacucugucagcuuguuuugaggaugaguuuucuaucucuugaacuuuuuuacugaaaguucaaucaagaucuuuggaacuagugcucuggaaaguugacaaacuucuacauaggacaaacaaacuucauauucucuuucuauucucuuggcauacuucuuaaaaaggcagugauucaagacccuggcucugauaaaguugacaacuuucgggacaguagacaaaaauucucucaggauuacuggcagugucuuuauugccauuauaugacagcuuagaaaauagugagucacagucuuguggggagcuccuuucuucaccaaagcagcaaaacuaugcugccaauccucacaggugcuccgucuguggacaaauuuaccaacccuucccuuccaagcuaaguuuuucuuggcaaauaaacuuuucacacuuucaaggaugucacuguccauuguaguuuucaaacuggucccaggaaauaagaaauuuuuuucgaugcaacaaaauaauaucgcauaauagaaaugacaacaauuuuguagauauagucacugacaauauuuuauucugcuccaaaccauaagugagcuggauucauuccaggguucaugccaucacgaugaucgugccaaaagaaguguuucuucuuuuugcuucacaauguaugcuuaaaacaaauauauuuauauuggagaaauccagauucagguacuagauuaccauuaucaagucgucaucucaugaugguaaucuugauuguaauauguauuuuaguaaugaacaaauguaagguaccuuaucaaaaauugugaccuuucagcauaaucuuggugugcauuacacacuaauuauaugucucugaaauuuacauauaaauggauaaacaucagccauuuagagaagggcugggcuuacaaugcaucgggaacauaacaagcaaaggcaaaaugugguaagugcauguaggauuuuaaagaugguggaaaguuuaguggggucgaaguuuagcuuauugggggaauaggaaaaaaagaauuacuuagguucaaaucugaaggcuugauuggacuggggaauaugauuccaagauggcuuaccuauuuggcaggcaaauuggcacuauuaagaaaacuucuguucuacucuaagugggcuucuuuauacaauugcuaguguauccucaugacauuagcuucucccagaguaagcaauccaguagagcaagauaggagccucaaugucuuuauggccuaaccucagaagucacauguagucauuuccuuaauauccuauuauaaacacagucaaguuuauucagugagauggggaacuauacaagguugugaaugccagaagucaaagacuauugagaacuauuuugaaggcuggcuaccacauccaauaauaaacaacugcugucaucacacaaguaaaauauauagaagggucaaccauggauaggaauaaaaaauaaugauuaccuuuugcauauuaguuagaauugaaguagacaaacacuuuagagaauaaagcaauucuuuaagguauuuuaauaagucggcuaauaggcccagcaauguacuuucagugaaauuugcauagucacacuaaaaauaauuauucaaaucuucguuuaaaauugugcagguuacacaauuuuauaauugcuguucccaauuugugauuuaaaaauacauuuaaaugaaauuuauuauuuaacugcauuauauaaaugccuuucaauaacagugagcauauaacuauuguuuacaaauauuuauuuguuaaagauuuuaauucacuuucccaacauauuuuuaacauuaaucaucauuaaauuuaacuuuauauacuauauguaauuaauuuuuaaauuaugauuuucuuaaacuuuuugaccuuuuuuacaauauaaagauuucuuuaucuagaaaagcaguggacuuuaacagaaucaaacauuguaacaucauugacuuuuuaaaaucccauauaagcagccauuuuucuacaccacaaugugaaauacuucaacuacaaaucaacaaaagaugucauagcaaaaucugcaccagauguagcagcacaaaaauacagguacuuuacuucacauuacccagagccugauaugcauuaccuuagccauucaaaauagcugcuuugaaaguuuccagcauuuugcuguuuagccugauuuauagagcgaaauaauaacaccaacaauuuagcuuuuauuaaugcccuacaguaugccaaaaauugggauacaaagaugaguaaaaaauggugcuuauucacaaaacgcucaccuuuuaguaggaaagauugacauguuucuguucagcuugcuuccuggcuuaagguuauaugcguugacaauguguacaaugacaaugggaaacacagaggaaugagcuugaggcuaaauucucugugcuauagagcuguguauccaaauaaaaauuugugcaaacaacuuuuggugcuacaauuuuauaugcuuaauuuguuucauuuuaagccaugggaaaauucaguuucugaucaauaagccaugcuaccacuuguggucauugaaauaucucuuuguacuuacuauuuucucugccuuggauaaacauccucagauucuuucuaaggugcuucauuuuuaucuucaguuuuaugcuuauuuauuaaguauuuuuagagacagggacucacucuuuugcccaggcuagaaugcaguagugaauagcucacugaaagcuuggacuccuaggcucaaugaauacuccugccucagccuccugaagagcugggaccacaggcguaugucacuacaccuggcuaauuuuuugcauuauuauuauuuauuuuuauuucuuuagagacgucuugcuguguugccuaggcuggugucuugaacuccuggccucaagcuauccucuugacucagcccuucuaguuucuguuuaaaugucacuuccucagagaaauuuugguagccacucuaaaguggacacccaaauuuccuauuucauuauacuauauauuuccuuaauacaacuaugcauaacuuuuuguauauuucugauuacuuaucuggauccuucauuagaauagaaaaucaguccauaugauuuugggccagugguauaaggauuguaauaggagaauaucucuaggauauccuuuuuuguuucagaacaaaaaaaaauguccaguuaauugacuuaauuauucagaaugugucaaaaauauguuaaaggcagaaaagaacuaagauccuuaauguguguuucuuuucuuugaagaugauauaggauuaaucaccacagguugagaagacuagaagagcauuuuaaaaguaguauuauuccuuauuagaucccuagagaaauuuuuaguuucuauuugcuaguagauguaaggcuuguuccuguccccacccacucaccucacccucacuauuccacccgauuuaucaauuauuuagugguucccuuuuggggaaaaaaugcuggguaaauauguauuaagaauuuaugaaacuugaaggcgcuuacacauuuaaagggguuauaaaccacuugcaaaccuguuuaaagaacaagauagaaaaggggcaagcaagaagggauacgauuuguuucuaaugauguacuguuaagcaauuuauuuaguagagacuucagcuuucugagguacaaaaauuaaaaaggaguugugauugaaacaaacucuaaaguugcuuccaauucuaacauucuguaagguaauguuaguuuaacgaagaaagaguuccaugggaauuaagugcugucguuaucacuucuaguagaggauaauaaggaaaagcugcaaaaaagaaaauuugaguuuggguagagucuucggggaugcauaggauggcuagauuuugcacaauuagagguaaaaguggaaguugugaaauagaaaggcuauuggagauagaugaaagugcccagagaggaaaagcagaaaugagucaaaagaguaguugguccauuuuggcuggcuccuguuuuacauaaagcuagauucuggaaggccuugucugccuggaugagcaguuuuuacuuucuuucugugcaagugaagaauauuuguauacuuggugcuauaugcuucuauacagaauauuucaucugcuugaggaaagacuuaaugucuaccaauguguaguaaaaauuaaaagucuugaguguuaauuaauaaaccaaaugcuuauuaggauguuacuaguacuaguaaucuuuguuaauaacuauaauuucuuaaguuuaaaaauugaauuucuggauuuuucauggcuucagugcguaagaguagagugauuacuuauaauaggaguauuucuugugaauugaaaauacauacugaucaaacucaaccuuucaaaaaaaacucugaaaucuauuuuugaaucauauauuauuauaaaagauucuaaaucuuuuaaaaauuuuaguggauuacuuauaauuuaugaaaaucauguuuacuaguaucugaugcauauuaagcuuacauuaauuuuuauauuaaaauuugcauauuuuaaaaauuagcuuauauuauuuaaauacccuguauuaaguacaauuuuaggaaauaggaucgucuagcauaguuacucauuaaaauugaaugacguuucuuuggauuuuaacucuauuucugcucugcuuuuucauuuucuuacaugcugcaugacaggagacucucagaaauaaauauugaaaugguuuucuagggauuuaacuuuggaucacuuauuaauauuaaaucucaucuuuuccuuguaugcuugaaaugcuuacugaaauggaugagcagauauuuaaaaggcuaagaacagauugcuggcacaaaaaaaaaacaaaacaaaacagcaaaacuaaucuuuuaaaugaacuugggaagaagccaggaagacaagaaugcucaauguaagaaucuaaagguuuuuugauacuaaguauggaaagggugguuaaucuuuucuuuuaaucuguuuaccauucugcguauuugaaaauuaaggacguuggaagaagauggauguuuauaggucacacagauuacuuccccaacagccugugaaauagcauucuaauauguuugcuugcaauauuuuuauuuguuucuuguuguagaccuuuugaucaucuuaucuguguuaauuuuuuauacauuaaguuucuucugacaaauuuacguacuuugaauuaguguuuucuuugucuuauaucuugcauauuugagcuauuuuuauucuguuguaguaaaacaaacuauaucuagaacucagugaaaauucuguaaaaguaccuuucauuaccauuggaaauagguuuacuuuuuaguguccuuagauuuguuugucuuuaauggucaaaauaacuaaagauuuaaauaacuaaagauuauuucauuugcugccaaguugaaucuuguaccugcuuuuauguauucuaacauagaucuguugcuucaggucauuuaucuggcuauaaucaugaagcuauaauuuauuuaucauuuugaaggguugcagugcccuaaacuaaaugucuuugaauugaauagaggucucaucucucuggagccaauuuuauuuuucuuuguauacuuuuccucaaaaaauauuuuaaaauuauaaacaucuauuauucucaauguguucuuucuuuacuuggcuuuguuuuucuucaugcuccuucaaaaauauuuaauuuuuaucauuucauccuauaagugucaaauccccuuuucuaagguuucaauauuuacucucucucaaacuuuaccuuuuuuugcauuuuugcucuauuauaggacauucauauuuguuaggacuaagacuauguacaaaugaacuuugagguugaaugacuuguuuuacaaacagaaauacaguuuuuccucauuagucuuccuuuuuugggauauuuugaauuuuucucucucuauugcccuguuagaugauuauauuuuccauuaauuacuuucuuucuacucaagggucuuuuuucagauuugaacagauuucauucauuuagcaaaggaauucacaacaucugacaaaacuguauuuccuaacaguuuuacaaaauccaccuggacucaugucauuuuaagauauucuuucgaaauuucuguagauaacuccauaugaaacuacauauuuuuuucuaauuuuuccuaugguagucucuucaggaucuuucauuuuucauauugaauuugauauauuguuaccaauaaagaaacaugaaauguggauguauuaguuuguuuucacacugcugaaaagacauacccaagacugggcaauuuacaaaagaaagaaguuuauugaauuuacaguuccacauggcugaggaggucucacaaucauggcagaaggcaaggaggagcaagucacaucuuauauggauggcaccaggcaaaaagagagcuugugcagggaaacucucauuuuuaaaacugucagaucucaugagacccauucacuaucaggagaacagcacaggaaacacccacccccauauuucaaucaucuuccauuuggucuuucccacaacacaugggaaugauggaagcuacaagaugaaguuuggguggggacacagagcccaaccauaucuauggauauuuggaugcccuaaaaagugcaugagaaucagaugcugaccuaucuaacuuguuuguuucuaguuuccaauugaugauuugauauaaugcuaaagauugucucauaauacuuuaugguccuaguaugcacuuuccaauucucauuagaauauuuuacuuucaaacacugaagaaacuucgaguagcuuucuugcuccaauuaugaaaagaaucagagauuuuaaucuugcaaaauucuaaugcagcuauguuaugugggugaggucaaaauuauauagacaagauagggcuaggaauuccuugugaguaugaaggauuauggagacauaaaaauuaaguuaguucuugagcaccaucuuuuaugucagagggaaaaagcccuauaauucuacaaaaucuguuucugaucccuguucuuaaguaccacaagcaugaccucggauauguauuauuaugaaguaaugcugaauuuccucuauucuuucuggugggaaauaagaaaacccagagguaaguaaguauuaacucuauucauaagccauuuaucaaaguaguaaaagaaaaauacaucugauaauuuuccuuugccaccaaacaaugcuauucuuuauuuaugauuaauccuuagcaccaaaguaaggugaacacuucccaagggaauguuaggcauuugcuuauaggacaauuuaucauaucagaguuuauguuuuuucacugaaugaaaguaugauuuuaugauacucuauuuuugguuugucagugcgauacuuuuaaugauucaguccaaucuaauugugcuuagcauuauaagcugcuugaauaaaaucuggauauauaugaaacucugcauuuaggauauaguugcaaagauagugugugccaauuugccauucacauggcauucaaauuuucuauuuauucaaauaauaauaauagaauugugcaaaggccaauaucccagaaaaaaauaguuucuucuuuauugucugaggauauuaguuuuucauuuucucuucuuuuuuuuuuuuuuuaacuuagaccuuugugcuaacuuuguuuuauugcauuuaucauugaacuuacagaauauugaggcuuuuucuuugguaggaauuucucaacuuuaucaaauuacuuaccaguaaucaagucuuaaugauauuaaacauuauauuuugaguaguuauuauaugucaagcacuguguucagcacuuuauaaauauuaacugaaacuccaagaauuaaauauuuuugaggcuucaaugauagaaacagcaucugcauacagauugguaugggggggucuuuacaacacaugaugauaaaggcuuuuacuuguuuaaaacauuguuuuaagauaguguuuugaauauugccuuuuuaauuuuuuuauuuccauuuuauguuuucuguaucauugagaaauaaaaagcauuuauucugacauguuuuucuguuggauauuguuaaauagcaguccuggaaguccaaccaaaauauccaggaguauuguauuguccuugcauguacuaauacaaaauggguuacagaauagggugaauuccacaguacuguuacaagugcuuuuccccgcgaauucaauaugugacaccuuuaguccaaagucauucagaccaauuucgaucaugauggaaaacucaaaaucuucaaauagcaugugauuucagacauaugacaauaugauucugagcaaugucaacacaguuaugcuagcuuuucauuauggaauauacaguucauuuuagagaaugcaguguucuuuuacuuuuaauccaaugugauuuuacuuuuuuaaguggaguuaaauuuuugauauucauucuaaagucauuuuaaaauuauuugugaauaauauauagguauaagaaaauguuauacauaagcauuuaccucaacuguaucuucaaauauuuauauuuauauuaauauauucuuauaugguauguacugcagagugggugaguauaucagucaggacccaggugggaaaacaaaggcaaugcugguuauuucaaacagaaaagacuugauaaaggaaaugauuuacaaaaguauuagaaaucuagaagaggaaaaaggcaaguagagaaaauguagagauuacuaauuccgugagaagaagaaaaccuuaaagacaguucaggugugaacucaggaaagcugggccuacuuggggacuuuggaggaggaggcuucauggacuaggccagguuagguaauucaugggcuauacagguaauuuguggacuguacagcagauauuugcuuuuaaggguauguggccugguaugcuaugccacucccacccccuagcaauaaagacaaaugcaaugcaugcagauuaauguguauaucacuaagcauacuuugaaaacaugcaacucuguagaguguagcacaaaacaguuuuagccccaucucuagccccauaucuguuuaaaacugcaacagggagcagaaauauuggguuauagcuaguuuagauccuuuacauuuucuaaauggucuaagguaauaaaagcauccugguaauauuuagucagaaaucaucuauauguucacggcuaauguguccuacuacaucuaggcauguguaauauacaaaauuccaaauuacauuccccuagcuuugggcucuuucaaacuuguagucugugugaggcauggugaggauuggcaagugacuugcguuucucuauuuccuugucuagugcuuaugugguuucugaacuuuccagaguugauggggaagaggguagguugaagggagauaaaaagcaaagaguauucuuuuauuugugcuaucgugaucugacauuggugcucucugugcuuggcagauguucaaaacuaauacuuucuugauuguuuuuguuguacaauucugcuugaagaguaaucaguuguguuuccuuguaugcaggaaaugcacucucuggcuaaauucuucugacuuucccucauccuauaguuucuguggguucuccaugacccaaccgguaguuuuguaaggugcagugccucugagucaucccaggcuggcuuucuauccauuauggcccaucagugguccaagugaaacacuuaagaccccuugcucugacaaccgaaggaagugcaggaaaauuccaacaugaccaccuugccuccaccugcuguuugaagaagaaaauagauaccaucucucuucuuucuuucucuggcugaaggaccccacauguuguuaauguugaagguucuuuuauuugucuugagguggagauucaccccauaggcuugcaaguauuucucaaauagauauauauauauauuucuguauuuaaucaaauguauauuauauauuugagagucucaaauauguauuauauauuuauauauaauauauauuugagacucucaaauauauauuauauauaaacauguaauauauauuugaaacucaaauauauauuuauauguaaauauauaaaauuauauuuuauaaaauauauaauauauauaaaauauauauaauguauauuuuaaauauuacauauauauuuaagaaauacuuguaagccuauggggugcaucucuaccucaugucauggguauauauauauauauguguguguauauauauauccaucuagucuuuucaacauaaaucauuuuaacauaacauaaaucauuucaacaaaaaucauuuuauacccacaagugggauuugagguacggagggucacaaaaccauauuugacuguucucuugaaaguacuaccacauaggugacuuacccugucucuuugugggggugcaguuguuaacccacuguuuaguccuaaguccuugaguacacaaacaauucaagacagaaaacucccacuuuaauggaacgugcaacuuuaggagacaaaaaaaaaaaaaaagccuacagaagaaaagagaaggaaugaauuaggaauaauauuuuuaaaaguguaaaauccugaauauuuauaauaaagacaccaaaauaccaaagcuauauauuaaccgagcauuaaaccccuguaaaggaaauuuguaaaucccuguaaaaucuauuggaagaggaccugaagaaauggaagagggaaacaaaggacaaaugauuaggacaauaggacugggaaucaauuuauuacaaauaacagguauacaaagaauugauggccaacccuaaauuggcauacauauagcauauuuuuaaauguuuuaugcuuaauuuaacuuuuagauugaauuagugguacuuugucuauagggaaauugauauucucaaacaaauuugucuuuuguuacaauuccaauuaagaacuauugacauugguuacuuacaaugacauauggaugaaccuaaacagaaaacagguuauuagguugaugucuggagagggauagagugcuucugauugggucuaccuuaacucauaguuuuugguggacagaggaauguugaagauuauaaaauugauguccuggaaaugguugcaagacaauauuugaauuggauuuaauuuuuaaccaaauuuaaagugcuauuuuuuacaacuucaauuguuguuuucuuuuauguuuaucauaaucugcacauccuuagucacauauuucauuucaagaaccuugaaauagucauuaggucuuacuucuuuccugcauacacauacacacacaaacccaauuccuuuucuuucaguaagguucccaguugauggacuuauucucugauuuuuuuuuuuuuuuuuuuuuuuuuuuuuuuuuuggucagugcucuuacugugcuugccaauuuaacugccgaggguuagcaggcugacaacuucguaauaaucagcaucuauuccauuuccauuuuauacucaaggucuauuguugccaauucauucaagaagguguuuuuauuuaagaggugcuuaagugcuggcuucugugcucugugaaugcaguccucauagggaauaauacuguagaaugguucauucuaugugacuccaagcuacugugaugcucuugucuauuucuauugcagauucaacacagaauuuucuuuccucuaauguaacaauuguuuaucuggcuuguauuguucucuagcaccuuuaaguuacgaugcgggauucgggggaagacuaugacaaagcuuugccaucaagaaacuccaaauauauuuggggcuugagaauuguaauacauacuagagaaucauguacauaacacauggcuaaauguaaugauaugugguauaaguauuuaauuuuucaggaaggauaauuauugaagguuuuguauaugucaguauauuguuuauucucagccucacauuagacacguauuuuuuaucacagcuguguacauuuuauacuacacuuuuccuucacuucagaauauauagaaaauacguuuuugaguuaagugccuacauccagcuuucuauaucaucagaaacacuucucaaauagauugccaaaauggucaaugauuaucaguguaaguuaaacugaauaaaucuuuagaccccucugaucaugaaaaauuccagauuucugcagcccuucucgccacauucuuggcaugcuauugguauuugcacuuaauacaagaaacuaguccuugaguauuuauuauuugaccucauauucauuccucuuaucaaguuccugaagguuucucuuuuauccuuuauguucaucagggauucugcauaguaaaaacuccaacaucuucuugaucccaauauugaguugguaucgggaaauacaaauaauuuuguuguuuuuuucucuccaacacuuggaggguucuuacuguuaaaugcaaaauggguaaugcuggaauauuagaaaccugaagaaauguaauuauucauuuuauuacuuuaccaagagacuacugaaauacauguucuccugcuuacuugucuauuguuacuagcagggucuuuucucuggacuucuuuaguggcaucuccacaccuacgaaucuauuccuuauugugcuuaccugguaauuuugaaacacuuauaugcccacaucauguaccugaucagaaauuucaauggcuucccagugcuuacaggaagaagcuaauguccuuagcacaauauucacauuccuucagcaucaaauagacauuauuuuauuauauugcccucuuaauacacguugaacuauaauuacauugcauaaucugcuguuucucugaacuuuucacaaucucuucuaccuccaugccuugacucauucuguucuguagguuuaaaauggccauuuccuaccuggcuaccuaaagagauccuaguaauucuucaaaauccaagucagcuucuacugcccucauucuuuccuucugcgaaauuuucuuuuucauguacucacauuuuauuuuguuuauauucauauuagauaauuuaucacaaucugacucauaucauuguuagaugugaggguucuccuuugcucaguagugagcucuuugauuaccugaauggugauaccuuaagaaccuaucagugucuuauacucaguaccuuguacucaguguugcacuggaauucauuuauuuuauuaaaauauggugauucauggagcauccauauuaacaucuuuucuaucucuuucuaauguuguuucuuggaacacaaaggucuuugugugcuuagcuucaacuaccaucacugugaacuaaugaagugauuauuuuaaaagauuauaagcuuuuugaagacagaaaugaucucuuuuaucuuuguacgcugauguuuuuagaacagaaaucauuugcaaauggaguuauuaugcagaagagauuuaaaaaauaauaugcuugagcuugcauacucacugacagaacacaguaaguaucucagcuaaguaaccuuucuuacugaguaacuuccuugaccuugaaaacuacuuuuuauugaaacaucauggcaugguggaagaaauaugaacuucuuaugagaauauauccagccccaaucucagcuuaaacauguuaaacuuuaacuuguuuuaacaaauauaaucauauuuaggcauaugucuugccacuggguuuuaaauacuacauuguagauauuuauccuuaccaaugcauguaaaaugaccuaaucguaugugcaacugcagaacauucaaaagcauggauauaacagacuuauuuaaagauuuuucuaaggaggaagccacuauaacguaguggcuaacaucuuugguuagauuuaggcuuuaaaccuuuuaagccuugcuacaucacuuccaaauuaugugacacuuuuacuaaguccugauauaugagaccauaguauuuagaaaaugguuaagaaucauuaaugcuagaaaauaugcuuagcaacagaaacuuuagcucuuuuaugaguguaaagaauaccaccagcagguggcagcaacuuugagugauggucauaaacaccaagaauggugcucuguuaauuacaggugguucauggugcaaauaaaaauaagcgaccuggcuaauaguauauccuggaaguacuucuacuauuagaguugcauuacauuuuuacauguugcauaauauuaaauaaaaaugaaauauuugucacaccuaauggaaauagauucagauguuugcaaugauccagauuaagucaaaacuuguaaacagauauucaugaaauaguuuauggcuuaauucugaauauaaaauuauuuaauucuguuauuugcucucuacauguuaaugaugaaggaaagcaugacaaaaaaugacaacgaaggcaguuauaguuuaacuuggaaaggcagagugcuucccaaagaauuucuacagcacaauugguuaaugauggauaaaaagaacucugucucuaauuucuaauugcccacguuuauuuccuggcucuaucaguuauuaauuauguggcuuaagugccagauuucuucauuugugaaguaggaauaacaauaauauugacuucauaauguuguaaagauuaaaugagaugacuaugaauuguuagcaguaccaggaauauaguaggcacucaauauauuaguaggcgauguagcaauuaucuuuuguaacauggucuuaagcuuuauuuuuaauuuuucuacuaaauaucuauuccaacaucucuuugaaaucuauaguacagagucagucucacuguuuccuaaauuuuauacuuaaaaaucaaaggaagaagaaaauauuuaaggugaaaauccagauacaaauuuauuuacaacagugauaaauguagaagucauaggauguucucauagguaagagcaacaucccaaguacaauuauuaacuuuguuccaucaaauagaucugacaagugucuaagauacuuaugauuuucuaggcuacuaaaaaauauaggauuuacaucauccauuuuuaaaagcucuuauuuuacuguuuuucucuaccuugugccacacauuuuacacugauauauauauuuauaucucaccuuguugcaaaaacaaaaagaaauuaaccauauugauuauuugcaguuauuuuggccuauuuacaguguccuuuuuuucuauauguaauucauauauauauguaaaguuaaagaucaguaaaaacuucuuaauauauaauagauguuuuucaaaugaauauacaucuuuaauuuuccauuuguguaauuuaauauugcuuuuuuuuuuuuuuuugagauggagucucgcucugucucccaggcuggaguacaauagcgcaaucucggcucacugcaaccuccgccucccagguucaagagauucuucugccucagucucccuaguagcugggauuacaggcgcgcaccaccaugcccagcuaauuuuuguauuuuuaguagagacaggguuucaccauguuggccuggcuggucucgaacuccugaccuuaggugaucugcccgccucagccucccaaagugcugggauuaugggugugagccaacgugcccagccaauauggcuuuuaauuguaccuuuguagugugcacauuuuuuccuacuauagccuaggagggcuuuacacacauguaaagccccaugggguuuuauauuucaaagcuaaauucacaucuauauaaauaaauaagcuauaugaaauaucuaggcaaucagucuaggaaaauagauugcuguaaacaauucucuuccaaaggcauugccucaguauucacugaaauguacuuaugcuaaaucacaguguaauucuaaaaacugugaauuguaggcaugguauuugaaagaaucaaauaguucugguaucugaguaaacaaauuuugaaucacgugccuguacacauuucaacuauaaugcaauuauuuauguucaaaguuauuucuaaaugucucuaucugugauuugugaaacuauuacaauacaacgagugagauaugggaagaacucuccuaacugaaaggggaaauaugaaaugaucuuaauucuaccuucucaagagccaugugagcuuuuccagagcauuuuaacuucugagcuucuauuuacucauauguaaaauuggggcuguaaaaagaccuaaacucauugaguuuuugugcagauuuaaugaaauaauaagcugccaagcacaagaucugcugcauagacaucaucaauucaugauagggauuuucauuuuuauggaaggcuuuaugccauuuaaacauuuucuuucugaguaugcuucacccaaagguaccacugagaucccugccucuccacuuaaccaugugugauuauacauucauacucacuucuaugucauauucuguagaaauaacucuagacacaaagucuaaaacuuaagcuuuugagucugaaugccauguuuaguagcuguuugaauuuaaacaaacauucaagcuuucugagcccucugucuuuauguuuaaacaaagggaagugauacuuaagucagugaaauaauggaggauguaaucccaauccgguugaaacggcuccauugucucagguauaugcccugguucuuugucauaguugagaaagaauucaggacacggacacacaggaagaguggguuuaggagcagaaaguuuaauagacaaaaagaagacagagaaaaggcuuccgcaugcagagaaagcugguagcccgagagagggucuccgguuugcggcagaaugcaaucgauuuccuacagagguuugaggaggcagugauugauuuacauagguccuaggggauggguuugaccagguaugccauuuauauagccgagaaaagacuggcccucccacccuagucuuuuauuaugcaaauguggccucuaccaggcguggccauaaugccuguacaugugguuuucccuggaggcugccaugacaccauaaacguggugacaaggaagagagugagaacugccauauugaauguaccuggcuuccagguacagcugcuggcauuuacauauaaaagcuccuaguuugcauaucuaucaggcugcuuccuguuagcgaaaaaaugguuuggggcugcguuuuauuaaaggaaaauuccaccaauaacuuuuacccuuucaagcugacuaaaaauaauuucuuaauaacuccuguauuauggucauguugugaaaaucauucguaaacuaucaucaccuacucugauuucuuacuguucacucugcaauaagguucagagaaugcaaaggccuuuugugaccuauuaaugagccuuuugagucagggaaguggcagcaauuguccacuaauauuucaauuucuuauggacaaaagauauuuuuuuaccugcuuuaucuauuuggcauucuguuuacuauauuaucacaaaauaagguccuguggauguaaaauaaauggaauaccuuuaucagaagagagaaaccaaggcauguaaagcuugugauuuuccccgaguuagacaccaaauuaauuaguagcaagcaaagaaguaaauacucaacauucuucccuucccuuuccugcucaucuaaaaagauauacaauuuauauuccacagugggugaucacaccugcaugcacaauggaaccccuucugguguuuuccaagggcuaaagaaauaaaacaguacuacagggaaguaacacaccugugugguuuuggcgaggaccacuauguauuguaacuggccaaauauuuacaaauaagaggauucugaagauaauuuuauauaaaaagcaaccaaaaaaaauucuacacauuuaacucaaguugauugugcuacauggcugcuguacuaacaaauaagaauacaagaaaacagucagauccuguuucaccuuccugaaauaccugcaguaacugagauaugaauucuuuaaaaagaggacagaauuuuguugguuuucuuauauaaaguagaaauauuaauauuaagcaauaacccauggcaggccaauguuucuggguaaugauagcacaccguaggggguguuuuacaguuugaguccgaguggcuuuauccacuucagggacaugaaauaaucccccugaaaugcauugccuggaguguuguauuaauauuauaaaaugaaauucauaaauacaaaggaaaucauguagauccaugcuuuuacuaggcaauauacaccauggaaaaaaauaacagucuaaacaugcagguccuuaaaagcuguuuuguucauaaacccaguuagaugucucauacauugaugucacuaaaguuugguguauuucuuuaaauuaauuaagugcuuaaaauuaaacagucuaucauaagaugguugcauauguuaauauguuuaaaaugugcaugaauuuacuugaaagugaaauagugugaaagccaaugauuaauguuucauacuuuaagaaacagcaucguuuauggaaauacauaguauuggaauaaaauucuaaccuguauaaaagccuccuuuuugacagugcuuuaaaaaaucuuuccauuauugcaggguaauagcuugacuguaaugucugcuguuaaaggagcaagugccuguacaaauauuaaucuuacauuauuacugcuaaauauucagccgauuugaauauuaaaauagcccaaagguucuucaauaaaacauaugauuaccaaaauacugcuguuccuuuuaucaugccaggcauauccuauacauauauuaaaagauuuuauaguugcuuaaguaaauguauuaauuuauaauaguggcaaagccuaaaguuuaauuuugugcuuuuagaaguguucuugcuauuauauuuggacuuuucuaguagaaaauuuugauucugugaguaacaauuuaauuacugaaacuuuguacaguuuuuuuaauuucuagaaacugauacaauuuuuaagaauugcuucauaaauaguaauaauagcuaacacuuauauggcaauuauucugugcuaggcucuguuccaaguacuuugaaagagugaauccuuuaaucuuuguaauaagccuauaagauaggcucuaucauuauucccauuuuuuaaaugaggaaacugggucucaaaguauuuaacuaaauugcuggagucuacucaccuaggaagugaccucaccaagauucuaaucaauauggucagguuucucagucucugcugcuauaugcuaaaauguauuugaugaagauguauguuagagaagcaagaugauuuuuuaaaaaggagaauauauauauguaugaauguaagaacugugcaaauaacauucuguaaaaagauuuuaugugugugaaauggcuucuuuauuuugagugugaauaaacugaaggaaacugaugaaacucaacuauuaacuuggguccugauaucccauuuuagaacauuauagucuaaaaaugacuaauuaauacugagaagaguaagaaaagcugaagaauuugcgugaaguccuuuaacucuagcuuucuguauaccauugcaagauuagauuauaagcagggacagcucaaguguaauuuuaaaauccucagguguuccuauuaccuuccuacucugcccauuauucugugcacuacguucuucuugguuccugccccucuguuccgaaacuuccugucuucuccauuugcacgucaguuauuuaggaugcuuaugaugggccaucccaaauuaucccucacagaaucuagguguuacagguuuuagagugaucauacccagcuaccuuacaaugcuugaaucacuuauaaacacaugagaaguaagucaucuuccauaugcagaaugauuauuguuaauguagacaaacaaguguuuuugagucagaccaaccugaguuuauuuucuagcucuucuaauuuuuagcucugugaguuuggguaagcgacuuccucaauucuagucuguuuuugucauuaaaucuggagaaaauaauauuugccucacuaggcuguggagauuauuuuuucaaaaugcauguaaaguauuuggcacaucuuggauauuccacaaauaaagcaccccuuccucuucuugaauauucccagugguacagaauguaucacaucaugagucaguucauuccacagaaugccccuuauuuuaggcucaaaccuuccucccuucagacccuuucugccauuuccugguuccccucuguguacaucugggccuauaacucauguaaccccaugcaaguacuagaaucucucuggaccucaguguucaguauucucaccaguaaauaaaaggauuucacaugagauauuuuucaaccucuucccaucuauaaaauucgguaaugcuuugugaugcucucagauuuaaguaucuccuauuuugcuacucaguaacugugaagcuaauaauagcaagcauguauuuuuucucucccuggcuugucaauugaaaggggucaauuuuaagaagauaauuacgaugaugauguuuaagauaggaaaugugcuuaauuuucaaacaaaauguccagcaaaauuuuaauauccaaaauaaguaaaaguggaauggcaccugaguaaaguggggcuggauauagaggaguccugccugcuuggccuccucagauccaucuuacauccacuuccucccuaucuccagugcucuugaaguaguuccacagaaacugaauuucaugaaacaauucuaaaaucacugcuuuaauccaaguagugucucuuauggugagccuucccaucucuccagcaagcugauguaagccaccucuucugcggcugcauaagauucaggaaagguccaauuucaaaccagcugcaggcugcuauauuuuucucucuuuuucuucucaaugaacaggguguccuguuaguuaaugugaaagccuuccaggacagucuaacuccaguugccccauggaagcaacaaaggaaacacaacauguaagauaaacucuuacgacuuaauuuuaagaaacuaugcacaaaacaugauuguuuuaagaaugcuacgugaagagcaucuuuccuucaguuguuuuuuuuuccauguguaaguucaauuucuuuuuuccuaagaaaguguguagaauucucagccaauauuuuuguaugauccuuguaaacaaucaaauauuucugucaucuuuuccaaggguauccggcauuaauccuaaugacuugaaaauuucaaugacuguaacuacauuugcuuuaucuaauguucucauguaaguucaauuauauguaguguacuuuuuuuuaucuuucugcuuugaaaugaaguucuuuuuaguguugaucaaugugaugacuacauuucagaaaggccugcuugcuuugucuuacuuauacaguugauaggauuacuuuaugaauaaaaauaaucacacauauauuauuauaauuuuaagugauaaaauuguguuucuucuaaugaggcucuuacauaccagguacccauguaugguauuugauuuuaaauaugccuacccauagacuacugucaauauuucuuaagcuucacccaguuaauaguacuucaguaguaucuguaguuauuagccgggcaugguggugggcaccuguaaucccagcuacuccagaggcugaggcacgagaaucauuuaaacccuggagggauccugggaggcagagguuguagugagccaagauugcaccacggcacugcagcuugggugacagagcaagacuccaucucaaaaagaaaaaaaaaaaaaguaucccuagcugugaccuuacaugugauaauuuuacauucuacauugucacuugugucaagugagcaccagagaacauugguuugacauauucugcaacuacaugagggcuggcuuuauauuuuuuacuaccuguuugcaaagcuguaagauuuuuuuuuucauauuucacuccuuuuaaacauuucuuaacacuucaauucuugugagaaagaaagaaauuaguaacaauuuuuagagcauguuuacauuuuucaguauuuauauuuuauucacauaauuuuaauucauaaaccuaccucaauucccaaauuagauggggcauaaaaacugaauaguauuauuauauguuggcuuucugacauuucuuuuuuagagauuuuuauucccuuaaucagauuauacauaaacaugauuuucugcagguugucgaagaacucuugaaauauaauuuacccuuagaauuacucuaugacauucaaaugcuuuguuuucuuuuuucauuuugucgcauauaacuuuuggagcacaauguaaaaguucgaauaauucuucaauucagcacauuguuuucuguuuaaaaguccaugauuuucaaugaaauaugcuuacauucuguaggagacagcauuacuugucaauaaacacgucaaaaugacuccguuacaggcacacaauacuggauagaucguuaaugauccauucuaugagugucauacuuaaugauccagaguggacaguucacauagcuauuucagcugcugacuagacaagccccuugcuugcuuuuucuuauaccuugaucauuauaaaaacaauacugagguugucuuuguuucuucccuuuucuuucuucuauuuccauuuuuauauuuuuuagagaugcaggucucacuauguugcccaggcugaucuugaacuccugggcucaagugauccucccaccuuagccucacaaagugcaggauuacaagcgcaagccaccauguccagccuucuucuaccucugaauaaaugccuuuguuauuuuguucccuucuucuuugcacuaguuuagucuccauauuuucaaauuauauuuuuguacucuaagaaucaaucuuuauauauuaaucuaaauaauugguugaucugguaucuuguuuaaccagucauuugacccauuaugcuuuuuccuuuagcguuuuagauauauucgcacuaucauucuuaaauuuucauuuuuacaagugcucaauucuuuugcguauuuugugucguucauucacuaaacaguauauugagcaucaagcccugaguuagggauauaagacaugguucuuaccuucgaagagcucuuggucuaauaagggaaauaaacauugaaacucuugcaguucucaaauugcuauaauaaaaauauguguaggauauggugggaauaugaaacaaagugguaaaguuuauuugaagaaggucagaauaguugacaaaggcagaauauuucagcagaaucuugaagguuaaguagacauauuccagauuuaaaaggaugugggaaguuauacuagguaaagguaucaguguguacaaggacagugacaugaaaucacuuagugcuuugaacucagugugaugugcugaggcaacuacaauuugugggugaagugagcagagguagguaggggugagaagauagaggguuguuuuaucuuuauucuguaggcagagagaaauaauaauugcauacauuaauuacacucauauagcagaccuccugguauguuaguaacauacuuuuauguguguucuauguaugccuaucuaaaaauagauguuuugugugaaagccuuucaucaguagaguauaaguauaauucauacuuuugaaaaauaagguacguauagaggugaaagauuaaagcaaggaugacacagaguccacuugaaagcuguuguaauggccacuaugaaagaugaugaggcauggauuacugcuaugcuggaguaagaagaggaagaaacaggcugaggacuauuuaagccauugauucaauaagauucagugacuggaaguguaaaaugaggaagacuucaagauaauugguuaggcuaacugggcggauuugggaagucaauuuuuaggauagaaauuucacgagauaagaauagguuggagacaggaccagugcuaaaauguugaaucugcgggagguaggguauuguaaguacagguguugauggaaaauccagguggaaaaaucuaguacaguguuucucaaagcuuaaugugcauacagaucaccuggggauccucuucacaugcacauuuuuguacacuaaauaugagguugaccugaguuucugcaauuaugacaggcacccuugggauauggccaugcuaucuguccagggaucacccuuugaguagcaaggauuuagagauagucagauuuaaugcucagcagaaagauaagagcuggagauauacauucacaaguucucagcauauuuguggcagcugaagccagacuaaugauuauuuauauagcuuuaacauuaaaaacaaauuuauuuccuauaaagccaaaauuugaaagacuaauaaaaaguugcaaauuaugucguucuggcagauuuaauauuuuuuauauauuauuuuuuaauuauuauuuauaccugguucucauuuauccuaucaaccagaaacacucuuauuugcagguuuucuguuuuuuguuuuuuuguuuuuuugagagaaacuuguauuuuacauggaaucuagugagcuaauagaucuaucauaugaaaccagugaaggcuaaauccuuuguaaguaagaaaaaucucauucuuuuaccaauuagaugaaaccuuucucaaaaugugcuaaaaacagauuggcaagugagggagaccaaacauucaggccgguaguacuuuaacccaugaaaagaacaugaaaugagaacauaaaacaugagucuugggccgggugcgguggcucaagccuguaauuccagcacuuugggaggccgaagcggguggaucacgaggucaggagaucgagaccauccuggcuaacacagugaaacccugucucuacuaaaaaaugcaaaacauuggccaggcguggugaccggcaccuguagucccaccugcucuggacguugaggcgggagaauggcaugaaucuggcagguggagcuugcagugagcccagaucgcgccacugcacuccagccugggcgacagagcaagacuccgucucaaaaaaaaccaaaaaacaaaacaaaacaaaaaaaacaugagucuuaagacuauuaucuuuggagugaggacauuugagaggcuaggauaaaaagccaggcuagcuaugcaaguuaaggauugauggagaggguagaaauaauguauggaauucaccaaguuauugaaaaaaaaggaaaagaggguuucagggaggaguuuguaaacagcauaaaccaagucaaugaaaguaagauggguccaaaaucauugcacuuagcaguuuuguaguuaugcaguugguggccauuuccagggcuauuucaggagagagagagggucagaagaagccaaaucacuguggcuugaagacuauauuggagauaaggaauuagaaggaaugaggguuuuuuuuguuguuguuguuuuaaagaaugucauugugaaccgugcaacagcaaaaggaucaguucacaaagucuaauuuuaagaauuauauuuuaauuucaauauauucaacuuugacgucagcuaguuuaacucuuuugugaggugugggagacuccaacuccuuuggagaaaaaaaaaaaaagguagcuuggaaguagagacaaggguuuuaguuuuugauuugccauuaauaauccauuuaaucgaacuagaaaaugacugcuaaagucacccagucuaaauuuuguauuuccauuucuucccuaucuuuccauuuuuaacaguaaaucaguugagaugagaaccacuucacagguagagcagggauaauacuuuauuugauccaaugagccaucugcuuuaauuaugucauuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggaugaucucgaucuccugaccucgugauccgcccgccucggccucccaaagugcugggauuacaggcgugagccaccgcucccggccaauuaugucauuucuuaaaaguaaggcugcuuucuccagaacugcaacguaguuuuuggcagaaaguauaaagacagacaaaaauuacucugucucucaucagcaauauauuuaaauacugcuaaaugaaaaucugaauucaacagaugcuuucagguagaccacagaaauuaaaacucugcuuuauuuucccuauuccaucaugugcuuguuuaacuucuucaguaacuuuuucuauguugaugcuacugccugggcuaggauugauuuuaagcucaguuuaaagaguauuuugguaacccuugauuuccaggcacuaugugccugaaaacacggaaguuguuccuuagauaguuauugaaucaaugaauuauuuuauuaauuaauaaauacuuuuagacuauaagagauuaguacugaaguacuuaaaauugcccauuuuuauaaacaaguuuugcauggccaacagguauuuuggaaacaccuaugcucuaauaugguaggaauguuauauaaggucauuuggcuucagaauaaaacucacucagugucuauguaggccuuuucucggaaauauuauuuuuuaaauguugugaauagauugaauuugagcagcuucuggcuuuuuuugauggagucaauguaaacguuauacuauauaagacguaaaaacuuagcuauaucuauauguuuuggagucuagacugaaaaguauuccuuaaaaguuuaauagacuucuuugguuuuuggacuauaauucauuuguagaaaauugaaauugaauuguuucacuauaacucccaaguggaaaaucauuucaggaggucuaugaauagguacauuugcacaaucugauuggcuacccaaaaggcagaaccaauuauauuaugcuaaugugcauauuaugcucagaaaucugaauuuaccauucuaguaccucaauguauauugucuuuuuaaagagguaagcuuauagcugucaaguucugcauaaagagguuuuaaagauuuguaaucgucagguuuagggagcuugaagcauucucacguuucacaauaaugacugaaucuuuccuuugacaguaaauacaaagcugacugcagugauaaccuugauuaaguauuacguggcuguggaaacauucuggaaaaggcuuuuuguaucuuuaugugaaguucauaacaaccugaggaaaaucauuuggaaauuuucucauuaagagcuuagcagaaaagcauuuuguuugcauugccuaauaaaaugaaaauaaacuaguggauauguaauuuuucuagggcauguaguuuauggucuaaaagguuguggugcuuuugugacaccauuuaucaaggauuuuuauuugauuuauuuuauuuuauagcucaucauauaauuuaauaugaagaauuuucuuuaaaauugaguaaacaacaauaaaugcuguuaaugauccugucuuauauaggugccuuauaaacccuaggaugcucaaaacaucucuugcucaaacuaagaaaaaaaaaccaugaaaacauauauauuauagacuuuucaauuuuaauuuuagauggagaaauaaauaaauuauuugguggaaaaaccuuaauacauagaauuuuucucaaauaauuucugguauguuaaucagugauaaaucagguagccagcuggcuaugugugagaaaucacuguggaaaucaaacauucuaaucuaaguuugaacaaggguguugccuugaguuaaagaaaauuaguaaauuuuauauuagagcuaaguuauaaauggugauuuucuuuggaaauaugauagcuuauauaaugcuucuaaagguuauucuuaauauaaugaugguaaaagauauacacuccaguuguaagcuaucaaauaguucacuaugccucugucuauaacugugauuauucuuuuguuuaaacaguacagugugucaaggcaggagagcauagcauaauuugauaggagaauauaauaaaauauaaugacauuuacuagucccuuauacuccuaccauguuauuuuguuaguucauuaaacgguuuucucuuucacuuuaauguucauugauccccaguguauaugaaagccuuuacauagcucaacucuuuaauuuguuauuucaguaauuauuguucuuguguuauuuguuaaguuuuuuuuuuacuaaaauguuuuaaacauggauuguaaucuaguauggaagaauuauauuaacuuuaaaaauccauugcuuuaauuuacaagauauuuucuaaucucauuaagggggauuuagcagcacaacucucauuuacacaaaaacaggcugguugggcuuucuaugugggagaauuugcaucugaauuuuaaagcacuaagccuuuuuaaaauuccccugauaaaucagcuuuuaggauucauccagcaaauagguguggggagaaacuguaaacacuuagcuaagugguuacagauacuugagcaauuaaaaauaagguaauuuuauuuguguaaaggauuugggcuuaauuugaaucagagaacuguggagggcugugcucgggguacgauaccaccacaaucaccacugccacaacaauaacacaaucacuucuucaagggcaaagacaggaaaguaguuaggaguuaugucugcuuucuuuaauaacuucugccacaaaaaugacaaugaggagaacaccggaguacagugaauugaggaaaggaaauacuguuuaaugagaugaguuggauacaugcagauuuuauucauacuucaucaagucuuuauauuauuucauggcauuucaauucacugaaaugcagugauuuguagaaaugaaauaauauuuaaugaauggagaaggacaugugauauuuuauucuuacuacuuugguuguuucuuuugcuauaugaguccuugucaccuuuuaaaaauuacaggaaaauuauaggauuuuauauacagcaaccuugccaaacaauuauugaauuuaauuaugaauuuguagauucuuuuggugccuacauguagacaaucauaucgucugugaauaguggcaacuuggauacuuacaagucuauagaucucuaauuuauuuuucuugucagauuauacuagcuaaaauucuuguaaacuuuuaaaauaagcguugguagcaaauaccgggucauguucagaagaaaauacauuuagcuuuuacuauugacaauaucuauuguagccuuuuaguuuauguccuuaaucuauaauuuauauauacauguauuauauauauauguguguguuuauauauaugaauuauauauauguguguagauguguauuauaucuaucuguuuauugguuuacuaugcuuuuuauaaauagauauaaauuuuauuggauguauuuucugcauucauugagaugauuauauacuucuuauuuaauccauuacuaaaguaccauaucacuaaauagaaacaauguguuuaaaugguauuauucucuuuauaaacuucuggauuguuugcuuuaggauauucguguauauauauauauauauauauauauauauauauauauauaugaaaauuguuuauaauuuucuauugucagcuuccuggucugguuuugauauccaacuuacaauucccccaaaaaaucaguacagagucuuucucuuauuucuauucuuuuuuauuuuuauuuuucugagauggggucucccucugucacccaggcuggagugcaguggcgccaucucggcucacugcaagcuccgccucccggguucacgccauucuccugccucagccucccaaguagcugggacuacaggcgccugccaccacgcccagcuaauuuuuuguauuuuuaguagagacgggauuucaccauguuagccaggauggucucaaucuccugaccucaugauccgcccgccucggccucccaaagugcugggauuacaggcgugagccaccgugcccagccucuuguuucuacgcuuugaaaaaguuuuaacuuuggauuaucaauucgccaagugacuuauagaauuugccugucaaaaccagacauguuguuuuuuaaagcaugauguuuuaauaauuauuuauuuaauaguuacauagaaauuuucaauguucuccuuccacuuuuugaguaaguuuuuugaguaaauuuuucugacauugagcauuuugccuagguccuaaaauauguuguuauaaaguuuuucaaaauaucauuuuacuuuucuuuuaauuucuaucacaucucuaauuauguuucuuuuuucauucacaauaugguuuuuaugacuuaucuccgauuuauuaacuuugccagcuauuugcuaauauuaauuuucuugagguuugguauguuaugauccucuguuauaccugaauuucaaaugcauuaauuucugcuuuucaaaaguacucauuuuacauccuuugcauuuauucuuucaucauuuuaacuuauaaauuuggauacuuagugcgugaauauucagucucuguuaugauauaauaugauuauaauuuuuccuaaguuaaauauauaaauucuucaaacuuugauaggguaguauaucuaauugucaauaguguucaguucuuuuuucucuuaacuguugugauuucuuuuuagucccacaugguauuuagauguauguuauuaaauuuccaagcaaaugagguuuucaaaauguaauauuuuauuuuugauuucaaauggauucguagucagaauguggucauuaugaaauuugucaggacuuuuaguauguguuagguuuuuguaaauguuucagugguucuuggaaaaaauguguuauuuccaacuaucaguaacacagcucaauuaugaccauugaguuaaucucauuaauagccuauuuuguuuauguccugcuuucuugacuuuuuucuuuaaaucugcuuaaucuaacaauuaccaaaaguguuguguugacaucuuccacuauaauuauauauuuguaugcuaguauaauagcuacaucauuuaaauauauugaagcuguauaaaaaucccuccaaaauuaagcauuuuauaucuuuucugcagaauugaaucuuauaugaauaucuagugcuuaucucuacuuuggugguggugguuguuguagucgucuguuuugguauguuaccugguaauuuaccuuguuauuucuauaucagauggauuuuguuuagaauuugccugacauaucuuuuucuguuguuugacuuuuaacuuccaguguucguucuuguauuucagguuuuuuuucuuguaaauagcauaaggcugaucuguguuuuguuuuaucuagucuugacaauuuuuguuuggucucuucacaagacccaaccuagcaagcauucccacuacuccuuuuucagggaaaauaauuuuuccugauuuccuuaccaaaggugcuacuuuuuagaauccugacguuauggaagauaagucuuuggaucuuuccccuuuccugggucccagaucuugucuguugccuucaagauuggcuugaggauucaaacuagugugcuccagauaagcaaguguucaggauuuaccucucgugguucaggcauucuuguaauauuggccucugaggauuuuguuacccuuaauuuccugcucgcuaacccauauaucaaauauuuuuaggugaucuauacuggaacuaucuuucucaaaaucgaugaugcuucauugccagaagccaaagggaauaauaauaaaguaugcaguguuuaaaucuuauacucagaaguaauuuuagaaguaacccacccaccuuuuaauuuacguaggcccucaguuuccucaucugaaaaacaggaauuuuaaaaucugcuuugcagcauuagguuuuucacuauaacuagaauaugugaaacccuuggcucauaguuagccacauaagcgcuccauaaaugcaaauuaauagucauaagguuuuauuuauauugaguauuuaagugaagaaugccuuuaaaaaggaaguacagaugaugaaacaaacuguuaaugacacugggaaugauuuuagguuaaaaugcauaguuugaaauuuacagugaugcauugaacaaaaugaagaaaugugauauuguauggcaaauuaggcacaguaaugaagcucaaccauuauucagcuuuuauaaaaagagaaguggcaacuuuaaaauuaagacaaagccaauuuugaaaugccuuuacuaucucaaaguuucuacuugguugaaaucaauucauugaucugaucaaggguucauuccugucuuuagugguacuuucauucuuuaguucuucauagcuuuuauuacucuuaaagaaucuucagguucauacugaugaaaccaggcauaugguacagcugcauuauaauacagcauugucuucuguuuuuuucugucacuauuuucuaguguaaaccaagaaaagacucuuuagacuucagagcauuuuauaauugugcagugauuaugcaaauaugcuuguaugcuguguccauaugauuaacacuauauauacaugugaaugagaaacagaacucugaauagacuauuuuaccauacuauuuuaagucaguaagaucuaucuucugucucuucaguuagauaaaaauacauaagcauguaacuccuauuuaugagcacagggccgccauucacuccauugcuuaagccuaauaauccuagaaucauccuugacuucuccccuuguuccuuacaucauguccagcccaugaagacauauucucuuaacaccaaaauacauaucgaaucauaugucuugauuuccaaugugaccauccccccaaagcccucauguuccuccacauuucuugguaggucuugcugcuuucacuccugcucuuccauagcauauucucugaagagcagccugagggauguauuugaaaccggugcuagaucauguugcccuaugccaacauuuccccaauguccuccuaucacacugcaaugaaagcacagaauccuugcaguggccccugacugugcaacugaaaaaaguccuccuucuccuccccuccugcccugagcucacugcagccauacuggccuuguggcugcugcuggaaugcuugccccuagaauaugcacuucuuucuuucagccgcugccaguuucuuuucccuaggcuugcuucauuuugcuuuguggcacuuauuacaugacauuauauuucauaauuuuaugucuguuuguucaguuuggauguuuuuuacccuggugucccggcagaauuaccugagaaguuauuaaaaauuauacacauuagaaucaccugagaugucauaaaacguacauaauauuuauguuccaagacccuguuuuuguauauauuuuucgacaaauucaguaagaaucucuagguacaguagggauaggggaauccuaggcacugguaguucuuaaaagaucuuuaguccaaguuaaaaauaccugaaaagcaauguuugcuuuguuucuuucuccacucaauaggcuaugaguuuauuaaaggcaagggcauuauuuauuuugcucacugcuguauuucuaguccuuaggaaaauaucuggcucauaguagucuuucaauaaauauucauucauaauuuuuaaaauuccuuagucuuucucuuguagaauauauaaacaaauaugaaccaucgauauugaccguauguaauucuguaaucccuauaccucuaauucauucaucaaccuguucacucauuuaaaaaauauuuuuucagugccuucaaugagccagauaaaauccuagacucuuggaaaucaagauugaaauaaauauauaaauaucugcccucauggagcuuauauucuaauaauccuggugguaaauuucucuagaugaguauaauuuuggaaauuagaaaauguaaguucuuuaaauaauuuuguauguaugguauaucaucuucaagaauagccacuuaaacuuauugagaccaaucuuaaaauuauuuuuaaagaauccuucuccuuuaauucaguuuaacugaaacuguuauuuuugugcugauguauaaaacaacuuuccaaaguaguuucagaaaguuuuuuuuuucuuaaacugugacuaauuaaaagaaaaccaguuuucugaaaaaaaaaaauaauuggauuguaacagauuuacaagaaagaccaacuacaucugucuuaagaaaagcucugauucugcaguauaaugccaguuggacugauagcucugggauauccugggcaaucauguuugaucauuuaaagguucauuugaguuuuguacaaacacucaauuuuuuauuuuuuuauccauucacucaacaaauaucugcgggugcaauaaauuaccagguauuuugccaaguucuaagguuagaauacuuguucuuugcucuuaagaaguuuacuuuauaauagaggccuaauuuuguaaagaaauaaugucaaauaugucaaaaguaauauaagacaccuacugcaaagaagcauaugauauugaaucuagcgccuacucuuaaacugccaaaauuucucccucuuuugacauucuguaacauucaucuuguuuuuugucaacugacacagucugccuuuauucuaguuacuuaucuacucauguuauauauuccuuuaagcucccuuugguuuacacacacacacacacacacacacacacacauauauguguauauauauguguguauuauuuguauauuauuuguauauguaugcacauuacauuaccuaccacauucacuccaauacauauauuuuaucaaauuauacaguaaaaauuaaaaugacugugaaggguuauagucauucuuauaaauaucuaaaaccaaaugcaauaaauucaaauguauaaaaucaugcucaaagguugccaaagaagcuaaauaaauucagaugaauaacucuguuuauaauucagguauaauacaaaaugauccagaaauuguaauuaacuggauucgacacugaaaucucuagaaaggccaaacugucuggggcaaguagugacugcucauuacgucugguaaacccuguaacuucccucugagauaagagcagugcagggguuuuuagagugaaccuaaacaccucaguuuuuggaauguagguuuucauaaguugcugugcaucuuuuagucuuccaaguuuguguuuuucccauacgugaaagcaagaucucagcauuuaagggucaaacaccuucaguuuggccugguuaccuuaaucaugcaaguuuaggggaaauuccagaaacuuuaaaaacuuuccagucuauuucccaucuuuaugacucuugggugguugucugguccuuuuaauguugugaggcagaugaguguaggagcuagaguguggauuccaaaggcacacaugccucaguuugaaaccugguucucccacucacaauuguaccaccuuaaaagaguuaacgucacuaauccuuagcuucucugucugugaaauagggacacacucuguaucuuauguggcuuuuuuaaugauuacauuagaaauuccuuguaaaggaugauagguauaaaaaugucagguuccucuuacacuuauauuuuuuuaacacauuucaucaauuauuuuguauuuaaucuccuguucuccuuuggucaguuuagguuauugcuucucuaaauugggauucaaaccuaucagugacugaacaacaaaaaaaaauuaaguuaaaaaggguguuuaaaugcaaaaaugugagacugacaugaucucagaaugaaggauaauuucuuauauugaaaaaauuaacuuaaaauagaagucacuacacuauuuuugcucuucucauuucucuuuggaucagacaaaauguuagccuagauuugcguucauguuuaggacugauuagguaucuuuaguggccuguuuuuauucugauauacuuugagauuauuuuggucauggacuuaagagcuacuaguguugggguggccagacccaaaaccaggccaugagggguuuuagacccuggacccagaacauguuccaagacucuuuuacauuauggcagacaugcaagcccugccucagcuuuucccaacaacuagcaaaauaccuaauuuauguauuuauuuauuuuuauuuauuuauuuugagacacggucucacuuugcuacccaugcuggaguucaguagugaaaacacagcucaguacagccucaacuuccugggcugaagcaauccuccugccuuggccucccaaagugcugggauuauaggucuuagccauggugccuggccuugaagaauaauaauggucauuuuauuuacgguaaaaaccuaaagaggaaaguuguacauaacuuaaagauucacuguuagucuccacaauaauuuuaguugaauagcauaguuauggauacucaggccuaaagaacaaugaaagaugcauuuuugugaccacaaaauuguauacaucuguuuuuuuuuuagaagaagugccacgcuaauacuuuaaacuuuuuuaaaaagacaaagcugaauaaccaauuucauuuaugcuuauaaaaacaucacaccagcaauaaggccuuucauucaguauguuucuucuaagaaauaugcuuauaugacaaauucagggacacuuuuucuuaacauauuaaauuacauauuuuuaaaaauuguauuuucuaguuuaacucauuagugugacugucaaaagauuuuuuucugaauaucaguaauaauuggaagaaauaagguguuagcuguaguauuauauugaacacagucuuauuuacuugaguuacccaaaauaauugauccuuagaaaaaacucuguaauacaauuucaaugacaaccaaaugccugaaccuuggugcauuacuuuaugaaagaauacuuucuuguggcauauuucagggaccucuuaauugucauauuuauccucaacuaagauuugauaauuauuguuacauugaagaccaucuuuguuuguggauaaauaaauaguagguauuucugguuuaaugaggagauauuaguuaaaugaagaaccaccuuuaaaaacucaauguccacauugguuuaaugauaauauauguuaauauugccuuucuaggcuggaaauaauuauuugaauguguuauuuaacaaaaucuugguauaugaauauaauauuguuauuuuauggaaauucauuuuuaaagguuuugugcauauuuaaauaacuuuuacauguuaugcuauguacaugaauauugguugacuaauauaacuuagcaaaccauucaaaaaccugaauuguaaagugaaauuaguaguaaaaauaauaauaaaaugacugggaaauuuuacauuaaguaucuaagaaagcauuuuucaagugaguuaaaaacagaaauuccuuguacauguuaucacuuaaugucuaaaaauacagcuguugaauucaacaguccuagauucaauaucacuuaccacuuaugugacuucaggcaguuccuuauguaagcugagaauuucucaaaugagaagaguaugauaauuucuaaauaauaagauuauuaaucaagauaauguuuguacugcaauauccuaggcaaagaauaagcacucaauaaacaacacuagcuaauaauguuaauaaguauaacuuuaaaacgugagaacuuauaugauaaagaauuuuggaaaucugcauacaaaaaaaguugaacagcuuuuuuuuucuuuaaccuuccccagagcuuuuuaaaugcuaauaugcauuaugaaucuuuugaaauucuacaauuucuagauuaauuaacuaguucucccccaaccuccuuuuuuuuuuuuuuuuuuuuuuuuuauuuuucacagagcaucucuugggacuuguauucuucccacacacuuucuuaaaugauuucuuagguaaacaccuaccuauuaaucauacugcaugcaaaauucauauugcuuagguuuucaacuuuuuuuuuuuuaauuaaguacuaaaugucaaaugucaggguagcgaauguuugaaaaacuuuguucacgaacaugacagucagcuagcuaaccagaauaaaguuuuuuaacuacaucaaaauugguauuuccauucuagaagugcucauaagcaucagagcauaauauucaauuaauacuuuccaauauuaguaauuauuuguuaauaauagagguuuauuuauuuacaguugauuuauauuacaaauuauagugcuuaugcuuauuuacugucauaauuauauuuagauuuuaauuguguguauguuuguaauaaaagaauuauacaaacugaaaaguggcaagauggcuaugaagaaaaccagaauauuuuacccccuaauauguuugaaguuagaagcagccucaaguucucucugaucucucccagaacccuuggucucucccagagcacuggaugagacuguucuccgagguucccuuaucuaccuagaaagcagacaugcaaggaagaacacaaaugucauuguuuucccucccugaaaugucauuaucuaucacagaacagaagagugaggaauguaaccacaucuggauggauuuuuucccacaaaauaaugcugccucuggggcucauucaaauuccaaagagaauuauuuacaaguuaauuuuugucucugggguccauucaugcucccuuauuauaauuuauuaccccuaaaaagaauugucuauauuccccaucuccucccuccccugaaggguuuauaagcuucuauacauuaaauaaucauucuccuguuauuccaucaugcuauucauauuaaaauaaauguuauaugccauaucuccuauuaaucuguuuuuuuuuccaguugguuuuucagcaaaccuucagaagcuaaagggaaaguuuuuucuagccccuacaacuaguaucuugcucuacaaaaaaaaaaauauauauauauguguguguguauauauauauauauguauguauauauguguguguguguguauauauauauauacacacacacauuacuaauguuaacaaaauaucaaugagaucuguggaggcaaaaggagaacuuuauuuucuggaaaaaauauaugcagauuggggacgcacagucuuuaguacaagugaacgugugcucuuugaagaaaaaaaagagggucuggcuuaaacaggggaaguucuugcccagguucuuaaccagguccauuuaugcauauaaaaaauucaaacuuuuucuguucucauugcucaaaauagucaggacuugauuggaugauguccaagccccaaaccaaagucuccgucagauguuucuuucaaauggcugguaguggggauagggaagauccagccacaauucacuuuggcaccaauaacagaaacugauuuggcucgaccguagcaagggagguccugugacacuuuuauaauaucuuucugagaacacagaguguguuaacccugccucacccagcuauggcugccugguuuugcuuuaaccuugagcccuuuaguuagccaugggggaguccauuuugucuguuggucuggggcgugcuuugacacuaauauagucauuauaaaagcagacuguugacaaagaucauuagauauuguguauaaacuugaaauuuaagccuuggaaucucaaauacugucuucaccuuguguuauauuuauucuaacauacuaauauaauauaucaauaauuucauauacuuauuauaauuguucuaccuguccacaguuuuggaaaauacgccuuccacauuguaccagaggaauccauacaaagcuaacuucccuuugucuucgguguaacuccuggcucuuuaacaaaacguaagacucuucacagccuugcaaacgcccacucuccaucuccaccuucaaagcuuccauguacuucaucacuuaaugcucugucaucacuuaggauuugauagaucccugcacacuuuaggcuauuuuauucguuugccuuugugccuuuguguaguguucuucuaggcagcuacuccgacucauuguuuaagauuaugcuuagacaucaccuguucuagaagccuucuuuaaccacugaaucagaagcugaacuuagugucauucaccgauguuuccuuuucacacuauuacuucuguuacuugaagugaacaugcugcauucuaauaaucuguuugagugccuuuuuguucccaaaaaugucagcuuuuugagggcaaauauuguggcucauuaauuccuggcaucccuuugguaucuugcuugaucuauggcgauuacuugugacugaccucacuaaauguuggaaauauuuccauuaggugguuuaaccuuaaaaaucuuugaacccuccaaguuucccuuguaauaucuaagaguguuugaucuguacaucaguauuucuaugugaaugcuauuauauaacauugagagauuguccuuucaaauccuaaccuucccuuuccccaagauauuagcucacccacugauuuucugaauuauucuaauaccaacugcaucuuauucaggcacuugcugguaaugaacuucuuagacaugcugagcccacuaauauccuuugaauucuuauguucucccuaagcccucuuucuggguagagucucagaauguucaucagcccccacagugcucaaauugaucuucauugacaugaccaaaaucaugcagaggguacuauauuagauaauugagaaaaaaacaagaacuugaaaggaauauuuaguuuuuaauauguacuaaauuuuucucuuguuacuuuauuccuuaaucugagucaguuauucuuauggcaucaccuuucaauuucccauuguuaauugcacuaaaauucuauuuauagaaccucuuuauaacaagggaucucagguugaagauaacagugaaggcuaggucacguguugucaugaauuguccuguguauuguaauuaucuuuaaauaucuaacuaugggaaugaugacgucuugugcuuaaagaagucacuuccauccacccagucauauuccaggcuucuaccagcaaacaaaugcucacaucuuccuacgcuuauacaaugugcccccucagauuuguagccaaagucaaguuucccuugaguagcacacaauucugcauucaggaauauuuuuuuuucuuucuacaguccuggagggggugggagaguggagaaagggguuggggggagggagaggaauauaaauacccaggagagaauauugcaaugcuuuaguugagacuggcagguaugaagaguuguauacugcacauaaggcagagauuucauuuuuauccauuuuugucacauuuucuuuagugaacagaaggaggaaaaagagagaguaugacuuuguacuaauuagaaaaauaaagauaaaaauagacauuuugaaauuggacauuuuaugggcaccauuuguucucucuuuccuuucuguuuuuauccagcacuacuuuuccucugguuucuuccccuaccucaccucauuuuaucagcugucucgagcugccucugaccuaucucacagucaugagauguggcaaccacaggugucagcagcucuucacagcugguaaagccaugcuuucacuugauucccccgccccgccccauuaaaaacagaaaaaaagaaaaccaaacaccuguuuugacucuugucccuuccuuuucuccaauagcaaauuaaacugacaagcuggcuggacaguggcagaggggacuuaguuuucagucaaauuauuuuuaaaucuccuuuuugccagugguuccucuuccugucauuucuuccauguauguuuuugacagcugggauuauuuuuauugcacauuccagucucugcuuuugaauagcuacauuuuuuuuuucuaccucccagauuuaacuagcaguagaauggcuaugucugaccccuguauuuagcuauuuccccacaguuacaaauaucuacauuggauuucauucauucucuaagaacauaaauauccauaauaugccaaugcugccagauguuggggccaaagauaugaauaacacguggcuccuguuauugaauagaucaguguauaauacccagcuagacacaaaacaguugccuauggagagaugccaagagacaaaacuguaaauccugaauggauaauccuuuagguuacacguaaacugucacauauguccugcccuaauccuuaggauguuccuuguacauuucuagaugauaguagguagggucuuugaagacugcuuuguccaaagaguauuuuuuuuuaucuuaagaucguacuuuuuauaaauauaaaaaaaacccucugcauuuaaaaguagaaugauuuaaaaaagaagaaaaacacaaguugggggaaacugugcuaauuuuggauuuaaaugaaaucaaaauuagaauauugcguaaguuuccauauguuaacccucacaaagacagggauaacuuagaagaggaacugucccugaagcguggagggaaaagggauggcuuggugaauccuacuugcuauaguugacaauaaaggaaccacacguuugagcucugauuauuucuguuauggaagcuaaagagaagaauuuagcaacaaaauauuaaauuuguucaucaucuacuacaugaugauaucauauaaaauauuuugacaaauauauuauuucauccauauuaccauucuguaaugguaauaugcaccauuacauauuaguagccauaacauauuagaucauaauguguaauaugagauaugaucacucccccuucuuucuuucuuuucuuucuuuuuuuuuuuugacugaugagagguggugguuagggaaguuuaaugguaaauuaacugguauggacuagaaccagauuuuaauggaagcuuuuugacuucacucuucccacuaaaguaauuucugaaggaguuuucaaaaauaucagugguguaaucuaggaguaugcaauuaacaugcuaugggucauucuaaugaaaguggucuaaaagugacauaaugcccuuauauuuugacuuaucuuuuuuuauuaucaucagucaccuguuaggacaaguuacacuaaacacugcauuaaucaugggacuauucaagguguuguaccaauguaauuacauaggccaaggcuaaacuuucagugaguuuacaaucacagguguuuauagaaguucagaauuauaauauuuaaaauguaugaacaauuaagugugucaggcccuguagcaagcucuuuacauagacuaucucauuuaauucuuaaagcagcccaauagauagguauuguuucuauugcuguuugcagaugaaaaauuugagcuucauguaaacaacuugucauguauccuuaaauuauguguagcacacuuagaauguagagucagaaaaauguaaugauguguacuaguaggucacaagagaaaaauaaguacauuuuauuagauagaaaaaccuuucuuuuuaaugauggaaagagcagcaccaugggaguuagaugucuggauuagagcugcuagaaggaaaauucuaaccuucuuugauuaaucuacuuauuaacuaugugaccuuggucacaugaugacugcuauacucaauuuccuauucucuaaaaugugcauaguaauaauugacacccauuaaaaacaccaaugaacacguauauccgcaucaucauauccucauauuuccaaaagugauauuuguucuuguuaaguaaaauugcagggagaaaaaaaaaucuccaaacacuuauucaaacaaaaaauguaauauuuagacacacaggauaacuuuuuaaaauucauauuuuauuauaugucuucuaauacuucuucauaguuaaaacuuagccgcuccuuuuucauaugccucauuauuacccagccauaaaauggcuaacuugacauauuuucuuugaggagcaaagaaaauaaaaagauguaggccuuaggcaaaguauuguauuaauguacuuaaugaauaaagaacugaaauuauuugcaaaugacagaaaauggccuauaucuuuagaguaaauugugaaaaauuaaauuggguuuacucuaggcuaacaacuucauacuucuguaguauuugagcagaagaaauuauaguaaaugauuuuuuuuaacuaguucacuuuuaaauuuaggauuuauuuuuaauucuggcuuucucuuuucuucguacucuuuccaguacuugauugcuuacauguguuuuuuaacuaguggccauaagacagugaguaauguggcauagcaguggcggagaaaagucagaaaugaccuucuucaggggcacccuggcuuccccugcugccaaccaagugagcucacacugagcuugacccagaaaauuggucagguuaaaaaagaaaggagaaaaugucuuccuuuuuuuuuuuuuuaauucuuucauauauguauuuuucagaacuugugcuuaaaaagagaagaaaguuuuaaaagaauuuaagccuaaauuuccucuuggauguuaauuucaaaaaagaacuucaaacuaggagaaagauagaagaaaauuaaaaaugaaauggucaagcuuauuaauauggccaaggacauuuacuagugcaagugaaugcuuagcauguuugcuucugggaagaacccagguauuuaaaugacaccuccuuuuuuugaaaaaacaaauugcugcaguguuaauauguacuccacuuuuuuaugaaaggaagugauuauuuauuuuagaugaaaaaguuugacuuuuggaaggaaugguauuagaccuuauuaacaggaaagagauguguaaagaaauauaaccucauuaaaacauacaaaaacaaccaaaaaaaugcacuauuaauuuugaccgugaucucucacuuuacacccucaucaaaaugugguuaacaauguacuuauucccacugugcucugugagaaagguaagggugcugcagagaauauucagcucugggucaaagggacuuguuaagggcagucuaaccuugucuuugcaagaugcuucccgccccccccaguuuuuccugcaguaagucaugagaauacauuagcaguagagauuuaccuucacauuauuuaguuugcugguauucuuauuuuuagcggaacuuuuuggaaacacuuuuauuuuaauguaauuguaauauucucccucaucacauaauucaguuagguacuuggcuaauuacugggugcuuaaugucaaaaugcauaauggaucuguaguguggcaccucuuuuccuuuccgaauauccuaagcagcauuaugcuguguauugaccaugagaaaaugugagcaggacaguugguuugguggcacugacacuuauagaggaaaauaauucuucugauagaacauauauuacauuuugugguggagaauuaugauuauagccauuuaaaaugcauggaauguuucugcuauaccuacgugguccagaaggccuuuucuauccuaggcuuauuuacucucagaacuccaaauuuaccaugucauuuuaacacauucuugggggcugacagagcuggaaauacuuucauaggcuaauguaaguggacacacagaagugccaaagugcauuaggaaaauagaaaucuauucugcuucacaguugaauuuacccuucuccagagacugaauuuauuugcauauuuuauuucaaauauauguggguuacacugaaagagguuuuaaauuaaauaaaugccaugauuaaaugacagacauaacaauggcaaaucugguagcccaucaugaauucuccuuuucguaggaauucaagccuuuguuacuuuuuggugaaaaagauacauauuauauaaaaaugaguaaaauuguauuagaaaagguuggccagaugaaaaguauauuuaacauuauuguauacauuauuaauaugugaggauaauuaaaagauuaauagaaugaaaauauaggugguuuuauacuguaguugauuuccaaaauugauuuucuuuuucuaaauauucuuuccugaaucuguacaugauugucuuaugcuagauauuuugaaauauuguagacacuaggaaaauuuuacaggugaucuuacuauuuaaauaaaagaaauauggaaacuugauuuaugaauaaacaaacaugcauuuauuauugccaagauuuggagagcuaacucagcuaaaaugcgcaaaagcuauuuggaccaaaauuuuagaaauacucuuuuacaaaugucaaauaaauacaaaucuggauauguauaauuauagaacaugaaugcuuaauuucaaaauaauuauuaaaagcuuuguuauuuuaccguauucuuuaaaaauuauaauuugucaagagaaagaauauauagauggaagucauuucuaauaaugaguauguaaucuuuaggguuuguaaguguggcugagauucauacauacaucuuagugauugacuucuugaguuuguuuauauauagcguggcguuaaacuauuuuuuauuugggcuugaugguagauugggguauuuugcauucacuaugcucuuauuuugccucccccacccuauccccgcuuaguucucaguguauaauaguagaaauaucauagccaaaaauaaacauaauaaacagagcuuaggugccaaauauguuauuuucaacuuucaaucuucacuuaugcauguuucuaugcccuuaauuucaaaaugccaggcuagugcuuaaccaggcucuaacaaaaaugcaaacugucaaagcaaguacaauaggaagucagcugaauggcaugaaguuauaccuaaucacccauaaaguagaaggagauuaauauagugauguguaacaugacuaccauaaaaucuauuuggaggugcucaauagauaacuuuaaauugaauuguaagauuucaauucuuuugccuuuguuuugcuucuuacuuuucaaacauugugaguuuucaggcuaaugaagccugaaucuccaggauauugaaauguauuaugcagugguucccuaaauaucauauucuaagucaaagcauuguuuugugauuuuucuaaauguuaaaaacgaagauaauaguuauuuuauuuuauuuuuauuuugccauaccaaggauguuaugguauauaugugugugacugugaccacugucuacauaaaaauguaaugcauaauuuuauuauguagacuuugcuguuaaaaguuugauauucuaggccagguacaguuguucaugccuauaaucccugaacuuugggaggccgaggugggcagaucacuugaggccaggagucugagaccagccugacaaacaugguguacuaaaauuacaaaaauuugcugcgagugguggcgcaugccugaaaucccagauacucaggaggcugaaguuugaacccgggaggcagggguugcaaugagcagagaucgugccacugcacuccagccuggacaagacagggaaacucucucaaaacaaaacaaacaaaauuauuuuauuuauugcuuuccagagaagaaacacguuacuguuucucucuauauauaaauaccuaugcauguauguuuaacaaauauauauauauguacgcauguguguguguauauauauauaucagccuuuuaauuauauuaugaaaauaaauauauaauuggacaaagggaagagaaaaagaaagaauaguggcuuaaggcaguuguugauuaugggaaguucaauugcccccauucucuccacacuucuuuucuccucaacuaaugaggcauacugaucucacaaaauaaaauaaaugugagaaaauauauauaucuuuauuuuucuacucauuaaucucucauuuauugucuauccauuaaucuuuccuuuucuccauagaaaauggcucaugcaaaugaacuaucaaucugugguacuggguuaacaguacaaugcuaucacaaaaauaaauaaauuauuuauaauguuucugaauuagaguaaaacauuuuaguuccguucauuguaauaucagguuuucuguacauugcauuggcucuggggaaaagacuguagugcaauuccuaucaaagugcuuuuucuauguaagauuuuauaucguuuuuaugccaugcuuauuuacauaagcucaacaugauaaggaaagucuauuaggauaaacaaguuuaguuaauauggucuaaaaacaaaauuuaauccuaucuucugauaacuuccuagauuccuccauuuagagcuuuuuuuucuaaguucuccauuuucuuucuaccuaaaaguauccaaaucuuagcuuuuuauuuuguuaaugucuuuaauuuuacuugcuaugccauccugcaccuaugucuuguguuuuccuuuuccaccaauauuuucuccuugcuuauuuaacuuuuuaauuaaauccugccaaaaucccuuuagaguggcauugcauguuuguuggcaggcugcagugugcugugcugcuucagcuugagcuuagguacaaaaauguugauauuuacaaagccguaaaagucaauauuguaccaccagagcagaacggccucuagauugucaagccuaaccuccgacccaacacucagauagggcuuaaaagcaucaaggcuuaaaggaaaccucaagcacugggacacauacuuuagguuauuccugaaucagagaaaguuacuaaggaagugaauaucugaacacagaauugaauuuccuuccaucuuuucuuuaaaucacuguuuuuugguuuuaauuugcuaaccuugaaagugcccaucugaauaucuccuaguuuuaagugcuauguuggagucacuuuacauguuaauaacaguccccaaauguuaauaaccuccccaaauguguuuauucauaugcuaucuaaauuguaacccauuagcggcaauuauuuuuagucagcauagaaacaugcaacauuuuacauucgauguguccuuugcauugauuuaaggaauccaugagagauaugugguaaauuccuuggugcaauuuguaaagaauaauuaaugaauugcauuuuugaaaguuaguauugauuuacauuuaagaguaaacaauugaugugacauuauugauuaguaauacgaauaguaaauuuuuaauauaguuuccucauguuauaugguuuuguuauuuuaacacucuaccaccuaauucuuuaaacuccuguugaacauuuucucuauaggcuuuauaauaaaauucuaccaaacaauuauaauucucuuuuacuguucucuaaugguuauaucuaucacuucacuggacauaggcuauagauucuaucauaauuguggauggaacuguuccugcuuaguugauauuagaguuaucauacuacuuucuuagaaaacacuguugaauugugcuuuagucuagggacuauuggaaauucaaugcgagaaugaaaaauuaauuagaaaaggcaccuugcuauacuuuaaaauuauuuauugugaauuuuuuuuauuuuauaacaaauuucucacaccuaugaaacauucauuaagaugauaauaauuaauaaaaacaacuuuauuaccagauucucaacuuauuuucuccccuuauugcauuauaacacaauguaaaggcaggaaggaaaugaguuuaaguccaggcccaaauuaauguucuuccaaagccguuuaagaauuuucacauauaaucaaaaaacaaacagacaaaaacacggauauuaaacucugagaaguaguagcaaaaagaacagcagaugacuagaauuuuauuaaaacccaaaauuucaaaagcaaaaauuugauuuaagaaaacugcaaauucaugucaaccacugagaaaacuuuauaaugaguuuucagguugauuuuuugcagggagacaggaaaaaauacaugucuauggucuauguaguacaagaggauaguuuucuugauaugacacucuuaagugaaucaagaguauacauguacuuauuuuaggguagccucuaggaagauacauuuuuagcacauuguauuggcaaucacuuuuccauuuucuucaaaccccuugaaguucuaacuuaucacuagguuagguuacucuagcuauuauacuaucuauaagauugcaugugauguucguaaugcccuccuuaauuucaaagaacuuaacugguaucuaguugcccaucuaucauuuauuuuguuuucuucugccuuucuuagugcccauuguuaaugcuucuauuuuaauauuuagcauuuuguuucuuuguagcaaggacaaaauauucacaugccaggaucuuaugauuauaggucaaauuugacccuaaagagugaauguuaauguccauaugaaauuuggggaguuuauuaaaaugcagaucugauucaaugggucuagaauaaagccugauauucuacauuucaaguaagccucaaggugauuaauauuuuugaaauggccugcuugucuaagugcuaccugaaguucuuucucucauggcugaggaaaucaaggacauggacacaccaagugugauguuagagcagaaguuuaauaagggaaagaaagagagaaagcucucugcugcagagagggguccugaaaaaaugguugccauuucacaguugaauacagaagcuuuuauaagaagccgaugaggucugggcaucucauuugcauaaaucacgaauuucugguaacuguacccuguccuccuagugcacaugcaggcccuuagcuugaguuacuccauauugcuuuguucccuuuacuacacaugugucgggggauggaguuuuccauuguggacaugucugagcaagucuccuggauagccuuucuuaucuauggggcugugggcaugucucaggcaagcucuccuuugcaaguucccuuaucugugccuucaggcuguccuuuuguuugaaagaacucauccaaggacccacccgaacuaccugccugucagguuuuuucuuuccucuuucauuuugacuaucuagauccugagaauauaaaauaaaugacagugauagcguaaaauaaacaauagaugcugcaaaacacucucacuuugagaugguuugauaaauugccaauugguucacuguuagaaacaauuuaaauggaagaacuuuguaaccuaagaguguagaaaaagaauuaauaaacugcauuuacaaacaugacgugaugaaagugaauguauucauuuccucugauauaacaaauauugacuaaaaauagaaaaauguguuuuaaauucacaaagcuaaauauauuauuaaaaauguaaauaauucacuuuucaaauuguauuuuugguaaagaguauagcauuuauauuuuugaaguuauuaaugcuuaaacugcacuacauuuuuuuuuauauuuugccucaacucuauuuccucauuuguaaaaugaguauuuuacagauauuaaauguguauuaacacauuuuguguggaauuggaaauuuacuacuguguggaaacaguauuaaaugugaucauauguguaaugugcuuaucagucaauaaaugcuagauuaauaauauucauucuaauuauacccauaacuaccuuuguccaaaguucaaauuuaagaaaaauuaaaggaagcuuauagaaaaaaccaucauucaugaugacuuuucugaaauauucaucacuaugauaugccaguuuucagaauaaguuggagauuuaaaaguauaggauuugaagucuaauuugagccuugguuuuagcauaccuuucguaguguuauucugggaaccgaacaacauaaugcacauuuaguucacaguacaaugacauacacaaaauagaggcucaaauauggguauuacuauuguaauauggauaugcauggcucaaauauggauauacuauuauauucuaagucuucagagaaaacaguccaauuaaaacgaaggaaaauagaagcaaaauguucugugacaaaguaaauaaaguacuaaaccuaaggcuggguuuuaagugcaaugccuuaaaaucucaguagcaucauugauaguauguaaacaaaguaaaauguauguauguuuagugacuacaagagacuccauguaaagucaaggcuccgagaccggacaaaaauauguauguauauauauauauauauauauauauauauauauauauauauauauauuugcuuugcucaagaugcaaauacauaagaauuuugggagugagaaggaauguacaguaucuuaaaaauuuucagaagacagaauuaacaaaccuaagugaaaauagaugcuuguaaauagaugaagaacuucaguucugaugcauagauccaucugucauagugcuugcuuauucugauauauuuaacuuucuuaaaacuucugguauuugucaucuucccagacaggaaaaaaauggguggggaaagguaauguuucaauuaccuugaaaaauaaucucaagacugucugugggaacuaauaguggacauuauuaaacaugaaaggguugagucaacaaggcagguuaugaaauccuauucaaaguugaacucuuuuaaaauagaagauauuuuuccaaguaaugauggccucauugaagccuggagugggcauucuuauauuccuuuucagcccuauaauuuugugaugucaaaauaauugagacucagaaaguacauuucagaaauugacaucugucagugaggcaaaccuaaaaccauaguaaagccuggcauuuguguguuucauagaugauggaguagaagccaauucauucaaucauguauucacacauuuaagaaaacuauauugaucguuuaauaugugccagaugacgugcuaagauagaugucucacagaucuuagaagagaauguuauguaccuaaauuuauaaucccaaguguguguguauuauauacaguaucuauaguauauguaacuauauaucauaucccaaguauguguauauguagauaaauaauauucauuuuauauaucaacauuguauguaaauauuauauaauacauccaauauauaguugagauuacacuauuuacuauauacuuauguauaaaagaauuaauauauaugaauauauuuauaucucuauauaaaauguaaaugcaaguguguaugaauguagugaaugaaaauguggagguuaugacuuccuuuaagcagugcuuugugauaugaguaagaaucuguguagcaagagaagguaggugggagucaggaacacauuauaagaaggaaaaacaugaggcuuaaaggugcaugagguaucuuuuauuuggccuuaguguacugugugugagauaaacaauagcauuaugaagcuggaaugaaaaauuagacuucuguuaugaaaggucuugaagucuaugccagcgauuguggaauuuauuuugugagcaguauauacaggauacaaguauauaauagaauuguuuuuauugaaaaagccuccugccugaaauauagggaggaacacaauuaauuaauaaaauacacauuaauuauugagcuauaugccaggaaucacaaaaaucacuuuacaugcauuauuugguuuaaucuucacaaaaccuuugagauaaguauuaugauuagccucauuuaacaguuggguucacagaaauuuagggaauuuauguaaauugcaaaaucagguuguugacuuaaaaauccuaguguuuauccuuuacguagagccucuuagccuuaccaaccacaauuacaacuccugggaauuuucuucuuagucagggaaaauuaagaaguuguuucaaaauuguuaauuuuuacaaaggauaaaucuauuaguguuaaugacuguuaaugcaaagccuaaaaauguuaauuuuaccugguaugacuauagguagaagguaguauggugucaaaccucauguacauuuuggaaauuuaugacuggcaaaaaugcuggagauuauuuagacuaaauguaauuuuauagcuggaaagcuggcuuagcucauugaauauuagcaauuagaugaagaaauaaguaacuuaugcaaauggaaagaagauguaacagagacauaaacagguuauuaaaauaugaauuuggaugucagauuauuuuuucagaaagaaaacauccaauaaauauuuauuggagucuuaguuauacaagguacuauaauagauucucagggagacacaaaaaauaguguuguuucugucgccaggaaguucacaggagaguugaauauuggacuaaaacaccaaagagcuagacuauaggguagaaaguuguaagcauuauuugaaaaaugaaaacaauauuuuagguguauuagaugaugcuucauggggauuggacauuugcguuuaagugaaaaauaacauuuguacuuggacguuuuggggaaagggcauugcaguauaauuggugcuaugauauguuuacacuuuggacuacaacaaguagucuguugugucuacaauuuaggaagaauaaugaggagauaguaguggaauuuaaacuugggaaaguaaauuggaagugaaaucauggaaagccuggaauaguaucuuaagaauugacuuauagagaccuaacuagaauuggagaaauuuauggguaaaaugagaacuucgauuuuagucauguugaauuuugaauaauggcagguuauucaacagguagcuugauacauacaacugaagcugagaauagaaacaaagccuugauauuuaguugggaacacaucaaauagaggugacauuaauacugugcaauuauauuaucuagaaacagauugaaaaaaggagaaguagagcauagcucucuuagugaauuauaguagggagguggagggagcaaacuggaggaaauuucgggccauauagaaccaaaaggaggaguauguuucaaagagaaucagggaaaacagacauugggaaaaggucaauugagagaucauugguaacuuuagaaagcaccuuacucagaauguaaaggucagagguaaaaagugaaagguguguacgacaaagaaaguucucgaaagcaaagaucauuuuauuuaugguuaugucuucugauccuuuuauaaugccugaaacuuugaaggcaugaaagauuacagauuuccccagguaagcauugaugggagcaggcaagaaggaaugggaucaagaucauauguugaggaaguagccuugacagcgaagagagcucccugaagggauaguugaguaaaaaaucagaaauaguuuugagauggugagaaagaaagauugugagaguauccaacuuaaugacuuugaucuuuucaauggcauagaaaguaaagucauauauuaaaaaaugauggaacugauuagguccucagggguuuuagaaaagguuugaaacaucacugugaggaaauaauaggcacaaaugaauaggcagaagaaauagcaagugcuuauuucuaguaggguagcauaugauccuaacuugucucaaugaaaauaauugugugacuucuuauagcuauacuuggcugcaaguaggugaauguguauauuuguuuauuacauaaagagauagaaaguauguuuuaucuaaaaaguaugagcaaauuggcuugauuuuuacauacauccauauuuuuauaauguuguaaauguuauuucauauuuauuauacauccaguggugcaaaaaaaucuacaaggggcuacacagaaaauacuuuuuucuccaggaaguuuccaaugugguguguacuauuacuauuuuuucaacaaguuaaugcuuauuccucuuuuuguaauuucagaguuaacaauuguacguaaauagauaucccuaauucugaagaauauucguucucuaaaauaauuccaaaugauuuaaaaaaauuaacaaaacuagcuacuaggaagaguaaaaguaauuuuuuagaauuucaugaacaucauuaaaaacaaaacuucaauuaauuucauuuagaaaauuguucuagaauaucauguuuguguuguaauuggugacugauggagugaucagagaaagaaaauguugauugccuuuggcauuaaaaaauuaguuuagcuuucuggcuacaauuauucauacauggaaaucguaaguuuuaucuuuucagcauuuucuugaaaauguuugaggccugagugauguuguaaaauaaugaaagugaauugagauguauuuaaauuauuguagugauacuucggaauagacaaauuucaguuaauccuuaaguacagugaagaugaauauggacaaacauugaaacuauaagaaucucuaccauucuucagacacaugucuauuuagccuguugauauuucucugauauaugugccuguaucugauuuuuuuuuucccaaaaacccuuucucugauaguggcucccuauacauguguagaauagcaauguuauucaugguauaaucaaaauacauagaaccguuuuuucauaccuccuucaugggcuauuuccugaagacauggcacgaagggguuuaaguugucaauucucccauuaauugaguugagcuaaagacaagggaagauaaccaagcgaagccuuuaacaucuaugaucacucuuuccaacaauggauaaaugccagcucucaaauccucugaucugagugugauuuaacuauuaccacggaaaauuuucuguguggguaaaagcauucaugguacuugcuuauacauugagcucacgaaagacauuugaucuuaaauaguguucuuucagaaaauaacucuuucaggagauuccgucaguagaagagcuuuuuuuuuuuuuuuuuuuuccuguaaauuuggagauuuaggucucccuaaugcuuauauugcauugccauacauccuggcauacugaugccuggcaggaaguuugauguuaagugccagcugcagaugcuacuacacaagucaagguaagagugaaaaaaauuauucaugaggccuuaugucucuggggaacuccuagacugccauacaggaaguucacaaaguaauaucaugguucuaggucucgaacacugaaauaaauacucagucuaaguuugcaugaugugggcacuuuacugaauaacucccuuuucuucccuccaagagguauagacaaaaccaugcggaaaauaaacaaugacacaccaaacuuguguauaauaauacuugacuguucuacuucaugguggguuuuuaauauauaagauauuugggauuuaaauuuuugugaugaguguuuuuuuuuuuuguuuguuuuguuuuguuuuugagacagagucucccucugucgcccaggcuggagugcgguagugccaucucggcucacugcaagcuccgccucccggguucaggccauucuccugccucagccucccgaguagcugguacuacaggcgcccaccaccacgcccggcuaauuuuuuguaauuuuaguagagacaggguuucaccguguuagccaggaugguuuccauugccugaccucaugauccacccgccucggccucccaaagugcugggauuacaggcgugagccaccacaccaggccguugugaugaguuuuauaccucauauuuaaugucuuaucaccuuuaggcucauaauucuaaaagacaugguugcauuuccacaauagcaaaucagaaggcugccauuugggaaguaauugacauuugggaaguaaucuaaaaggcaggccucaugaauucauuuuuuucauacauuccuuaaacaacagaguugugcuggauguucuauuaggucuuggggauaagaaggcaggcucuguacuacuuauagacuuauuaacauuguaggugguaagaagaguggagaaauuauaacaguuauuccuggggcccugguuggacaugccuaaauaaaaaagagcuaagaaaugguagaauuuggagaguaucuccaggguuacucucucaaguagaaacugugguuaagaugaucacauuggaguuaguuaaaauuucagaucuaccacuugauaacugcaugacuuggagggaauucuuuauucuuucuuaguuuaauuuauucaucuauacaauagauacaauaauuccugcuuuauaaugugacuacauagaaaacuaagauaauauguuuaacacauuuuguggcacgcccugagcaucuccuggauagcuauuaucauugucacuauuauuauuucucagcuauucuccaacuuuuauuuucuuacaggaagagauaauauaauaauuuuaauaaaacaauucaguuuuacauaauguuucccuuuucagagauuugagccuuagaguuuccauuauuuuaacgaguaaauuuugucaacuaaauagaugagguauuauuuucucaaguuuaguuaugcauagagagagacauggagaguguaaauggcuuaccuacacugccagucgguggcuaacuccagcuaaaaguuggcgcucuuaagucuccucucuguucuuuguccauuacaucauguucacuugcuuaaaaauuacuuugcuaccuucaaaguucuuuuagauauucaaagaaagcuauuaagggaauauauacuauucugaaauuuuauaacuugacuuagcucccugacuaggguguggaaaguauuaaucuucaauugagaagaauaugaauugucaaaguuauccacuccaaauuuggccaugaagcaaccugcugagcaauuugccucauagaauauacuauguacuauauuuuaaaacugccucaggaaaccucugaaagcagaugauggcucucuuuucguuuguuuggaaauccgcaaugaguacauauacucauuuacuauguagcaugauaauaggacagggaaaacccauauuuccuuagucauccuuauuuuauauuggagacgucuaucaagguuaauucuuuaaaaguaauuuaaacuuuacuuuggucauuguuuuugguauucaaaaaacaaacacgcaaacagauuuuaaaaacucaguuuucuagcugcaacucagauuucauucagagcugcuguuuaacugauuuauuauugaauggauuugagccacccaucuuugugaacuucccaguacagaagguacuagcuguguguggcuacugaacacuuuuaguguagcuguucugaauugaacuguacuauaacuauaaaauucacgccagauuucaaagacugcauauaaaaaggguuccauaauaccucaauaacuuuauauugauuacauguuuaaauaguagcuuggauauauugagauagauaaauuacaugacuaauauuuauuucaccuuaucuuuuuacuauuuuuuaaguuggucacuagaaauuuucaaacuacauguguggcuuacauucuauuucaacuggguagugccauucuagauauguaauuaugaacauuauaagaauaccauacaguacugaguccuucaaauauuugacauuuuuagugcugcaauauuuguaaucuuguagcaauguguauauaaauucuucuuuaauuuuuauacuuauuuuuaauuaucccugaaauauuauuguaauuuaauuuauaugcuaaaaaugaauaugauguauaugaaauacacaauuuuuaaauaauacucauaauauuaaagcuguucuucaaaaaugucacuuaaaucaucuauauugguaguagacuaugauguuauauauuuaauaguaaacucaugcccgggcacagcggcucacaccuguaaucccagcacuuugggaggccaaggagggcagauugccugagcucaggaguucgugaccagccugggcaacacagugaaacccgucucuacuaaaauacaaaaaaaaaauuagccagguguggcaguaugcaccugcagucccagcuauucgggaggcugaggcaggagaauugcuugaacccaggaggcggagguugcagugagucgagaucgugccacugcacuccagccugggccacagagcaaggcucugucucaaacaaacaaacaaacaaacaaacaaauacuauacucauucauucauuuacugacauuccaugacuaccuauaauagguuagguuggggcuguaaagcuggguaauacuuguuuguugaucucaauuaauuugcaaccuaguggauuaaguagguaagcagauaucaguuagaguauagagaaguguauuuugauagaaguaauuauaaguuguaugagagugcagagaucacgagucuuuccagaggaauugaagcuaaguuuuaggaccucuguggaccacacaaugcucuucagaugaagaagagguaagagcauuccagguacagcauuagccaaaauacggaagcaggaaaagugaucuguuuaaaauguaaauguguuuucuauagcguaaacaauagauguauuugcuauuggugggagggaguagugguugaaaggggagagaguaagucauaagagcugagauugagccagaugauacuaaaauaugugauuuuaaaaauaugacaucuauuacauaguauuaagaagauuauagaggaggaauaugcaacuugagagcuaacuguaacagaggaguagaggguagauuucagagagaaaagaguaguugugaauaaauuaauuaggaaguaauugcaauaguccuuguaagcauuuaugaccaccugagcaaagaaguuuuuauuuugagaaguugagcagggaauaaagaaaaugauggcuucuagaauaccacucaguuuucuguucugaacuacaggauauuuauucaaagauagggaauguaaggaaacaagcaggauugauacaaggaaagacuguucaauuggacacagugaauuugugguaucugugaaugucuucuagucauuaaaaaaaaaauauauauauauauauguauaugccuacagauauagauugggagagucauuauuaagaaaucauuuuauuaauguguuuacggauugagcuuucucagaaagaaaaugcagagugaaaagaacagagagccaaggacuaaguaaaguuuugaugaaaauuaggaaguauuagagauguauccagagagacuuuguguaauauauuuuuuagaauuacuaauguaaucugucgcuuugguagacuaggacuauucuaagaaacagauguuuuauaacuucccucaauuaucaucauuuuaccaggaguaaaugauggaaaccacacuauuauccaaacuuauguaaaucaaauauaaaaauauauuacuuggcaugcauuucauagcuauaaccaacaaauuuuccagacuaucauaaguuauaucaacaucagauauuaagauuccucuuaaagcugaaugggaagagaggaugugaucuuggaucuuggaaaggguaccaaaauaugucacuuucaaugaaaacuuacaaaagucuuugaauaaaaauaauguauauaguacaauagaaaagagcaguauuuuugcuuaccaauauuaaauaauaauguuauugaagaauucauaauuguugaggcgcuucagcaaacuugaagcguucuggggagucagguagcugugacagaugaaauucaacuucucuacauaagaucaacaacuuuuggaaagcugacaugcucuuuguagaucaaauuauugcacauuuggauuccaugagaaaagcaguaugauacacagagaagacaaauuucagcugcauuuucauaguugauaauaaaaguauuuuauacagaaagaaaaguaaaccuuuaaucauaaaauagcuuaaugacuucauaucagauaaugcauccuuguuguacaugguccaaguuugauuauaucauuuuaagauguguaucagagaucaaaaagauuuagagaaaacagccaggauaauuagaauuacuuugggauuuacauaugaugagugauuaaaaaaacauuaacugcaaugguauauaaaugagaaaaucuaggcaaggaguuuugacugagagagucacaaaugugaaagcugugauagaaaaugacucugaugucuuauuuauucuguuucauauuuuauuuaaaaaagaaguuuuuuuaagagguuagaaauauacugaccaauuuaauagaaauaauuaguugugguaucaguaauguacuuacuggugcaauuuauggucacacauaugcuuuauuuucccaaaaguuacagaauaagcaugcuggaaggauuuuuuuuuaauggacuugggucauuuuuaaagauggauuaaaauuauuaaugacauuugcaguuauguaagcucuagccauaaaaugccauuacucauuuguucuacuuaggcaacacaaaaugcaguugcuggauugaucagaucugcagcuggaucacuuacuggcucauuaauuuuuaucauauauugaguauucugaccugguacaucagcuuuugaaauagccacuugucuucuuucccugggcaaauagcuacuggaugcauuuuuaaaauguugaucuaauuuauuuuguucucacugagcaucugugggaguggaaggcugguaaacaaguguuuagguuuacauguacuuugggagucauaucaccucuguguacacuccugcaggaucagcuuaggcaaauuuguuuagauggcaaaacaggucuucagcauuucaccucuuuucauuccacuuucccuucucuuuuagcaccaacccggaggcauuuaguuuuugcucuugcuuucacuugguagucucaguggaaaaaaacauaaaaauaauuuuguaugcuugaggugaaacaacuuuguaauaacauucuuuugauuugcuaguuuuguguaucucccuaagucuacuucagaacauagaaagccuuuuuuuuuuuuuuuuuuuuuuuuuaacauccaauaugauagagcucauugccuugacaucauggcauggauaugugguuuuuccuugcauuccaaauaauggauguuuagcugcguggccauagcuauuuuauguuuuauuaaaccauaugucacuguggcagguguuuguucucugugauuucucuagucaugugguucuuuauaauagacauguuuucugugugucccacuguaaaaccuacacauguauuuaacugaguaccuugugccccuuuagauuuagcaucuucaguuuuuuucccuccuuccuuuuuuauguuuuccucaccugaaaaauuuauguuucuauuuucugucuuauuucucuccuuuacucuuuuuuuuuuuuuuuuuuuuuuuugagacggagucucgcucugucgcccaggacggacugcggacugcaguggcgcaaucucggcucacugcaagcuccgcuucccggguucacgccauucuccugccucagccucccaaguagcugggacuacaggcgcccgccaccgcgcccggcuaauuuuuuguauuuuuaguagagacgggguuucaccuuguuagccaggauggucucgaucuccugaccucauaauccacccgccucggccucccaaccuccuuuacucuucauagcauccccaugauaccuucuuuuuucuuccucccuuuuacauggaugucucuggccucuguucuuggcaugauuggaggggaggacugaucuuccuuaggguacuuuagugaccaaaaagacaacugaugcauggccucacuggcaggcagugucaacagaauugugaccucuucuugcuguuaauaggcacaguggccacaagagccaggggaccugucuguacgugcucuucaucuauggccugugaggggucuuagggaacaagaaacagacucuuucuucauuagagacuuagaaauggaaaauaauuucuuaagauuuuuuuuaaacaguccccaaagcauccuuuuugaaugaagggcuccucuuucaaauuccguaugucaaagcugauugguuuacacacauccuuucagaguuaauuguguagaaaaggaacuaaaaagagacucagaaaauaaauggcuuugauaaagcagauuuuauaaaaaaauccuuugauuucuucaauucaucauauuauuccagagauuuuccccuggccagaaaugaauguaauuuuccccuuuguggcacaaauggggguguuuauuuccuacugcugaaugguagcugaaaugcuguggggaaugcgcuucugugauaucuucuccaauaugcucuaaccccaugcaaucaaauaaauuggaucauugaagaccacuaggcgccuucauguuccagcaguagugagugagagggucaaugcccugcauucuguuucugccccuuucuuuguuugcucagcaguguacuauuuggucggcguuauuuagucuuauaucugcacugucucccccuucaccuaccccuuccacagaucaguaccacgugagugguuuguauuucucccugguagcuguugcuucucucuaucucccgccugucucuuuaucucuuuuuugugugucagaugugaagcuggcaccaggccuugauugaaacccucgaguacuucuuucacuacuugcuauuccuacaucuuguuacuuuuaucuggauucaguaagugaagguuauagaacauacaggauuaagcaauucugggagggaauuggacguuaacucuuuaggaauucuaguguggcuaauaaagguauacuguugaaaaaguagacggguuagguacuuccuaagcagugugauuccacagacagaaaaaaaaaguuucucccuggaaaucucuugcucagaaaacacucaaaauucugcuuuuagaguaccaaauuuuugaguuaacuguuucugccucaaaauaccaauaucaaggcagauauugcaauuuuucacuuuuguagauuauuauacugaccuguagguucuacaguucccugcugcaaaauugucauuuccuuuuugccuuaagacuuuuguacuggggaaaagggacagaagaacugugagaaaucucugacaggagaauugcuagaaagcagcaaauacacucaugagaauggacucugagaaucugcaaaucugacacaguccggugaagccaccuguggcuggucaggauaucagggaaaggucuaccuuauuauggguggcccagagagaccagaugcuugaaaguuauuuugaaacaccaaccugauuucuacacuacuuugauucuauuaaccaacaucauggggacccucugcauguucugagauuuggaaucccuucaugguauguauucuuggaggaaggcagaaaaagggagagaggagaaggggaaagaugggagcaggacugagugggauagcagaauaguuguagaagggguugggaagaagcggaggaugaagaucagucuguaggaccagaccagacaugccagaaggacgucucaguguuacugaguugcagaguucaaagaaguagaaacgaaaacuuaaacauucacucagccaagacaaauguuucuuuuaaagucucauaaugcacuauuguguggaacauaucugguagauuaaugaccagcugugguaaaggccuggugcccaauuuuaagcuagugauaaauauccuggauuuagaggauuaaauguuuuuguagcugagcuauauuuuauaaaaugauaaaaacaauuacucuaccacauauagaauuuucacacacugaaaccaaauuuaauuagcuaugucuuuccagaugagauugggaaacaaauaaauacauaugaguauuuuccacuucauguauacucaagauauuccuuccuuuuccuuuaacgguauuuucuuaaauauguucucaguuaaauguauuucaagugcucuccuuuccaguuuccuucucaugagcaaaguuauccucuucucaaauaugagaaacccuggugguugaagaaaauuauuucaucaacuaaaaugugcuuccaaguauggugaagcaaaauuugucuaccaauuagagaaugaauaaacaagccuauuaaauauccuaauuuucuagaugucgggaagggaagccacugauggaaaauaaaugauauucuuaacggauucaaagagauaaaguacuuuuacuucuuaucugugcauuacucuaugguuaccauuucuagaaaucauaaaauuguguacauauauaauuuaauagauuuguccauacauuuucaaagucauuacauagaaaaccuaggacauaaauauauccuuccucuuuccccuagaaacuguauaaaauauaacauacaauuauguagaccccaguaugaggcuucccacauucaaaucccaauugagggauuuaucggugguacaaucuugggcaaguugcuuaaccuuuauacaccccaguuuucucauaucacaacccuaugaagauuaaaugaacuauuacacauaaagugcuuaccacagugauuugaacauauuuuauuauacagaguuacagggaaauguuuuccugacuuaaaagauacagagaagggagcgaauucaagaaauagccagcguaucuucauauuuuuacauuauuucaaauuuuaacauaugagacacuucacacauugcuauacuuccggcugcuuuuuauuuaugauuaugauuuugccugugaagaagagauuauuaauucuugaaauauagaaugggaauucaaagcucacagagauuaauguagugugauguagaggauaagaucccauauccuggagacaaauugccuggguucaaaaucuggcuuuaccauuuacaagcuggguaaucguggaugauuaacuucuuuuugccucaaguuccucaucugaaaaauagggauaauaauagcauuuauuuccuaugguuguuaggagaauuuauuuauuuauaauauauguaaaaggcuuaaaauuaugcucgguucauuauaagcauuaguuauuauuuuauaucauuauucuuauuaguaaaaucaugcuuaaguuuauacagcuaaaaauaaguaaagacagaccuagaauucuggccuugugacuggaaauauuuguauuggcauuaauggaucaauaauuucucugaaaaauaauauuaagauauuuacuguagucuuacuuuaugccaaguauucuuauauucauuuuacacaaauuuuaaaaauuauuucucacuacaacuauaugagauaagacuuauuguuagguuuacuuuacacaugauucaaugagagugagauuaaauuauuugccaaaggccccaaaauuugaaaacauguagccuaaucccagagucagcauaacauacaaauuuuaauuuuauuguuuuucucuauaauuuuuaaguuuuucauacuagacauguguuaguuuuacaaguggaaaaauggacauuaaaaguuauuucaaggccgggcacagugguucauaccuguaaucccagcacuuuggggggccgaggugagaucacuugauaccaggaguucgagaccagucuaggcaacauggugagacccuguaucuacaaaucauuuuuuuaauuaaaaaaaaguuauuuuaacagaauaaauauucuguugagcaguaggaccugaaguaauuguacacaauaggugaugacuaaauuguguagccaaaaguuaggauuauaaggcuaugggugggcaggaggcaguaaagagaaaaugggaaugagggagaaaaauaaugaaucaaaggauagcauagagauaacugaaaugacaaacuugaacuccuuuuacugggggcuagcuuuacaugguaaaauggaauggcauaacaucuuucagagacacauuuuauuaauuucauaguuugauuaaugaaaguuuugagacuccuuuagcauucugauucuaugacugguagaacaauuucaugaaugcuuuaaaucacaauuauuugaagaauagauuauuauuuuuaguaaaaaauauguugaguaguuuuucaaguuaugaauagaaaaaauaaguuaaucaauuacaaauaaaauggaguaugauccuguguauuuacuugcuauuuugaucaauugccacauauuguugaauacagaugcacaguuguacauguaugcaucccuuuguccaaucucuauuugugagacucacagacauuuguucuuuauacaucuuucauuucugagaguuuaguuguucacaaagcagucugaacuuaugaagacuuagcaguugaaaagggcugaagugcauuuaauuugauuguaucugcucaaaguaaaacuuacugaaguucaagccccuguggaguaugcaaaaauuuuuggaugauagugaauuaugcuuugcucuacaaaugcaggaaguaucuccuuccauuaugugguccauaggaguaaauucugucagaaaaaaaauucuauuuuauuugaguuugccccuagauaaaaagcuauuuaaucugauuuuucucucaggaaaagaaauaagcgcuuuccauuauuucauuuuccagauaacccuguguagaaguacuuauagcuucaucaauguauugaaguuaaaaugcuauauuugacuuauuuauuaaguuucauaauaguaaauaguuucaauaauuuggagguuaacuuugaaucagcauuuuucuuaguuuuuacaaauaucacccacaacaaacaggcaaaauaauuucaacugcaaagugcucuaaaugacugacaaauauuuaugacccauguuguuuucuguaugacuaaacuauuaaauauaguuuaaaaagaacauuuauuauuuuaaauguauuaaauccagguagcaugugcagcaguuuuguuuuauguauaggauucauaagaacuacaaugauuacaucaacacccgagaaagauauugucagagaauuccacauaugugaaguagaaugcacuuaucuuuccauguguacugauaaaaggaaacucaccauuuucuucuuuuugcauguuuagcccuucagguauuucuccucuucgaaauagaguuuuauaaauuauauuucauuuguacuuguugauaucuuccuaaauuaauguuuguggcaggcacucucuaauuaaacuaaguucaauuagguaauuuugcuuuguuuuugcuaucccucuauuugaguuucugaauccaauuggaguuuuacauguaugcaaacacugugcugucugcuccaaguuaaucaguuaacauuuauugaaccccugcuauaugcacuguaauaaaauaagcauuguggaauuguuugaaggaaauaauauaguagccaguaacucuaagcaauugggaaagcaaaugaaaaaacaaauucagacauuuugaaaucaauagcuacaucaucucuuuuaugaaaagaguguugacaaaaauuaaagaagcuggaauucuaggcuggcuguauuguaccaucaagaugcuguguccacugugcuaugccaaaugauaguuagaccaaagagagcuaacccuuuagggacaggagauggugaggacugagaaauucuucuguguuaugcugaaaguuacuuagaagaaaacaaguuauguaaaagcacauggguuuaauacugaacuuaaaaguuuaagguucaagauaagcccauauuuacauugggccuugguuuggauuuguaaagucugaaaaaaagagagauuuccuuuuuugaaaauuagguuuucauuuaccauuguauuuccuuaacuggcauaucuugacauucuuauucccuuuuguaaauugaaagaaccggauaguaacaaugucacaaauuacuuguuuauaggacauugcucauuggaugcaaaaacaaaaacaaaaaaaugccaaacaagacauuaaacauuauugcaaccuccacaauguauacagugcuaaacaauaugauuuauguuuccaaauaagagccaaaugguucuaaucuagaugugcauuugaaauuuuuuaauaguucauaucaugaauauaaacuguagggaaaguuucaucuuuuucacuguuaugcaugaagccucuaacccuucuaacccuuccaaaucucaccuucuaguuacugguaaggcuggggccauuagacauaacauucuuguuauggugcuauauucuuacacugagauucaaaaccuugaauccauaaugacaucuccuugucacugcccuuaugccuuccacuaaaccuuguaaagccuaucaccugauaggucucccauaaucuuucuccucuguuguucucugcugcuucuuucaugguacuuucauaaauaucuuuucaauaaucucaucaaguuucacuuccaucacuuccaccauucccauccacuaugcacaucucaaaauauaucuucaaauacccaguccuguucaugauguucaaguuccuucaaguguuggaacucagcuuuccacccagcacaugaguaaagcagagcuagucuuccuuagaaggaggcuucugcuuucugauggccucguguaagaccuucuagcguccuccuacugggcauuguauccucugcuuuaaucaugagaugaaccuaaucaaaauuuuccuuaggcaacaaacucucuguaauauuuucuuucuaccaacucucaaagaaugagagacucucauuuaucauaguauuucucaaugucuacguagaauuauagcuuuccauguaauuuugcucucucuacuauuagauucauuuuagggaacauugucauucuuacaccuaguagcucuugggauacaaugaugaauuuuacaaugucuuacagauaaaauauuaagcauuugguuuguaaguagugagguagaugagggcacucuuguuacagaugcacagaagaaagaaacauaacuggauuucagaguuugggaaaacuuuuuugaagggaucacacaaagauagacuugaugauaaagaaugaaaagaggaagccaaauaaagaaggauggugagaacauuuuaaggagagggaauaacaugggaaugcaggaucacugaggccugauacuccaguaaagaugguuugguauuaguagaacuaaggcauauagggcaggaaguggcacaccacaaccuagagaguuugagcuuugcgcugauaauaugugaucauaauacugcauauuugugauacugagguugagccuugugauauuauguuaugggcuaaggggcuuagacuucauuuuguagaugagaagaagccauggaaagguggaucugguuacauuaaagggacuuuuaaagcagaugcauauuuauaucucaacuuucccacaugcuguguuccaguagggauagggagauguuucucaucuguaaaacguauagagucauauuuaaccgacuguagaagaauuaaaugaaaauaaaugguggcauaacacuccuggaauauuagauauugccuuuuucccuauugccuagaauaaauccuggcacauggaaaauguacaauauuuguugaauauaccacaaugcagugcauaagagaauggauccaauguugcacuguguugccaaauaauaaugacuuacauuuuaauuuuuucuuuguuuuauuuuuagauugaauuuuuauuuuuaucaaaguaauauacaugcauaguuuaaaagucaaagauuaauacaggcuuucccacuacuauuucuggcuccucagaaguaaccucuuguaacucuuguggcuauuucugucugcacauaucuccauuuuucuaaauagcaugcacguucuguuauuugggcaguugcauauuguuauuaugcaggaacucuuuuuuaucauuugcauuuucuucauaguugcaguacucacuuuuaccacucugaaaugguuaacaauauucuuuguuuuguuuuguuucacuaucacuauaauguuuuauccacuauugggcaggcacccuugacauuagagucuuugauauaauuucucugguugcauaagguggagaaugauccaaguuacacacgacuuuaaccauuugucuuuuuuucagcccaccccucauucccacuuucuaaguuagcuggugucucugauuuuuuagcccuuguacauuucaguggcucagauugaccugcuucuuuugcucaccaccucagaauaaacugaguuuucauccuucuuuuuugugaguaacuagucauccauuaguuucccaucaucaaaaacuuuucauuuacucucauguccauauuuauuuccguugucuuuguggguuguucuuuguccuucuuuacugacauuuuaguguacuuggaggaugaauugaagauguaaacacaaucagucugggacuuuaacccgcauuagaaaguuucaaaaugcuuuuauauugaccaucugauuuccuucucaccacaaucuggaauuuuuucacagauggaagugguauuauuucuauuuuauaaguugucgaaaguuucuuuuuuacuuuuucuucuuauuuuuauuucuaacuuucauuuuagguucaggaauacauaugcugguuuguuauguagguaaacucaugccguggggguucauuguacagauuaugucaucacccagguacuaagccuaguacgcaauaguuauuuuuuccguuccucuccuuccucccacccuuuaccuucaaguaggccccagggucuguuguuccccucuuuguguccauguguucucuuuauuuagcuccaacuuauaagugagaacaugcaguauuuguuuucuauuucuguguuaguuugcuaaggaugauggccuccagcuccauucauguuccugcaaaggacaugguuucauucuuuuuuuuuaucgcuguuuaguauuuuauaguguauauguaccauauuuucuuuauccagucuagcauugauggacauuuagguagauuccaugucuuugcuacugggacuagugcaaugaacauacaugugcauauguccuuacaguacaaugacuuauauuccuuuggguuaucccagaguauguaaugggauugguggguugaauggcaguucuguuuuuagcucuuugaggaaucgccgaacuucauuccacaaagguugaacuaauauacacucccaccaagaguguaugaguguuuccuuuucucugcaaccuugcuagcauguuauuuuugauuuuuuaauaauaaccuuucugacuggugugaggugguaucucauugugguuuagauuugcauuucucuaacgaucagugauauugaacuuuuuuucauaugcuugaugccacauguaugucuuccuuugaaaagugucuguuuauguccuuugcccacuuuuuaaugggguugcuuuuugaauugaguuugguaguuguuagguagcaauuucagggccauaauuuguauuuauuuucaaugaucuuucuagugugucacaaaguccaggguagaaaacaugaauacauuggaaccucagaauuaaauaaauauaagaaauaaagagauacacuuuagcaucaugacauaaagaaaagacuucuuaaaugucaauagaucaguucacuucauucaauuuuuacccuuaauucuuguucacucaaagagaacaaacacuuuucauauuuaaacaagaugauaguuguugcucagucucauauaauuuucagacagcacuuaacugaugggguuagcauggccugcaucucucccaccacuauaaaggcugaaauaaaaggcuuuuuuaucuucaaugcuagggcucacaaaaaaaagacucuagagaggccuuauucucucuuaaacacaccuuugauaaugcagcucuugcaauuugagaaaaacucaucaccaauaaaaucaguuuagauagcucacuugggcuauugauaacuuauucuucaaacuuguuccaucuuacuuggaauagcauuagcagcaacugaggagacacagguuggaaagaaauuuauucuggcagagagcgaaauuagguauugaauuguaccuuccaagggugcuguuauuuucuuucuuuuacuuuuuuuuuuuuguuuugcgcuuuagucucuuuguugggguuccuuuuuuuuuuuuuuuugacuucuacuuuucuacuauuuuccuuagaauguugcccauuauaauuuuuagaaaggaaaauauucuuuuaaaaauuuucauaaugacaagacaguaaaaguaugcaagcugguguguucuccaaauugcauauauauuuuuuggaaaagaacaacuuuuauaucuuuucuguuacaaaaaauaaaaguagguacaacaaaugaaaaucuuuuagauucgguuuuuacgaaaucuuuaaaguggucaucuaaaaaaucauuguugagauacacucguugaccauuuuuaagauaccuagauuuucuucaagcagagaauuuaucugaaaaauaagaaauagcaucuucaauuauuuauaaucuuuugaaauccaaggacaagcaggcacuuucuaguuuuuuguuuguuuugauuuuguuuuuguuuuguuuuguuuuguuuuuuuugagauggagucuugcucuaucguccaggcuggagugcaguggcaugaucucagcucacugcaaccuccaccucccugguucaagcaguuccccugccucagccucccaaguagcuuggauuacagguucacgccaccaugcccagcuaauuuuuuuuguauuuuuaguggagacaggguuucaccauguuggccagauuggucucaaacuccugaccucagacaguccacccgccucggccucccgaaguccugagauuacagccaugagccaccacucccagccacuuucuaguuuuauccuuuauaucucauauuaccuagaauucuguaacuauuaucuaaaauuuccauauugaaugugccuuaaaaaucuccaagagaugaaagaaauauaaacuaaggccaaaacuaucauauuaaaugucucacuauuuuuaaauuauuuauuugugugagcucuguaauuaaauccuuugaagaauauacuaaaaauacacuguuuuuuucuuguugacauuucacucaaaacauaucuauuacuuuuagagucagugagauuaaagugauuggaaauaaauguuucucuucgaaaaccuuagugcaaagacaaaaggagguuauaaaaaaauugcacaauaaaauuuauuuuuauuucacuuauaaacucagaaagcauuuuuuuaaaguaacuuuuuuaaaaaaagcuacccaaaucccaaauacaaaaagauaauuauuaucugcaguugagaucaugcaaaaaaauucugccagcuccuauagccgggagccagucucccucaaucagauucacuuaucagguguuaaaaauaaauggaauggaaacccugcaucugaauccaauguauuccaagucugcauauucacaggaaaucuuccaguaaaucguaaaauaaaacaauagcacugaaauuucagaguaauaucuaagacacccaccucauuacucuuuuaucucuucguucacguacauauugcauaagcugaugggauccgcauugcuucagugaucuacauuuggauggaaauucuuaacuguauuucaagguuaugauaugacgaugugaguucuugaagugaagcgaaaacaaaaggaaagaaacaaaaaauguaaacuugccuuuugggaguuuuagauuaauucauucuagauuuugugauuaugcaugagucuuauguguauauuuuuccauuuugauaauaaauaaaugugauuauagagaccaacacuagaacauuaauagggucucaguuuguuaaaaaaucauguuuaucgcggauuuaugaaaugugaagcauugggcuugaugauaaccacacaacacagucuaaagcucugcacucaggagaaaucagaaauaaguaguuugcucucuccaaauaacuggugcuugaauucaaugacagucucuucccaaagugauaggugaauuugacuauaugguaaaaaugaaucuaauaauuaaaaguuuugagcugggagggaucucggagauuaucuauuuuaucuaaaguuuuuguuuucuagagaauaaagucagccacagagaacccgccuucagucgcauggcgaauagcuagcacaucugcagcuaggacucagcucaguacagugaagaggguaugggaugcagagucaggcauauuuuuuacucuacagauuauguuuuaaggaagauuaugaaugcuaaucuagcauugguucaugccuguguugauuucauuacauagaucuagcagcaucugugaaaguaguauuaggccucacuuuuaaaaugcuacagauuucuacauuuugcaugagaaauaggucagaagagcauuccauugaaguggcagagcuccaguuugaguccauaauucuccuccuaucauguccuuccuaaucuaauuaucuguacuucuuuagguugcaguauuuuuuaauauccuuagacauagccuugguauauuagaaacacuuucagaagacuguaaaagauggggaaauaaauauaagaagucaaaggaaaucagaagaaauacaccagaaagaaaauagccacuaucaaugccccaccugccucccccaccuacuucccauuaagcauauauugcuuuucuaaaauuauguggacuauauucuaccuuaccauaggaaugcauuugaaauccuuuaugugcuucuuuggaaaacucugaauuccuuuuucacaauaagugauucaacaugcaaaaacaguucuuucuggaauaacaaacauugacugaagaaaaaaguugauauaucuuuuccuaauguuacauuuuucucaccagaauucuauuagcaugaugucuuuucugugagucccaaacugacucacuguacauuaguguaggaaauauuaacauaaaggaauauauauuuauuuucaguauugugcuauucucgaguuaguuaaagcuucuauuaauuucagugggaaacugaauaaagauaauguagcaucaugauuaagguauacaucuuuucaaagaucaccugcauuagucugucauauuuauggaauagacaagaguugcuaaucucugauacugaguaaaugaauucagauguaggcauuugcaaaaauaauuaauauaccauugaauauaaaacagacuaauuucaaaaugaaaagaacuguuauuuguauaggauucagaaauaucuugcccuuaaauuuuuaaauauuucuagcagauuaggauauaccacuauuacuuuuauuaauuuuaaugacuauuucauuagugcuguauucaaaacuagugccguuuaauuauaauuuuaugucaauuuguagaauauuuuuauuuuuaauaaugcuauuaucaaaauaguguaauagucuaucagaggcucaaagaaaaaacaaauuuaauaaugugauuuagaaacuaaacagaaauuuacuuaauauccucaaguguaaaagcauguuuacuauuuuauucauuuuguuuauuuucauaagaauacauauuaaugugaaccuaaucugauuuggcugaaauauuaccaagauaggagacucucaagcuuacuuugaaucccuacagagauagugaguaauguaauauggaaaaucagcauguccaaugaacaguugugaauguccugaaguaauguggcuaaugugcauggccccauguccuuuagacuggauuccugaggcaauggugugaguaucugcagugagaagauaaaaagcacaaggugaauggugaugauggcucuacuaaguaaucuacuuccuugacugaauucuguaaagagcugaauuccucuaauaaaauuucuuuugcacaaugaaugaaucaaauagaaauacagcaugaaaaucagaauggacuccuaaggugcuaaagaaaagaaaagaaaaaagaaaaauaaagaaaagaacaagagaaauaaaugaaaaaaaggaagcauucuuguaacagugcagacacaagaagccacaagccaaggcaccaacacugaagccaggcagccuuuuuaggacauccucuuugguuccaauuaucuguuguuauauucugugcauaugcuuccaaauaaagguggaaguuauuucauucacauuuuagcacaaauuuaguaucugguuuuuaucaucuccugugagauucauuuugcuaagagaaaaaaagagaugauauaauuuuauuaaauuacauaaucaaauaauuuucaaaacuugcuuaaagauaaauauuuuaaugaaauguuuuugucccuuccauucugcauggagauuaaaaaucccaaugguuucuggaugaaaauuaaaaucucuauuagauuucuagagcuuuuauaacaaauugacaaaagcgugguggcuuaaaagaacagauauuuauuauuugaucucucacagccuggaggacaaaaguccaaaaucaaggugcugccaggacuguguuccaucccuaggcucuucagaagauucuguuucuuuuuuuuuuuuuuuuucuuuugaguuggagucucgcucugucgcccaggcuggagugcaguggcgcgaucucggcucacugcaagcucugccucccguguucacgccauucuccugccucagcuuccagaguagcugggacuacaggcgcccgccaccacgcccagcuaauuuuuuguguuuuuaguagagacgggguuucaccguguuagccaggauggucucuauuaauuaguauaauuaaaauauuaacugagugccuuaugaauuuuacuauaauuugagagaaaaugaucuaauuuauauuuuaaaacuucgguauuucugaauuuuucaauaugcauuuauauguucacuuaccucugcgagggaaucuuguaacaacacuuaagaugggacuucggggguaaacaucauuauuuaagucuuacuauuuaaaaccguguuuauugcaucucagauuuccaaccaaagggcuacaauaaaacuaacguauacaauauaucuuaaagugaagaaucaacuggggaagaaauguuauuacugcaaucauccauacucaguucuaccucauaaauuaccuuugaguucagcuguaucaaaauaaauagaaauuucauagcaucccaagcauaaauagggacuaguggaauauauaguauccguggggcaggaaauaaaaucguagcuauuugguaagauuuugaagucaccucuagagagacaaauacuaccagucagugaagagugaccuuuuucacacaucagagaagcaacauaaauaaaguuuaagauguaaaagggaauaaaaaacacagcugagguuaaguauaucuaaguucuuccuaagguaauauaaaaugaauuuaaccugacagaaguauuuuugaagaaaggacccauauauguagaaagauuuauauuauuuuuguuuuuaguuucuacuuuucauuaauuuuuauugccuccuauguccccccaucccacaauauuaaacugauaugggagguggggauagugaaauauccuuaggucuuuuacuuuuggauauagguguccuagcauggugucuacuuauagaccugccauuuuuaauuugaaaagcuuuguaauacaccaguaauaaaugcauucauauccacaucuucccuaaucacuacagugccugcacugcuauuuggcacucauuagcugaaacugccauucaccuauaauuuaugacuagcauacaauuauguguuaucacuacuccaagugauuacuacacugcauguuucugagauaaugguaugcaacacuccaugauaaauuguacuucaauggauaguucauuucugucauuuacucuauuauuuuccuaaaaacagucucaagagaauuauauugaaaugugaguaccuuuugaaauuaagaauauagagccaacgcuguuccuacaggagaggaaaacugcauucagagaaagaagcagauaacguuagcaaauacauuugaaaauauuaugauaaaagugaaauauggaaauuuaagagcagacuaugaauuuuucuuuaaaaauacgugaccauauuuugauuaacgacugaaaauaauguguguagucauuuggccauaaaggcaaauauuuuaacaucaaauauuguggaauguggcauggauauuuguaaaacuuacaaagucaugaucaauuuggaugugaugcauuaaaaaccaaaauauuuuuaauuguugaaauauguucauuuuauuaucuaccuaguacuuuaacuuacaacagcacuuacaugaacugacauucauuauuuacuuuguggugagcaaagcacugcucuacauauuucauguguauaaucucauguaauucacgugacaacccaaucaauacaugaaauguuaguacaccaauuuuacaaagaagcaaugaggcacagaaaguuguguagcuuacucagaagcauaccaagacuacaugaaugaauucauuuccuugggcugucauaacaaagcauggaccauaaacuggcagcuuaaaaaaaaagaaaaagcaaaacaaaaacaaauauuaaauguucucuugaaguucuggagacuagaaaucagaaaucaguguaccgacagcaccacgcuaacacugacaccucugggaaaaauaccauucuugguucuuccagguucugguggcuucacacauucuuugguuuguagcaucgaaucucugccuuugucuucauguguccuucucuguguaucucugugcccuuuccuuuucuuauaauggcaucagucauuaaauuuaggggcacucugaguucaggaugauuucaugucaggauguuuaacuaauuacaucuguaaagacccucuuuccuaauaagguaaaauucugagguuuugagucaaauuaaauuuugggaaacaccuuuccuaccaguacaaugguggagcugaaugcucucuucaaacacaaacauacuguagagucuguccccuugaauguguaugauugucccagauacaaugaucgguacauauuucauuuaauaaccauuccaacccucugaguauauguucucuuuuuuacauauaagaaugcccaaggucaugugacauagagcaguauuauuuaaguuaagugauuuuuuuuuucuuugagacagagucucgcucuguugcccaggguggauugcaguggcacuaucucggcucacugaaaccuccagguucaagugauucuacucccucggccucccaaggaggagcuggaucuacaggcacgcacuaccaugccuggcuaauuuuucuauuuuuuaguagagaugggauuucaccauguuggccaaucuggucuugaauuccaggccuccaguaaucugucugccucaacuucucaaagugcuggcauuacaggugugagccccuagucccgcccuuaauugagugacuuuuuucuaaaacacaaaauaugcauucuccugcuuaaaauuccccugaugcauuauaauuaccuuuaaaauaaaacccaaauuccuugaaguaacauuuagggcccaccaggaucuggcccuuccuugcgucuccagcucacgucucuuuccccacccaauagguguacauucccuaccauccuggccuccaagcuuucuccuauguuguucccucugcugacaacacucuuucugccaggcuauuucuucugccuguucuucuggucucaccuugccacuucugcuaggcuguuucuucugauaucccugaauagguuuggugaaccugcuaugggcucccauaauaaucuaaguagcaccuaaccuuacagucauuugugggagcagacaucacaacuuuaaauuuucagcugcaauuucaauacagcuaugcaauauauuucaguauacacaagacuauagugacugacacucaaauaucuauugaaagaaaaaaaaugaagccagaauaucucuaggcaugagauaaagcaaaggcagaaaacugccuaauaauucaugacuugaugucaucaucuuauuuccaaaaggcuuauucugacuuuucagugcaaugcuucucaaggaggaaacacauuugggcuucccacaagcagcugggaaucaaauaauauguccauaguuucacuuacuucuguuauuuucuucaugaaucuagaacuuccuaaucauguuguaauaauuaagacagaauacugacuuuucuuuccacaccugcccccaaugguaaguguggaagcacacugagaaaauauggaggcaaguaauagaucugcaugguagggcugucauggcagaaaaugugauugacuggguugcuuggucaaggccuuugacugcaugcauccugggguugcacagaaccuaaauuuacccauaugcuuuuucuagagcucacuaaacucacaugaugacagaagcaaggcaauacuguauaacaggauuucaacagaagaaucuuaguucuuagaacaugaugguauaugcacgcuaacuacaauauuagauguagggguuaggcugggcaugguggcucaugccuguaaucccagcacuuugggaggccgaggcuggcagaucaccugagaucagguguucgagaccagccuggccaacauggugaaaccccaucucuacuaaaaauacaaaaauuagcugggcgugguggcgggugccuguaaucucagcugcuugggaggcugaggcaggagaaucgcuugaaccugggagguagagguugcaguaagccaagaucgcaccauugcacuccagccugggcaacaagagcgaaacucugucucaaaaaaaaaacaaaaacaaaaaaaacauaugagauguagggguugagcugcagcccucacagcauggcagcucuuauuuaaauucaugcaaaugauuuuaccaggaagccacauuccccuauaguagaguggaacauuuugaaacaucaugucuucuuacagcaagcugguuuuccaugagaaaagcauuacugccuaaaaccaaggccucuuaucaauuuaucuaaaaaaaucacuugccaucauguagaguaccuauagauuuaguguacaauuuuacacauaaugaaaccuagauguuuccaauuagaaaauaauagaucagaguuacagaggagcaaacuacauuucagaauaauaccuauagaauguuugauuaucauuuagcacuuuaauuuguaaaaccuuuucuauacaaaauauguuaaaucucucuuccucauagcauuguuaagcacaguagcacaguaaauauuauucccccuuuaaaguaaacuaggauuuugugaauugaauguuagcuucacaggauuuuuauguguuuuguucacggaugcauccccaguuucuagaaccaguaugcaauagaaauucaauaaauauuuugaaaaaauuaacaaauagaaaagaaauguacuguaacuuaaacucacuaacugaccgcaacaaaucugauaucccaaaguuguuuuguaauacuuuguuuuucauaucaacuucagaauguuuuguuucccuauuaaaucaucuuuaugcacauuggcaggguacugugucuugcugguugugucucucauugguugaguggauccuuucagugucuccucuuuccagugcaauuugcacauuuuuuuauaaucguacagauuuacauuucugaagggaaaaauugauaaagucccagagacuuuagagagaguaaauaauacagucagugauauucuugauagcauauuuuuaaagauacaacauuaugagacauucauauggcuucuugaagcuggucuuccguaguuguagcaagauguggucuggauauuuuaucaagugcuuuaugugucuaaucaucacacauuacuauaaaauguuuucccaccucagcaccagaaucuuugaguaaaagagaaaguugaugucauauagagaauacugcauauuggcacugcucauaagucugugcaaccacuuccccuccagucauguggcuuucagaaaacaauauaauguagcaucagacauuugcuauauuuacucuaugaagaaagguagugcuuccggauuauuuacauuugaaauaaaacauguaaaugaaagauaaauaauuggcaguauuauccccuggaugcauucacuuauuuuuauuuguguguacguguuucuugggaauucaccaagccacaguuguugauuauguggagauauuuuuuauuuguuauauguauaauuauaagguuaauuugcuuugagauaaaacucuauaaaaauuauaaucauguaugucucuaguuacucaauguguucauauuuuaaauagauuccaaaaaucauaugaucauauucuuuaaaauucaagcuuauaauuugucuuuccccacaaaagccucuggugauauaaaauuuauauccacuguugccugagugugccauggaagaaaaaugauuggugccuuuggaugacgguugggcugaauugcucuauuuucuuucccugacugcuuacuaugaggaagaacacccagcauggacuuuucccaccgucauaauccauuuauuacagaguuguggcauuuauuugaauuuugcaaguauaauaucaguucuucauucauuauuuuuucauaagugcaucuuaguauaauaauccccuguucucugcucucauguuuuugucagaaucuauuacaucagugaagaaaucuuuguuucuuucuuagccucaaacccacucagagcucauuuagguuuucuaaaauggaaacaaauguagcuaauuauuccuugaccuguauuaacaacccagcugguugugccuagauuuagccuacugaauauaaaauuauaguaaaauugacuugcacccuucuucuaaguugugagcauguuaaauaauaugaaaaauuguaaaagcugcuuauuuucuuguccuuugggcaugaucagccacuuuucuagagucucaaaccguauguuacuuuuaacuccuuuauuuucuguuugccacagagcagaaaaucagaggggagaaguuaccaucugcauuggcugucaucaccugcaggaauuuugacuugccugcugaugugauugaggcauguugauuuucagcaugcugcaaaagaugccuuuguuucacugaaaauucaguuugagaucuucuaugcacuucacucuuuaaaauaccauuugauucuuucauauaaguuagaaacaauuagaaauuuaucacuugcaaaaaacacuuagaaaaccaagcauaagacucacauuuugaaaccugcuuuugaggagcuuugcagagggcaaccaucaguagguauagaaaaaacagcguguaacucaaauauguccaagcugagaguaacucuauccggugugguugaaggagcauugaggccuauucuacuguuuuggcauguaucugaaauuucuaacacuuaaaauacuuuucgauccaugcacauauuaaaauaaaauugaugcuuuggacagagcacguguguuaaguuaauauuuaaagcuguaacuugaauaaguuugucagauuaacuaguugucauuugaagaaguagcugugcuguaauuaaacaagagguaucuacauuuaaugaaguguuaugaaucugagcugcaguuauuuuuaaacuaaaaaacccagagguuuuacuaaaaauuuuggacuuguaacauuaugccuagaaucuacuaguaacaaauauuauuugaaugaauguggugaauuauugaacuuaggauaacauaguuauuaacauucuacaucaauguuuagcacaugguuauugaauuagugaaugaaucaacagaugcaauaauauaauuuuuccuauuuaggccacuuuuaucacauggcacacuccacaaguuugggaaaauauugaugcaguuauaaucuuuuacugucuaaacuuacuaaaugauuuuuuucuuuuucuacuuuauuaugaggaucaaauaaagcuguuaucuaaggaggacauaaugauuaaucucuuaaaauauuuuucaggugauuuagaucugaguucauauucauuuccuaauuguaacuuucuaaauguuaauuuauuauauuggauucuguuaggaaaguuuauauuuucauaaucacaagugaacaauuacauucuaaccuacaauaagauauuuaauauucuaaauuacaagagaaaauugguagaggugcaaaccaguuuuucuuuagcccauuuccaugaauaaauaaagcacaucaguuugauccucaccaaacuuccauucaaagcaaaaugccuaggucuaggaagauuuagaaugcauauugauagggccacugcauuacacaaauccaguaguaucauucaugacauagacuaugaagcaugcuuaaguggccauauguggaugcuaauuuugucuaagcauaguguaguguuuauaauacauucagcugcaaguaacagaaaacuucgcuaaaguuauuaguaauauagacaugcagugucuuguuuaugaugagaaaugaguguuuucagguuuuauucccugguucacugauuuuaugccuguguuuugugccuugguccuaccuuuauauucacaaguuagcugcuucugcuuccaggaucaagucuucauaugagaaauuguaaaagcgcaaaaguggugauggcuagaacauugcaaaguaacuauuugugugacccucgauuauuuuaucaaagaaggaaaauauuucccagaaugcuuccauugggucugggucagcuuuuauuggccagaacuuggauacaagccuacuacuaaaccaacaacuaaaaaaggaauaguauuaccaugcuaaacucgaacaauuauugauuaucaucuggaaauucuuagguagagaacuaacagugccaccuguacccaguguuuccucaaguugaacaugaaauccucuuucccaaacccauaacccuuaaacacacuuuagggagugauuuuuuuuuuuaaugugauuauauauaaauacaaucagcagauguucuuucuucauuuuagaaaguauaaaauaguguuccagugguguagcuauguguucauugauauuacugcauaacaaaauacugcaaacauaguguuauaaaauagcaaccauuucauauuuguucauggauacucugggucauaaacucaugcagagaacacagugagguuggcuuaugucugcuuaaaaaugucuggggccuaagcugagaagaaucaaagggcaagggaugugacucgaauggcugaggguugaaauuaccuggaggccucuucauucauguguguggcaccucuacagguaggaaucaaagccucagcuaggacuguggauuaggucaucuacgcauggccucuccuuggcgacugacuggauuccaaaaacaaacauccugagaggaguaauggggagagugaacaucaccaaaguggaauuccuagggccuucuugagccuacccuaagaauuccugccucgucauuucaaccacauucuaaugguuacaagauaaucacuaaggccagcccagauuggagaaggguuuuuaaacucugccuuucgaugggggugucaaggccauaacgcagaagcaucuguggcaugggcgauguggucauuuuguaaaauacagucugccacaaguaguaaaaugaggucaaagagaacugggauagaauugauaaugauaguaugauugagguuauuuuaaauuuuuuagcugucacuuuuguagaacuuuaacuuucaauucaagguauauuuugaggacagaaagaacaccaccccucaucauuuugauuuucugugaaacuauauguagaauagagucugauguaauguagaaaaaugauuccugaguacagcuguguuaaucacccgagauuuacaauguauaguuuuacagauuuggacucguauuucuugcaucacaaauucuagugauagguuuccacaauuaauguuuauacaacaaaucuacacugucaaaaaaaugagaaaaugauuacuaaauaugcuuaaucaaugggauuaucuuugggagauuuuaagaaaaauaugucugagccuccagacccaaucauagacauuuuaauaaaguuuguuugcaguacaauaucucuuucacacucucucuguauauuuaaauaaucacacauauucauuaaaauauauaaaaauauucccaugagcaaaggaauggugagaguguuacuuaacaugacauuuuagaaaacaauuugggaaaauuaaagaggcacauagccuuugaaccagcaauucuaccucuaugaguuuauacuuuagcugugccuacauuguuacauuuaacagcuauucauggcagcguuguauuagaggagaaauacugggaaaagaccaaccaaccuccaccuaaaagacgugaauaguaacaguucucuguauuaucucuauaacauagaauaacugcugaugaccacuuagagguaguaggcuccuuccuucuuaguacaaccuggcucugauuaauggaucaacuaggucuucucuuguaaauaauuugugaaugaaucuucagguacuuaaaaagaaaggggaaguaccuaccuguaggcauuacagaaaaauguccagguguauuauaaaggcaagcaagcuguuuuuuaguauauuauguauaggauuacccuauuucuguuaacaacuuuuaaaaaaaaauagauaucgauacagaaaaauacucuggcuuacauaauuucugaaaagacauacaaaacauagaaaacaauucuguugggggaguggcacugggagauuuagaacaaagagugaguauuucuguauuuuuuuuaucauaagcauacauuguuuuuaagacaaaagguaggauauuuuuguuuuuguuguuguuguuuaaaaugcugcaaaggugaauccgauguccauucaggguugagaacaacugucucuuaugugacucaucuuuuuuuuucaguugagaugaagaacaaaagauauacuuacagaaaaaaaaaaaaacuuggagaauuuagacagaguaaagucuaaguccaaauuuuugaacaguguauuuuuugagagaaguuaacgugagacauuuuuuauucuucuaaauuagcauuuguaaaugcuauaaugagauaugcuuuaacauauuauuaucuaagagauaggugugucuuaauuucuaaaggauucuuaaguauauugaauagagccaacuagggcagauuuucauuauaauguaauaucauuauacgaaugauugcaggcuaauuccccacuuacacaaucugaccacugaccaugcuagaucaagagaguuuaauuucuuuuguaaauguucauuccugcucauuuuacuugagagcaaguaaaaugguaguuuaauaagagaauaaauuauuuuuaaaggaagaauaugcaaaagcaaaugcuguggauuuuucucacaauaauuauguacuucccuuuaccaucauccccugacauaucuguguaaaaccgaaaagaaaucauguuuuuugauuucuuuccaauaaccuuuuaaaugaugccugcgauuguuuuggccuuuuguguugacaagugcacauuggacucuugucuucaggaaagaggguguaauaauagauccuuuuccuucugucucaucugacauuuuggcauucaucacuuuuuaagacuguguuggauuuuuuuucaugaaagcauuacuuuauacuugccaacagucaacuuuguuggucauuuuccccauucacaaggauuucuuaagaauaauacaaauaccacucuuaauguagcccccaaacuugauuauuucauuaagccuuacaaaaacuaacgucagauuuauuaguuuuaaaagggaaaacaaauggagcuuagagaaguuauguggcuuucucaacucauauaacuaguaaguggaaaaauggaauuucaaacuaaguccauuugacccaaaaccuguguucuuaaugagaugauguaucuuauuuaaaaauaaaauagcuccagaagauaguuguuaauauugauauuuuacagagguauaagaugaaagauugagaaauaaagugaguugcccaggaugacagaauuaaaaagugauagcucuggaauuugaagacagaccucuugauucccaugacucuuuuuauugugcuucaccuguguuaaugauuuuacacccauucucauuaccaccuguucagucaaugacuuccuaaaucuugauuuuacaguagagaaaaccugauguuuugggagguuacaaacuagaaauaguuaaguggcagcacuagaggcuggaucucacaucuaccaacuccaaaauuacuucucaccugacugcuuuuuaguuaagccuuacccucuuggcauuuuacucagucaacaaaauuagugucaucuauaaauguagaauuuuacuuugcagcccugcuugcaagccagcgauaaauaauguucaauaaaacauguaucagaguugauuccagcaucguaccucaagagacaggaaaaggaauugcuuacuuagaaucacacacaaacucugggaaugaaaguaguuauuaaugggcacuuuacuuagccuuuagcccacccacagccaaaguuuaguucaaguuggcaacuuaauagugaauaaugcuucuuagugagccuaaaauaugaucaggaaauuagauaggcaauaaaagaauaugguaaaauuccugugaguguauuuguuaaaagucugauacguaguugcuauaauaauuuauuuguagaaaaguuagaaauuaucaaauuauacaaaccauagaguuaauauuauacuaaaugauaacugaggaaaauaagcauaauuuuauuuuguauuuugucaucuaaggaauuuugucucaguggagacauuuuugcauuucuacaaaacuuacaguucauuuuaauaaaagauaauuuuauaagagcugacugaguugaauuuacuacuaugaccuaagcaaugaaauuaaccaaaauuagauuucugcuuauuucuaacucccaggaaagcaggccuuaaugacggaacaaauguuuugcccugcggauuaacucugagccuccuaaugagccacuaauguucaugggaaugcuggacagaguuucggauggauacaagaaaugaaaaaaccuaauaacaguaaaauaauuaauuugaaacucugcucuggccauuaaagauuaaacuuuaauagaaaauaaagaaaacuuacaucuucauuuuaugcuaugauaauuuucuagacauuauagaaccuuuguaaaauuauaugcaguugcuuuuaucagauucaaauauguguggcaauaaaccuucauuuaaaggccugacuuuauuaucaaauaccuuguuauaucuugaccauagaauauaaaacaaggcacacaaaacuaggaauuaggagaacauuuuuauucaagaagugaguuccaaagaagcuuuccagggcaaacacaauuuuuuuccccauagaaaguggucaauaaaugucagugagauaauuugauugaaagagguaugugagauaucuucaauauuuauguaaacauaaagaugcccaauaaguaggcuauguuuguaaauguuuuauaguccauuuuuuuaagcuuaaagaaaagaguaccauaugugaaugccaaugacauuuucuugcaccuuucaaagggaauauaugcuugcccuacuuccuaccuaugaaaguuuuuaauuugagagcuaagggauaaaggaaugccuuuguaaauuuguuaucauuuauaugauauacaacuuuuggcacaguugguauaaaaaugugugacagaaauauaagauauauugaauauuucucucuugauaaugccguuucugucuucuuauuuauuuaacaacguugucugugguacauauugggaaaaaaugauuucauaucuuuaaggguuuucaagucacaaaacgucauugaaaaaauaauaauauaauuaggaaauuuaacaggcuucuuuucauaaaaauauuuaaaguaaaauuggauaugaaaaaauacauagaaguuuagaagcaccuggcaaccugacaaauaaauuauuggcaaugaaacuaccagggaacauaacuguuaaagaggaugaugaaauugaagauuaauaagcuuaauaaacuuaaguuuauuuugaccuuaaauauguaagaccccagagacacagaaaauuauaccuaguauguccagaccugaauauuguauuuaguacaauuuaucaugcauguuuuuaaaagaacuaacguaacccauuuuuccagcaaggagauauauagagaaagugaguuauuuuagaauuuuaguuuuauugauguuuguaauuuauuuggguuuguaccagaaaaaacaaggaaauauuguuuaacuggguggauauugguauaccaucugacaaaacagugacaaaauggaaagucauacaggaugacugguccaguguuaaacaaauuugguuuuagauguggguguuugucuccaaggaucuggaauucaagggagggauuuuuauauauauagauuuuagguagaugaauuugagaaucaucaugucauaagugaugauggaagagugaaaguaaauuagaucauccaaggggaaaaaucaguugucuuuugucauuuguguugcugcaguuaaugagauuauaaugguguaaacaaaaaauacugugagaucauaucagcaaaagaugacuauguuugggagagauuauggaagauaccacauagacgacaacauuaagauugagaaguuuggugucuuuuuuuuuuuuuuuuugagaugagauggagccuugcccaggcuggagugcaguggcacaaucucggcuuacugcaaccucccccucccagguucaagcgauucuccugccucagccucccaaguagcugggauuacaggcaccugccaccacgcccagcucauuuuuuuuguauuuuuaauagagaugggguuucacuauguuggccaggccggucucaaacuccugaccucaucauccauccaccuaagccucccagugcugggauuacaggugugagccaccgugcccagccugaaaaguuuggucuuaaaacaagaauuaguucuugucagcuguagaguaaaaacugcaggaagaagauauuccaggaguuggugaccaugaauuuuuuugaggcagaguaaguaccuuacucaucaaaauauuaaaaauaauaaaucaguauuauaaucagagucagucuugggaguaguaugauucccuggaguaugagaaagucuccucuucguccuuuccuuuucucuuauauuucauaguuuuuaucuggauuccuuuauguagagacaaaaguuuuauuuccaguuauaaauuaggcuuaaauagcaaaugucugguuaaguuaacauacugaugcagaugaauauauauuuugaaaucuguucacuccugcuuuggagaaagggguuagaaauugaaagaugugaauacuaagggaauaaaugucccuaaggggggaaauguagaagaaagggaaggcuacaaggcauuaaauuucaucucucauuuugucaugaaaaugcuauaacuguacucaguggaugugggaaaauagaaaauguuugaaaagguccuuuaugaccuacacaaauugcacauacuucaguggaaacucuauucauguggggugauaagaaagggaacuucaaagagguaauuuauaauggacauuaaaggaugguggagguuuuaaaugaaaauacaaugaggacauuucaggcaacucugucauuaaggccucaguauaauaaaaauuugaggggaaagagaaaauagaccaaguuaccuacuaugcaaaggucauauuggaaaauucuaggagaaauggcuggaaagccgaaauaggucagauuauaaaaugucauuaauucuaggauaaugccuuugggcuuaauucugugggccaugaggaauuaugugagaugguacugagcagaaaauuauguaaucacuagaauuucaggacaaucugauaaaaguggguagaaugguaguagauauguuaaauugguuccaaacccaauugacauuuuaaugugauuacuaaagagugauuauucagaaauauuuugcucacaaaaaguuaaucuuuuacaaaggccuuaauugcuauauaccauauuccucucagcugcagaaauauaggcauuuuccuccuauacauuuucaaaaaauuuauauuuacugaucaugggucacuaauauugguuuuuauuuauccauaaaaauaccaaguauauaucaauugguucaguucauuuuuauauagaaugacuagcucucugccucaaauuggcuugaauaacuuuuaguguucauaaaacuggauuuuagaguuucacuuuaccugaauagaagcaaauaucugauaacaccaugcuuacccuugaauuuaauucuagugcuguagcuacuggcauuuaguuuucugcuccguagacuaaaucucuaaaugagccagaauggacaaagugaaacucucugaagacuuccacugggauauagucaugacuuucacuuuggcaucuuuuuugcuccauggaauacuaauucuggaagauuaaucuuggauaucauauucagagacacauaaauuugggaauacuuguguauuauuucugucucuuugagaguccucagggacauuaacauacuaaauggucugaguauuccugcgaugaggaaaugugcucauuuuaauucauuuauaugcacauggaaguagaauuugaagagaugcuuguuaacaucccagggaaguaguuucauggaaaccccuuugggaaaugcugauucuguuuuacagauaagggaacuuaagucuacagacacuaugucuggaauagcaguuaguugguggcagaauaacaauuagaguacaggucuucacauucuauuuuugaacucuuuauccuggcuguguuaccaaaaaucccacauguucuguaguuagacuuuagaccaaguguacuuacauguccauuaaaauucacagaagguaaaauagaaauauuuccugcugauaugacugauauguauugacagauaauuucagaaaugugaaauaacuauuaaaauaucaguuauaaaaacauugauuuuuguuucucaccuugacuuugaugacaaaauuuuacuaauaaugucucagguuacuuauuucuuauuauuuuuauuauguauggaaaguguucucucuccccaaaauuaccugcaacuuuugcaauaaauguacuuaaaugagcagauugaaaaguuagaauuuaguuuuguaaaagaauacuacuucauuauuguucucuugguuugaugauuuuuuaaaauuuccucuaauaaaguugaauauauuucuaauuugugucauuaauaaucacgguagaagauaauuuauucaacuauuaauauauucaaccaguaaucacugagcauuugguaaaugucagacacugugcuaggcucugugaauauauuggcaucaaggaaauccucauacucaaggugucuguaaucaaguugacagauugaagcuauauuuaguacuguaauaaaucagaaagaauauaucaguuuguuggaauagcauaugguugcccaaacuaaacaauguuagccuugccuuuuaaaaauauuuauuuauguacuuaaaauauaccugguuuaccgguaaacacaaaugaaaagaaauugaauuuauccauauuaaugaugucuucaaaacaucuucauuuuuaaaacaaagcaaauguuuuauauagacaaugugugaacauaagccuccacaaagaacuacguuuuguuuauaagcccuuccuuuuccucuacaacaguacaguuaacugaaacagaaugguccgugaaaacuuaauuucgugcuaucggccagaaaagcacaagaggaacugacaacaaagaugugucuccuggucagugucacugcugaauuauaacugagguuuggauauuuuuaaagauaccacuuuaauaauucccaauguuaaacucuuuugggaaaaggaaaugcaaaaauacaaaguauaaaacuaguaaaauuugcugcuuuaaugcugagacagaaacugaucuauaugguaaaucacaaauggcugaugcaaacaagaauuugaagguuauauaagaaaugaguguauaagagaaaagaugcacugcacuauuucuuuguucuucagggagcccugcuucacuuuugguggucgagguugccuucggggaguuugcagucugucauaucagaggauccagaacccugaguucauugccauuuauauguguaaaguaggaaagggacaauauuaaaauucaagaauugauccacuaccacuuaauagaauuccucucugcauuaaauuauuugacuuccuguucuauucaggacugugccauuaauauuuuuugguaggccacauuagauuguaggcucacacagaaucuauggccuaccaaaauauauuauuuauuuccuggacucauuuagacaacuccguguaacauacuagcacaaaaauauuucccaguggcauauggauaauuugaaggauaucuuagaauuguacuuuguaguaaucuguaaagcaugguacaaagggccaagaauuuggauucaguuggaauugagguuaaauccgaaaucuaccuguauguaauuuguugcuuuaaacuauuaauuuucuagagauguguguaaaauuuauuccucauguaaaauuuaucaacauuaacucuauaaauuacuuuugcauauuuuauuaauaucuagguuaucaccauauacauuuucauaaaauaaaugauggcaaugaugaugguaauuguuauuugaucauagcuguguguggcugacagccacaagacugcaguacuuuuuauuaggauugguuguaugauuguacuuguauuuuuggcaaugugcuuauauggauuuguguuuuuaauuucuugauuucuccaauuuccuuuuuggaagucagaaaagcauugaucauuagaaauaaugauaauuauuccaacacuuuccucaucuucaaguuaaaguucauuaucugaguuuauaacauauuugaauuauccugaacucuuuuuuucugauucuccuaucuugggaaauauauugauaacucugcagccuccuuuuuuucagguauaugaaugggauaauaauauauacuucagaggguuacuaugauaauuuaaauuccauaguauauauagaaucauagcuuacuauccaguucuuaggauaugaucaaaaaagccuuucuccuaaacuuuuuuuuaauaauauaccuuauguacucugaaacaucuuuuugccuacugaaauuauucugaaauucacagguugacaucuaaaaucaucuaucauuuaccuccaagcgaauuauggaacuuuucauccccacuucuuucauacacucuauugaaucaaaugagauuuuaugcuaguccacaaccucacuccuuauuuugugucucuuuaucuguguuucucuugguguccccugcugagaacuguuaugucgacagcucuuauucauccucuuuucuaacgcuaaaugauuccugucuauaaagaaccauuucacauuccuauuuccccagcuaauuuuacaaauucuaaugcagugaaauaugaucucuucuuucuugaaguccuauaaaccauuaugucucuuaugguauaggcuuaccugggagguauuguggaucaguuuccagaccacugcgauaaaguggauaucucaauuaagucacauuauuuuuuuuaauuuaccaauaaacaaaaguuguguuuacauuauguugucaucuauuaaguaugcaauagcauuaugucuaaaaaaaaguauaucacuuauuauaaaacacuuucuuauuaaaaaugcuaauuaucauuugagccuucaacaaguccuuuguucuguuugugaagggcuuacugacuggucagaguggugguugcagaaggauaggguggcuuggacaauuuauuaaaauaugacaacaaugaaguuggcuacauugauugacucuuucugacaugaaagauuuccuuauuccauccaauacuuuuugauagcgucauacccacaauagaacuuucaaaauuggagucagcccucucaaauccuguuguuguuuuaucaaauaaguuuuuguaauagucuaaauccucuguugucauuucaacaauauucacagcaguuaccccagggguagauaccaucucaagaaacgacuuucuuugcucaucuguaaagagcagcuccucauuuuucaagcuuuaucacgagauugcaucaauucaggcacaucuucaggcuccacuucuaguuauaguugucuuacuauuuccaccgcaucuccagucacuugauauuuugaccucuucucaugaauuacgaauauucucaaugauaucuggaauggagaauccuuuccaggcgguuuaacuuaguuugcccauauccgucagagaaaucacuaucuguggaaacaauagcuuuauaaaauguauuucuuaaguaauaaggcuugaaaguugaaauuacuccuugaucaugagcugcagaauggauguuauggguguuguguuacuaggcaucaaagcaacauuaaucuucuuguacauucuccauaagagcucuugagcaacuaggugcauuuucuguuaguaagcaguaguauuuugaaaagaaccuuuuuuuuuuuuuuuuccugagcaguaggucuuaacuaugacuuaaaauauucugugcaucaagcuguaaaaaaugugcugccauccaggauuuguuguccaauuuauaaaucacuggcagaguagauuuagcauaauucuuaaggucccuagcauuuuggguaugguaaaugagcauuggcuucaacuuaaagucaucaguuacacuaguccccaacaagagagucagccuguccuuugagucuuugaaaccagguauugacuucucuucucuagccgugaaaguccuagguggcaccuucuuccaauaaaaggcaguuuuaucugcacugaaaaucugauguuaauguagacaucuucaucaauuauuuuagcuaaaucuucuggauaacuugcugcagcuucuauaucagcauuugcugccucaucuugcacuuuuauguuauagagacagcuucuuuucuuaaaccuaaugaaccaagcuguuccagcuucaaacuuuucuucuguagcuuccucaccuuucucagccuucauagaacugaagauaguuagagccauacucuggauuaagcuuugguuuaauagccuguuguggcugguuuggucuucuauccagaccacuaaaauuuuccucauaucagcaaaaaggcuguuuaacuuucuuaucauucauauguucacuggauuagcaauuuuaauuuccuuuaaaaacuuuagcuuuacauucaccauuuggcuaacuguuugggacaagaaaccuaacuuuuaaccugucuugucuuuugacacgccuuccucacuaaccuuaaucauuucuagcuucugauuuaaauugagagaugugaugcucuuccuuucacuugaacauuuagagaucgcuguaggguuuuuaauuggucugauugcaaaauuguuguaucuuggggaauagaaaggcccaaggagagagaaagagauggggaaugacugguaguuggggaagucagagcacagacaacauuuauuaacuuagccgucuuguaugggcauaguuuguaaugccucccuaaaaauuauaaugguaacaucaaagauaacugauuauggaccaccauaaaacauauaauaauaaugaaaaauuugaaauauugcaagauuuaccaaaauauggcacagagacaugaagugagcacaugcuguuggaaaaaugacaccaacagacuugcuugacacaggauuggcacaaagcuuaaccuuguaaaaagcagaauaucuaugaagugcaauaaaaugagguaugccuguacuucuaucaugucuaucaugguaauuauuguguaaauauuuugcuuauucugucuucuagauuguaaguuuauuaaaagaagcuauuuuuuauauuuuuaaauuuucuagucuacuugcauggccagaacucaaaaagaaauuguuggaggaauugaaaggggaguugacucagacgcuaucucagaauaacaaccuuuaauucauuuugaaguauuguuauuuccucacaaaauugauagcuauaucucaguuucacuuuguucugucuguguaaauacaaaacucgaguuuaauuaguuguaauaguuaugauuugccuguuacaguugccugcccauuaauaguugauugggaugaccaauucauuucacaagggccaccgagcaucuguuagauaaugaugacuuucagccauugguaaagaugaaaggcaacuguuucucauuauauguaagagaauuugguguuuggcuaaaucaaaaguauacuuugccaaaaaugguuuccucuaauuauuggagcagugugcauuucaaaaaaaauuaauccauucauuuuccuaaaugccaguuuaaaaucuauuagcuguccuuaaaaucuuauauuuauuuuauagccuauuuuuuguacuaaguccaugaaaaauaaaggaggccauuaaauaauuguacacuguugacuugaaauccugaagacacacauaugauaaauuaaugauuuagagaaaacaaaaagaaaaaugugauaguuucuuucaaagguucauaauuagagaguccaaguagagagacagaaaagaugcaaguguauauaucguaugguauccauguaguccuuuugcaucagaagcgagucaggaauuaaggaccuaaggagacaagcacagccagaaacaauagaccucuguguuuaguauugacuacaaagacaauugugaaauauugguaacagaauaaaagcuaaggaaaguguggcuguauuccuaacauggcuuuuacaaggcaguuugugcuuaacuaacuugcuuggcugcuugaaaauaaugcacugugaaagauaagaaaaguggauauaguagguuuugauuuucauaaaagauuuugacagcuucacgugagagauuaauggcuaagguagagaacuauagagaaagcaguaaggaguucuuuacauaggaaaucgguucaagaaugaaacaguauuugaggaugaaaauauuucaaguaaaauagaauuuuagggagcaguacacuuuagacuuuuaauuucaaaaagcacucaauuugcauucuuuuuucuuuccuucuucucuaauuuauaauucccaugcauuuauuauauuuaauaauguuacuuauguguuaugcuugcuacaaauuauacuaaaagugauuaccaguguguuuauccacaaaaugcagguaaauguaagaacaaugaaugacaaauauguaucuugcuaagaaaugaaggaguuacugccacacaguaggaacucugaacuacauaaacaggaaugauauuucaccaagaccauguuuggaucaugaaauaaaaauguaaaaaacccaucuuugaauucauaagaauaauaauuacaauauuauguuguuugagucaaauuaaaaccaaaugaguaagguuuccucaguuuaauaaaauauuuguuaacuuauguagauuuucuuuauacggccucuuuacccauucuuuaucuauuuuaccuggccucuugaguuuuucuuacauguuccagaaacauaggaaagaaaacgaaacuauaugagcagcuuccauuuguuuuucuaagacagaaagcaguuuguucuccuuucagugugucaaggcuagaauuuaguaucacuaaguuauuuuuaaaguaaaaugaacaagaagauaaaaggagacucucuagacagugggcaguuccauuuguuccaaauuauauauucaauuuuugaaccauagaggaaauccagagauugcugugugugcuucaauuuaggauaauuugaaacaaaaguucuaaaguacaauagaguaaggcugguguuaaugcugccucuccuacuaaaccugcccugaccuauucuuacccuauucuuuguuccaguagaauaugucaucuuuucuuuuaugcagcagucacacaguauuuuauuuggaguucuuauaguauucaaaaaacuauuuuuuaaguaccaacuacgugacagguacugaacuucuuacuacacuucacaaugaaaaauaagccagagucuuguacaguuuagcaggacaauaauugauuaaaugagugacugaacagugcagggcaauaaagaaugaugccuaauaugcuagggcagugcaaaccuuagggaggguccauuacaccugucugaggccauugaauggaaaugucagggauagcuuuccaaagacaugacaucuaagguuaggugcuuagaucuuaucacaugagacauuucaguccaucucacaaaauagcccuuucaagugcguauucauauccccauuuuaaagaagcaaaugugaagguugagaaaaauuuagucccuaaauuccucaggcuagaagucacaggaagaguuaugauucaauccuguguuagucugaacccaaaguacaauauccuugaagaagccauaucaguauuucccccagauuccaguucaccuguguuuagagugauaguguauuuuuuuuccucuucagguuaacuuuuuagagugacucaaggaaguaauaacuaauaucacaaaauucugaccuugagagaugauagucauggggcucgaaaaauaugcagcaaucuaguaaagacaacuccagccagaaagucaugguugaaauuuacgguuuuccuaaaucgcaguggauuuuacaucccuuagagguacucgcauuucugagccagcaaggcagugagauaugacagguccagcuguccacuagaugcugcugcuggauggauccucuagcaagagaggcaucgauauguggggagauucuggcacuuucuguaagaaagagcucagaugaaauuaauuuaaauuauauauugguuucauauucaaagugugucacuuuuuuuacuauacauguaauaauaaauacucauuuucaugucuuguccauuuucguaccaaauaucuccugucucucucucucucucucucucacacacacacacacgccccuuuugaagcacacauaucccuugaagaagcaaauauuuaacaauaacaaagaguugaucauaaagauauauuuuuauauuucucaaaaugaaaagaaacccuagacuacaaacacauauuuaaaaauaaauauuuauaauauauggauaucagcuuaaguuuuucuaaaguacauaaauauugacuaaauacaaacgauauucaagcccauagaauuuaguagaauagggcacaauuuuuauuuucaagagagaacauaaauauuuuaauucgcugauccauggaaauuauaauaaagugugcuacauuccaguuguuguuuuaacagaauuuaagcaacuuuaaaucuacacaagauagaacaaagugaaaagauuuuuuaagcaacuguauuuuaaaaguccguguucuucagaaagauugucuuuggggcacuauauucaauguguaaacuuauauuauaauaauucucacauauauucaguugucuccuuucccaaccucuaggaagauagaaagggaagauuagaaguggagaaauacuacucaaauauguugguagcuuaccauuagaaaaauauaccaaauacagcaucuuagacauaaauacacuuagguacaugaugacuuuccaaggacugugcaggaacagauaguucuaagaaauuuauugaucauuaauuuccauauuuuuuuuuuuuuaagugaccaaccugcuggagaaugucuguauuuugacugguucugguuccuacuuccugcuuuuacugucaccuuucacaaaaccuguugaacauguagaaucauaccaugggccacggcccaaaguuuaaaacuugcagaaaguaaacaaagaggcuauuuaaaauguugauguuaaaacaauaucuagagguugcuaaauucuuuugcaauagaggugguuuacaacuugcuuucuauacaucuacaggguguauaguaucaucaucaacugauaaagcauuaggaaugauuuugggugagauuccuguaauuguuuguuguaucccucucaucaaguugaagaauuaguaguauugcuuaaauaggacaccuuccauucccauagacuuauuuaugaaaacagauuuucucacgguuucuguccauaaaauccauuccaacaaaaucuaggaagaauucauucuggacuuuauuuccuguaaguaaaaaguuuugccauuugaguaagaaaguuuuuccauguaucuagauaaaaccaauucauuaacaccucuauuauuaacuauauuaaguuauauauaugauuuauauauauaauauauauuaacuauauaaaguuauccauauauauauacauauacguguguguguguguguguguguguguguguguguguguguguaugagacaggaucuggcucuguugcccaggcuggaguccaguggugugaucucagcucacugcaaccuccaccucccagacucaagacucaagccauccuuccaucucaaccuccuaaguagcuaggacuacaggagcacaccaccaugucuagcuaaguuauguaauuuuuguuguagagaugggguuuuguuauguugcccaggcuucucuugaacuccugagcucaagcucagccuuccaaagugcuggacaaauauuuauuaaaaugugggauacauauauaaauauaaaaguuguucaaucauauacuauuaauaauuauaaaaguuauuuuauuuuugaauauuuuuucacuuagauuuguauguucacaagacauauuuuaaugcuaauuuauauacagcauuuuacaguagaaaagauaggauaucaauaaaaggcuuuaaagaaaaauuaggaucaaauuaugagggauaaguagaauaauaucaguuuaaggagaaaaagcaacguagcguuuauuuuaaaguagaguuuguucaucuuguuuuaaauggcuguuaaugaacaucacaucacucuuaauucgauuucuuuggacauauuuaaaauugagaacuuacgguuuuauuuuaaaauagcaauauugauaguaguaagaaauuauagguuggcaaagaccuuggauuaugaugaaaauuuuagguggcaauuuuugagaguucaaagguguacauaauuuacaaaauuguuauaugaaccauacaagcaagaagaaaaaaaacugagguugagaccacccugggcaacauaauagacccugucucuacaaaauauaaaaauaaaaauauuuagccaggcaugguggcaugcaccuguagccccagauauucgggaauguaggacauguggagagaggcuaaggcggguggaucgcuugaacccaggaggucaagucugcauugagcuaugauugcaucacugcacuccagccucagugacagagugagacccugucacucccacacaaaaaaaaagaaacgaauagaauugguaacccuuuacuuacauuaaugggcuugggaagaucagugugcuuaugcagucucuauauagaaauucacaaucauaaccuagaguuaugaagagcauuaaccuauaaaacauuguaauaauuauaaaauguuuacauuuauaauucacuuuauaacuuuauaaaccuaucucccaugcacagccucuuugaucuuauaccaaaauagaagcuacuuaacacaggugauauuaucucaauuuugcaacuauuaaauucuuuauagaaguugaauuacuugcccaaaacaguugcuaguaaacuaggaauaugguuucugaauguaaguuuucagucccaguacaacuuuuauaacuuuuuaaaauauaacaccaaggcugucuuuuucuacauguucugcuuauaagauggggaaguauaaaaaaagaaacuuuuguggcaguucaaaggggaguaaaugaaugaaguacuuuuacauaugacaauuagcuaccuauaaaauuaguucugugaaccagcucugugcucugacaguauagaaaaauaaaguuuugcuacaucaagccagacucugaauucuuuauuuuuuuccuucuucuaauuauauuuuauacauaggguuuuuuguuauuguuauuacuggcaguaguauuguuuucaaacagaaaguuaaccacagggauguaggguaauaauaguuaaccugaauugcauacuuaucaugcaccuccuucuguccuaaacaaguuaaacaaacuaauuaauuuaauccucauaacaauuuugucaaguaaguacuuuuacuaaccccaucuuacaggugagaaaacuaagguaaauuaacuuggcccagguuccaggccuaguacacaagaaagaugacauuugaacucaauauuaacuauaauuacacuacacaguuuguuaaggaaaaguuauaauaaaaaauaagaucuagcaaagacucaaauuugagacuauuuuuaacuuaacaucuuucaaaaauauaaaguuuaauuuuuuuacaggaagcuguuuaaaaaaacauuaauuuuuuucuucuuggguauacuccuuaauuuauauuuuaaggcauaguucauacugaauuaugguuuaguccauuuucucgagaagacagacaaauauggguuaauggcuacuauaguaacugauugcaaggcuagcuuuaauuaguugacuguguaaccauuuuuuauucauaaaacaaaauuuguguucagaauauuuuuuauuaggaaaaauugcaauaagaaaaauccagcagugccuggcaggaugcuuaaagaucaacauaagcagauggguugggaagguggggaacagaauucauuuugcuuuuuaaaugucuguauuuggugauacuguaaaguagcauaaguuuauuauuuuuacaaaacaugaauuuagaaccuuuccguauauccauccguguuauguuucuuauuuuauaaucucuauuuauuaauauaugcaaauagaauacuuuuaaugacuucaacacaaagauggcugauggaagggagacgagcugcaauugcugauacuguucuuacuagagaaguccauguccuuuauucccucaauuuagggauaagguguauguaccuggcuccaucccaaagaggauggaauagaaaggcuugucuggagccuagagcuuuaucucagucauuucucuggaucugauugcauucccugucuuugauacugcuauuuuaaacaccuccugcaugcauuuugaauguaguuuucauuaucuuuguaucuccugaggugaaaguccaacuucuccaggaagcagcugccagggagacaguauugcagacagaacuuuccccacagcgguucagagcaccugccaguuaucaaaaaucuugaagcccuuccagaucccaauaucucacauucaaucaaguccaugugggagaaagcaagcugauuuaguugaauucaaaaauuaaaaaguagagaugacaaagaaauuuucugcuuaauucauguuuaaagccauuggaacaaagcuagccuuaaaccacucaaauuuguaacaccuuuuuuucuuuuuuaggacuuuuacauucuuugcuucauuuaucaauuuuguauucaugcauucaguaaucuuagagcagagaugauaagaccuaucuacuucucagaauguuuuugugaguguuaaaugagaucauacauuuaaaaaauauuuccaugccucuuaacccauaguaaucauucugcaaaugaaauuuauuaucgggauaagaggauaguaauuaguaacagaccaaaaaugaagauauuuugauauucagacuuuguuaguuucuuuaaucauaauguacaagaucucucuuacucuauccaugcuuauuuuacuucauaaaugcuaauuuauauguuaaauuauuuacaaauaauguauugaagcacccuuuacauguaaaaauuguuuggcauggccccuccuaacacagacauauauucuugcuuggaagcuucuuauuaauggaaagaauaagauaaagcaauuugugguauugcagaaaaacaguuuaauuaugaguuaaaaugagugauuuuaauguuugaaaaugugacuuaaucauaaccaaauuugaaugauuucccaggcauuuaaaauguuauauauacauauauauguauauauauaaauggcucuaaguucauauuuuauacacacauguguaaauauguguaugauacauguguauauauguguaugauacauguguauguauguguguguaugugugaguauauacauaaaacaaacuuaacuauacauauauguauaguuuguuuauaaauauacauauauguauaguuaaguuuguuuuauauauauauacacacacauacacauauguauaguuuauaaauauacauauauauguauguguguauauauauacacauauauauacacacacauauauauacacauauauauguauguguguauauauauacacauauauauauacacacacauauauauacacauauauacuuauauauauauauaaaacaaacuuagggccaggcauggugacucauauuugggaggcugaggcaggaggauugcuugaguccaggaguucgaggcugcagugagcuacgaucguuccacuguacucaagccugggugacagagcaagaauuugucucuuaaaaaauauagauuuaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaaaaaaaaauauauauauauauauauauauauauauagauuuaaagaauuuuaaguugugcauuaaaguaaaacuaaacuauaugaauuaauaccaucacuugauuacauuaaacuucacagauuucagagaggcguuaaguauaguucugcaugaaaaaaguaagaaaaauucacaaagcuuaauuuucaguuuuuuuucccaucuaauuuacaauguaaaaauguuuuaagauguucgaggauuuggucuuauaaucaauaguggcugauaguuuucaaucuuguauccaaaauauuuuaaaaauaagcauauuaucccaaauugcuagagugaaauacauagaaaauagaauucuuuuuccaacaaaauaagaaaccaaugcuacuuguuuuuuuuuucuuuuuugcuauuacacaagaaguaaaauauacccaacuuggcauaacucccauuuugaaaauaaauguacauguuuuauugauauuacuuugguucuaaggccugaagauuuaguguaauuauuucauaauaaaguuuuucucauauaauacaaauguuaauaagcaagucaucuguuaguuacuuaacuaacagaugcaucucagugucuucauuguaaaauggguauaaugauaauaauaauaguuuuugauauaaccuaacucaaagucuuguuuugaggauugaaugaaaaauauacauaacaugcuuaaaauguaucuggugcauaguaauguuaacauauuacuauuguauacugaacgguauugaacuguuaccugcugaagugcaguucucacuuagauaucaccagaacauauuuuaaaauacaauucuuaucaucucuaaggaugaggacuucauuaaauaauugaaguucacuggacaaauuguuaccauggauuucccaccacccuucacugucuuccaccucugccacaccugcaaaaauagaaagauaauaagaaccauuucugugucugaguaguuguaaaagagaauuuuaaauauugucaaucauaagauuauauaaagugauauuauuaucuaggaaauauuuauauaaccauacaauuuauguauacauacauacauauuaucuaggaaucaacucucaugaaagauaucaagaagagagugcccuaaaaaacaaagguaggggagaaagaugguaaaauuucuguucucuuccauauaaucucugcuucacuugccuuaccucauuuggucuugaaauugggauaucaaaacucucuuugugugcaaaaucagcauggagauuuuaugggguucugaacucuguuaauaugcuuuugaaaguucuccuucugucaaauuuaggacuuuaugaugcaaugaagagacagcaguaaagguagcugguaagucucuucauaggaauauuauuuucacucaguuuagcuuugaguccaagagaaaaauguacuuuuuauuuuuuauuaauuggugccuuuaauaggagcuuucauuaaucaaaaugucuugagaaagcuguucuuucuccauacagcugaauaaauucugcuguguggaauacugguaauggugcuaaugcuuauguuuuuggacugugcaacaaagaauuugagauauaaguagacaaaaucauuccucagcagccacaggcuuuuugacuuaacugagcuuuaaaaaauaacaaauacccuaaauaugcuauuuuucgcuacacucucugauguccaccuuuccaauuuaaucaccacaggaguuaguaucacaggcauauucuguuagaauuuuccuaacaguuugaucaaauagcaucucacccaaugggacuucauacccccaaaacagagaccugccuaaugcguaguaacauccuuuaagggggccccuaaaaagaauuuaggcagcagugccauucuuauuagaaaagaauuaaauauuguuagccuggguuuauauaauuaaaaccaugaagcaaaaagaaauguucaagcuauuuccuauguauuuuccaauagccagauguuuggaacuaugugcacaaaauauccagaugacugacugaaaauuuaaguauuuaucaugauauuugguauagugucaacagagcauaugcugaagaguguauuuuuggaacuguuuuauucaucuccuugcaaaauagguagucuagcagauuuuuaaagugaaagauaaaaaccacuaucaaggaaagcuaugccauacucgauuaaaggauauauuuauuauugaacauuuuuauucagauuauuucauugucuauauuucaaagggaccuuaagaucacuugcugcuaaaauguuccauuuugaaguccaaagaaaaaagaucugaauuugugaccagagaacuguuacuucaugcugucccauuaaugaucugaccacccucacuucacugaacucccccuuacacccuaauuccuccauucuaaacagguagucccccugacuugcugcugccugacucuaaaaauacuagcauagucugucacugugguuaagaaugcaagccaacuggcuuuguucaaucacaaccugccaguaccuuugcuucuucaucuaaaaaauuaagauaauaguaguaucuggcucauaggguuaugugaggcuuaaaugguauaauaaauguaaaaugccuagcaaaccuccuagcacauacuaagcagaaugucuaaugguuuaaaaggguuucggaaguguagagucaaauguuguaguucuuucuuauuucaaguagcuauguguaugaaugauuuucuugaucugccaccggcacucugcccaccccugccccugacuugccuuuuuuucugaucacugaauucuuagcuuaguucuucacuuacugauuuagauugcuuagcacauccucuguaucauucaccaguuauugucuguacuacauauaucugcauuuaauuacauguaauuauaguuuacaugggugugacuuugcuuuuccaacuaugccucacuuugggaauuuugauacacuuuaucauauuauuccuuucuccaaaauuuuccuaauuuuuaccuucauuuauccacucaacacacgcuuacauuuauuguucauuauuuuuaggcccuuggaauauauagaagcaaccaaauagacaaaauuccuggaucuugcuucuaguggaaagagacagacaauaaucaaucaaguaaauagauaacauguauaaagggagugugggaacagucgcgcuauuuuugcuguuuaauacauuaggucauuuaaugaaaaccuaaggaagauagggaacaaguuauguagaacuuuaggggaaaaaaguugcagggaagaaauagcaaauacaaacuaacugaggcaagagaaugccugacuuguuggaagcacagcuaaaggaccccagccuagagcagaguaaaguggaaaauaggagugggagguaaagucagaaaagcaucaggggaccagacucuauaaggcuguguugacuacuaucaaaauuauaaauuuucuuaugaauuaaauagaaggccuggaguuguugaugaucugauuugaacucuaaaauguucauucugcuuauugugggaagaauggaccuggcuacaagggucaagggcagaagccagagacucucagagaaucucaauaauccaauuauaaugacaauuuaauuacuacauuuuucacucccuguucugcaugauggcuguucaugcgcaugcuuuaucauccuugcuaaauuauaaauucuguuugggccaggauuccaacaaauuuauauuuguagacacuagacguuuuaaaccaagaaaaaaaaauguugguacccaaagaguacaaaaauaaauugcuaucaugcuccucuacuuggcucucacccuccaccccauuguacccuacauagcuucccuccuuacaaaauuucuuaauacagcauacacaugucaagcaauaucucuuuguauugcaaaggaaaaaauagaauguagauggagaaugaaaaggagguacagaggaagaagacauaguucuuauucucaaggaaucuuuauaaugaccaaaaaaaaaaaaaaaaaaaacaccuacacaugcauacagcuguguguguguguauguguguauguuuggccuauucacauagucuauguagucaucucauacuagaccuuuaaacuacauguauucucuauaugauuucauaacauagccaagucuacguagacuugcuauucaaaauuuguaaaauuccauguaugguaauuuggguuauuuauguucuaacauaauaauguagaacauuugagaauaauucuacaaaauucagcaaaauuuccaaaaggaaaauauuuuuuuuucugauugucauucaagaguauuacuaauguguaucuuaaaaaacuuugaguugggaacacuggcuauuacaaaauagaguuauugaagccaaggagacauaaaugaucccuuuuuucauuuuuuucaucaugaagaaauugaauuccauucuucuguggcagcccaugucaugccagaauugaggaacagugcuuaugcuaagacuacugguuaaucucugcagucuucccuaauaccccccaaauaaagguaaagcugcuacugccucuggggaaauggaaaugcccaauagagcauucuaaaucagacuuucaugguaaaacauccacuaauaauuaauuuucugcuuccuuuauacuaggacagguuaagcaguuggucacauucaguaaauaagaaauuacuugcaguaauuucugcaacauucuaaucauuuucccauuucugaaaccuauuuuaaaagucuuugaucugcauuacaguggaaaggauguugaauguggaaagagaagacuugauuaugaauucaacauuggcacccacuaauaucguggcuuaggccagucauuuaaccuaaacaucuccauuuauuuucuagugaucaagagcuuugcaaucuauacccugaaagaguuguuaugaacacgcaauagaaaaacauacgaaggccauagaugcaguggucacacagaaacacuugaugaaugcagauacuaaaugacacacuagaauuaucacaguccuagcaguugauauuucagaguucuguccuguaccagcacaaaugugaucugugaaaugggaaauauguacccucuaucuucuuucugcauauuguuaagaaugacaauaugcuggaauuauuuaauuacaucauuaaagggguuuuauuuucuuuauuaaauacauaaggacaagcuuuucaauuaacagugaccuuuaugacuuccguuuugguuucuguagauggcaaagcugacugcaaauuagauucugcaauguaccuuguuccuuacuuuuucacccacugauuaguuucauacaguugacagcagcccacccuguugcuuucagcuuacaauuuuguagcaaucucaaacacuguguucaaucccccaagguguucuguggaaaugcugucaaacuauuuuuauguauguguguuuucguucuguagcugugcuuuguacucauuuaagaaaaccagucuuuaauuuguaacagaacauuuucaagaugaaacagaauuccaggccucagcaaaaucacugguauaugaccacagccuucuucuguucuaaagcuugaugugccugacuacuauuaaacacaaugcuguauuuuugaaaccuguuacagaauaugacuaaauaaauggcugcaaauuugaccuuaaaauccaguaauugucauuacgcuugucaucaucauguggauccaguuuuauuucuccaauuccaucucucaugccuuuuaccauauaucucaugguuauuuguaguucccugaaauuccuauuucucucauguuuaccugguguugcccacauauagcaucucugucuagaaugccauaucuuacaauacuuaucucuuuaucucagacauugccuauuucagaaggccuuuaugccuucaacgcccugagucaaguaacucucuuugaucucucaugcauccugugugugauuucauaaaaauauucuccuuucuguaugguaauaauugguuugcucuugugucuuccucgcuagacuaaaacuuguagacagcaacagacaauaccuguuuaaauccauagauaucuuauaaauguuugcuagcuaaaugaaugcuuuauaaaaaaguauugaucaauaaauugcaaaaacaagcaacauuauuaauaaaaguguuauacuagcuuuuuuauaucuaaugacuacagcaaucaguaaacauaguuuauaguuuuaucagugaaacauaguuuacaguuucaguguacaagcuuaccacugugcaaaugcaagcuauuuuaaaaguaaacccuuauaggccgggcaugguggcucaagccuguaaucccagcacuuugggaggugaaggcaggaggaucgccugaggucaggaguucaagaccagucuggccaacacagugaaacccccucuccaauauaaauacaaaaauuagcugggcacaguggcaggcgcuuguaaucccagcuacuagggaggcugagacaggagaauugcuugaacccaacagguggaaguugcagugagccaagauuuuuccaccgcauuccagccugggcgacagaguaagacccugccucaaauaaagaaagaaacaaauaaauaaauaaauaaacccacccuuauaugagucuaugauuucugcaucugguacauuauauucaguaucagauugggucaggucagucuaaaucaugaccuuuacugcuucucauaauuucaaacaaugaaauaggcuuuaaugcagaaaauuguguaaacuaauuuagcuuuauuuagaugugucauccagacagaaugaaaaaggcuuuugacuaacuuucaguugaaacacacacacacgaacaugcacacacacacacacacacacacuacacacuuaaaaaaacuguacacaaguauuguuucacauuugcauugggaauggaagaugcaucaguauguucauguuuccugaguuaaugucugauguuugcauuugaugcugugcuauuauucagcaaaagaaaaaaacacucagaacaaaauaauguugucucucauuuuuauuuugauuaauaguguuguaucucuuguaauuuguagguguuauuuggaagauggagcuucaaagggugccuggcugaaccggucaaguauuauuuuugcgggaggugauaaguggucaguggauccucgaguuucaauuucaacauugaauaaaagggacuacagccuccagauacagaauguagaugugacagaugauggcccauacacguguucuguucagacucaacauacacccagaacaaugcaggugcaucuaacugugcaagguauguauuuucagaacugcuauauugugaaagacugugcuuagaaauauuuaauauuuagguaucaaaaugacuaggaagcaguuaacaauguugaaauauuuguugucauugaaauauuuguugaauuauauugucauaguuuucaggaauuuacauuccuagacaucagaaagucauuaagagucauacagacagaaugaaaaagucuuuugacuggcuuucaguugaaacacacacgcgcacacacauacacacauuuaaaaaaagguaugcaaguauuguagucauuaagaaguguaaugacuauuacaggcauacaaaucccuacuuacaaagauaaagaaauauccauuaacaccauauuaugacauuuguaacugauucaccucauaucuuccuuugauucaucccuucaauaaaucuuugggagcccaugauugacacauuaaauguuugaaaccuacaauagauacaugaaaauauuagaacuuuuugaaauaugcacaguaacucuuuaaaugcaauccuccaagcauucaaauacucugucucaauccaaccucuguuuacuuugauucaagucacaaugaaaaguagcagccuucuaggauuucuuuauuuaaauauagaguaauugagaaaauauguacacaaugguuuauauuugauuuacuuucaguagaucaugaauuaugcuagcuaacuuucaaucuccagauacaaacagaaucaucaaauuauuuuauuucucuuccauauuaaaauguaagagcauaaguccccuaaaauacaaaugguuuucaagaaaaauuuaauuauuaugcuaggagaauggaaaacguuuauuuuuuaccuuuuacauuauuucuuucugcuuuauaaauuaaucguguguugguuguuuagaaauauuaugcucuguggaacuaaaacugaaguugccuuauuucuaaguaaaauuaauaacaaauuaugugauaauguggugccagagcaugcauguuuuauuccuaauaggaaaguugagugagaaagucagcuguacucucuuugaguuuacccuucaauaagucaaggcuuaaaauuaacuuaggugcauagcuuaagucugaaaaagauuguuaaucuauagacuuauuaacugagcuuuauuuccuuauguaaagguaaacuugaauucaaacacaccuucaauuguuaguacaguaaauauuuuaacuuugugaugagguuaaacuucuuaaacaauuaacuuuaaggaggaaaguauaaauugaaaaauaagucaaugaauuuccucagugauuuuucuuuuuuuuacagauuauuguaggcugugaugauguucauuauuuaaaagugguauaucagaauauaauaacauuuucacaaaaguucaucuuuaaucagagauuauucagggacuccagagggugggaguuaauccaccuucagaaaccgacaugagauuguaagacaaaacacauuucuuauguuauucaagcuuaaucuuguucucuuguucaguucucugcccuuugacuugaguuucuagcucaaagacucuaaaagauuuucauuaugugaaaaaagaaaguauacuugaacaauaauauguucgaguuacuuaagacacagacauuuggcuuguacauuuuaaacuuguagguuuaaaugauauauuucugaagaauaaauauauuccauuuuccuuuuuccauucucucuuguuccauauuaggucuauauuuuaaauacccagacuaucgguauuuaagaccagccuagguacauguuuaauucucauaggauuuuuaaaauaacuuuauauuacauagguuguuuaauauuguucacguuuuuaaaacugcuacaugucuuacuauaguacucuuuuuugcuggucauuagacgauggugaacuuuugagcaguuacgaauguacuuauugaauguuccuucaguuuaauauuuuauuccucuagaaaaagaaaaauccauguuacuguuuugaaaguauaagauuggauaaaauuaaaagcuaauaauuuuacaguauuuaugaacauaauuacuuauuagaaguugauugacauguaggcgguuuucaaauuacauuaauaaaguucagggaauacauuaauaggcuugucagucaauucaaguacuaaauaaaugucauaaaaagucaaccccacuuaagcuacauuucuucucaaugaacaaaaguaaacugauguguacaccucuucagucccuaaauuugugagauugucugaugcucagggguaucagcauaguuuugaagcauaugcucuuugccuaacaaucugacaauccuuuauucaccaagauaaagaagcuuagcaacugagggaagacuguauuaaucacugaugucaaacauacauuggcugguaaaaacaaagcucaucuucaauuguugcauguacuccagggaacuauuuuuuuuaaaucauuuugaaaagggauaaaaaggggauauauuaucaacacagacacuauguuugagaaauuuauuagugcuauugauuucuuagagcuauuaauauaaauaaauggagcaguggaggagggaaaacacuaaaguaggaauaggaaaacccgcauucuaaucuggaauuguccugcauaaacuaggcaauuauuaagucucucugaacucuggcuuucucauuucaaaagagacauaagacaagaaggucuuuaagguccacaccagucaaaaaaagacaaaugacaacaacaaaaaaaaacaaaacaaauaaaaaaauaacaaaaaucccacgucaauuauuugcuuugauuuaaugggaacaaauauuuaaguuaaaaaagaaaaauauuuuauaacuuuuauugaacaccaugcaaacuaauguuuacauauagcuccuguuacuacuuacuccacaaguacauuucauuucucuuuauauuuuuucuuuauccaauggagcugagcaaccuauguauuuaugaaauuuggagaaugugauaauuuggagccuggcuuuaaaaggguugaaacugacuaauagacuuaauaauaaaauaauuuuuuucauuaccuauauauaacaugguuuugauaaaucaaaugaccuauuauucacuguuuugaacuaugugauauauuuacuaagaacuaauuucuuuguuuauaaguauaaaagugugugaggcuggaggacuuguuaugaagcaagagcuccuuauuacaauacuguaauguugagaaacaugaaauauagacacugcccauuugaauauaugucaggaauugugcuaugguuagaaugugucccccaaaguucauguguuggaaaauuaaucuugaaaggaacaauguuugaggugcagucaaauaaaagcugguuauucauucaugagagcucucaugaaugggcuaauguugcugucaugggauuggguuaguuguugugagaguggguuuguuauaaaagugaguuaggcccccucuugcuuucuuguucuuguccaucuguuuucugucaugggaugaugcagcacaaacgcucuuggaagaugcugguacuaugcuguuggacuucucagcccccaaaaauaugagccaaauaaguuucuguucauuauaaauuacccgaucugggaaauucuguuauaacaacauaaaauggacuaagacaugguuccuacuuuuaguucuccaugacguuuaaagucuagauuguauagagcacaaauuagacacucauagauagcguguauuaaauaaacauaugaaauguuuaguguucaacucauucccuuucaaggaaauacacucuaaguuuucucuggucagaguaggaggagauuugacuagcacauaacucuauaaucaaaauaacuucucaaagguauuuaacuucuccaggguauuguaauuuccuuaggguacauaacucaccuagaguauuuguaauagguggggugcuacacuucccuuaucaagggugggcuuauuucucuagaaccugggaguguaguuagaagacaacauuccgggcccuuuugaggauagccucagcugcagagagccuccuugcugaagucaagcccugccuagagcagccaacacccaaugacugcuugaggcaaggaguauaaagaccuuuuccuuuuagcccaauguaggacagcuuugaugggccauuuuagguucagagcuccucaugggcagcugaggcuauuguccagacuccauugcagcucuacuucuuacuauauucaaacccaucuccuucuucuuccguccccagcggcugaucacaaggauauuuccuaauaaacaucuugcacucuaaacucugucuuguuugaauucguuucacaaagauccuaaaguaugacaacaucagauccauaucucuugcuuagucauuguuuugagaaagccuuuauaaagugaaaaggcauucaaacaucauuuauuauuaauauucuauuuuauguuaaaacggauuugaaguggcuuauggaggaguauucagaacaccaagauagauaggaagaacaaaauaaacaagagaagaguaggaugcagucagaggugagguuagaucauaaaauuuguaauaugauuuucauauacuuucagagcaugucaaaaauuuauuucuaagauuucugaaagccaauauaucuagagaaacagaaucaguuauucauuucauaguucauagguuaaaacuuacuuuucucaguacucugauccuguuauucagaauaaaguagcauuucugccaugagcuaucucagagcaucacggugagguauaaggaacaucucuuugguacacauagcauucauucauaaggcuuuuacuuauaacagcuuucaauauaaccugaagagcagggaaguaaaaaaaaaauuuaaaaauaaauucaauaagaugccauuccaauaacagggagauagcuuuuugauuaccaccuuaaucuaugaauaaauuuuagaaccuauccuucuuaggcaaaacuccacaaauauuauuucucccaauuagucguugaauaggaauucaagugcagauacuucaaaguuauacuuaccaaugauuaucuggagagcaauuacucuauguggccacaaguauaaagccauauucuccaaagauuagcacaucuuugccuaauguuaacauccuuucaaugaauacuaaggccuugacaaggugcacacugaaagagaaggacaccacacucuguuccaguuugagcugaugggaauaaacagcaucacaggacaugggccugcuuuucccaaaagaccaaaagaagaaaaaaaaaaaaacaguaauggugaaaaaagcaugaaaaaauacuacauacauuggacaauucaagccauugugcugcaacagugaaaauuucaaaauuuucaacaagucaaaaaaugaaaccaaagaaaaauuaucgccacuaacaaaaauuuuacagagcuacagauguugaaacagucauugucuggaugcaauaauggcucaugacaagacucucauauuggauccuagucuguuuuauucaggaucuauuuuuaccuguggaggagaucaagauuauacaugggaacccaaucuuggacaugcucuaaaacacaaagaaauggacaaagauucaaaccucaugcuguuaauauuuuuagcauggaaacaauaauaaaccauaugaaauaaaaauggcuuaauaacccguuaugugucguuacccuacccaaaauaucuuuaucuuuaaggaaugcaccuucauacuuacaaaacauaaucuuagauaaaugaaaaaagauaacuuguuaguggagcuacuaccaguaaaaacuaggaguaggugucccaaaauuguccauguuuuuuuguacaugaucuauagcuucuuuauaucaauaacuagauaacaaagcuacauuucuaagaacauauaugauaaauaccuguuaucugcuuguaagaaaaugcuuauuauuugcucucuauaauuuggcuaaaagugaucucaaauauuuaagauaaauguuacauggauagggguauacauacucauucuuauucccuuugcaggggauuucgaccuguucuaccauaaaucauuauuuacuuaccccauuuacauuauagugcagguccaauggaagacaaauuauacugagcucaggcagacuaaucaauaccugacuacugaucacagggugaaagaccaaguaaguucaauuaccgauaacaauaagacuguauuagucccuacaaauuuuccccacaaugaaguaguaacaauggaacuaggccuaagaacauugcauugcauuuuucuauuucuauugaucugaaauguccaguuuugcaauuuaugaagacaggaucuuauuagcauuuuggaagauaugccucauuaguuaacaggacgaucauuuuauauauauauaaaacagugagaugcugucucaggaaaaaaaauauauauagguauauauauacacauauguguauauauauguguauagauguguguauauauauacacauguauacauauguguauauauacauauauauguguauauauaaguauguguguauauauacauauauauguguauauauacauauguguguauauauacauacacauauauacauauguguguauauauacauauauacauauguguauauauauauacacauguguguauauauacauauauacguauauacauauguguguauauauacauauauacauauguguguauauauacauauauacguauauacauauguguguauauauacauauauacguauauacauauguguguauauauacauauauacguauauacauauguguguauauauacauauauacguauauacauauguguguauauauacauauguguguauauauacauauguguauauauacauauguguguauauauacauauauguacauauguguguguguauauauauacguguguguguguguguguguguauuuauuuauuuauuuauuuauuuuuuccugagacagcaucucacucuguguccaggcugaaguguaguggcucagucuuggccuacugcagccucaaccucccuggccucaggugauccucccaccucagccucucauguaacugggacuacaggugcacaccacucugccuggcuuuuuuuuuuuuuuuuuuuuuuuuuuuuuuuuuagagauugggucuugccauguugcccaugcuggucucaaacgccugggcucaggcgaucuacccaccucggccagccucccaaagugcugggauuacugacaugagccccuacgccuggccaggacuaccauuauauuccccagguacuuuauccaguaggaaauauuuaaucuguugaacuauaugaagcaguauuauugaggucuagagagacaauggucugauaucuaaacaauuuagaauaguuaugccuaauuugggaaacuugggaaaaguaaguuuuucaggugucauucgugaucuuagacuuuagcaagauuauuuccacaaauauaccuucacagacaaauucagaaucaagguuguuuucccaaauguaccuucacagacaaauucagaucuaagauuauuuucccaaauauaccuucacagacaaauuuagauccaagauuauuuccccaaauauaccuugacagaaaaacucagguucaccaucugugcuuaugugggguaagcuuuuuuaggcaaggaaaucuugcauaacaauuaaaaaauuaaugcauuuuucagguggacauuuucagcuuucuuuucacacaaucccuucuggcuagaauugcuaugguuacauggcaggauauaucagaccagauucuaggaauucauuaucucacuuuucugugaauauauugacauucauuagguuauggguuuagcuacuaugauuuauaagauauaaggugaauugagcuacuuuuaguaaaauucuuguuugaauaccagcuugucuuccagaauacacauuuuuuuguucuaaauauucuaauauucagaauuauugaacauuacuuuucuacaguugggaauaaagaaguagcagaaagagaaaguagauuucaguaaauaguauuuuacuuccaaaagauuuucuauguaaauauauagaucauauauuccuaagcaaaauuaucacaugaaguuuuauguauugccuaauguaaggucugauauuagaacaauacuuuagaucaaaacugugccaaaauccauaaugcacuucuuacucuacacaaagggaauuacuaaguugauaauauuuucuuuuacauuuucaauuuguuguuacuugccaaugaaagacaaguagggaagagccaaaaaaaaaaaucauauugauagccaccacacauugucggcuuccaucugagucaucucuuuuuuuuuuuccuauagaaggaacuuugugaguucauagcagaaaggaggagcacuauuggaauuuaaauaagcaucuuugcuaacuaggaaauuauaccagcaaggaagauucuaauucagugucuuggaucuacucaugagaugaauaauauguugagagggugguagaagagggccaaaaaucaaauaauuauacagcuuguggucaguguugaugaggagaaauguugcccuacuuuauccuuuuuuuuuucaaguuuucagcuugaauuagaguggcaaguauuccauaaaaacauaucugggaauaggauauauaagaaagaagaagaauauuauauauuauucauuuggagacuaaggcaguauuucuguuuuugauaacacacaguccaaaauuacaauuugaaaauaauuuaaaguaauuaucccuuucagcaagauuugcugcuuuuaaaagucccuuuaaugauuaauggauguuucuuacaauuccugaagcacagaguuugauaaguaugucagagcucagcagacugaucacauuuucauguucuugguaguaauucuuaguuuugcaugugaaaucuguauuggaaagugguuauauuuguugccuaucuuggaguauauucauuuucucuuaaaaaaaacaaagaaaauaacuguguaaguaauacaugucaaaucccagugcaauguacacuaucacuaugaaaaucucucuauaaauaaaagauuacuaaccucuagcuggcacauuuauuuuaagaaacacugcaaauaaaaccuaugucuggugaaauaacuuuucuucuuggagucguuuuaaugggauuugaucuaugaaauaauuuuucuuuuuuuuuuucccaaaucauguauauaauuaagauaucacuauaaaggcaauuaggaauuuacuguuuucauuaguuaaaugccaacugacaauacuccuuguaaccauuauguaaagcaaagauaacauuuugcaggagaaaauuggaaucugcuaauauuguuuacucuaugaucuguaguagaaaaauaaggauuaaucauauguagcaccaacaagaaaauggacacaauuaaaacugguggcaaagcuuaguuugcagaauuagagugaggcuauguuccaauaucucucuucccauacuucgccacccaucccuucagcaucuucugguuaguaaucuagcaagagguuagaaguggaaagauucggggaaaaagggaccaugcaccugcacuaaguugucaguuuucuagcccgcauuugcagguuugcauuuggacaaguggcccuuaaacaguuuguggucaugaacccauuugaaaaucugaugaaauuuguagaccccuucucuggaaaaauacacauaccuuuagcauacuucuuuacaugagcacaggcuuaugaacaccguaaaucuauuuguggacuccaagaaagaucucaagucaacuucuugagcgugaugacuaggucuuauuuuauuuuauuuuauuuuuugacucucaaccaggauggugucugacaaauguuagaaacucaguagaguuuuauuguuuuuauaaaugcacguauuucuuucugccuagcuucaugccaaucguuuugcuuaagcugugacuuaguauguugaugcuaucuuuaggacacauaagaccgugaaugcugacauaauaagaaaaaaaaaaaggauuaguuagacauucaugacuuagauugcuuauuuuuauuugaggccaaaaccuucuuauucucuauaauuuccauauuuucacaaguguagaauagugaaugcguguuguaguaaaaaguaacaaauaagacaccagcauucuacaaaauauauucuacccuagcaauguuauuuugaggaaaaauauacuuuacaugggacagaguuagcuacaaagacuguagccaaucguuucuaaugccaaacccaaacaagaguuuaacauuuaaaaagagccaacaguuacacaauuaaaauuuuaucugaggauuuugcucauucuuuuagguuuugacuugaacaaauggguggauggacccuuuuuuaaaugaaauauugaagacuugaggaaggacagauuuugcagcuauuuauuagugcagaauaaagugagauguguuguuauucacucugcuuaggaguuguucauuuuaagugagcccauuuuaaaagagcaggcaggaugacuucaguuuaugucaauaaagacuuaugaagucucacuuuaauucaauaccaacuaugugcaaauaacuuugcuaaauguugcaccuacauucauucauuaccccuugugguagaccgaaugauacagucucccaaugugacuacauccucaucuccagaaccaaugaauuuguuagguuaaguggcaaggaaaaauguaaucugauuuuaagacagggcuagccuauaaucccagcacuuuggaagaacgaagcaggaggaucacuugagaccauccuggacaacacggggagacccuauuucuacaauuuuuuuuuaaauagcugcuguggucccagcuacuuuggaggcugaggugagaggauugcuugggcacaaaagguggaggcuacagugaguggugaucgugccacugcacuccagccugggugacagaacgagacccugccacaaaaaaagaaaaaaaaaaagaaagugccuauuaacuuugcuuauccagucaggcccagugaaaucacaugggaccuuaaaaguggaagaggaaggcaaaagaauggucagagggagcugacugcugauguaggccagauugaugugcugaagaaggacucaaccuacaauggcuggauuuaaugauagaggaaggggacccugagccaaggaauauggauagacuuuagaagccaggaaagucaaggaaaugaaaucuccucuagaaacuccagaagggacuucagcccugccaacaccucgaguauagcugagugagacaugucuacccuaacagacauguaagauacacuuguguuguuuuaagccacuaaauuuguaauaauuuguuauggcagccaauaggaaaacuaauacacuccccgugcacauucacacauauacacacucuaaaauaaaggcaccuuuauauccaucuagaauaaguuucuuaaccucaguacuauugacauuuuggccaugugagugugugugugugugugagagagagagagagaguguguguguguguguaucgcuguccaaguguaaggugcccuggccucaacauauggacacuagcagcauucccugcuugugacacuuaaaugucugcuggggcgaaaaucaccccuaguugagaaccacugauggaauagaagacaaaugcuuuaauuuucaaaugcauggcggguugugaaaagcuccaugaaaauauggaucguaucuaucuuacugaccuaaccugagugagcagaacaggggcugcauauaaaaggggcugaaauaaauauuuaauggaugauagagugaaggagugaagucucuuagaguauaaaccagccaaugaccagagaaaauucuucuguauuuuuucucucuggucuguuuccccuguugacacuaguaaagaucaguauucuuuuucuuaaguaguuuagcauggcauaaguauuagauugaccucaagucacauucacuuuuaauauuuauaaagcauaugaacuuggucaacugucuucaucuauuuaacacucaccuccauccucugagaaguaaaaaguaauccccagcucucugguuugcuauaaaaaucuaaaaaacaauuagauauauauuucuugaaguguccaacucagaguagauauucaaucugaguuauaaucuuucuuuuuccaaagugcuaauaguguacauauagguccuuucuucuuucuccuuuugaauuaggaugcaauugauauugcucucacugauuccaagugaucuuuacuaagaauuuagacaacaaaguuagacuguaaaauaucaacaaaauuaauuacccuucucauggagaaauucuaugugaaaaggauauaacaaauuuauaccaauguuaagguuuugaacauaauugaaaauaaucguauauuuuuugaaaacuucuaccuaaaauuaacggaaagauauuaugcacucauuuuugccuauuugaucucaaagcuauucucugcaccucucuugcuaugcucuauguugcccccacaccagaaggugcauucccagccuacuauguuuuuuaguuucuggcaggguucacucaaugggagauacuggcaagagagugauuguagacuggagaaagagagaaaucaggcuauuuuccucucucuuauugucacaggcggugucuccuccaaagccuuuuauuuccuuggcuccagguucagcuggacagcccauccuccuauuggcacagcucacacugggaaaccccaugucaugggccuagcugcuauugaacaguccugaccugugggcucuggcagugagaccugcuuacaaaaguauuagcggcuucuucuuguuacaaaucucugagguucucuccuucaugugcucuggcuucuuagacuuucaucacguauguaaaaacuucucuguauuagaccauccuuuuuuugaaauacaguugacgcuugaacaacaugaggguuagggacacugaccuccuacacagucaaaaaucugcacauaaccuuugacuccccaaaaacuuuacuaauagccuacuauuaacuggaagccuuaccaauaacauacauagucaauuaacacauauuuuauguuauaaaauauguauguauauguaugaaccaugcgaugguauucuauauauauauauauauauauauauauauauucuuguacuguaucuauucuauauauauaauauucuauauauauucuuauacuguaucuauaagaauauauauguauucuauacuguauuccuacaauacaguaagcuaaagggaagaaaauguuauuaagaaaaucacagaaaagagaaaauauauuuaguauucauuaaauaaaaguggaacaucauaaaguucuuuaugcucaucuucacauugaauaggcuaaagcagaggagaaagaagagggguugguccugcugugucugguggcagaggugaaagaaaauccaaguguacauggacucuugaaguuuaaaccugcauuguucaaaggucaaauguacuuagauugguuucuacuuuccuggcuguaucccaacugguaaagauuuuuucuuaaaauuuccagugguuuugaguuguaaauauucgcaaaaggcaaguguuuaagcucuauccuuuauauaguuaaccauuuuauauaaugauaauuacugccuuacauucuaggaaaaauaugucucauuccugaauaucaaaagcaaauuuaaaaacaaaauuuaaaauuaauuacacauauauugggaucucagauuuauuaaacuaauuauuagaaaguaagauaaauuggggaaaagcuaaaaguaugcauaauuauuaaaugcuggcauuuaugugagccuugggcuucucuuuauuagcuuuugggugcgauuaucauuaacauuucaguugcauccuuaaugaauauuagagcuacaaauacacaauggcaugagugaaaauaggagucuuucauuaccacacagacugaaacuuuaagaaaaauaacuuacagagaggcuguagagcugugauuauauauuuacccugggagcugugagcugucuagaaguauucugagcuuugauuuuuacaccugcaccugugccggguggagaaacuagugaagagcaauuugugccucuucaguaaaccaguuaacugauuuuggacacuaacucuaaagcaacuuagccacauccuuugagcauuugcuucgugcuaagcauuguuguaaguguuggaaaagaaagaucugcaaauaaaaauuaguccuucuuuucaaggaaauuaccuaucagcugggggauacugacuugggggcaaaugagugcacuaaaguuagguaggggcuaggacagauguauauauagggcacauaaggcaggucuucuuuuucuguaggaucauacccagcuuuuggggugaaguaguggauaggcuugagguuuaauuacaaggcaugaagugauagccauaguauacugcuugaaaguuacucuuaggguauauaguaagucauucagagcucaaugaggagcuacuucaagucucagcaagugcugaauaagcaauuagauguauaaacucgcauugucuuguuccauaaaauggaauaagaacuguggggaaggaguaggaacaggacaagaugagaggaauagcucaaucagagcauuaccauaagauggccuuuagaaguaguacugacaaagagauacucaaauguacagcuccucggagcuggagauggcuuggaggugguuugagcauguagaagcaauggggaaaauggaggacucuggggagcaguuguaggaggcuauaauugcugagcucaacugcugacuggagccauucaauacugagaggagcagcugcagagagcuuaagcagagaacccuggagagccacagcuggagcuuccccagauuaagaagcugccaggggaagcagcaguuaugagugucauugcauggaaaguucaaaguuauccauucaguuccaccaucucugcagcuggcaauaacuauugaaacacagucuuagauauaugaagaaauggugaaauauugauaagauugacaaaauauguuugagauuuuuaaagacaacuuuccucaaacucgaaccuaggcuuucuuggcuaaugugguauuauguuugcuuguuguuuguuuauugaggaacaauuuuacccuaacaauagcuguuacauuggccaaaacaaggagacuugauuuuaaauuaaaggauucacuaaccaaaaaaucaacgagaguauaugcaaaauuugguacuuuuugauacuucuccccuggaaagaguaacuguaguuuuuauccuguucucaaaguuccugaugcuaaaaaaaaaaaaaaaagguuaagauaguuuguauuagaaagacaaaaaagauuagcuaauagagaauuugguaacaucuauuaucaacuuauccacaaaagauguuguuguauaacagugugaugaauuuagguaaucauuacauugaacauugucuagcauuacuaugaggcuguccucuucaaauauuguucaggauaacgagccuugguauauuggugaucccuucugcaucuuuuuggaucagcuuggguuugauuauggaggaagacggaagcagcauaauagauauuuuguuugaguaaaacacaauuaugauguaaacacuugagaaagagaauccagcuggaaaauuauuguguuaguccaccuuugagugagagcugagaacuacuguggauccuguagaaauggaaggaagaauguagagguggagguauucauucaacuugugaaugugagcacuguaauuuuaaaauaauaaugcaucuauuuauauuuuuguuuuguugaaaucucacaguacugcaaauuuuuaucaaaaucacuccaucuggaaaaauucuauguggauuaagccacaugggaaucaguuaccccggcuuaacagauauuucauugcuguggguuuuaaucgauaaacuugaccuucuaacuuugcugguuauacaaucuguucugagcaaacaaugaaaugaugugaagugagucaggcuuugaguauauuagcaaauuggggccugagugaccaagaaugaaaugucaggauaacaacacaaagaagaaaacucauuuuuucagguucaacuuacucgauuuuuuuuuuuuuggcacagcauaccauacucucauuuaaaaagagcauuuuacccaaaaagcuauguguguuuuucaagguaacauaaauuuacccuugaagccucugaccuaguaaagacuccuggaauaguuacuuuaagucugcucugaacaaauaaaaaauugcucucaaaguuauuuauuuagcuaaugaagauaccuugcagaccauuugaacaauuauuugaaagcagaaaccauugaaggcucauccaucucucauggagaguugcuggcuuugcacaccuuggaguguuuuuuuguuccccaacuccaaaggagaaaccgucccacuuucugagacuugacaugugguugggauuacugcaaggcuuuugggcuuuugagcucacaguucauacacuuguuuuugacaguaugauguguucuucuucuucuuuuuuuuuuuuuuuuuuuuuuuuuuuuuuuuuuuuuuuugagacagagucucguucugucgcccaggcuagagugcaguggcgcaaucucggcucacugcaaccucugccucccggguucacgccauucuccugccucagccucccgaguagcugggacuacaggcacccgccaccaugcccggcuaauuuuuuauauuucuaguagagacgggguuucaccauguuagauaggauggucucgaucuccugaccuugugauccgcccgccucggccucccaaagugcugggauuacaggccugagccaccacgccaggcaugauguguucuucuuuuaacguugcaguagagcacacagcagugaggucguucuuaaaggcaaccuaacucaauuugugcuuuuugaagagugguuugcuguucaauuuggccgcuuccaaaauauauaugacuuacuuuuuuuuuuuuuuuuuuuaagacggagucucgcucugucgcccaggcuggagugcaguggcgcaaucugggcucacugcaagcuccgccucccggguucacgccauucuccugccucagccucuccgaguagcuggcgacuacaggcgcccgccaccaggcccggcuaauuuuuuguauuuuuaguagagacgggguuucaccguggucucgauuugcugaccucgugauccgcccgccuccgccucccaaagugcugggauuacaagcaugagccaccgcacccguccgacuuacucuuuacauuugcauguaguuaaaaaaaauugauauggccuuaucaagaucaaagagaaagaauguuuuaaucucugaacccuucaaauucacagauauuucauguaacauacugaagccuuaaaauauggaguuaaucaaauagaaagcuauauauuucagacacaaauuugucuucuguuuuauuucuucaagauaaaugaagaggucagacuucuaguacaucaccuucugaaaaaauaaggguuauuauaaguaaauauaacaauuuaauucgguaugauucauaguuuuccagcucucuccuuaucccagugcaauauuuaacauuccaaagcaucacuauagcgugacauuuaugaguagccauuggcgcccagugcacaggcugcugugccaaguguggccucaguccucucuauuacauaaaacaaugagcauugacacagauggagcuauagagggcauauacacacacaggaaacacugagaagaaaaugugacagugaccucugccuuucucuuuuucccagacucccguugucagucaaauaaucagaaauugcccaucacacacagccccauggaccucuuuugcuaagcucagaauaaaaacacuaccuaugguugacuaaaaaaugaggacuuucacugggaauaaucugucuaaugauaaguuagaguacuaugcacuuggaauugaaagaucucugguuuuuguuuuguuuuguuuuguuuugucuuuuuuacagaguuucacucuugcuguccaggcuggagugcaauggugcaaucucggcucacuucaaccuccaccucccagguucaagcaauucuccugccucugccucccaaguagcugugauuacaagcacacgccccuaugccuggcuaauuuuuuguauuuuuuuaguagagacgguguuuuaccauguuggccaggcuggucucaaaguccugaccucaggugauccacccgcuucggccucccaaaguguugcgauuacaggcgugagccacagcaccuggccugguauuuugaucucaugauucuaaauauauucuuuacauuuucaguguuucaugaugaauggguauuuuuuaaggaucuuuauauuauguagaacuuugcuuaaacuuugcugucuguugcuuacuauccugaugauuaguaagggagaacauaaaacauuuuguuucugauaagacucaucauacuuuuaacuuuaugcuuuauacuuuauuuaacuuuuaaaauuauaauauuaauagacauugaagcaucagauaguauaaaauaaacauuuaaauaaaugauacuaguuuaaggauaucucuguaggaagaaguguagucagaauggcagggaaacccccacucccugcuucccccagggcaacaauccuucugccccucucuucucucuuuugcccacccuuacccucugggaauacugaaaauuuugcucuucccuuaaagaaccugaugugucacaccucuguguuuuuguucuuuccuaagcacucuuccuucccucuaaguaggauuaaucauuucuucucugaacaucucugaacauccuuuuggcgguccuaucauagucuguuacuuguuaaaguaucuguguuucucgcucaaagguaaaccacaugagggcaaguaauaugcuuauuuauacuucucaauauaugaucucuuaaugaauuaauuuauguuauuauuacuaauggaaccauguucuguggagaaaauggcuucuccuaaauuacgauauuacacaggcauacacauuggaaaggaugaacgugcuggaguaagacuuaucugaacguggaccuuggcucugccacuuaggagcuauauuaacccaaguuugagacccuuagucuaugggaaguuuuguggagaaugaaacccacauuauagaauuuccuucaaaauuaagaaaugaaauguguuaagaacuggacacaaagucaguacaaugaaugacacuauuauuauuauauauaauaaauaucuuuuaagagguuugugugugcauucauaacccgaugaaaaggucaguuauuuguuuuugcuccucaauuucuccuuuuauuuauuacucuaacuucuuauucaauagaugugucaaacaacuuuguuauaaauauuagcugcuuauuucuccaacuuucuauuuuuucuauucuuuagugaugacagcacaacauagauaaaugcauaugccaagccauuuuucaacuuuguaaugacaaaaaggcuucuuaucauaucuaaauauguucaaaugccacuuagucacuuuuuaaaaucagaauuaaugagauucuugcuaaccuuuuuauuuuuauuuuaguccagucaucuccuagccugacaaaacauuaaaaaaaaaggacuucaugauguagccucuaacagucguaaugagagacuaauugcagcccaaauuggaaaaaacuuuugguuucaacuaaaggaagaggaaagacuuaauagcaucccaaaagacuuuauaaacaaaaugauggccauuagcaauagcaaaaauaagaacacaagagcaaagaaauccacuuaguuaaaauagguaauaauaggcagugauuacagacaaaugauggcaucaugaguaucuauauggaaacacugaaaagggaaacaacauuguuuccuaacuucuuugauauuaugacacaagcaagaaacacagagacagagacagagacagugagagagauuacuacaugagcugugguagcucucaauccucccaucaggaggcuacucaaaaauuauucucaagaaaaaaacauuaucuuuccaucggacugaauacuguaguauguggaugcuuuguguaaacuaugagaugacuaaaccaacacccccacauuucucuaggaaagagagaaggggcuuacaccacuuucugguaaaugggagugacaacagcaaaugauagcaccaaacucgaaaucauaugaaaagugggaugaucaaaugaauggaaauaauuuaaaguaucugguuuucauuaccugggcuuagacuuauuuccaguuaacuuauccauucagagcacaacuuuguaccucauuuagcucuucugugaaaugugggaaaaaauccaaaaagguuaaguuugaucaggcauuaauguaacaaucaccuacauuuugauuguugaaguaaaggauggacaaauucugucuauagagaagcuggccccaagaugagucagacacugaaguaaggaaaauaauguauuccuguccucaggauauaauaauguauuccuguccucugugucuucucagaauauaaauggugguagguauuggcuaagaaagaguuaauuccuguucaggauuggcgucucagaaucauauccuaaguugaccauaagcucugaucucaaggaccagaaauaucucacaaucuucuuauauuguucaaauuagaaugucuuuguuuuaaauuuagcaauuguuauguuaauggagagaauguugguauugugaucaacucuucacagagaagcuuaucacugagggauuagagacauacugggaaaaauauuguuugucuugcauacacuaaggaguguacuuaguuaucacuguuuuuuuuuuuuuuuccuuuccuucagaggaaacacuuuguguuacuagaguuugcaaccauguguaaaugacuguaaaauaauagaauucagaaauggaagcucuguuucuuuuucuuuugugucuaugugccauccauucuuuuguuauaaaagauuagaaaugcugaacaacuagaaauaaaauaaucagaaauuaaaucaggguaaaaugaauagaaagaaaauucuaaucaauuuaugaaggcauaucauuuggcauugagucuucuuucaguauuaacauauuuccucauccuucaaaaucgaauugcuaaggcugagacauccaaaaacgagaacaugggaaugucacaugcaaaauauggguuuagaagugacauuaugcaggcuucuuuucuugucuuguuuguauuaaguaaggguagaaauguaauguaaaaaaggauugcuuccggcugggcgcaguggcucaugccuguaaucccagcacuuugggaggcugaggugggcgaaucaucugaggucaggaguucaagaccaaccuggccaacauggcggaaccccaucacuacuaaaaauaaaaaaauuagcugggcgugguggcaggcgccuguuaucccagcuacuuggaggcugaggcaggagacucacuugaacccaggagguggagguugcagugagcugagaucgcgccacugcacuccagccugggugacagagugagacuccaucucagaauuaauuaauuaauuuaauuuaauuaaaaaugauugcuuccauauuuuaauaaauauaugaggcuagaaauaacaugaauuuaggauauauuguggaccuuugaaccuacucaaacagauaagaauuuucuuccgagaauugcacugaaucacacauguccaacaauuuaaaauuagugcuaaaaaugucagauaaaagauaaaauuauuuugcaaaguuaaguugaaauuauuacaaaaugcaugaaaauguucaaauaggaaauuuauaugcauauauacauaaauacauauauacauguacuauauauauauacacacacauguacauacaucuauccaucuauccauucauccuuucucacaguccauuuauuaacaaauauauuugagacaauaugguagacuacauuauucuuauauugcuucaaauguauucuuuggaguaaaaguuccaaaaaaugaucugcaauaaaagggacucaaauuaaguuuugaaacucugaauacuauacuccccuuuaagacauacaaaucauaaaugcagacaggauccuguaagaaugacguuuaucagaguagcuguaguagacagaauaauggucuucaaagaugucauguccuaauuccuauaaccugugaauaugcuaccuuuuguggugaagggauuuaagguuacggaugaaaugaaaguuucucaucaguugaauuuaaaauagagacaugauccuuuauuaacuaguuaugcccaguguaauaacgaggguuauuauaaguagaagaaaaauauagaaaaacagaucagaguuaugagaugugggaaggacuuacucccuauugaaaacuuugaagauggaggaagagacuaggaggaaggugggcagucuuuaaaagcuggaaaagacaagaaagugcauucucuccuacaguccccacaaaagaaagcagcccugcccacaccuuggucuucgcccuguaggacuacuauuggacuuuuaacauacauaauugcaagauaaugcauuuuuuguuguuuuaggucacaaaguaucugauaauuuguuacaacagccacagacauauaauauauaugcuauggcuguuguagucauuacuaccugccagacaccaggguacauucuugauacccauuaauauauuagucaacccaaaaagcaacaaauuauaaacauuauucucaucuguauuuuaugaaggaggaaaugggguguggugguagacucuuguagguuagcaaauuaugcauaaugauaccaauagaaaguaccaaaaccaaggcucaaguuaaagacuaauuacaaagcuuacccuuuaaauuucuuacuguucagucgaucuucuaucaaacuuucuugacacaacagcccuuucuuucuuucucaauauaccuguuuauuuugggaaacacuaguguaguggaaaguaacuacacuucagagacuaaagauccuaauuccagcuuugcugcuaacuacucacauaaccuuaguaaaacaaucuuguauuucuuggccacuauucuuucugguauuggugcucucaaaacagcuccuguucucauggggcuuagaauccaugccuuaccauuauucauaccuacaguuaaauguguucugcauuauuuacaacucccucaggaccgaagaauagguauauuaauccuauuuuagagaaaauaaaauuaaaaugcagaguaguugaguuucuugcugcagaucaaaaagauaguaauaauagagccagguuuuaaguggaugucaucucauuccugaccagagcucuuuccacaguacuacacuuaaucauauuuuaauaaaaaucauauuauaaaacucuuacauauugcuuuauuuuuauaccaaccuaauuaagccucaauacaauuaaaauauuaccauucaaauacacuuuaaucaaauauacugaagaaaugucauugacuaauaaauaguauauugucuuaauuuucuucuguauaaugcuugacagacuuguaucuagacagugauuucaauaaaaaauagaauuacauuucucucacuagggugguucucaagcucuuuuauuuuuuuaaaguacuacaggaaauucugguuaaaaucuaagacucuaggcugggagugguggcucaugucuguaauccuagaacuuugaaaagcugcgguagauggaucacuugagcucaggaguuugaaaccagccugggcaacauggugaaaccuacccucuacaaaaaauaagauaauuagccaggcuuuguagugugugcccauagucuaagcuacuugggaggcugaggugggagaaccaccugagccugcgaagccgaggcugcagugugccaagauugucccgcugcacuccagccugggcaacagagugagacucugucucaaaaacaaaaacaaaaacaaaaaccuaaggcucuagaagagucucauacauggccacucaaccuacuuuaaaagcuuaagauuuugccagauaaacaaauguaacuuugaauggaauuuuacuuauuaauuaacaguaaugguaggcagaguuguaaaacaaaaauagaauggauuuucaagucaaauuaucuggacuuaaauuuacacucuagcagcaucagcauuauuaccuuuagugaacaauaucaaauuguauaaucaaucaggguuaguuugcuccucuguaaaaugagaauaaucacgucugucuuugaggguuguugguacuuauuagguauccagguauuucguuaccugcaaauuuuugaaaccaguuuguaccaagauccuucccaaaguauuccaguuuuuaauuguccauauuuuuacaacaguugcuugcucgcaaguuuauacacuggauucuaagucccuuaucaguuuagaugaugccuuauucaaaguuuaucgccaacaucuagcauguguucuggccucuaauagguguucguuaaauauuuauugacugaaugaaaaccuucacugaauauuacuuggcugacuuuuaauguccaaguauguggcauuacuuuuaaaaaucagugauaagggaauaaaacacacaaaaagauguacugucuuacuccaucugucaauuuuaguuuuaauuucuugcuuuucuuccuguaagcuauaaucguaugauagacuggauugaaucuguagcauauuuaaguaaaucucuauacuauuuauagagucuaugcauaacuacaauugaugacuuugauuacacauguuuaauauuucugauguaauauuugcuaucuuuugugguuaauaaaucuuucaaacaucuccucaauauuaauguauugauucggucuucacaauguuuguaaauucuaauuuauuuuccaaaucuggccaagagaggcuuacauuuggaaguaacaagauaaaucuuagacagauucguguaaaguggaacaaaauaaauauucaaaagacuucuaaaaucacauaaaaaccccuuuccaguuaaaacugacaauucauuacucuuuuaaauuguggguacuugagugagaugucaguuuugguuauaaaauuuacucacuagugccagccacuguuaucagccugucuuagcucagaacaaaaagagcaggauugaagaaauuucucuugaauuuagaaguguuugcugagauuaaccaaacaauaacaaagcaaucacauucaacgaacaccggaaacauuaaaaggcuaugguuuaguccaggauuuaucuuugaagaaauauaaaauagaauuuucagaaucaugccuaguuuuuccauacuuuuucuuuuucaguccuauguugucugauauauggaauacuugaugagagaaaaaccaccagccauuucaaauggacuccugcugauaugcccugcuacguggcagcaggaagcaaugccuucucuuaaaaguacucucuguaaauagacaauugcaucuuucaucuuuaggauugugcccacagagaacugaagcaaauacuuaauuguuuugaaagacucacaggcaauccaaagggaguucuucaaguaucucagcagcuagaguccuuauacuucaauuaauacuauugggaguugcauguuuaaaaaccugagugguuucaaaugauuugucuuuugucaacaauguuacacuugacaccauuuaaaaauaauguguauuuaagaaauaagggaaaauaagucagcucauuuuccuaaauuuaagaaaagaaagaaaauauaguuuaaaaauuauuuaauaucuauuuugguaacaaaaaauaacacgggaaguaguuuagaauugaaaguaauaaugacugagaugguucucugaauuacuaaaaaaacuguaacacuguaacaguugacugcauauauuuaaaauaauguauuuuagacauugaagaggauuuagcaaucaauggucuaaguuuacagguaaggacaagauccaccagaaguuaaugacuuugguaacucauagagcaaguaacagaaagaaucaagugaaucuaaguuuacaguauguuuuugucccaguuggaggaccucucagagccuccuuucuucaaccuuuugauuugaguggucugccuucugacguuagauuggugcuaagauccuggcuguguuccuggaacacaugaaguguuuagcucauguugggucccugccuuuccuacucuucuguuugucuggaguucuuuaaaugacagaacauuuguuagauuuuguucaauguuuguauucagacauugccauaauccagauuuguaauugugauuaaacuuuuggaaauguuugcaucaaguuagaaugaaagcugugcuggagaagauucaaaaauguuguauagaacauuccucuuugcugagauuaaccaaacaauauucuuuuuuuuuuuuuuguaguggcauuucguugugguucuauuuuauaucauuuuuauaaacaauuucaacuuuuauuuuagacucaugagguacaugugcagacuuguaauaaggauuuauugugugaugcugagguuugggauaugagcgaucuugucagccagguaguaagcauaguucccaacaguuaguuuuucaaaccuugcuccccuccuuucuucccaccucuaguagacccccgugucuauuguugccaucuuuauguccaugagugccaaauauuuagcucccacuuguaagugagaacauguaguacuugguuuucuguuccuguguuaaugugcuuaggacaauggccuccagcugcauccauguugcugcaaaggacaugauuuuguucuuuucauggcugcauaguauuccaugggggguguauguacccuauuuucuuuaugcaguccaccauugaugggcaccuagguugauuucaugucuuuucuaugaugaguagugcugcaaugaacguacaacuucaugcauauuuuugguacaacaauuuauuuucuuugagauauaaacucgguaauaggauugcuggguggaauguaguuguguuuuuugagaaauuuccaaagugcuuuccacaguugcugaacuaauuuacauuuucaccaacaauauauuaguguuuccuuuccuccacagccucaccagccucuguuguuuuuucacuuuuuaguaauagccauccagauuggugugagacaguauuucguugugguuuugauuugcauuucccagggacuauuccauauagacuuaacuuuugucuuuuucaaauuaugucucugauaaucuuaugucuguuccaaauaaguuauuugauguuuccaacaauaguuauauucaguguuuuuggcaauuauauuaccucauuaaguuggcaucaaucagugccauguaguuucuagacaaccacuauggaaauacaguaauagaaacagaggcuagaccuagaaauuacuuucaugucuuuaaacgaguuaucucuuggaagcaugaguuuaacccaugcuaaauuugaaaugauauuuucucuuguaaacauugauaaucacucuuugcuuauguuuuuuacaaaugaaaccaaguauaaagagaggggaagaggacugacuguagcagagcuaagacaaaauaguuaauucguaacauuuucccuaggguuaauuggagucaaccaguuggcuggugacaguagcaauuaaagcaagaaaauccugcagguaaaaauaagagagagucuccuaaauucagcugauuuccucaagacuaucuuuucuaauugucccucaggcuagguuaagugcuagguauagcuaagagccagcagcuaguuuuagcuccagagccaccuccugaaaucuaaguuagcagaugugaauuauacacuucaccucauacuauauuuuauugauuuuuguguguuuuuauuuugaugaagugaaugaguuaauaggacauaugcgucuagugaaugcuguuaaaagaaaaacuuuugacaaauuaaauuugacaguuuuuuuucacuauuuuaaacucuuucauugaucaaaaucauuuauucacagaugaaaugacucuguaccuaaaaagaacaaagcaaucaacuuaacaauuauaagaguuaaugagaaaauuaaauaaggggaccagaaggagauucagaucucaacuuuuuuuuuuuuuuuaauccuuggccagggaaauuauucauauucucaucuuuauauauuuuuauuuauuuuauuuuuuaaauuguauuuuauucuguuuuauuucaauagcguuuuaggggaacagaugguguuugguuacauggauaagcucuugaguuggugauuucugagauuuuggugcacccauuacccgagcagcguauacgguacccaaugugcaaucuuuugucccucacucccuuucccccuucuccccaccaagucccuaaagcccauuauaucaaaggcauaaaaaugacaguguuuauuugaacaaagaauggcuuaugaauugggcagcacccagaauuggaagaguuuuagagugcuccguuuuagcagcaugaguagggggcuuuaucagcugaauccagaagcaaaguaaagaaauugcucaauuugcugcagcuagccauuugccuuauuuugauauaauaugguggaaagucccuaauuagauauuagguggcaguuucugguuggcuaagcuuaaguuguauuuuacuguuuacaucacacuucacuuugcuuacauaggaaacuaaagcacuggaauuuucucagccuuucuuuuuuuuuuuuuuuuguaacaaccucccaauuaauuuaacaaccucuaaauuauaagugaauuuuaauguuccuguccuacugaccuauaggaauaauguguuaaaccucuuaacacauguaccuucauuucuuuggaaagcaguuuuaucaguggacccuguuuuaaauguaucuuauuucugccagcuuuauaucuuuuccuaggucagaaagauuauucaaaauauuguuaaaucaaaaggcuaaguuuuacuuuauuugcaacauaagaauucugaaggacuaaauaaugaccaauggaucauauauugccuaacuucacugaauaaucuucacgauguuuuauuuuuauugauuauauuuacauuguucuaaggauuagauucuguagaagaggaaaauuccaaccacauaaugauuuucuugaugugaauagaauauaaauguaaauaaaaacauuuaucuaaaaauaugagauuagauaaaaaaugagauuagaugaaaaauaugagauuagaaaaauauaaaauuagauucaaauaaaacacauuuaauucaaauaaauuacuuuuuaauuuauuugaaacuuuuuaucaaaaauauugugauuaaaaacuaauaaaauauuucuaugcauagcuguuaaagaaaaaaauuagcuuauuuuguguguuaaaaacugauuugaaaaccuugaucaaagaauauuauuauaauugacacuucaaguauuuuuccagauaucucaaccaaaacaguggauugaaugucuuuaugcuuaagacagagcuacauauugagggggaaaaaugcccugauuaaagaagaaaaaucuuucacauuuuuuggaggaacauucuaaauauauagagaauuaagauggcugcuguagcauucauuuguaggcaguauuacguuugaauuggauuaacgugucuguauuggaagcuuuguauguagcaagggacucccaugcaagcugccaucuuggauauugaauguauuaaaauccacacugcugacugucaaaucauacaacuuugaucuucugugaaaugugugcaucaauaguaaaauugccagaugccaucauuguuuuggauuuugaguucuuucuggauaccagauuaaguggguggauacuaaauaagcagaaauucuaauaaaugugaccauucuuuagugagcuuguuugaagaaacaggcaguuguauaagcaauuggcuuaugcaaauucuaguuugaauuuguucacagccacuuuaugaagacaaacuuucucuuuacuuccuaauaagagauuucuaauuuugccaaaccuauauuggaugacaaauagagauaaaacuugaaugacaguguuuaaaaguuuaaggaauguugcuacggcauuaaguguauauuacuuuaucagacauucugucucuacuauggaaauuauauuaucuuucauuuaagaaugauagugauguauaguaucauaaagcaaacugauuauuuuuuggugaucuuacuauaaauaucaaauaauuauguccacuugugcggaauuggcacauaauaguuauuaauaauggcauuuuauaauuuacaauauaacuucucgauuaacaauauaaauuaauuuuauuaaauaauaucuauuugaaauccaguuauuacuaaauauccgcaaguccucuuuuucccuuuauguuuggugauacauacaguugcucuccuuagaaaugcugucacaacugcuuuuguuuccugaggcacugcuucacacugaauuucauuuuggcuagcuaaaagaugcacuaaaggauuuuaauauaauauguaacagagugauuacauggaguccucacuguaaguucucauaucauguaaauaggggaaagaaaguaauaaaucaauuguuauugaaugaaagaauaagacucaugcaaauuagaaggccaaaaaucuguuuaugcacacuaacguuaaagucaaguaauagcauuuauaacauccauucaucugccuuauuaauagaaaaauacaucauuuuuuauauauauauauaauagagagagaaugggguugauauauaaggaagaugauauagauauagcuguaguaauaagagggcuauguauuagggauguguguguguguguacauauauacauauauauggagagagagaugcaacagacauauguauauguaugaaauaaauguauuuaugaauaguacaaaugaaggaaguaugcaaaggaaauuuauuuggacacagcaaaauccauaguuaaucacuguugucacaugauuaaauguaucaccuuauucaugggacuucuaggauauuucuugaugaaagauugaggucacaccgguagucuuucauuuaaagcuaacaacaucugacauuauaaauaucuuaguuaaaauacuaucauuacauacaacucuuuugucaacuuugguuaauauuuauagaaugaagggcauagaaauagaauugaaaguaaaauuucugccuuaauuuugcugacagcagaagaacuuugugauagaauuacuuauugcauaaacauaaaauuuauuuauuuaguaaaaauguauuuauuaaauauaauaugaacagacauaaaauaaauguuuacauaccaucacaaugacaucaaaagucaacaaagccagaacaggguacaaaggugggugagagcuugaguuauaauaauggaagucuuagguaauuuuugugauuuuaauuaggaucucuggagguuuauguuuacauauuuuggaucaaguuucuuccuuuuuauuugaucuaaaaaucccuaugauaaaacugaauuuuauagauuuaaaacuuugggaaauuaauaaaagaggguuaauagcauuucaauaaaucauuggcauauucuagucucauguuuuuuucaauuauaauaacauagcuaaugaauauaugaaaacauaauuaauaaaugaagcucauccaguuaaaguaaaaacuuuuuauaauuugauuuauaauuuaaguauacuuuagaauuagaagugacaucuugugcccauauuguauuuauuuuccaaauaaauuugcuaaaauauuuuaaacauuguauauuccuuagaauuguuaaaaauaaaaauuucaaaaaugauucaacuuguggugaccuuacaaauauguaauuagagcaugaaaaggaaaaauuaaguauguccugaaguuaaugauuuaucauugcggcaaaauaauggguuaaaagguguuuaauucaaaggugaaaugauaaauugggugaauacuaaauggcgccgaaguccugaguuacagaaauugacaauaucugaccaagcaggucaucacauugaagacaguuaccacaaauacaauggguagaacagguuuuaacuccucauaaaaauacuugugucuaaauauauuguaagugaaaaugaauuaaaauauaacauucaagaaguaaucuuuaugcaaaauuccucaacuucuguuaaacucuaucagguuuuuuggauaauaaaaugcauaaacugacaaaugcccuuguauuaaacaagcuuuaacgaauacaugucuuuagacuaaaagcacacuaaccacauacugcgcucuuauuuuaucaucuagugaauaaacagagacaguggacacugggugaugaucuugucauuacugcuacauccuuaaauuuaugugugccacuucaccuaccucuuucaauuucuaagucugugaaauaggaauaagaccuuuucuuccuuaauuuccccagacugcuugcaauuaauaagugaauauuuaugauuuuguagaaaaauaauugcuauuaucauuaugcuuuauuuuucacuuuugugguguuaugguuuaaaucaaauauaagauguuuauaucuuggccaggugugguggcucacgccuguaaucucagcauuuugggaggucgaggugggcagaucacaaggucaugaguucaagaccagccugaccaacauggugaaaucccgucucuacuaaaaauacaaaaauuagccggguaugauggcacaugccuguaaucgcagcuacucaggaggcugaggcaggagaaucgcuugaacccgggaggcagagguugcagugagcugagaucgcaccauugcacuccagccugggugacagagugagacuccgucucaaaaaaaaaaaaaaaaaaaaaauuuauaucucauuuuuagaaaaaugguguuuagaaaaaaagcucaucaguaucacaaugucacauugugguuaggagggaacucuaaccccaggggcccauuuuaaagguuguuuuaucuucucuaagccaauuaccuacacccuagaucaaugaaauugauuguucauucaauaauaguguuuucagcacuuugaacuauauguaauguaaaagcuagagauucagcaauauacaaaauagccccaagaggcugcucucauggggccuacauucuagcgaagaaagaugcgugauaaauaagaaauguaccagauaguaauaauuguacgaaugugccagaaauaguuaauaaaugguauuugcuauuauuagcaguaguagcaauaguaguugcuauggcaggcucuuagguuaauaaauaugaaggcuaguccuuauuuuuggaucguuuuguuucuacuaacuauauagaaugaaaaccucauuaucauacuuuaaucaugcauugauagaauguuuuugacacuucuauauggcugcuucauugacacuucaacaaaucacagaaauaagauuaaugucaucauuagaugauuuuaaaguagagaaaaaugagcuuuaagguuagauggaucuguguucaaaucauuuacuuauauauugcaugaagauuaaacaggaaauauuuugaaacaguuuuaacacugcuuaguaugaugaugauggcgauggugaugauguauuuucuauuacuguuuuaucuuguaccuaggcacaucuguagccuacuaacagaucuuguuucucugcuucagucucuucccuucaauguaucuuuccaaguacaaucaaauuaauauuaauuaaacaaaucuacauuuuccauggaauaauuuuguacauauuuaaaaaugaauuaagcaaacaaguguguuuuccauuucuagcaucuaucauugugguuacaguucaaaucuuauguuuccucuuaaaaguuauuaaaacaugcaaacauuauuuuccuacguuaauuggagccuugcccucauuuuccaguacauaguugguuacccugcaaguuaaauaacucuaauuauuaagauucaaaacauuacauguaucauugaaggcaauuaagaugauuugaauauuauuaaaugaaaaugaacuauuucuuuuuucaaaaaacuaaauaaauaugcuuagggauuuuuacauuguuaaaauugccucaaaaauaauugggcaauucaauauaauaaagugaaugcaauaaauaauuuuaauucauaauaacauuaaguaauaugcuuauuugcaugacuaggauaaagaauggauugugcaaauacuaaacagagacuaauagggaaaagcauugguuauuauacuuuuaaaccuguaguucauaaguuauuacacuuuacuaugguugaauuggccuaacuccacuauagcaucccuuacaagaguucuuaaucuccucgcauuuaucaugugaggaaauccccauaaaacagaccaaauaaacuacauaggaccuuccuuaagcaagguuucccacucagugguauacuguauuuuuuggcuggagguagagaaauggaaacuacuuaagcagcugugcuuuggaugagaguuuuauugauuguauauacuucaaauguuucucuucacuagccauguuuucuuuguaacucuuggcgaauauucccaaauacuccaguggaaauguuaacaaaaguucuuaaggguggcugcagggccagggcauuuagaguggacccuugaccauugauacugacccuuuggacacuuggugaagaaaacaaugguucauguuugaugagaucuggaugagacuaaaggcaaauauggaauauauuaaauaagccugccaugagaagaaauaaaaugguuucugauaaaaacagagucauucccaacuauaaauaagaagacuuuugauuaaagaaauugcaaauguaauaaaaaauguuuguacaaauuaaaugauuucauauuuaauuagaauaauaaauauaggguuuaauuucaguaaaugggguuauacgcagauacuggaaaacugaaaugcuacuguguaacuuuuuaaccauuucaaggauuugaauuucuuaguguauuugugcuuuuaacaguuucuuccucagugauucuuccuuuccauugugauaauaccccagcucagaaaaucugucugguucaaaucccuaacuuuuucccccaaccuucuuaaucuggucuagugccuuccuaucugccuucccaucugcaucuuccuacucacugucuuuuggaucauccuccauacccuuccuccauacccugaaauucagaguuuagugccacucuaaccauaaacccacuucuuucucagcuucuaaaucuaagaucugcguucuggauucuuauauaucuguguagggagcucagaaaccaaugaaaaauacauucagcauuuuagcaggcaucaguggaggggacaaagguugaauuucucacuuuucugaaagaaguugcaaaaguggauucuuccuuaaaagaauuuugcuguucccagaaucuuuuccauggaaguccuaggcauacacacacacacacacgcacacacacacauuaguugccauauauauauauauauauauauauauauauauaugcuauauauauauauaugcuauauauauauauuugcaauauauuauauauauuugcaaauauauauuugcaauauauauauauuugcaauauauauauauuugcaauauauauauuugcaauauauuauauauauuugcucuuuuuucuuuuauauauauguaaaauauauguauacauauacuugcucuguuuucuuuuaaauggaucucaauuauugcaagauagguuuugaacguccaaacauuuauuuaaacacaauuauugcaagauauguuuugaacguccaaacguguauuuaaacauuaaaugaaaaaaaaacaaagcaguuuuuuuguuuauuuguuucuuuuguuucuuuguuuuuugagacggagucucgcucugucgcccaggcuggagugcaguggcacgaucucggcucacugcaagcucuggcucccggguucacgccauucuccugccucagccuccugaguagcugggacuacaggcauccgccacuacgcccggcuaauuuuucuuauuuuuaguagagacgggguuucaauguguuagccaggauagucucgaucuccugaccucgugaucugcccgccucagccucccaaagugcugggauuacaggcgugaaccaccgcgcccggccagcaaagcaguuuuuaaugucuguaagcauuuuaugggaugagcguuucuuagauauggaugauaaaaauguauuaauaagaaaaaaauaaaaagacagcuuucccuuucugagaaagaauguauuagcuuccucaaugacggaaauuuuaaauaccuaccagacugacuucaguaaugucauugaauacuuuuagccaauuucagaagaaagauaaacuguuuacagacucgcaguaauuccuagauaaugaguauucuuucauuauuagccacagcacaauaguaacugugauacuggagaacuuaaaaauuuguuccuucagaaaauacuauccguaaaguaaaauugucuguuggcuuucuaaaggaaccaaaacuauaagcuuaaaauuucuaaguuggaaauaauuuucuucugaauuuaugaaaaucucaugucuaagucuuuaaaauucaguauugauuaaaauuauuggauaaauguucaguuaugccugcgcuucuagauaagcacuccucaaaauuuuuagagaucuuguaccauaaguguugaccaaacuuuggauaaaaacaaacaacacaaacacacaaacaaaaaaaacccuuaaauuguuauguacuuuuuaugccuuuauuguggaaucaucuugauuuuuauaccauuagcaaauuuucacacuaggcaguaaauucauucuauauuuuaaaguaugaguuaaucucuuuaaaauugugggucuacuacguuuuucucuuucuuuuguauaaauaugaaauacaaacuuacaauuucauuugucacaagcccugaggaagaccucucaaacuaggguuauaaauauagaagugacuuuagauauaucagacuaguauuucacacuucuccuuuugcagggaagaagugacaacacagaaguugaggggcuuuucaagggauagguaacuaacuagcuacacagcaggaaucggagaacuauccuuagauucuaaauccaauguagaacauugcuucuuguccugguuuaucugacauuuguguuauaaugagcuuagucuuuacaagauauucaugucgggaaauggagagaaucugauguucugucaaauagacauguuuugaaauggaaaacagagacaauaauacuucgaguuauaguauauauauauauauucuauaacauauauaugucuauauacuuuaagcgugaacagagaagaauacucagcaacuacuuuauuaacugugagauuaaaaaaggaaucagugcagucuguaucagugcagauuauacuuguaacauggcaucagagcacagugcuuaagaauacagcagaugggguaaccaacuuugaaucccagcuuauuacauugucaucuuuagccaguuacuuggccucuccaagcuucauuuuuucauuuauaaaacagacauaauaauuuaaauggaaaauccagaaacagacccucauauuuauggucaauugauuuuugacaagaguggcaagacuuucaaugggggaaagauagccuuuucaacaaauguugcugggaaccacuggauuuccaaauggaaaaauaaauuaaaaucagaccccuacaucaugccauauacaaaaauauuaacucaaaaugaucaaaaaucugaagguacgagcuacaacucuaaaacuguuacaagaaaacauaggaguaugucuucaggaccuuagcuuaggcaaugguuuuuuagauuugacaacaaaagcacaagcaucaaagaaaaaauagauaaauuaaacuuaaccaaaauuuaauacaacuguauuucaaaggauccacuuaagaaagugaaauaacacgcagaaugggagaaaauauuuguauuaauaucuuagauaaggcacuaguaucuaaaaaauacaaagaaaucuuacagcucaacaauaaaaugaugaauaacucaauuagaaaguggucaaauaauuugaauagaaauuccccaaauaaacuauauaaauagucaagcaucacauaaaaauauguuaaacacauuugggaggcccaggcggguggaucacuugaagccaggaguucaagaccagcuuggccaacauggugaaaccccaucucuacuaaaaacacaaaaauuagccaggcaugguggcaugcaccuguaaucccagcuauuccagaggcugaggcaggagaauaacuugagcucgggaggaggagguugcagugagccgagauugugccacugcacuucagccugggccacagagucagacugucucaaaaaaaaaaaaaaaaaaaaaaguuaaacguuaucaucgagacuuaaaaguugaaaccacaaugagaugccacuuaacauacacuaagauagcuauaauaauaaguguugaauaauaagagguguuagcaaaaaggcggagaaacugguaccuugauauauaaaauaguguagcucuugugaaagaaaauguggccaaauucucaaaaacacacaguuacuauauaauucagcaguuucacuucuagguauacauccaguaaaauugaaaauauauguucacacaaaaaguuguauaugaaugcucuuagcagcguuacugaugacagccagaaagugaaaacaauccaaguguucaucaguugauaaaggguuaaacaaaugugauagagccauagaauggacuauuauuuggccacaagcaaaaauaauguacugauauguuacaauauagcugaaucuugaaauuauaacacuaagugaaagaagccaggcaccaagaccacaaauguuauuauuccauuuauaugagaugucuacaauaagauaaucuauaaagauagaaaagaaauuagugguaaccaggggcaagaggaagggaugaaugaggaguagguacuaaugggaauggcauuucuuuugggagugaugaaaauaugaugcuuacaaaacuggauuugcuaaaaacuuuugaauugugcacacaaaaugguaaauuuugugguguuuguauaauaucucaauaaaaaugaaaaacaaccuacuuaaacggaugguuaugagaaugaaaugagauaauauuugaaaagcucuguaccuaggaaauaguaagcacucacuaagguuagaugauaaugauaaugacaaaaaugacaaaaacuuggaacaauagaggcacauaaguagauaauaaaauagcuccuaaauuaaaacuuaaagguaccuauuacccuagucacuccuauccaaggcuuccaaaauguccuauugaggacacaugguaguuaacaauagaaucaugcgauggguaugccuacagacugcuuauagauauuuucuauaaauguuaguaaauuguguauagauuauuucauaguauggauucuuucuuuuccuuccuuuuaaaaaaaaaaaaauuuggagauggagucucacuguguugcccaggcugaagugcaguggcuauucacaggcaugauuauagcacacuauauccucaaacuccugggcucaagcaauccuccugccucagccucccaaguggcuuaaacuacaggcaugagccaccacgugcccagcucucucucacuuuuuuuaaaaauaaaacuuauugagagacuucaaguuuuguuaaagaaggauugacaaguuagcguguuaugaaguuaacaaguuagcaaguuaaaccuguauuugauaaguuagcuaacuuugguaauugguagccuggagucuugauuggauuugucaaacaguauuuuaauaguuacuuaacuucuuuggucuuauuuuccuuaucugucaaauggggaaaauaacacauguaucucaguguuguuuuaagaggaagugauauuauccauguaaaguguuuguuauagugcuuuuugccuaguaacugcugaauaaauggaaauauugucauuaugaauugcuacucacuuuagaagagugcuucaaagagccccuauuccuguuucaaugugguuccccugauucuugaacuacuacagauguuuucuuuugaaaugaauuguaguauucaagcacauaccaaaaagucuuguguucuugacuucuccauucuuuuuuuuuuuuucuuuuuuuauuauuauuauuauacuuuaaguuuuaggguacaugugcacauugugcagguuaguuacauauguauacaugugccaugcuggugcgcugcacccacuaacgugucaucuagcauuagguauaucuaccaaugcuaucccuccccccucccccgaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauagucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugauggccagugaugaugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuaggucuaacguuuaaaucuuuaauccaucuugaauugauuuuuguauaagguguaaggaagggauccaguuucagcuuucuacauauggcuagccaguuuucgcagcaccauuuauuaaauagggaauccuuuccccauugcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuucauugagcagugguuuguaguucuccuugaagagguccuucacaucccuuguaaguuggauuccuagguauuuuauucucuuugaagcaauugugaaugggaguucacucaugaucuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcaucccugucuugugccaguuuucaaagggaaugcuuccaguuuuugcccauucaguaugauauuggcuguggguuugucauagauagcucuuauuauuuugaaauacgucccaucaauaccuaauuuaaugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuuuugcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaaacuauugauuauugccacaauuucagagccuguuauuggucuauucagagguucaacuucuuccugguuuagucuugggagaguguaugugucgaggaauguauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauauguuugcucuugcuuuucuaguucuuuuaauugugauguuagggugucaauuuuggaucuuuccugcuuucucuuguaggcauuuagugcuauaaauuucccucuacacacugcuuugaaugcgucccagagauucugguguguggugucuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuuuacuuccaacuauguggucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauaaauauuuaggauaguuagcuccucuuguugaauugaucccuuuaccauuauguaauggccuucuuugucucuuuugaucuuuguugguuuaaagucuguuuuaucagagacuaggauugcaaccccugccuuuuuuuguuuuccauuggcuugguagaucuuccuccauccuuuuauuuugagccuaugugugucucugcacgugagauggguuuccugaauacagcacacugaugggucuugacucuuuauccaacuugcuagucugugucuuuuaauugcagaauuuaguccauuuauauuuaaaguuaauauuguuaugugugaauuugauccugucauuaugauguuagcuggugauuuugcucguuaguugaugcaguuucuuccuagucuggauggucuuuacauuuuggcaugauuuugcagcggcugguaccgguuguuccuuuccauguuuagcacuuccuucaggagcucuuuuagggcaggccugguggugacaaaaucucucagcauuugcuugucuauaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuuuccuuugaggguaacccgaccuuucucucuggcugcccuuaauauuuuuuccuucauuucaacuuuggugaaucugacaauuaugugucuuggaguugcucuucucgaggagaaucuuuguggcguucucuguauuuccugaaucugaacguuggccugccuugcuagauuggggaaguucuccuggauaauauccugcagaguguuuuccaacuugguuccauucuccacaucacuuucagguacaccaaucagacguagauuuggucuuuucacauagucccauauuucuuggaggcuuugcucauuucuuuuuauucuuuuuucucuaaacuucccuucucgcuucauuucauucauuucaucuuccauugcugauacccuuucuuccaguugaucgcaucggcuccugaggcuucugcauuccucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucgucaaaaucauucuccauccagcuuuguuccguugcuggugaggaacugcguuccuuuggaggaggagaggcgcucugcguuuuagaguuuccaguuuuucuguucuguuuuuuccccaucuuugugguuuuaucuacuuuuggucuuugaugauggugauguacagauggguuuucgguguagauguccuuucugguuguuaguuuuccuucuaacagacaggacccucagcugcaggucuguuggaauacccugccgugugaggugucagugugccccugcuggggggugccucccaguuaggcugcucgggggucaggggucagggacccacuugaggaggcagucugcccguucucagaucuccagcugcgugcugggagaaccacugcucucuucaaagcugucagacagggacacuuaagucugcagagguuacugcugucuuuuuguuugucugugcccugcccccagagguggagccuacagaggcaggcaggccuccuugagcuguggugggcuccacccaguucgagcuucccggcugcuuuguuuaccuaagcaagccugggcaauggcgggcgccccucccccagccucguugccgccuugcaguuugaucucagacugcugugcuagcaaucagcgagauuccgugggcguaggacccucucagccaggugugggauauagucucguggugcgccguuuuuuaagccggucugaaaaucgcaauauucgggugggagugacccgauuuuccaggugcguccgucaccccuuucuuugacucggaaagggaacucccugaccccuugcgcuucccaggugaggcaaugccucgcccugcuuaggcucgcgcacggugggcgcacacacuggccugcgcccacugucuggcacucccuagugagaugaacccgguaccucagauggaaaugcagaaaucacccgucuucugcgucgcucacgcugggagcuguagacuggagcuguuccuauucagccaucuuggcuccucccccgacuucuccauucuaaaucaguuucuuuuucuauucagagauagguuagaagaaaaaaaauaaaauagagucaucuaaccucuacuaugggagaguggcaaguugaagaauaaauuauggagccguucagacacaagccauucagacaugagcuuuuuauucuagagguguguguguguguguguguguguguguguguguguguguguguccuuucaaaaguuugagcuccacuggcuuucuuugguacuacccauugcagcaggauuguaggaauaaaagacaugcaagcaggacuccagguggggguaggggagauuagccuguaggaauuccaaauggaaaagguuguuuccaccugaucuuucaggagaauauauauugcuuauccuuuaauaacaaagagaaaguauggagcaaaaauugggggugagaaacauugcaguaaaaacaacaacaaaauagaauaaguuccaguguccuauacuacuguaaaguggcuucaguuaacaauaauauauaguuuuaaaaagcuggaaggaggauauugaacacucccaacaaaaggaaaugaugaauguuugagaugauggauaugcuaauuacucuaaucugaucacugcacauuauacguauugcaacaucacucuguaucccaugaauauguacaauuacuauuuauuaaagaaaaaauaaauuaaaaaaugaaaauuaagguuaaaaaauccuaguacaaggaaugagacuagauauuugucccugacuucaugacugggacagagaguaagaaagaaaauaaaaauauucacauuuugaaaaguuguuaagcuuuuagauaaauaugucaauacaguugacccuugaacaacauaaauuugaacugcauggauccacuuauacuuggauuuucuuccaccugugccaccgcuaagacagcaagaccaaccccuccccuuccuccuccuccucagccuacucaacgucaagaugacaaggaugaagauuuuuaugaugauccacuuccacuuaaugaagaguaaauacauuuucccuuacuuauaauuuucuuaauaaaauuuuauuuuuucuagcuuacuuuauuguaagaauacaguguauaauaccuauaacauacaaaauacauuuaaaucaacugcuuuuuacuggcaaggcuucuagucagcaguaggcuauuaauaguuaaguuuugggggagucagaaguuauaaaugaauuuucaacagugcaguguucagugcuaacucccacauugcucaagggucaauuauauuuugcaccccaaauggaaucuuguucuuagcacuagucaauacaaaguaacuaagugguaaguguaguagacacaauggcuccuuuccugugcucuucuccuccauguuagcaucccucucuucccuauugcagaaaaccaguaaauggaauacacguaaaaaagguaaugaacaguucucaacuaguuuuauaucuuauuuaucuuuacuaaagauauauaucuccguuuaaggcaacuuggggaaaaggugagugacauaagaggugcagugugccucauaccaccuauauuacuguuucagaagcagacugaugguaaaaaguaggggugacuguucugccccgaauaaauaauucaccugguuagauauuaaaaacuaaagucuaauuuaucugccucacccucaauuccuccuuccaucucucccuuccuuccuuuguuuuuuuuuuuuucccccauaaacuaagaacacacuggucauuuaauauauaaucugaagucacaaaggguaauaugcuauuaccauucucauggaauaccuagguuaaaacuauggaagaagaaugcaauagaaacuuuagguuuuacuauucuuaaauuagucuuucuauagcaaacacuaauauuuucauuuaccauuuuuauuagggaacaacuaauaaucauaauucucaggggagaacauguuuagcaaguuuugaauucaggaaacuucacuggacuaaucuaagcccuuuuguuauaguuuucaacaccuuuuguuccuuuguguauaauuagcaacuccuuugaaagcuugcaaauauuagcguucagccuugucauaaggacuauuaaugguugauagucuuuucccagaagugcauaagugaaaaagcugucgucuuuugauauagaaacuucauugcaagauuuaauuaccuaaguauaacacuuuuaaaccaaaccuucugccugcuuauuaaaagcauuucuauauauuacucaauuuauaguauaaagauauuuuugggaaaacacauuucauaaauuuccauacugauuauuaauacgccauuuguuuuguuaugaaaaauauccagguaaaccuagaacagauaacugucuaaagagaaaguuauaauacuuuaccaaauauuuggauaaaucauaauaaugcugauguguauaaucaaggaaaauuuauucucuaaaauauugaguacuucucuauucucuaauguuucugugcauauuaaauauuuuguucaaugugauuaaucaaugacuugucaaccauuuuccaagguuauuauauugccuccuuucagcuuuuauguauacacuucguguuuuuuaauucacccagauccucuuacuuacaguugcauugcuaauuuuauguuuuacuacagaaguuuaaaaaacagcuaacgugcgaauuuuccuuauaauaaaaacucuaaaaaacaaacaaacaaacaaacaaaaaacuaaacaaguagauguccugcaagaaacacugcugugugagucaagacuucuggagaauugcaagcuggcauucugcccacuuaugcaggguuucuuaauuuguucuacuauaaaauaaugugaguguucucucuagccauaaguaccucaaugguuugaaaugcagaaaguguaauuaaauuugaagcugaaaaggaagguaccuuggagaguccuggcucuuauuagcuuucaagcuagggacaaacagaugccacagaccauuugagggcuguuuguuggaugaugcuaauuguuuacugugcuuauuauucugugacauccuuagaaucacccagguggggagaugucagacuaaaguuaccaauaucugugcuaagaaaaacucaacacuucuauaguuuaaguccauuuuggucaaagcagaaggauucaaagccauucugagguuuaugaacaagauuaagaaagcaccuggcacugauuuuagcuuguaaaaguggaacccucagaaauuauuucagauuauuucauacaccuagaaaaaauauauagagaaagguguuuacaagaagaaauaagaucaaaaacaaguacagccuuuguccaugugaauuuaaagcaacuagcaggcaacugcuuugauuuauuugaugcaauugccuguugauagguuuuuuugucucauucugaagaaucauuaaacuaccuuuuuuaguguaacuuuucuucauguacuugauucaugaaaguggcaagugugucaucuaguucucaauuucccgcaugccaaauacagguuuugguauaccacagauguuuaaugagaaauuuguuucuuacugggaauaaaggugcauaugauauuugaguuuaaguuagaugaauuuuaagacaucccuucaauuuucaaauucuguaauuuuaauaauuugugcauuugcuuuuguuggucuaucaaauaauaaaauuagcaguugagaagcuuuguaaaccaaucaaaugaacuaauauuugaaugaucuacauguacagugauaauuaaggaaugaauuuagacuguggaugagucuguguguauggauggggguauggucuagucacaaugaaugauauauggcuugcagaacaauggaagugccuugaacaauguucauaucccacccaagaagugaggcaaaauaucacucuugaaauaaaggaaaaaaaacaaacacaauuaacugcuuacaacccaaguggaggaaacaauaaccaauuaaacacaguguuaggaaagagauggaguaaggagggaaugagcugaacugcuuucaguagacuuuaaagggcacccuggagaaaaugaccaauuugauuucauugaucugagaaaagcauaaagguaggaugguguuaugguuaaggauacaaaagagucauaauaucuaggaaaguaaaaaaaaaauguuaauaaggcuguaguuaacucuuccauuuauucauaucagaaauuuugucuuguuuaaauauuuucguuucuaacaacaaugacaauugguguuuugaaugguuuucaagcugagucaauauuaacuuuaagaaaauagcuccuuuagacagaaaaccaaacaccacauguucucacucaugggugggaauugaacaaugagaacacuuggauacaggauggggaacaucacacaccagggccugucgugggguggggggaggggggagggauagccuuaggagaaauaccuaauguaaaugaugaguuaaugggugcagcacaccaacacggcgcauguauacauauguaacaaaccugcacguugugcacauguacccuagaacuuaaaguauaauaauaaaaaaagaaaauagcuccuuuaauuucucaugaaaaaguauauuuuaguguaauaaucuguaauuaucacuauauuagacucuaucucuucucaaauggucgaauuuuuguguucaauuauuuaucuguaacauaacuucuuguugagcaaaaaaaucagggcuuuuauuuuucuauuuauuuaacaaagcuucuaaaauuagccaacaugauagcauaucaaacaacgguggaaguuugauguauauaaugauuauauaguaaaucagguauuucaaucuagaggaaauuauugaagucauuuuauuauuguauauaauguauaacauuauagaauuaagguggcaguuuuauggucugaauggaauguaauagaggaaauauauuuuauaaugaauaaaucuuauaauagugguauugaugagcaagcuaauguguauaauuuacaaucguugaagcaaugcuuuguuagaagaaacugaggccccaaaagauuuauacuuuauggccaaacagcaauaaaguggaaauuauacuuuguaaauuuacauauauugaauugaguuaaguaaaaguaaauauuguggcaauaaacaaaugguugcaaaggaucauuuuaaauaccuaccccaugccagguauuuuacauauauuuucucccaucuguacaaccuucaaaguagguaacaugacucucaaaugaaauagcagagcuucagaaggcaaaggaaauuacucauaaucacauagccaguaaaugguaggaaaaguaucuguguaaacuccuccacauauagacugagaacuacugaaauuaaauccuugggaagaccucaacaugcuuuuuuuuuuuuuuuucugaagacgaugaagauuuuuuaguagguagugcugauaaucuguuaucacgaguacuggguggugagaaaacagggauacuaaagauaggucccuuuuaagccuuauuaaauuucacagugucuguuuaauuuuuaaggaacuaaaaauuuuacacauuguguuugcaagacagucagccaugaaagauucaguguucuuaugggaaacauucucuuccuuaaaugaaaaaauaaauuuucuguuaacucucuugaaaggucuucuaauugaggaaguccauucuucccucaaaccacgugggcaguucccauuaauaauaaagcccuuaggggaaagauaacucccuaagaugcuauaaaaugcccaaacaggaugaaaucuucugccaacguuuauacugacuuugaguuuugauauaaguaacucacugggccuuccgcaggacugaggaaaauuuuaucagcaguuauacaacuaacugaauuaaauggaauggagcaaauguaaaagucaacaaauuuaaauugcaccuucuaacuacaaagcaaguuucgcgucuguuuauuuagaugacaguccauuuuggugccaugcuauaggauucaggagccuagaaaugugagauaacagcacucuugaauuucacaggaaggcaacauguuuggaagagaauauucccaaacuguauuaauaugaaaacaucugucaguuacagauuaauuuucuucacagauuuucuaccuuuggaaacaucugcagcugaaauguauuucucuaaaauguagauuacagaggucaaccaguuuaucaaccauucuaagaacuggcugcuuuuuacaguacacagauguagcugaaauagcaagauuaagugcauacccuuaaaaccacaagcaaaaagcaguugguuaaagaggaaagacauucagaaagaauauauuaugccuaaaauaauucaguuggaaacucacuuguggucugccacaugauuacaauaggggaaagucaugugauacucauauucaggaaacauuuacagcaaucuucuuuccuauguacauuuucauaguuaagacuuuuuucuucaaauuuaacagucaauaaucaaaugaaaacaaauugagcaaauguaccuugcagaaucuuuauuuaaaaugguuuacauauaaauuuuggcuuaaauacucuguauuuuaaaauaggcacaauaacagauaaguuaggaaaauguagauguagaaaucugugcaaaagccuaauugaguugaaccuugccaaacaaugaacaauuacaauuuauuuuaaacugagauuucagacucuuuagggagcucgcacacaagugucaaaagguuuggugauguuacugguacauaaggaaaaaccuaucaauauuguucuuauuaaaagcugaauuugcuacgaagcagagaguauccucuucuaauuaucauucuccuuuuucuucuguuuucuuucugcaucagacacuuacugucucagaaaaaagucagucauaaaacauuuauauauuuaggguccuaugaucuguguaauuucuagaagaguuuccuuuaagcucgaaacauacuguacuguaggaaggauuuugacugaacacaacuuucuugagaauccuguguagguaaaaagugggagggagauaccaagguaagaugagucaauaaaauaaauugcuuuuauauaaaagcauauacaccacccaucuuuugccauuuugaguauuugccauuauuauuacauuuauugaauauguugccuaucauucucgugaaacuucaaaaagccaaauuucacgucagaaaucgagucuaaauauuaaucaauauucaugauuaaauauuaaccuccuauccccuguauauuccauauuguggcuaguaaaugugagcucuaaaaaaaugcucauagcuauaagcauagagcuuuggucgaaagcucuuacucuuuuuugaggaguggcauuuauggguagaaagagaaauaugcauacagucagaauugaaggcaguagguuaucuugguaggaagcugcaaauucguauuuugccagaugguaaaagaguacuuugaaaagcuucauugaaacugcaagguuuucuaucuauguugaaguguuuggaguucauuucaaaggaguuaaaaaaaauaaauguuuccaaaaagaaaauucauccagaaccaaaggugucuuaaauuugaacagagagcaacaaauuaaaaauccacaaagaaucuuuguuccugcuaacacuggcuuucauauauucuuagaggaauuauuugguuaaguaauugggggcaucaaaauuuugucucucgaaauauacuuuuuacuguauaaaaauauucuuuuaauccuaagaguauaguaaaauuguacuuuaugaugccaccaugcuucuuugaaauaugaguaauaaaucuaauauauaggaaggauauaaauaaaauauuuaaauuauaggccucucugcaauaaaauuguuauuuuuuauugugaaaaaccuauccucaaaacuuuccaccaugaugccuggggcauuuugaaauauaaggccuuaaauaucucuccauuaugaaaucugaaaguuuaaaguuaacauacuucugaaaauauuacuggaaaggaaaucgauuuuagauuauuagcuaucuugguaguuuaaaaauauuucaugacaagaaauacuaagguuaacauauuggacugcuaugaaaagauaugucuuacuauagaacucauaugaaagcuucaauuucugaaguaagaguuggaaauaacuucuucauacugagguuuacauuagcugguuuaauguuucuaaauugggccaucagaagggucuuaguccuuuuacacuuuguaaauagaucuugaauuucaaaaaaacuaaguaucauuuaguguuccaucugaacauagaggaaaaaaauuauucaguccuaagaaauguugugaaugccauguuaaaaaccuggcauuucuaagauuuuugugaaaugcuuuagugaagagcaagaaaguuauguuguuuuucauagagaaaaaaauuaucuguaauguaugggugaacuagaacuuuuuugcauguuuagaggucuuaacaaacucuugaucaagggaguucauuguguaauuaucaucacauauuuaaucugcuuuccaccuaaauuaucaguaguagggucaacagcaaaguccacauuuccaaaaauaugugguugauuugccucccuaaaaguaacugggcuugagccacuaugcuggcauguauuguuuucuugaaggcaaccuuaguuuuuaaaaaguauuaucuuguuuuaaauaacaaauuaucugcaggccacuaauccauuuccuuuuaguuuucuucuuauauugaugaauagggguggggaguagcaucuuuuauccucaauuugguccuuagccucaauucuaaggcacaaacaaaaagaaauaucucucccuaugcaugauccuuuacacauuuguauaauuuuuuuugauggcaaauagauaggguuuucaugcauuauccuuguugcuauuuuuuuuuuuuuucgagacagaguuucacucuuguuucccaggcuggagugcaauggcgcgaucucagcucaccacaaccucugccucccggguucaagugauucuccugccucagccuucugaguagcugagauuacaggcaugcaccaccaccccuggcuaauuuuauauuuuuaguagagacgggguuucucuauguuggucaggcugguccuuguugcuauuuuuaagcuuucagcuuugugaucuacaucucauacacugcaaucugggaacaguuauuuauuucaucaacccagauauaucacuuauuaaagaaauuuaccgauagauauuauauagcucuauguuucuuuuuauuguccccacacuaguauggcuaagaccaagaugacacauaggugcauaacaaauauuuuaaauacuuguugacuuuguagaguuguuagcuccuugauuugguuuuuggucaugguaacugcaacuauuucaugucuucugagauaccaugcauaucagaaugauuuccagcuauuuauuauuuuucauaauggugacaaauacauuuaauuaaaacuauauauuuuuaugaugaaaaauaguuuuucaaaguaaaaugaaauaauuugauuuuguuguuacaaacauuauugcagagcagaaguuuucagugucgcugaaccagcaauaacaacauuccugagaacuuguuaacaaugcaaaaauauuggaguccacaccagacuauaaauaagacacucuauggguggggcccagcauucuguuuuaacaggcccuucaggugauucuaauuaaugccaaaguguaagaaucacugcugggaaagauaaugaaagcacuuaauucagagauggauaaucuuuucuaaaaaauuacaugagagaagcaaauuuauacagguauguuguaauaaaacuugcaaaaaaagguuaaggaauauauugagcacugaaauuggccagauuugauuugauauuauuuauugauuucagauuacucaaagauuuucccuccacucaccauacaaauauaaaauaguaagagucggcauuuuccaauguuugaaauuauuaccaggagaggaugauuuugaagucauuucuaacuuuaguuaggaagaccaaagacaauaaaucauuauccugauaucacuaaaugaagucuaaaugaaguucaggccaugacaggccaugguauauuuuacuguaauccuuaaauuauaauauaaaauuuacaagaucaccuccaucaaggacuaagcauucagaccuuagaacugggguagcucaacaaaauguucacauuuuugagauauggacagcugcaguagaaaaugaacugaaagcaauuuuuuauuguuuucaucuuauaaaauaauguguauuuauuauaaaauguauaaauaauacaauuaaaaccacagcuaauuuuacucuuugucuauucuauuuuuuaucaauggcaguauauuuuugucccccaaaaauucauacguuaaaguccuaaccuucaguaccucaggauguaacuguauuuucgagacaccaucuuuaaaaagauaauuacgguuagaucaugagagugggucauaguccaguaagacugguguucuuauuagaggaggaaaucaggucagacacaaacacagagggaagaauaugugaagacagaggaagaagguggcuaucuacaagccaaggagggagcccucagaagaaaccaaaccugcccacgccuugaucucagacuuccacccuucagaacuaugaaaaaaauaaauuucuguuguuuaagucacccaguacaugcaacuuuguuauggcaacucuagccaacuacuaauagucccuauagauuauuauagcuacuccuucuucuaaggccauacaugacuaguucugguucccugguagauuuuucuccagauggagcugccugccuuacucucagacccuuuuuuuguuuuuuuuuuguuuuguuuuguuuuugucgugcuaccuaccuuugcuuugaaugcucuuugauccuuugcucccacucgcaacccucacauuuuaccuccuaaucuguacagucuuuguugcucaaguuuuacauuuuauuuccauccacacuauuacugcuauuuuuuuuuuaacuacugcaaacaucauccuauagguaauacuuucucuaaguaucuucuaauucugacccagucuccaaaauucagguagcaugggaauucuaaaacagaggucugauuuaucucauucgaucacucauccuuccuaauuuagaguuuaguuuagaagcaauguuuauccaucagugaacauauuaugauuccaaaugcccuaauaugggaucauaauauaaaaaacuucaguuucuuccacucccugacaugcuacauauaugcucaggcaauuccaaucuaugaguuuuccucuccaacugaaagaauucacuuaauacuguuaacacuuaauaguggacuaauuuauuuccuuccuucuuuccuuccuuccuuccuuccuucuuuccuuccuuccuuccuugccucccucccauccuuccuuccuuccuucuccucucucucugucuccucucucucucucuucuuucuuccuuucuuuuucagacagggucucacucuaucgcccaggcuagagugugguggcuucaucauggcuuacugcaaccucaaccuaagugauccuccugacugagccccuagauuagcugggacuaccagagcgugcaaccaugaccagauaauuuuuguauauauuuguaguggagacaguguuuugccauguugccuaggcuugucuugaacuccugagcacaagugauccaccuuccugggccucccaaauugccuauguuucuuauauuguuagcuuagaaucauggaauuagcacauuauagaacuauacuggacuuuuccgaagaaaaauauucuauaauauauacaagaacuauguguuuuuuagaguuaauauguuaaaaaauuuaagacugcccucccaaaggaaguccgagcuccucgucuucauuagcuuaaaaaauugacaaccauagauaguaccaauuucaguggagaagcagaguacagaagcugaguggaggagagauuaagacuaaauaagaaaaauaacguuuggaaguauaacuuuagguuuauuugaugggaaacagcucagguuuaagaacaaccccaugaagauuguauauaauggucuaucuucaucgagccuuuccauuuuuuccuucugacuuugaauagaaacagacaaagagacaauacucaagcgaagagucauuuuccagagaaggauccuaguuagcuuggauauuugaguacauucuuuauuaaaaucuugaggcuuaguguuucaaguaguuaagcaggaccucugaaauacagauguuuucagucucuaggaucuaaaaccaggacugaaacauuccauuguucagguuguuugcugcacagggaugccuggcugaaagaguaagguaacaucuuaaaucuagcccguaucugcacaucaaacuguaauuucuaucacugagcugcaccuuuucuaauucacaugaagacuuuuuuaacaguuucagcaucccuguuaaaggcaaggcuucaacugcccugauuaucaaaugccacugcuacugacaacaugaaucggcuaaauuccaaagacucagaaugaccagauaucugcuuuuacagagagaaguaggaucauucuguacccaaguuauaaguuuuaguuuaagacauuuguauuaaucagagaccuacuuuccagcacaauuaaagcaaauaaacacuucagagagaaaauggacaaauugggcccaggauuuauuuuucuugaaacucauaaaauuguauguacaagauuggcauuuuuaaagguguaucauuuuauuuauauuugcauuugugauguaauauaaguauacuuuuauagaaacgaaaaacuuggccaggcacaguggcugaaacuuguaaccccagcacuuugaaaggcugagaugggcugauugcuugagccuaggauuuugagaccagccugggcaacauggcaaaaucccaucucuagaaaaaauuuaaaaauauuagccagguguaguggugaacaucuaucgucccagcuacucaggaggcugagggaggaggauugauugagccugggauguuugaagcugcaaugaaucaugauuauguuacugcauuccagccugggugauagagcaagacccugucucaaaaagaaaagaaaaagaaaaagaaaaacuugcuguggaaaccgaaaaguuuccucagcaaucaauauccacagaacauugacuugugauaucaugauacuaagugaaaaucaagucuuaguguaaacuaucuuuuauuugaagauacuugaacaucuaaggaugcuaaacacaucuaagaaucaggccuggcuucaacccacuucagugaaagcaaauucacauccuaacugcuuuucagagcaggcuaauaauaauguaaggcugggauauuuaaaaagcaggcauuaauaauagagaagaagauacaccauaaaguagaaaacccaggugauguugcuuuguagguaugagaaugaauggcuguggaaguuugcaguugaagaagauagagacccacaaaccuugcuagacagggagagaaaauaagaaguuguguuguugagucugaagauaauauguaccauuacuauuuuacaacuaaaaauaagaaugcauuuuuauuuuauguccuaccuugcaaauuacuccuaaauacaguguucgauucuucuauuuuucuucauuaaugauaaugcacuuucauagagugcuuugagauccuuagauaaaagguacuaagugcaaauuaaugucaucuaaaagcugucuuaauaacuucauaagcaagaguggaauggcuuccaauuuaauucuaaauagguguaaaucauuucacaugaagaaccaagugaauuaauugcagaagaauaguucagcaugcaccaaaccuauuaggauacuugaacacagcugcaacucagaggauaaacuagauuagaauacuguuuguagaaaauagcaaaucgaagcacucuuucaggcaauuaacaaaaucagagcauccuuugaagcaaauaagcaugaaaaaugccuuucuuacucugauuuuuccaaaugccuaauuuugcuacugucuugaguaucuuggauuauguucaaagcccaacacaacagaguuucugucauacagaugagauuuuguuuugaugugaacuauucaaccacauccaaaugcucauuuucaacuauagcaaugaugaaugugaacuauuacaguaacacccacuacagcuugacucacugguggcauuacccaucauagucuacuaacguuuuuccauuuauuuggaaagaaggagagaugugaguaaaucgagaggaaaacuagaaaaaguuacuaacaacaauaaagugugaauauucuagcauauuugcacauagauuauuuagagugcacaauguuuuuaugugcauuauuuuaauuuuguauaauaaugcuaugaauuagggaagaugucauuuuccuaucuuuuaaagagaggaaagaauacuuuauauacauuaacugguccagggucauauaacgagccaguugcaggucaggaacuuaaccuaauauuuuuauuccaaaacauuuucacuaucccaugccacaauaaaauuucuccuuuuaaacauuuuguuuuguuaaccaauauuuuagcuacuucacacugcaaaacaagccuuagagauaauguucuuucauggacuuuauauauuuaauauauguauuuauauauuuacauauguuuuccaaacccaaaacucaaauuacuuugcaaauauaaauguuauucauguagauaaaugaacuuuucuauuagaaucaaacaaaaaccucaaaauacucuauuugucuuuuuuuuuuuuuuuuuuuuugcuacaucuuuagggauucaauuucaacauaccucccaauuucuaccguuuuccaguuuaggaauugagugguagagcaagaaauaguaugucugagucauaaaauauaggucauuuuguuuuugagugugaaacaucgguuaagucuaaggguaguguggguuccgcuaacuuccuaugccauuuucaguaggaaaaauaaacaagaaaugaaguaaaaagagagagaacaacaauguccacauggcaacaaacaagaaagaguguuuucaguaauguuggcuacuguaccaucaaaaucuuaacuucaauaaauuguugccuacuucuuuuggguuucacacaaacugcucuucucagcaguauggccagcagcauauuauuggaauuugaaaugaauccaaccuuuaucugucaaaaugugcuaaacuauaugguggucuuaagacacuguuaauuuucugugacuucaaauaaccaaguuuuauuucuugcucauguugcauguccaacguggugaauagaggcgcuuugcucaugauggucacugagagaugcaggcugacagagaagccacauuaugcuuugcuggagggaaaagggagagcacuuuagaagcucuccaccuaaacagggaguggcacacaucacuucuguucacaacacuuccuugcccauaauaccuccagggccccuuguaacuggcuugucacagaaauacgcggugaacagaguuaacgucuacaacacaauacuacuccuuuaauuccuagaauagucuauagaaccaugucuuagaaaaccuaaaacuaaagacuggaaguuaguucagcaaaaugugucaaaaccaccucagaaaaucauagucuaccacuuagguguacuuagagggaaacaucauugucuuccugcauguaacaccucuucaaagcaaguuuuagacaguauuuaaucauaauauuaucauaagguuaauuuagaaacuuuuaagcaauugaauggacuauaguuguucaccaauuuuaugacaucuccuauguugucaucauuuauuuuuauuccauuguauuauuuagcuggccagaguacuaaauuuuauagauugcacagccuaaaaguccaagguuggucugcugaaaguauuugauucuaugcaaacaauauuaagaggagcucugugaauaauacuucccauaauucuucuuagaaaggauaaauugauauuucaguuaaucucaaauagaaauugauuguuuguguucaaguuacuggaagcugcaauucaugaaugagcucugauagaaaaaaggacccuagguagauaguacagagaguuaaguuucuucugaaacaaauaaaaaaacaauauaucugugccucaauaaaaacuaucuuguugacaguaaagaaggugaaaacaauuugauuuaaacuuucaauaccuguuucagaaucaauuugucuagugcagaucagcuuaacuugucauguauugauaugccaagauaaagcaugcuguuuaaugaguaacaacaaauguacaagguguauaggauguaugcaacugacagggcugcuuaauauacauuuugagcuugcaaugaacauuaagugaccaccacaacugggaugccgcaugaaaaaguggcucgaaaugacucuuuuguuuacuuuucucaugauauuuaaaauggugugauaagaggugaccugacaagacaauauuauccugaaacauuguaguccacacaaaaagucuacuagaaaugcuauucuaucgauuuugaaucugaagaacuauuggaauuucagagaugagacuuuccaaaaugacuaggucacuugcuucugagaucaccccuagagcuaugucuuuuuacaucucagccuaauaugucaccugcauuaguaagccuacauaaguguuucuuuacaagauauauucugcacucccaagucacugaaacguugaugauaaauagggaguuugauauucuuaacacacgauggagaacaaucucaaagacagagaagaacuucugcucggcuccccuucuuaauguaauccugcaauagaauuuaacuuccauuaggcuugcuucucacaguucucuuauccccagguauucguaugaaagcugagauucuuacaaagaaaguauucuagccuucagggugaauuuucaaaacucugcuaaggcaaggcacauacaaaaucuugcaguuuauugcauuuuggguguauguuggcucugcaguguuuugaacauucaccccuucagguuagcacauucaugaaaacaacaucucaugagugugauaugaacucaaauuugagcacacagauuugaaugaauaaaaagacacuuacagagccagauaauggucacauucauaggucugugauuuuucaaccuagcccuaggccaacauaauuucacacaguguaacagaaugaauaauaaaaguauuacuuaaucuuuaauauauuacaauaccaaauucuggaauuaggaauaugagucagcuauacuuaacugcacuccccaccugcaagcuguaauuguagugcaaguaaaguauaaauuuaauacaggccaguuuuuuaaugucauccaccaauuucuaauuuuuaagauguuuuucuuugagcaauggucauuuuuucaaacuacuaucuguuacuucaucaauauccaggaagagcccacugaucauuucuauaacuauaaauugcauacccuaacguaauuaugcguuaauuauuuuaauuccuuagauaaaaaauaauagauauuucaaaaacuauagcuuuuuguagcaggucuuugucaauacuacauucuaauaucugaaaauguuuaaagcaagugauuugguuugacuguccuaauacuugcaggauacucaauuuauaaacacuucauaaaagcuauccaggcugggcaugguggcucacgccuguaauccuagcacuuugggagaccgaggugggcagaucaccugaggucaggaguucaagaccagccuggccaacacggcgaaaccccgucucuacuaaaaauacaaaaauuagccagcugugguggcccgcgccuguaaucccagcuacuugggaggcugaggcuggaaaaucacaugaacccgggagguggagguugcagugagccaaagucaugccacugcacuccagccugggugacagagggagacucugucaaaaaaaaaaaaaaaagaaagaaagaaaagcuauccaaacauguuuaagcaacucauuacuauauauuaagaccacuguuaaauaucacagaucaucauaaaaauguuaguauuuuccguauuaagugaaagugaaaaauaagaagucaaaauaauaauuauucuuuagagcaauuauuuucuuuugacuugaauauauacuccauaugauuguuacuauguuuuaauauuuaucuauacaaauauuguuugggaaaauuuccaacuucuacucuguuuagcuacuuuuuccauaauaugcuauuaccucaaaauaacaagccuuguguagcacuguuaaccuuaucuagcaaucaguauccaucacauuaaauaaaugugagacuaauugcauuucccuuauggacuaucugucuguuuuccagaauuuugguaagguaaucacuuuucccuccuacauuuuuuauucagauuuauuuuuaaccuuauagcuguauuuuaguauuuuuggcuauuucacaauuauucauuuauuuuuucaucauaguauagcuuuaauuuauaggcucacuauauuugucuauauuuaucaguuuagcucucuauauaaucaaaguuuugaggacuuguauuaguugacuuaaauaacucauuuacuuaauuucaucuagaauuccuuccucuaaucuauucauccauuuagcaaauauuuaccuaacaacagauuuaauccagguaguugguauuaaauauuaaucuaugaauaagucaugaaaggauucugccuucacagaaaauaaacagguaaaagaugcagaugaacaaauuauaguuuuugguguaguguaggaaacacagagcauguuugagaucacucaggagguguuccuaacuaggauuuggaauugaugauguauuccuaggagaaauugaggucauuguaaaucaugaagguugaagaggaaagagccugaugaagggccuguuuuccaguauguacauacauauuggggguaaggcguauuugaggggaaaguggugagagggagaaggugggaagugggaaggggagagagaguauuaggucagugagagaggaagagaguauuaggucagugagagaggaaagaaggaauauaaagugcagacauaagugagaggaaggaguagaaguguguuucagaaauaggauauagcuuucaauacacuagaagcaguuugauaugauuaagauauuagaaaacaccuagaaagauaguugguaacagaaagugcauuuuccaugaaguaauuaaaguuaaacuucaggggcccuuuuuuguaugaacagcuugcaaguuccuggaagugacuuuagcaaaguauuuauauaauauaaauccauguauguauguauguauguauguauguauguauguauguauguauucugucuaucuaucuaucuaucuaucuaucuaucuucuaucaucuaucuauuuaauuuaagguaagguauguuaacucauuuguuuaagauggcuauuucuuucuaugauuucccuuguguuagaagacauuggaauggccacuuaaaaggaaauugauuugggaauucauuugauugagauuuagugggauuuuuaaauguaauucauuuguuuccauguauuguaguuacuuucaguuauugccaugagaauauuuuccaggaauauugugcuaaguaaugaggaguagcagauuuaaaaaacacgcuggagagauuuauauuucuugcugauuagacaugguauacugacauugacaaagauuauauaaaacguguaugugccacuaaaaggaagacauugaccaaaaaguguuuaaugguguccucaauucaaagagcaaagacuugauaucaaacaggucauaucugauagaaaauuaauacagcuuuuuccaaaauugauaauaauccuaaaauaguuucuggacaaaaucaaugaugaauuggugugcuguaauauauuuccaaaacuaacaauaauaaaauuaaauuugaacaguguugcuaagagaaaagggaacauaaucuuuauauucuuucuauagaaaaugacauuaugaaguaacuaucauguuaagaggcaaagaauaccuaguuacuucauagaaaauaaauauuguagaggugguugagccaguuaauuaauaauaaacaugauacaauauuuuggauuuuuuacauuucugauauuggucaaauuuuaaaauuuuguauaugauuuuggucaggagucuauuucauaguacggcaauucuaaucauaacagucuuaguugacauaucagucucucaaacaccaaaagagaagcuuaccccuuaaucaauuugaccaaauuuuuaaauauuguaagacaacuguuaaauaucuuuuuaguauuuauuucuguaauguaaacaaccccaauuccuccauuauuugcuacacagcauaauaaugaaacaauuuugauuaaugcuauccauuccaguagauuugaauccccucguccccucccucgacggagucucacucuuucgcccaggguggcgguucaguggcauaaugucgacucacugcaaccuccaccuccuggguucaagcaauucuccugccuuagccuccugaguagcugggauuauaggcacgggccaccacaccuggcuauuuuuuguauuuuuaguagagauagaguuucaccauguugaccaggcugguuucaaacuccugaccucaagucucaaacuccugaccucaagugauccgcccaccucagccucccaaagugccgggauuacaggcgugagccacaguacccggccaggauaauguaucuuucuuuucaguauuuucccuuucaaaggcacaauaauauucguacuuauaugauaaucuuuaugccucacaaaugacuuucuucuacacuguugcauuuaaucacaauaacaaaaaggaaguagggacauucccacuuuucagagauaaaaacugcaguuuggagagguuagguaacuuaauaaauucauagcuuuugauguagaaccuuucuuaucuucugacacugcauucagagagcgucacauuauacuaucacuucuuaccacguuuauuuauaaaacauacaacagcuguuaagauaugcuagguuuucccuuauaaauauuauuuacugaccauaaaaccaacuacaagcuaaacauaaaaguuacccuguccucucagaaucuauaacuaccaguaauguugauggaauuacuacacaguggcauauuuaaaggaucaaaauauugggaaaaauuuuugcugaaacaauuuaauaucacagucauuuuaauuaaaaugugaaaaacuuuguaaggucagauauuuacgucauuauuuaaaguacaguuuacauuauucaaaauagcuauugccuuuuaucauuuuuugaauauugaaaugcugaaagaauuaaaugguugggaaagugucuggucuucauuauuauuugauuagccuauucuuacugacauuauaauggauuaauaugauauguuauggaacauuaugucaaaaacaauuccaauacuuccucugaaaccagaauuucuuuugcuaaauugcuaauggucuacuuaggagauauuuuacuguucuucuuguguuucuuaguuguaauuauucaauuagagauuuuuaaauuauucaaguaguuuuuuuguaacccaagaaagaguucuauggacauuuuacuugccuuuuuucuuuccucauuauuauuuccuuuaaguaaagggaaaggugucuuuuguuacaggcuuuuuuuguguuuguuuauauaguugaaaggaaagguauuucaaaccagaauugggaaaauuauaguauacuuuaaauguuggcaguuugaaaauaacauaaucaacacagaagaacaauggacuauaauaauguuauucauaagacaugucuaagauguauaugucuuuguuuaauacaggaaacagaacccacucaagauauuuuaaauacaaauagauuuuuuuauuagcaaggauaguucuuuauugcuaugugugagacacaaauuggaaacaagaaaagcauauguaaaauauuaauaugauauucauagaaugcaauggcauucuacucuuuuuuaauauacuuaaguucugggauacaugugcagaacgugcagguuuguuagauagguauacauguuccaugguaguuugcuguacccaucaacccuucaucuacauuaaguauuucuccuaaugcuaucccuccccuaguccuccacacccugacaggccccagugugugauguuccccucccuguguccauguguucuuauuguucagcucccacauuguucagcucccacuuaugagugagaacaggcgguguuugguuuucuguuccugcauuaguuugcugagaaugaugauuuccagccucauccaugucccugcaaaggacaugaacucauccuuuuuuaugacugcguaguauuccaugguguauaagugccgcauuuucuuuaucaagucuaucauugaugggcauuuugguugguuccaagucuuuacuguugugaacagugcugcaauauacauacgugugcaugugccuaaccaaauagauuuuuauacagggaauuagaugcuuacacaauuguuagaaaagcucuacugaagaccuucagguauggcuaagaaaauauuucagauaugaucuacuuuauagcuaaauaaauaagauggcaaucaggaggccacugggaaguucuaaucauuuuauccuuacuacugauuucuguauuuuauucagcaugugaucucaccuugaacuucuuuucauugaaaaacuuguuagaaacuguccucucuaaaaacugccucaaugaacuguucuuaguguguaccucucuucuuucaaaauagccuauacauucccuuucuucuucaugugugccuaaaucagaaaccugaaaggacaguuuuuuguuucucauaugauauucaacuugcuguauaaagccaugugcaucuacagcauuguauaaauaaugaauaauaauauuuauguccuucaggggaauacugagaacuuuucugcuuuaauugaguucuucuguuuguguuuuugauguuuuauuuaccgugugcuuauuggaaggauuuuucuauuuauuguugugguuccuguucuauuuuggcccuggaaauagcuccugucuuguguugcccuuuucuuuggaauuuuguuuaauuucugucagaugaaggugcuuugaaggcugcagggcccuuaaugucaauaaauuaaggauauaaaaaaugccaucugccaccuuuucaccuacuauacaacauuuaucaauguaucaggaaaaauuacuuuagucacaauucuuuuacagagaaauuuauuuucuuguuuuucucugaugaccuucuaauuuuuagguguaaucagauugcagugaagccaguaaauuacacaugcuauuauuaaguuuaaacucuagccacugcuagaccauucauaucaugggacauugucuguugagauuaagcagggagcaggacaaaccuuccuuacaggguucaucagugaccaagaacugcaugccugugugcuccacaguggaauaagcuguacagucuuaacaacugcagaucacuuagcaugagugauaccaagaggugguaccaugaaaccuguggacccaggcgaccucucccuaagacggcccccugacaaccauguggggaauucaccaaugaguacuucccaucaucucuaagggagaaaauauaauuuacugccaccuaaacaaauuuucuagucacagagaugugacauaguauaugaauucugaugugugacuuugggcaauuugcuuacuuuggugaguuucaguuuuuuuaaaucuauaaagcaugaaaaaauaccaacuuaaaauguuguggaaagauucaauaagauaacauguauaaacuaauuaacaccuagugaauguuaagaaaugauauuuuaauauucuauuaauaagggacaguccucuuguucauuauguauaaucaacacguugggugguugccagaccacucaaaauuauauucccuaaggcgcucaggaacacuaguacugucuauucccaaaugaggaggagccaucugcuuuugaaacuuaauaacuguguguaggaacuguaaucgaaacaaagagaaguaaguccaguauuaaugcuucuaauuacuuguguauucacauauuucuuuuucuucaucuuuuauuuaaaguuccaggguacguguucaggauaugcaguuuuguuacauagguaaacaugugccauggugguuuggggcacagaucaacccaucaccuagguauuaagcccagcacccauuagcuauucuuccugauguucuuccuucccacaacucccccaauaggucccaguguguguuguuccccuuucuauguccauguguucucaucagucaucucccacuuauaugaggaccuguaguguuucuucuucuguuccugcauuaguuugcugauaauaauggcuuccagcuccauccaugucccugcagaggacaugaucuuguuccuuuacguggcugcauaguauuccaugguguauauguaccaaauuuucuuuauccagucuaucauugaugggcauuuggagugauuccaugucuuugcuguugugaauaaugcugcaaugaacauaugcaugcaugugucuuuauaacagaaugguucauauuccuuuggguauauaugcagucaugagauggcuggaaugaaugguauuucugcuccuagguccuugaggaaucaccauacucucuucuacaaugguugaauuaauuuacauucccaccaacaguguaaaagcauuccuuuuucuuugcaaccuugccagcauuuguuguuucuugacuuuuuaauaaucagcauucugacuggugugagauaguaucucauugugguuuugauaugcauuuuucuaaugaucagugacguugaccuucuuuucauauguguguuggcugcaugaaugucuucuuuugagaaucgucuguucaugccuuugcccacuuuuuaaugguguuguuuguuuuuuuguuauaaauuuguuuaagucccuuguaaacucuggauauuagcccucaaauguauuuuugauggcauaugauguacccagcauugcacuagaaaauauauacuccuccuuuagagccagagaaauauaucaguaaauuaauuuugaugcaauaaaaucuagaguaagagacaauacacagaauggagaggaaagccaccaacuccuuaauacaaaugcagagcaaaggaacuuauaggcaaugccaagauuuaccucaggaagcaauugugauguuuuuguaauaucuaauaguccagaacagauuuggguaagagaugucuagggaaacagggagugagugagguaguuaucuuaugauguuuuugaaaaugggcgagugaugacauuauuagaaauggcaaugggaugauaacuugagaacagcuuuguaagaaaaaguguuaggagugucagcuauggggucagaaaaccuagguucacuucccuuuuuugacccuuuuuaguuauguccuuaauuucuuuuuguucaaauuucgucuucuaauaaacuugccagcauguugugaagauuaaagaguuuguuuuuaaugauaggaagaucucccuauaauaagcauucagaaagaugauuacuauucacauuggaagaaaagaaaaacaauauggauuacauauaauuuaggaaaaauacacagaaaauguaaacaaauucucuaacacauuaagaaauauugugucuucugucacacauaaugaaaucauuucuucagauuuucacuccugugugugcaaaaaguauauaauguccuugaagagauggugugauuuuuuuuaaaugucuccuggcaggggccaccucaucuaaauacaugguuuuucuuuucuuacagugaaaucuguuucauucuguucuacuguguugaguaagaccucuuaaaugguuaaaaagaaaaauggaaacagugauaauuacucacuaacuugaauuaaugugacugcauuaugcuccuaauaacuguaguuuacucaugucuccccuguaauaauccaaaauuaauuucauuuuaugcuugcgaauaaucaguuuauuuauaaagguuagccaucuuucuuagcacaaguuauuccuuucucauuacuuacugaauugugcuaaugaacccaaggcuggagaugcaugcagauuuauuucucaugcauucuuugguguugaagaagcugcaugagaaagaaauaagucugaagacaacugcauuuugggucuaggaaucugauucuagucuuaguuguuugcagugcauauaggcauuucaauaucuccuagccuugcccauggaagggaccaaaacuaccccuagggaaaaaguacagaaguacccugaacucuuccaaagagaugugcaguccaccucucuuagauuguaauaauaguguaugguguuuccuguaugccagucacucuucuaaguguuuuacauuuaauucucaugacaacuccaggagguaggugucaucauuuuauaugagucauuuuauaugagucacaaagagaugaaggaacuugcccaagaucauacaguuauuagaugugaugcaaauccaggcugcuagcuccagagacugugaucugaaacacuauucucaauauacagauccaauaaaauauucugucauuuacagguaauaacuuuuucccuauggugagaugaaaauaagcaguaguuaaaagagaguaacuucuuagcuuuuaaucguuagcaaacuaguaauugucaucucaauggccucuucucacuguugguuacauuggauacccaauuauacuauuuuaacuugauuauguagaugugcuauucuauaaaaauaaacuccaauuuuuucaugcucauauguucacuauucccaaccacagaaaugcuuuaugacuugggaaauugcuuauccuuucuggguaaggauuuauuuuuucaucuguacauaagagaggagauguaauuuaaaucuccaaagacuuuuuaacucuaaaacuuauccuucuguaauuccuuaagaaugugauuuaagcuucauguuguuuugcuuuuaguauuuaucagccccagcaaacuaagcucacuuuuuuuuugcacaguaaauuuaagguaagucuuacuaucuaucauuguauuuugugauaaucugacuucuaauauaaugauuuuucaaacauaauuuuauuagacuuuggaguugcagagucacucuaaugaaacacacaauaauuuugaauuauaauuucccaaaacauaaaguggucuaaaaaugaccucccacuguauuuggacaauaucaacugauucacaagauuuacugggcaaagauugugaauagauugcugaaaaacacacuguaaagagauaguaauaaaaaguauggcucugcugugaaaugaucucuccuaccuuguaagguacuugcaaaguuauguucucagaaaugcuauaaaacaagcaagcaagcguauauugucucuuacaaacucccccuuugugaauaguuguuuuuuuuuuuuuaaaugaugagaauuuugacugcccucuaccagucacacaagaacacauauaccauaaagcuaugagcuucuuggugcauuuguaaggauaacagggucacguaucaccuggauucgcagaauuuggaauggaaugcucagucauauugcaaaaauuugcagagcaguaggggucuggaaauagacuguuggcagcucuucuucuuuuauuaaucauugugaguauggcagaugguccuuggguuguucuccaagagaaguucucacucucucugaggugcaaugagagguucucuaaugcuaauguccucauucaggaacaguuacuuugauauuuagauggaugaauaaaaagcuuuuacugaacaauuaaauacaauuuuguugagugucaucuguguuccagguaugguuauagacaguggugauaaaacagugaacuaaaacccuugugauagcggagcugacauccccaaauguggcaagaagcugacaggagguaaaauaaguaaaaugcauacuauguuggaucuaggggcagcaaauucaaucugcaggccgaaucuacccuacugcuugcuuuuguaaacacauuuuuaucggaacgcagucauguucuuucauuuaccuauuuauugucuauggcugcuuuagugcuacaaaacccagaggcaguugcaaccaaaacucuacagugugugucuguccagaaaaagucugcagacuucuggguuagaugcuagaaauuaguaugaauaaaaguaaauccaggaaguggaagaggaauaggauguguuuuagagagaauggucagaggacaauugauucaaaaaguaacuuuuguguaaagcacagagguggugagagagcaagccaugcagcguuuaaggaaagaacauacuagaccaacagaagaggaaguucccaggcucugagacaggagcaugcucagaauguucuggaaacagcagagagaccaauguccuggagcagagugaggaagaaagagagaaguaggaggucaaagaaugggggcaaaagguaucaagaagucauacagggccuugcaggccaucagaaguuuuugauuuguauucuaagugaauuggggagccauuggagggugaacaccaagugacauaggacauaugauuuaacaggauuuucuuccacugcugauuugauaacacaccaauggggaacaaagccaaaaucagggaggaacgaccuucuaguaagaguuacagggaaccaggcaugagauaauggggacuuggaaaauaggagcagcauugguggggaaugcuauauuuagguacaauuuuugguuuuaaaaaaccacaaaaauaauaauauagggcugauauucaacuaaauacugcuuguauucaguuuagggcaauuaaaugauauuuugaaaugcaguaaaauauuauuuuguauuuucaugaaaguauauuuguguuacauaacuuuuccccaauaaccaucugcugggagagccauuagguauuuaguaauuaagauuuaaauguguuuuuguuuguucauuuguuuuccauaaggagccugcauuugaugucccauugagaacaaguaggcagucugaaaaacggggaaaauaucagcuaaguuccuuuagauucucuuuacuuuucuucaauuaucacugagaaauuuggcaauuuaauauaggacucuccaucacuaucaugaauuagcaagguuccacuguaauaauuauuucccauuaaaacccaugaaguucagguuuuucuugaugaguucagagacggcuacacaaaugcauugcucuguaggcagucuguuuaaucuaaugcaaaaaccauaguggcuuuuaaaacuuaccugcaggaauagcugcaaacugcauucuaaaugauacagaucugaguuuuagaaaggaauguuuaaaaagaagaacaaaaaugagaacagcauauuucacugugagcuuuggauaaguguaggagaaggaugucucaauaguagcucucuaggcuauagacccaaaggaugaacuagucaaaaauguguuuguguugcugcagagagugaccagugaugauaaccgcuucaauagaacaccagggaaaauauguuuaggaaaauggaaauuaggguagaagaaagugaaagccaaauugcaacacuugguguuagagaguugaaaagaaaagugaagccugccaaauugaaugcccuggagaauauccccagggaaaggaaaucaugcaagauucuuuagcuuugcaaaaaggaaagaagaaaggcuuucuauagcaagucuuucaaaaacaaaucccaucaguuagauucucuagaaauuguaggguuguauagaauuuauacaauauuugagacaaaaagaaaauguauauuuuguugaagccaagcuaaauagaauuaauauaucacagucaaaagauaauaaaagcaccauauauuucuguagagcuuuauuacugaugaagcauuuucacauacauucucuuacgaauccaaggaagauugugguucaauuuuuuuuuuuuuuuuuuuuuuuuuuuuuugagacaggaucucacuuugucaccuaggcuggagugcaguggcgugaucuuggcucacugcaaccugacuuccugggcucaaaugaucuucccacuucagauccucaaguagcugggacuauaggugugugccaccaagcccagcuaauuuuuuuuuuuuuuuuuuuuuguauuuuuuguagagauaggauuugacuauauugcucagguuggucucaaacuccugagcucaagcacucuaccucccuuggcuucccaaagugcuaggaauacaggcaugagccacagugccuggccuguuuguggucagauuuuucagaugagaaaaugguggcucaggaaaauuacaacaaacaguuuuggaaccaagauuacaggguaguucuuuugaguucuaacauaggacucuucccaaaacucauguucucuuuuacagcaaugaagucuauauuguauucaaaugcaauauuagacuuuuacagucucucagaaguugaauggaaagaaucacuaaccacugucauuuucacuaugauuuccuguuugcaagucaucucagugcgauaucauuugcucuuuucauuuuacauacaaggaaacuaagucugggacaccugcccaagcugaaagggccugcaaauacaggaaugagaauggaaauccaucucuuugaacaccaaaguccuuugcuucuucuauuauaacauaaauacgauacaugaaaacauauauaucuugacuuaacucaugauaaugugaaccauaugccagcagauccuagugagguugacacuguuaaaaaagaaaauaauucauauggcaugaaggguuuccuuuagauccugaauguuucauagagcagcugaaauuugagcucgaacuugggguuuuguagaguauuuuuaugcaacaauuagcauaaugacagacaauaaauguuaacauggacaaaagaauaaauggauggguagacagaugauauuuguaauaaugcuggaauucuguuuaucucacuauugcuucacuuccuguucaaaacauucuccuaccuaugccaagagcuguuaggugaaaauccucucuguuuccauauugugagguauauuagacugugauuccuuuaaagaaggaauuauaucuuucuagucacuguaucugacacacaauagagaacacauguuuguuaaaugaaugaauaaauaaauaaaaugggugaaauuaauggauaaauaagugaaugguauaacacuucaucugccaucaugugcuuacucauaggauaacucacucuuucaugaagauuuccuuuauggcaccuccucaaacggaggcugcuucucauaauuuaucaauucuguacagauggcuccuuauaaacuuauauuuccuuauguaucuaucgacugguagggcacuuacuuggauagaugacugucuuaucacuagaccaucuacuccuugaaaauggacacuauuuuucacucauuauuuuggccuccauauuuugaacauagacccuuaauaaauaucuacauuuuuuccugccccauucuuaaucucagucagaagggcucaugggaaugggauuaagaaguguugccuacauagcaaauaaagcaugcugagacacauaacuguaagaaggcauuuuugagggcaggcagaggaguugugugguauggcuguagauuagaaugcaauuauauguaugcuuacuagaaucacgguccauaauuauauauuuaagucugaaauuucuaacauacuccaacauaaggugcucagaauauauuuuuucuaaauucaaccuuuccuaauagaaauaauuuuaccuuauugccacccaaagcaucuauuaaaacaaugauuuuuuuucaugaugacauuaauauucucuaaaaugcuuugagcaccuuaaaagaaaaguguaaugaaaauucaacagaacauuauuaauuuuaagacuguuaagaaugcauaauucaaagcuaugguuacuguaccguaaggauaauuaagcauaaucaaaauaauaggcuuauuguucucaauacuuuccaggucucgguaugaaaccucuuuuucaauuaauuuuucaacaucuuccaaaugccaauauacauguccuauaaaggacuuccuauuuuucuucuagaaguuaaauggcuauggcagccuccuccagaguugaguugccuauuucugcuucauaaaucaacugcuuuucuccuaggaugagaggagacuucagauucauuuauuccauuuuguaagaaaaaaaauuauuaagggucuuccaaauaaucucacuggugaaaaaaaaugaaguuuccucauaguucaucagggaaaaccacuuggcaggucagggauuugaguuuauugaaagaaaauaaaacggguugcaguucgaccugacagacugcuuauggggaaauauacaacagaguuagauuuuucuagaaggacuuugggcaaugaaagugauuuauagaacuucuacaugccuaaacgugauacuguuuggggaguauuuaaggauaagaaguguagaggaucuuaaauucaagcaucaaaacucacaggucaacagaaaggugaacucagagacuuauauaguugaccuugugcuguuacagaaugccccacaauugcuugagucuugguguggauggacauuguuuugauaccuaagauuauugauaugguuuggcuguguccucacccaaaucucaucuugaauucuaguucccauaauccccauguguccugggacggaccugguggaagguaauugaaucauggggacgguuacccccaugcuuuucucgugauagugagugaguucucacaagaucuaaugguuuuauaagggacuuuccccccuuugcucagcgccgauucucucucuguccuacugccuugugaagaaggugccuucuucuccuuugccuuccuccaugauuguaacuuuccugaggucgcccccaccaccagcaguguggaacugugggucaauucaaccucuuuuauuuauaacuuacccagucacgaauauuucuucauagcagcaucagaguggacuaauacgauuauaauuaucaucaccuuuugacugaccaauugauuuacaguauugaguucaaucuguuuuuuuaaaaaauaucuucuaaauaucaggugcuguauuagaugugggguacaaaaauguauuuucauuuacucacuaauuugcuuaaaauuuauuuauugaggaccuacuauauuuuaggcacuguacuauauucugagaauauauagaaauuaauauaauuugggcccgaaguauaagagcacauaguuaggggaaguaauuugagagcucacagggggagcaauuugcagucaguguucuaaauguagaaauagaaguauguaaaagguaccaaaaauauuuugauggaagaggauuuaaggaaaguuucgaagagaacauagguuugccugguugacaagguauagggcaaagcaaaaugaacaaaauguguaaaaguaaauauacaugacauuaaauuaacuuuuuuaaugcaacaugcuuaauaaaaaucaaauccucaacaaacaagaauacagaaucaacaacauuucaccuggaaauuauucugcucuuugugcugaggguuuaaaacgaccaguuucaacucaagccuaauaauuuguuuugcacauuucauaauugauccauuuugcucugaacuaaacacauucauauuaaaacagacgucuagcaaugcuaauaaccaaagugagaaccgcuuuauaaauguaauccuguccaaauaacagcacaacuuuugaaaauuuuguaaauaaaugucagaaacuuuaugauaacaaaaacuuuauggcugcuuucuucuacugucucuugacccuuucuggaucugucuauuguggacagaaagccuguaaauucauaggcacagaaggaugaauuaaaaagaaucaauauacauucagucagccucaauuuucucuagugagaguaucuaauuucugccuuuuuuuuaacuacucugaaugaagcaaaucccuagugugcuacauagcucauggcauuuuucaagacaaaggcacgguuuggaagaauucugcucaauuauacuggacacaauugucuuuguaaaaauaucaacacuaacauauauauuuuaauggacuucuaaacauagcuuauaaaucgcauaauuauuaagcaaugucacauuaaauccuauaugucaucucuuuacguggaauaacaagaacacaguuguaucugaaaauuuauuaugcuguauauuugaaaauggcaaauuauuaccuuuuaauuguagcaaauuaugaguagcaucuguaaaaauauaccaacauucucaagauugauaaaaauuaugcauauuccguguaauuuaauucaauaaacacugagggcauacucuuuaccaagcucugaaauuacacaaauagauauaagaauauaauauuccaauccuuucccugaaaauucacaguuuauugucacugauuagagccugcaaauauuucugagggucaacauggauuuuccccaugauucaugacuauuagaaauuucuuuaacuuuaaauguccaaauucguuauaccacacauugaaaucucugugaucucuagacauauuuugguuuguccuauuucuauuacaagcguuuuccauucuuuaguuuuaccauucuuucucuuuuuuuuccucuuuguccauuuuuuccagucaguuagcaaauuccuucugauuauuccuuuggaauaacauucacaucagcuuuuuuuuuuuuuccuggccauuucugcauuaacuucaaaccuacuuaccucucaucuguauuacuaaaaaccuuguguucacuugccuccagucuugucuuuuucuaauugaaaucugcaaauuacaaagguguaauacuccugaaaauaucugugcaaaccguucucuguuaaaacaaaacaaaacaaaacaguuguggucuauugucuggaaauguugcacacucaaguuccuaaaaaggccaggucgguaauaaaauaaguaaagugaauagaauaagacaaucaggagugcuagagauuguggcaugcguaggcuccagauaagauuuagaaggcacuuagguauagcugauuguuuucauauuuuucauauugaaauauggguuuuuuaauguuugaugaaaaaauauacuaaauuuucuaacuuuuaagacacuguguggccaaacaaaauauuuguaucugcuguucucacacaguucugacagaauaugaaaagcaagcugccggcuugucaacucuggucuauagaguuagaccacuuuauguugccuggauuuugagguccugugacauguagucccauugucugucuccagugcaaucucuuauuauguagcauugacuuucugccuguucuuuaagggacuauaccuaguauuuacuccuugcaacgauguauggaaguaagaaucacuuaaaagaugaaacaguuuaaauguuugucaguagcuacaugguaaaggauagcuuuauaauucaaauacaguauuuucugguuccaaagucugugcccuuuauacuuugcuaugcuauuuccugaauacacauguaaauaggauauacaucuucccaagaaccuuguguaaaaggaacuauuuuuaccuucauuuuacaaguaagggaagugaauuacaugaguugucuaaacucaaaaacuguuaauuaauuaguaaacuuagaguauaaauccacgguuuaaauauagagucugcuaucuuaauaaaacuguuuacuauacuacauaauuuuuuuuaaugagcaaacaaagaaguaaauagaauuuacuuuaaaaucccacucaaaugcuacaguuucuguaaugauucucuugccccucuucaugagaaguaaucucuuccuccaaucagcuaccgugguauuuuacccauauuuuucuugucuaaccuugcauuaaaaaucucuuuuacuaaacaagaucaguguguugcugauugugcagaucccugugcauaguuggagcuuauaaaauuguguugaaugaaauuagaaauacaugaauuaaaaaguguuauuuccuaauacaacgauugugcuaugcauaacuguaguaaaaauaauuuuaaaaauuaaaugaguuuuaaaagaaaauuugcauuuuuagcacaccucuugcuggcagugcucaaaacucuugguucaguauaaggcaucaaaacuguucaguaaauuauuuagaaaacauaccuaggauguauuuguaaaauauuaggaagaaaaaaaucaucugguuaggaaauaaaccagggaucauuugugugggcgguaauaucaacaugaaaaccaauuccccugguaacacauugcauaaaaacauuuuguucaaaccaggguauucugcugcguugugugguuuccugccaaaauguuccuuugcugucauguagauagccaaagcuaucuguuaggaaaaauccuucucuacucaaagagcccaacucagcacuuucaaaggcccacaggaaacacacgcucaucuugaaacuaucagagguggaugauuuugauaaauacagguagucuggcacaugguccaugagacuacccuuuucuaaauccugaaucagaaguuacuguaaacuauauuccuagcacacaaaaaagucucagccuugagugcuucaggauugggcuucuuuuuaaguauguuuuagugaggaaauuuccaaaaaccaguguuagagucuuuauagauaaugguaccuuaaaauaauaaauaauauuguauucccuagauacauuauugcuuaaauauuggagcaucugaaugaggcaaugccaaaucuuuuccacuuaacugcucucuuucccaaguuaacaagaaaaacaaaagcauuacaaaauaaaaagcaaaaguauguagaaauaauuucucaucauucugcccaaaauaaaugagaugaaugaauaacauacaaucacugauacauacucauuuacuuagcagaaauuuuaauuuguaaagcauaaaauguuccaaaagggccguguaggaguuuauuuugaccuacaauuaagacauauucuugacaagacaauagauuuggcugggcgugguggcucgugcuguaauccaagcacuuugggaggcugaggagggaggauugcuugagcccaggaacucaagaccagcuuaggaaacauagcaaaacaccaucucuaacaaaaauauaaauauuugccgggcaugauggcucaugccuacagucccagcuacucaggaggcugagaugggaggauugcuugagcccaaaagguggagguugcagugagucaaacucaaaccacugcacuccagucuggaugacagagcaaaaacucaucucaaaacaaacaaacaaacaaacaaacaaacaaacaaaaaaagacaguagauuauaaauguucuuaacacacacacacacacacaaugguauguaaguaauggauaugucaauuaguuuguuuagacauuccauaaaguauacauacaggcauauuugggagacauugccaguuuguuuccagaccacuguaauaaaguaaauauugcaauaaauugguggcacauuuucacauuuuuauggguuucccagugcauauaaaaguuauauuuacacuauauuguagaguauaaguguguaguaccauuguaucuaaaaaaauguacacaccuuaauuaaaaaauacuauauugcuaaaaaugcuaagaaucauccgagccuucaucagguuguaaccuuuuugcugguggaggaucuugccuccauguugauggggggugguugcugaagguuggggugacuguggcaauuucuuaaaauaaaacaagcaaguuugccacauagauugacccuuccuccuuucacaacauauuucucuauaguauucaaugcuauuugauagcauuuugccaauauaaauuguuuuagaauuagaguuaaucccaaauucugguaccauuuuagcaaauaaauuuauguaguacucuaaauuauuuacugugauuucguguucacaagaucuacgccaggaguagauuccaucucaagaaaucauuuucuuuauucauccguaacaguaaacucaucuuucaaguuuaucaugagauuacagcaauucaaucacaucucaggcuccacuucgaauuccaguacuuuuacaauuugcaccacaucugcaguuacuuucuccacugaagucuugaacuccucaaagucauccuugagggguggaaucaacuucuuccaaacucugguuaauguugauguuuugaccuucuuucaugaaucaugaaugcccuuaaugacaucuaaaauggugaauauuuuccagaagguauucaauuuacuuuacccagauccaucagaggaaucacugucuguggcagcuauagcauuaugaaauguauuucuuuucuuuuuuuuuuuuugagacagagucuugcucugucacccacacuggagugccguggcacaaucucggcucacugaaaccuccaccucuggauucaagcaauucuccugccucagccgccugcguagcugggauuauaggcgugcgcccccacacccggcuaauuuuuguauuuuuauuagagauggggguucaccauguuggucaggcuggucucaaacuccuaacuaaccacgugauccacccgccucggccucccaaagugcugggauuacaggcgugagccacugcaccuggccaugaaauauauuucuuaaauaguaagucuugaaaguugaacuuacaccuugauccaugggcuacaaaaaggauguuucguuagugggccugaaagcaacauuaaucuccuuguguauguccaucaaagcacuuaggugaccagguacauuguuaaaaagcagugauauuuuuaaaauaauuuuauuucugaacaguaggccucaacagugggcuuaaauauuuaguaaaccauacuguaaacagaugugcugucauccaggcuuuguuguuuccuuuauggagcacaggugguauagauuuagcauaauucuuaagggcccuuggauuuucagaaugguaaaugagcauuggcuuuaacauaaagucaccagcugcauuagccccugacaagagagucagcuucuccuuugaagcacggaagccagguuuugaccucucuagcuaugaauauccuagaugacaucuuccaauauaaggcuguuucaucuacauuuaauaucgguuguuugguguagccaucuccaucaacgauguuauuuaguucauguggauaauuugcugcagcuucuacauuagcacuugcugcugcaccuugcaauuuuauguuauggaaacagcuucuuuccuugaaccucaugaaccaaccucuauuagcuuccaacuuuuuucucuguagcuuccucaccuuucucagcauucauagaguuaaugaggguuagggccuuucuguggauuaggcuuuggcuuaagggacuguuguggcuauucgaucuauccagaccacuaaaauuucuccauaucagcaauaaggcuguuuugcuuucuuaucauuuguguauucauuucaguagcacuuuuaauuuucuucaagaauguuuccuuggcauuuacagcuugauuaauucuuuggugcaagaggccuagguuucagccuaucuuggcuuuccacaugucuuccucgcuaaccucaaucauuucuaguuucugauuuaaagugauuuaaucugauuuaaucaaucuaguuucugauuaaagcaugugacucuuccuuuuacuuuaauacuuagaggucauuguaggguauuaaguggccuaauuucaauauuuuugucucugaaggaauaggaaagccuaaggagaaggagagagacuggggaauggucagucagugaagcagucagaacauauagaacauuuauugauuaagcuugccaucuuacaugggcacugcuuuuggugccccaaaacaauuaaaacaauuacaagaguaacaucaaagaucacugaucacaaaucacuaaaacacguauaauaauuaugaaaaugcuuaaaacauuaugagaacuaccaaaaugggacacagagacaugaaaugagcucaugcuguugaaaaaauggugcugauagacucgcuggacacaguguugccacaaaccuucaguuuguaacaaaugcauuaucuguaaagugcaaugaaaggaagauaauaaaaugaggugugccugcauuucaaaacauuauguuguacacaguaaauauaugcaauuucuauuuaucauuaaguaaauaucaauaaacagucugaacaguucaucucaacacagcagaggggaugaaaugaggccuuauuccccaguguaauaaaauauucuugaccucagugcuucugacuugauauccaaagccaacuugagucaaauggucuauacugugagauggggggauuugauuggagugguauacagaguaguaaugugaaaagaaagagaagaauucauuuuggagaguaaguacugugggagaagaaaacauugcaaugcuuaaauguuuaaauaugugcuauggucugaaaauuugugucccuagcaaauucaugaguugaaaccuaauaccaaauguaacaguaucaagagaugggucuuuuaggaggugauuaggucaugaggguagagcccucaugguuuagauuagugcauuuaucaaagaggcacaaggaagcuuguuugccucuuccgcacugugaggaugcagcaagaaggcacugccuauaaggaacaggcccucaccgggcacagagccugcugccacuuugaucuugcauuucucagucuccagaauugugauauauuucuaaguuacccauucuaaggcuuuuuguuacagcagccugaauggacuaagacaauauauagggugguaaagaaaagagagaacagcuagaaaguaauauguguggaauuucuggguucuucaaggguaugggaugaagugaaaccagaggaugagagagucagcuuuacuauuuauucacauuuuuucccccaggaaacaauuccuagaaaaugugucagcaaucuuuuuacuuccauaaccugcauguguguguguuuguguguguguuuguguguguguguguguguggguggguggguggguauuuguagugcugaagaacaaaggagauaaaucauacaaguaguuaagaccucuuguugaguuagauagauguggcuaaucggacuccuagguacuugguauuagaaaaggaaucagauuuaaacacuucucuaugagcagaauuuuuauuagguugggggggaaacuugcuuuccauucagcucaacuucagaggacagcccuagaguaaggaagagaauaacaaccuuucuggcuuccagguuggcaggagagagaauaacagaggcccuggggucagaccacaugauuuaaaucuggcucuuggcugggggugguggcccaugccuguaauccuagggcuuuggaagccuguggugggagaauagcuuaagccuaggaguuugagaccagcauggacaacauagugagacccucaucucuuaaaaaaaaaaaaaaaaaaaaagccaggugccguggcaugcccuuguaguccuagcuacaugaaagacugaggugggaggaucccgugagcccaggaguuugaggcugcagugagcugugaucgugccauugcacuucagcaugagugacacagcaagagcccaucucuaaauaaauagauagauauguagguagguagguagguagguagauagauagauagauagaucuggcucuauuguccuuuuugcugugugaauuggaucaacuuacucucuuucuaccucaguuuucucauuuguuuaaaaguggagauaagaagaguaccucuuuguaggguuguggugaaaauuggcugaauguuaaguguuuagaauaggacaugauagucagugcucaauaaauauuauuucuaaguacuuaguuucauuaguauuacuuaauuuuggugauacuuggugaagaaauuggggcagccugauuuccccugagaacaaaagucuucauggaguccauuaugugggacuuuguuucuuuuuucuuaccaucuccuacccaucucaagaucugauuuuuaaauauaauaauaacuuuaauuacuuauuaaauugauuaugauuuaugccuucuuauuuaugcacaaauugguuacuauuuaugcuuucauauuuaugcacuuauuuaugaaauauauucuguguagauauauaaaauucuauaguuauuuaucaaaaauaaaaacaaaaauuaagcuacacucucugagcgcuauguagaaauuaacacaggaaauguuuccuugugacugcauacugugcaauuaaaaugauguaagucauuauuuauuaagaacaauuucugauugguuugaaaaagaaccauugucuauuauuccuaacauuaaaccucuauuugccuugaccucagauuaacucauacuaagaaaacauuuuaauauauauguucaaaaccugaaauaauuucugucugcaaaucugaacuccuauagaaggcacuuucuugacuauauccuggauagucccccugggcaggccugucuguucaaggauguccaccaggaugucuaggaagacaagacaaucucuguccugggguugggccaaggccagucaccauguguuagugaucugacuucucucauuccuuuaaucuccaaacucuuugcuucucucuucuacugaagucacccugagcuguuugaaaaggcuggugagaaacuaauuucuuaucaagccugaggcguaguauccugauuuuaugccauuccugcuagucuagauugaacaauaaagcaggagaacucagagugguuucaauacgugcaaacgggucaaggacagcuuccaugugaacacuguuggcaggauuguaguuuccuacaaauacuuccucucuuuucagcagcuucuucaaaaccugaaggaucaccaguaagauuuaggucauuaagaauggcuuugaaaugccuuacuguggcaaaucaaauguuauuuuuuccauuaaaaccauaaguaaaacugauuuugauucaguauuaugacccucucuguuagggaacauuaaacacuguugucaggaucaggaggcccugauuuggacacuauggugugauucaaacacaaguguuuacaaaggaaggcccacuucauaaaauucuugcauucugcucuuuuccccauugaggcauuaugucuuuguuaagggaugguuacauccauaguucucauuaguuugauuaaugguauaccucuaauagaggcugcuaccugacauuuggggaaaaauacauggcagguaauuuuuaaaaauacagaaccuguccccuuaaccuaauuuuauucccucugguaaggguggcaauuggaugugacacuuaucauugggauuggucugacauccucucuuuaccucccucuccaguucaauuaaaagaaggcuagccugguuuucuggagaaacugaaacaaauguagggagagagauauuucauaucccuagcaugcugucauguccacaaauuuugaacuuuacauuuccugccaauuagacauguuaagauuucacuagaauauugaauuaauggagcgauucuauucauaauagauaaugaaucucaugccuuuuuaauuagaaaaacaaugagguauaaaaauaggucaauuucagauuuuuuaaaugcuaagcuagaauuuauuuucauaaguccuugcuuuggaguucauuuuggaucucacugaugagacuauuuucuucucauuucaucuuuaaaacuauuacgaauguuuuacuaccccaauuguuaucaacugucuccugugauaacagaauguaacuuaaguuucagaaucuauuuuguucugagauaaagcccuucuaacacuaggaacagauagaggauacagaccuggccuuugacaaccccuugcuuaguggacuugucucagucagcacguaacugggaaaaaucaccugguuugauaccauuucagugcacaggagucaauagccucgacuucuguucucuuauugccuaaugggaaauggacuuauuuuaaauugacccagauauacuucaaguugcuuuguuuuuauuggcuugccuuucaauuuaauguucuguuuccauagcuaagucuauuuaucuccaaagaucuagagagccccuguuucugugcaauaggacaagccuuucuccauccccugccacaaauaggauguugcugcagccuggagacuaaugacagccgcuguccuugggcauggauguccucuuuaaucaaagugaguucccuaaugggcacuauaacgacauucauuugccauuuggauguaccugaugugacacuugaggcaaugccaugauuacuuucccuuaaaaauguaaaauaauuucacaaaaucaaaaaggcagaaauauugcccaaagaaguuaaguuuuuuaaaaaauagugcuauuacccugaauaugggaaaguguuauaauccucuaucuccccaaugauaauaggguccuuucacuuuuaacuuggugacaacauucuguauuggagaaaaacagauucuuugguugcaaaagauguuuauagacuccauaacagagcuugcuaaguuaagauauacgauaaugauguuaauuuaaugauaacauuguuaggcacaucuuagaaaucaaauguuuuacuuccucgaauuugaaagguguuugauaauagaggaaaucacugcccacuggaauuaauauuuagaacuagaauaauguuuucaagauuuccuuucacacaaaaucugcaacaaugcuguaacuaaaaugcaugcaagaaaguguucuaugaaaaauuggaagacauguuuaacaguauagaugaagacauuucuccaucuauacuguuuauuuacuaacuauaaugaaaaauauuuuaaagauuuagagaaauuucuuaauagcuccuuauuucguuaagauccuagacuuaaggagcuuaaagaaucuucagaacaaacaaaauguaucuccagcuuccuggaaacagacauugaaagauagaugcuguccaugaugaguuuguaucuugucuaagcaugaugaaucuaaaaauuaagcucaauggauagguaguggauuuccccuucaaaagaaucaccagggaagacacuuucauaaccuucccuuucacucuauuccacugucuaacaagccagaauagccaggcuucuagcucccaaagugugacaaagccagaucgucaagcagcaugaaaaggaaauaaaaggacagaauaucaugaucaaugggaacuucccaugugacuucugagcuaacaaaugucuauuaccaaucaucuaauaggcaaugacaaugaguugcaaggcaaaaugagcacaguuuuuauuuagaacugaauuaaaugcugccucuacugcuaaguagcagugugugaucagagccucagcuuccucauccaaaaaugaagauacuuacguugaaggaauuuugagacaguuuuaaaaauucaaucuagcauaucaucaacacacaauaauugggaacuacugucaauaguuaccaacuaguugacaauauaaaaagcacuaaaccagguaaucuaugggaagaaaauguauucuuuucuuuuaggacacuauccuugccuuuuaaagagacuaaaagcaagaauuguauuucuacgauaugcuguguuaagaacauugcauacauuauccuuauaaugaugcugugaaguagagauuuuucuuuuuauucugaagaugaggaacuggaagguuugagaggcuaccuaaucuuuccaccaguguggcugcagaauggguacucauaaccaccacauuauacugacaugacaguguauuuguccccagugggggacaaauauguacaaacauaacugaaaaggcaggaugcgauuagacaauugcgacuagauaauuguugcuauacacaggauaaaugcuucuaugcaucggucuuucaaauuugggguuugacaacaugaugugcaaugaacuaguaaaucgaauuuaauuuuugguuauacacuuuaaaaagcuguuuauugaauacuggaauuauagcaaguaacuauauuuucccaugccuaggagaccuaacgucaucugaaaauaaaauagauuuauauguaaauuuauauuugaaaauuauguuauuaugcagaaauugagaagacauucauguuuuauauuauccucuucucauaggauucuucaugugaucucuugauccuucuauugggugacugccugaugguccugcagguuuuauuagucaagguucuccagaggaauagaacuaauaggauguguauauauauagagagagagaaagagauauaccuuaagaaauugguucaugugauuguggagguuggcaaguccaaaaucuucaagguagccugcuaggcuggagacucaggaaagaacaguguuguaguuaaagaccaaaggcugcucgccaugaguucucucuugcauggagagguuaaucuuuuguucuauucuggccuucagcugauuggauggggcccgccuauauuauaaaaggcaaucuacuuuauuuaaaauauuuccaauuaaauguuaauuucauuucaaaacauucucacagaaacaacuggaauaauguuugaccaaauauuuggguaccacgguccagucaaccugacucauaaaauuaaucaugacacagguuuuguuguggcacaaaacuauuuauagcauuccaaguuucccagauguucauuuauccacuggaacuuuuuagguuuugauuacucugaguaucauaacuuuuauauaguagagugaagucuacauuuuuaaaauaaaaauuaagcuaagaauauaaaaccauuuaucaguaguauaacaauggagaaagagaauaaagcuuuuguuuccacaucugauauaccacagaaacuuauuaaugauguaggcaaaggacacagacccuugaaggaaccacaauaacuggguguaucuacuuauuagauauaucuuuuuuuuucaauucuagagaugaaauaaaagauaacuuuggaacacauacaaauacuuacuuuuaacauaucucuaaugaugugguaauucugaacacuuuagaguguuuauggcagcacaauucuaagcauauuugcagcuguugaacuauauuuugcucacuguucauaauccuacagauguuuuugauguacaauguuuacugauucacuuaaaucagguaugauagggaaacucaaacugaucccacuucuauaguccuguaaagcaagcacuuccaggaauuauauugacagaaaaagagaaauccgcucuggagauaaugcauauaaucacauuugauaaaaauggaaaagccuuauuacauuauuguuugguaucuauuuuacaucgucaccugcagcuauguuauguuuccauuauucuaauacuaguaagaagaaaucgccacuaagaaucucaaaauagaggacuuauuuuguaaagcuguaauuauguaacucgaguuucagcauguccuucaaagaaugacaaugugaaagcucuaagacuacugcaaaagaagcacuuugaagugaauagauuuucuccaaaaacauaguaaaaucuuuucagaaauaaggguggagauugcuuuaugaagaguaguuuaaauguccugguuaaaauaaaauccucuggaauauuugcaaauaauaugcccaacucugcaaaugaagaagcagccuguuguaucacaaucaaaauuauauuccucuaucuaagccacuacuuuuugcucucuugauuuuauuuucaauaauuuuaauuuguauuauuucuuuagaaagcccuggugccuuugaaggauguguugaaauuaauccuaagucuggucucggccaggaguggugacucacgccuguaaucccaacacuuugugacucugagguggguggaucgccugagguccggaguucaagaccagccuggccaauauggcgaaaccccaucucuacuaaaaaaaaaaaauacaacaauuagcuggaugugguggcucaccccuguaaucccagcuacucgggaggcugaggcaggagaauuacuugaacccaggaggaggagguugcagugagcugagaucaugccacuguacuccauccuggcugacagagugagacucugucuuaaaaaaaaaaaaaaaaaaaaaaagucuggucucuuuucagccagcuguacuuuuuuuuuuuuucucaauuaucuucaaggauucuucaugggaccccuuguucuuucuauuggaugagugucugaugaucauagaaguuuugcugaggcacagauaugcacacagcauuucaacuuucccaauguggucagcuggcacucaaauuuucuaggugaugauuacuauaagaacuucaaguucauuccuguuuuaaaaacagcuuacauuuucucaaacuccauuacagaauaucaaaucaacuuuauauuaacuauucaaaauaucucuuuauugaaacugauuuuuaauuuuacuucaacuuuuauuggaucuguuuuuuaaucaaauacuggccuuugcaguuccagauuaaaucucauuugauuaauuucaggccauuuauucuaggcuuuuuguacuauuaugugaugucuuauugcuugauauacucucucaucugagaauuuaaauaauguuauuaacaaccaacugcauaucauuuaugaagauguuuaacagaguagaguucaagacuacucugaaugaaacaaagcacuucacacucacugccaaagacuugcaauaugccuuuauauuuccuacuuagcugaucaguaaacuaaaugcaaccuauuaaaaccuaagaacuuucuaauggcauuaucaacaccuuaauguaucaaugacuuuuaccuuagucaaagcuaggaguucuuugcuuggcacgaguagugauuuucccuaaucauuuuuaaaauagauguuuaaaugcaucuuucuguagaaagagaucauuuauaauuugauaauuaauucccaaaagaguauauauagcucccaaauuauauaaggaugugcuuucuuacaugguuauauuuaaaacauauuuuaugcugcauuugagccauguggcagagcagugccaguuugccuuuggcgucuaaccucuggguuauuuguauuauccaauuuuauuuucuugaaaagugaaauuuuucucaaaagcguauacuaacgauuuucuaaauaacuuuuaggcaaaauacauuauuuaauuauguacuauguuugcaugaaaauaaaacaauagacccuagaaacugggauaauaagaucuuauuuuuuucaauguaccucaaacaaugugaacaaaugggauguuaucagggauuauaaaacuuuuagaaaaauacauuuugucagucuuaauuaauagucuuagaucuggcauuaauauaguuagaacaucaggaagaauacaaauuuaucuuacuuuuaaaauguacuuuucauugauuuuuccaggaaagaaauaagggaacuagauuauauauuuuaguauuuguucuaauuaggugaguacccaauugugagugauuaacaauagcucaauaucuauuucauggaccuugcuuuacugcuuuaaauagauguuaauuaagguugugcuaauggcgguuugggaggugggauugcuauuguaaauggaggaauauuaaaagaacauuucauguugaaaacauaagauuaucuacucuuuacuuauuauaggguagauagagugcuauguucaaucaggguccaguuauuaaaagagugaugcagagaauguggagagaguuaacaagagggcaacaaacgugacugaaugcucuggauaagacaaaaaaugaauguauuuaacaucaacaaaauguauuuuaacggcaacaaaaaaagucuaaagagaaauaccaugucaguguucaaguuauuuucacacuaaaagcacaaggucuggaaugagagggaucuauauuugaauccuagauccuccucuuaacagcugccaacuugaaccucuccuauaugcaaaguaggaauaauaucuacuuugucagagaguuguuaggaacgaggaugauauaaguaacaugccuagaauagugucaggcauauagagaaguccuuuuggaaaugauagucauaauuucuacuauuuuuaucagcuacucuucaaaagcaaucugaaaacagggucacagggcugucuuggaauugcuaaucauggaguuacuugugaauaggcuaguauuugucagagaugcaaagugagaggaagaggugacuugacgguaaacagcauuagaucaguuaguuguuucacauacuaauaauacaaggaagagucuggcagaauucaaauuuugcugaauacauugagguacaacuucuguuccugauuuuuuguuuucuuccucccucccuccuguccuuccucucuugcuuccuccuucucuuccuuccuuccuuucuuagaaaugucuuuaaauguaguuaugugccucugaaggguauuuagucaugaggucugacuucgccauaugcuuuuucucagaaguguaguagcggguaaaaauauauggcaguuaaggaaucaugguuagguuuuguuuauuguucuuuauuuaacaauagcaaggaguacugcauacauaaaaugcuggcaaaaauauaaguguaauuuuguuuagagugaguuuuuuuuauaggaauuaucuuuucuuucuguuuuaaaacugaaaucgccggagucccaauucuuucuuagguugucuugauauacacaggaagaaauaauguuccagcagguuucauuguuuccccaagcuguaccugugcuaagaguaagaguaccgacuucauauauauauauauauauacacauauauauuuuguuguuuuuuguuuuuuuuguuuuuuuguuuuuuuuuugagccagagccuugcucucucgcccaggcuggagugcaaugaugcgaucucggcuuacuucaaccucugcuucacagguucaagcagcaauucugucuacaggcacccgggaccacucccagcuaauuuuuguauuuucaguagagaccagauuucaccauauuggccaggcuggucuuaaauuccugaccucaggugauccacccuccucagccucccaaaugccucucaugugccuaacauuuucuuuaaaauaaaguguagauuuaacaugccuggauuuugucuauuuggguuuaacuccaaagucaauaacaugcaguacauagucagagauuaggggguagaggcaguaugagauaaugagggagccugaucagccacccugcaauagcuuugccuuguuaucugcuaaucaccagggaggccagaauuccuaugauuuuaugucucacugaaacaaauuaauuacuuaaauauaaaagacacauaugugcacacacacacauacuauagacuaggcauauauacauauauauaguguacaaucucauuuaaucuuuuuaguaucucacuaacuccauuucacagacaagaaaacugagguaccaaagugauaaaccuccuagcacaaagucacauaguuccaaauugauagagucauaauucaaaaacaaaauagucuagagacuguuucuuuaaccaugaugcuacuauaccuuccuugguugcaauagggaacugaaagauucagaaacugcaagauucaagaaauuugcaaaagcaaucccuugugauuacuucuugauauacauagguugggggacugacaggaaauaacuagagucauuuuguuaaucaauacuaagcauccucuuuuguuagaaccaugaaauugcaaacaaaaaaugaaggugagagugaaagaaaaaguauaauaaggaaguagagagguugcaggacaguaauaacaaaaaaucugauuuauugcccuuaugcauauccuaacaauuuuuuauauuaugguagauugcaaaaaugaguacaauuuuucuaaugcucccuuuguccucaaaacuuugcaaugugacuuuguaguucuuccagauaagagauagagucuguuugcccauucugcaaaucuuggcugcccuugugacuugcuuucaccaauagaacguggcagaaaaaacaugaugccaguucagaguuuuguuuugaagagaacuggggacauuuauuuuucucugucuugaaaucugccauacuaugagauaaguagaaaaacagauagaaacacauaacccuauuaaccccaucauuguagcuggcagccagccaacugucagucaugugagugagccaacaaccaggcaaagaccauggaaaaaagccuagcuguaaucaguccagccugguccagauuggcagaacugcccagcuguuccauaaacuugugagcaaaagugaguaagucacuacauguuggguguuuucauauacagcaacagauaacugcugugugugugugugugugugugaucuccuaaaaucuuaaaacgacgguguuuggcaggcauuauuaccauuucaaaaauaacaaaacucuguuauuguaacauagcaaggcuagaagccaauauuuacucccaaguuguauaacuuuaaguccaggucuuuuccuguucagaagggaacaacauaaacaauuguuagcuguauuggucacgauucucuugagaagcacaaucaguaggaauuggcccacacaauuauggaggcugagaauuuccacaauguguuuucugaaagugggggcccaggaaagccaguuguauaagucacucugauucugaaaguauaauauccaguggagccaaugguauaaaacccagucugagggcaggaguaaaugagauuaaaugucccagcucaaccauugagggaggaaaaaaaaaugguuggcaggggguggggguggguggugaauuccuccuuccuccaccuuuauaucucuucagguccuccauggauuggauggugcccacccacacuggggaggucaauuuauuuuacucaguucauugaucuaaaugcuauucucaucuggaaacaucuuuccaagacacauccaggauaauauuuaauuuggggaccccauggcccagugaacuugacagguaaaaauaaccaucauaccaguaagugaauagcuagauaccaauuucuucuuacucccaauucaaauccuuaaaccaugaaucaaagcaaguuuuaugaaucaaauaccaguaucaauguagguggcuucacauccaauacaaugcaguuuauuugguuaacauugugaaaagguaggccaaaauccaagacugaagugaaacucauuuauuuguucaacaaacauuuauuaauugucugccauaugcuaggcccugugcuuggcacuauuaugcaauuaauuuaaaaauaauccaugauuucagaaacaacucuaagcugaauaauuuaggcagagcaagacaaguuauucauaaagaugcagacuaauuggaaaccuaguuuaaaugcuaugcuuaugcugcagugagagugcgcugguucuaaagggaaaugaacauaaaguucugaaaauaaugucaaaauaauuaagcacaugaagaauggcacuuggaaccaaauugcuucagcucacucuauagaaaacacaauauaaauuuggugcagcugguuugcaacaucaggucuagugcagucagaagcccgagucaagugcugaaagacugacccagcuuuuguauugcuggagacagaauagggaaucacacuaaguaccagccugcuagaaccaccaacucaaaaugcauuugucauuuguuuuguuugcuucucugcuuccuucuccauugcuuccagcucauaaaaauacuuuuuuccccccagaaagauucucucuguagagaauucuagucuugaccaaccauggagaaauaaauuuucucuucuuucacaguauauaauuuuuccuuucuaacuccugagaagagaccacugauaguaguuagugguauuucccuuuaggaaacaauagugucuaacucagaauuuuacaaaauccuuuucuauuuuacuauugcaaagcaaaguccuaacaucuuguuacugccaggugcaaaaaguaccuuucucacuuaaaaaaugauguucauaaugcauuugacuuauauuucuauuauuguaaguaaauacauaacaaaaaguagcaauuuuauuuuaugaugaucucaaaaaaaaguagccuauauugaagaaaacguaauuuuuccuuauugguugaaugaagucauaaaaauguauucucucuguaucacaacuuuagauuuauggaucuauuuuucaugauguuuuucuuucuauguaucagugcuacuucaggacaucacagauaacugauucuuuccauuuugaguucccaaauauauagauagcuagauguuuaauaauacuaucuguucuuaacauguaauuuguagucaacacuacacagucaaagcuaaccauuucaguagagaaacaaauucuguauaaaacaggcuucccuguuugaaauucuccaugauuccuuauguaaucauggcaaugcacuuuacaccugaguuucagaagaggccauucuauuuugccuaauugggccuugacuuugugauuuguuaaaguuguuauuucuccacucuguccaauguuaaagagguagaccagcucuucacugacuucuuguuaauuccccuauccucagaccaauucaacaaaucuuuacugaggaccuaccaacuauuguuauuugauguuuuguuaugguuuauaggugaccuggaugagacuucacaaggagaaccugaugucuauuugcuguucuaaauuguacagacaucagagcugacccucacucuaugggccuuuaauuugguuugacacaugaggucacaucagcuagugccuuagagggcuucuuuuuguaagaguucaucauuuacccauauacuccugagcaagaaaaaucuagagacaaccuuccuuucagcuuuguaucucugaugaagagcuuucagacauauggcacaaguggugucucacuuugaucgucugguugucaguucauagugcuauguugauucugucaccgguaucacuauucuuccaggcuaucuuuuauucuucccucucauucaaaccuaguauucagucugucauugaguccugucauuuccuccuuugaacugucuuucagcuucugcccuucucuccuuucccauuacucucucacuaaucuaggcuuaugauuaucgcaggggugcucaguugauuuuucucacucgagucucuaccaucucuaauccaucuugcguacuuacaucaguccaguguuccuaaaguccuacuuucauucuguuacuccccguucaaaacccagaguuguuuccucuuaccauauuaaaaaaaugcauucuagucaguacucccuacuuccuucaaaccagggcucccacucagcccacagugcuccauagacaccacacuuaaaagcaguaugcucauucuugccucauugcguuuuuuuuuuuucuuuuugucucagcccaaaauauccuuggucuuuccucucuauagaaauccuccuacauccccagggaccaacaugaguucgauccucccacuguccucuagccaauauucacauccuuuguguuuuuguagcauccacuaauaguaugucacagcaacuauugcauugugcuguaauugucugcuuacaggauugugucucacacacaauaaugagcccucugaugacagaaaacaauuuuucaugcccgaucuuauaaccccaugugcccagaaguauuugacucacaguagguucuccaugaaaacaugucagguauaaauuuuucccuuuuuaaaaugcuuaacucuaaaccagaauagaaguuuaacaauacauuguguauguaaagaugaggaauauaaugaguaacaugaaugaccccaaacuaggguagcuuuuauccacucaaacaaucuaacaccuuuauuugcaauuuuuuucucucuaaaaacucccuaggggcagaaaccacauuguauucccaccuugauccuuugauagugccaaacacagugauauugaguacuuggugauuugaaugaacaugaaauuuccagugucugucccagcaacaacuggcuguccuaaaagacacuguccuaaaagacagcauacuguuuuucuguuuacaucuuuauucauagacccauccagucaaagaaggcuacuauaguuucuauuuucauuaguucaugcaauggacucauguugaaggcuacauuaagaaaugugggagcuggucuuuagaaacguuuucuaaucuaacaguuuaacauauuccaagaauuccuaucuccaaaugguacacauuuuuuuuuucccacaacuauggugugaucuuaaaagcaggaaauuuggcuuauauaauugugucuccccauaacacaugguguuauguauugcgugugauaaauacuaauauuuauggcauguaaugaauacuaagugaauaucuacugaacgaaugauugaauuauaacaacuaaaaucuaaacuuuacaaaguuuacaaaguggcugagagagggaaauuucaauguggaacaaagucgaguaguauccuaaugaaauggguauuuucagaccuaccuguuuauucccuauccuccuuucuggcucuguuuuuuucuuugacucuuacuaacauugaacuaacugcuuuacuuacauaucugguauguaaguuacaauacagcagggaguuuuguuucuuuuuguuguuguugguuuaucacuagugucaagaaugcaaucaacaagguaccauuuguaggccaagucugacgcacggccuauuuuuuuuuaauuaaaauuuuauucaacacagccacucccauuaauuuacauauugccuaugacugguuuuuuuguaacaauagcagaauugaauaguugugacagauauuaugguucacaaagcugaaaauauuuacuauuagccccuuuuauagaaaacacuuuuucaacuuaguccagagcaaugcugaacaccaaguagauauucaggaaaugucugcuauaugaaugaaugaaauaauaaauaaaugagucagauauaaaaguaacacugcaguaacacuuuaccaucccugccccagagaucuuuugagguuuugaaauguuuggagacccugauaaagaugaaaaguccuauuucuugaucuauaggggccccagaguccuguggaagaaaauuugaauuuagcccacaauugggguccgauuuguguaaaucuuuugucaugggcuagugucccuaaagaagauuagaccagaggaaaggauuaaugagguuacugaaaaaaaauucccagugaguaaagaaaucuguuaaagguaggcagacuauacaugcaaacaccuugggggagguaguuauuuuaaguaauaaaaggcugugccuaacaguucccuggccaaaccaccuugagaaggauugugcugcaauauuuaggauggaacuacacauuucacuguggaccauaagaguaugcugugaaaaucucugaaagagcuuguuaaagggaacagcguuuuuugauuguguuguuguauuauauuuuguuucuguuucguuuuguuuacguuuuuuuguuuuuuggguuuuguuuuguuuuguuuuguuuuuuguuuuuccuagcugacuaaagagagaggaaagcuuugaucguuucgauuuugguagaagugagcacuaaauuaugggcuggacuacagcggucaagaaaccaaacggguguucgggaccuuagagucuaggccugagguauugcagagcuguaggcagcagcucugauuauauaucagaacccccuguuggaaauaauuggagugugguaucucugaaaaagacugguugucugccucaucaguuugauaggagcuuauugcauugagauuuggaguauugcugggaauggaacauaauuuuacuuacugguuggugaugccagagauaugcuggaaccaauaucuguuaaaucucaaaagaaaugaagauuucaguuuaauuuuuucauaggaaaaaaaacucaaaggaaaauaugauacaacaaaaaacguugaggauuuaauacuaauuaauuucaguuugauuucauauaauagccaacuccagaaaaacuccuauauccugcaaacucaggaacuauuaaaaaaucacaaaguauauugaagguucccugccaacuuaauuuggauucagacuuuagauaguagcaauagacugugagaaugaaaaggaggguuaaacuauauggauguuacacaauuuccaaacgugauaguguuuuccucuuuuuucccugggaaaugaaccugcccugaaauacauacacaggcccuugacucucugcccucagccuugucucauggcucagccgucaguaguguucauugugcauugauugggaggaaaacauaagccaaaccuuuuuuuccuugaaggagcagagcucacacugcaggcaguaaauaaugacacagaaucagaacaaacagcagcuccuguggagugcaggacagcagguguaccuugcuagaaaguuagaaacucaagaauuuggucucugauggcaauaggcauagguuacugggaaagacaaaacaauguggacuuguaucccacagacaugacccacauacucauuagaagagugaaaagacagugaaauugugaggagcuguguggauuguauacugaacaugaaagaaagaaaaagagagcgagacaaaggaaaaauaagaaaggaaagagaaccuauauuuugucaugggagaaaaacaaaaggucaaaaaccuauauagcaacaacaggguguguuucugacuugcucccaggaaccuaaaauacaugugcuauuuucucuuuauuauauccuuuuccuuaauuuuuccuauuccuaccccugcuuuccauaugaaaggaugaagaguagaacuaauucagggauaaaaacaauuuucaaacauuuauugaauacuaacauugagcagagaacugaacuaaacacuuuggacauaaagaaaaacauuccuucucugaaauccacagcuucauugcagaauaagagagguaaagaauuacaauacagagcaagagcaacuaauuauuuauucaauucccauuaccccaaaauauucaguuccuaucucuacuauagcaguuauuucacaguauuauaugggauaauucuguaauuuaaauaucccucuggcuuuaaaagcaaaugcugcucuucaguugauucugagauuuuagauguguuuuaaagaaauuauugaauucuuucagaaucuauaagaaaugaaauacguauuuacuuaacuguucaccugacguuucauuugguuccauuuucuuuuuuuccuucucuuuuuuacaucuuuaucauugacauaggauuuguauuuuuuaucugggucaauugggauaaagaaaaaaaccuugaagauaucaugcuguuuuuucauaccugucucucucgcgguauaguuacauaaaaauucugauccaaggagggagcauaauuuuagaaaaaacaaaaaagcaaaaauucuguguugcccauucuugucuuuaucuaguuaauuuuggaaacaaauguuuuagaaagcaauuuuguuauuguuuuguuuguuuguaauuucuguauuuucucaguugagaacaauaauaaaaaacaugagacacugaggaaagggauucagcaaauacugguccuauucuucucuuuuuuuguauuuuccaugaaaacagugagucacaaacuguaaggaaaaaucuauggcauuagagauuaaagagugauuaucuaccgagagucagcuuuuucauugauugaauagaguugugugacaagauucuuguugguaagagucguagacccuuuaauuuacuuggcaaauggaaagcuagucauucuuuugagaauuaucagcaaucuaucaaauuuuacccaucaaugguaaaugagauuguuucuaucucuugguaguaaaaagcuuuauauuuuuuuaaaggaaagacuuuuuauuuuucucucugcucccucuuuuuuuuucauaaaacagaacacaauagaauagaaaaaaaagcuccuuuuuuuucugcaaagucauuggcuauuuacugggaagccauaccaaacuggauuucaucacaagucucauguuuugggaaaccacugugaaaggagaaaagccaauaguggcaacugcucuuagcaaaaguauaagcuuaaaagcaaucgcuugcuaaaggcccuauuauuuaacacuaguuguuuucaccuuucuucacuagagaaauguugacgcucaucauuaauaaaaugcuauuugcuuaccacuccccaguuaguuuaaugaauguucuuuuuaccuuugucauuauccccuggucuuacaaaugcauuaaaauguauuccauaaaaggagucauuucauuuuaacauuuuagaaauguaauuauguagguaacuagcuaucccugcccuugucaguaagugaaaauuuaacaauucaaaaacaauuuuuuucuuggaauguguauuuuaguacaaaugaauaacaaaaacuuuguugugagguucaaaccaagucagugcaaacacacuucuuuacacagaaaaaaaggggaagaaucuuucuuccuuacuuccauaggcucgcauauaauauuaaggaaauggaaaucuacuuauaucucuuuucagaaagugugcaucauguuauuugcaaauuguucagguaaaggaaaaaagacccacuuaagugggaagcagcagcugauuguaaaacaaaacaaacaaaaugcaaagccagaaugagucuugagugacauauauuuucauuaaaagagagagagaagauuuagugaaaggaaugauuagcagguagaaucaugguuauugugguaagaaaaguaaacuuuauugugauaaucaaaacucuaucaucaugaaaguugcuacuggaguagagauauauagauucauaguugaaaaauagggaaagacagagcagagugacagagaacacacuugauugcauauguucauucaauguauacagggaacggaaaagaaaacugagaauccagaaacuaaaauccaaacaauuuuagaugagaacaucagauggaaagagggaacugugggaggaaaccagagagcauccaggagaccuggcacugguaaaucaaacagccgauagaggcguaucuucuaucaugcaucuucuuuguggcguaugaaagcugagaaugccaauaccugggacaaugaaaauucuauaugugagagacagguaaaacgauguaagaaagguguuuugggagacaaucugaagugaaugauaggcuaaauaauaguaguaaaagggauacaugucacaauacuaaaauuagacguucuaacuuguuuagcuaguucuuuacuauauaauucuaucuaucuaucuacauacauauuuucuucuuucuaauauacauugaguguuuauuaugaguuaggaagaaugguaaccauuuuacaugcauaaucacaugugauccuuuucauaaaucuguaaguauuguaauuccucucaauuuauagauuaagaagcugagauuuagagagauuccacaccuugcacaaaauuccauagagaggaagugcagacaaggauucaauaucuagucuuguuuauuauaaaguugauguucuuaauuauuuuuauauugcccuuuuaugcuauaauaaacauacuaguaguauugaaaaccugucagauaccuggagcauaauccagugguuccuuugugaaucagaaucauauuuuaaagaggcuuaugcuaaaucuucugaaugaaaauguguagaagugggaccaaagcaugcagagauuuuaaaaacuacacagaugaguuguaaaaugccuauuaaaaacagaggagaauagaacucagacuguuuucugaaggagauuuaaaccacaucuaauuucuuugugauuuacauaugaaaagaagcucuaccucauuagccaucuagaaaaugcaaauugaaaccacaaugaaauacuauuuuacaucccccagaaugacuaaaaucaaaaagacugauaauaccaaguguugacagagauauggaacaauuagagcuacuggugaguauuuaaaauggugccauccuuuuggagaauaguuugguaguuucuuauaaaguugaaaacagcuguguuaugaccuagaaauuccacaccuagauauuuacccaagauaaaugaaaacauauccacaaaaacuuguacaugaauaacaaaagcagucuaauucacaaaaucaaaaacuaaaaacaacucaaauauccauaaauaagagaauagauggguaaauuguugauuauucagguauuggacuauuauauaaucaguaauaacuaagaauaaaucaacgacacaugcaguguggacaaaucuuacagacauucuggugggcaaaagaaguuagaugauuccauuuguaugaaguacaaaauagcccaaacuauuuaugguaacagaaaucagaaguucuugcuucuucuauguguggagaggaacagagacugacuagaaaggggcacuggagugaauggaaauauucuauaacuuguuuuggaugaugauuacacaauaguuuacaguugucaaaauucauugcuuugaacacuuaaggcuggauuggugcauguaaauuauacuuagauguuaaaaaguauguacuuucuguugucaccuccuuucuccauuugcaaaagagaaaagugaggcucaauauaauggguaagauuauauggcucucacauuauagaauuuucuuaagaauccaggucuucugauuuugagucccaugccuuuuucacucuccaguuuuuuuuuuuaugaucuuaucucuccuucacaauguauuuauauauuuagcaaaagaaacaaaugaacugcccauauuuucaauaaaaaaaguguuugagaaaauugcaguggcuaaugcaucaaaauuaacuagguuuugcccuauucugaacaaauaucuaccaucaacucugaaacucucuugguaucacuagccucacugugcaagaguagccaauuuuuuuuucuguguaccacaauguauccucuggaaacaaacaggauagaugacuuggcaccuuucucaggauuauauuuuauguuuaaggaguuccucccacacugguaaauguaaugaauagacugcauuucauuucauugaauugcuucuguagacacucacaaaagaucagcuucugugcacuucagucagacgcacaguuaugaaagugccauaaaaccugugugaucaccaccugcauguaaaaaaugccagcaauaacuuaccaacauauuuccacugaaaauaugacuuugacccagauggcaaaauaggcggcguuggccguaaaucugcaggcaguaaaugggcaggugguaaaucugcuaucauugcuacuguuuucucaacacuuuaucuguacaggcuuuucuuaaggauauaaaaauucuggaaauauggaaaaagaaacaaaacauggacuggaaacucuggugugaagcuguaaguuucuugaaauuuagguaaccuguccuuagauuacaggcucaggucugagaugcuaugaaguaagaaaaaagugugcugagaauagaggauaaaauuuaucaaaauugccaagucaauuuuuaucaguuuuggcagcaaggaucaccuggaaaugcaaagcguguuuucuuuuuuacacagaaaagcaaauauucucuaaacauuaaaaguuuauuuaccucucaacuucaauucccuaucacaguuucuucuacccaaaaugagagaaaggauauaacaagguuaucauggauaugguggaaugaagcaaagucaacuuugaaauaauuugggaucauauuuagaucacaccuuauugaguggagauuugguuuucuccagaagggaauggaugucucacuauucauaauccugugaagaaauguuuaauucugggcaaaaaaaaaaaaaaaaugaugcagaaauugggacucuggaggaagcaucuccauuacucuauacauugggauauuugagccugauuccgaaguaugcauuguagagaucaagggcagcuuccauguuuacauagagguacauuaggaaugccaccccuugauuccuagaccuuuguauucuuccuaacagggacgcagcaccauauaaaggucuuugauugaaugcauguucuagauuuuggaggauggcacucucuccucucagacuauugccugcaaucuggcauuucagcuaugcuuucagcaggcgguucuaauacauuauauggucagcagucuggauuuagugugcaauacaacuaguggguccuguagucauaaguccauucauguaccucuuuggcuguaaaagaggagcccuugugaaugggauuccaugcuaguggcccaaacacgcugugagccuuuaauaguggaacuggccaaggcaggcccaaauggcaggaaacacaaagcucuauauggaaugaaucuauuccagugagaauaaaccacugaccuuuccagaaugcaagggaaacaaugcagucaaccugcccucauguguccagucuccucaagcaaugaugccauaaugagggcucaggauuagcuuguugggggcaguuggacacugagcagcaacaggagcuagaucagccuugacaagugggagcugaugccguuggacccauguguaguauucauauuugacaucauagacacuuuguuuaugugcugauuguuccagcacucaugaaaucaaugauagcggcuagcuggcaguagcuggcuagaucauuuuguccacuugguuguuaaaugccucuuucauugcagguguucuauaguagauaucaacauauaauacguagaucuucucauuuugugcaauccuauagguccaucgauguguuucuaccucauucauccuugucugugacagucuagccuuuugcuuccaggccauuugcauaggccaccucuuggcuacuuucugugccacuucucuuuccacaugaaguagaagaccaguugcacugccuaaagcccucacucacugaaauaauuuucccucacuacugucuuucaagcauacaguauaagucuauaguguagcugcuguccauuuuuggcucacacucacauacaaaaaaaaacccuucuggaaaccaaauuaaaaucacuucccccuuuauuaguuggucauaccugaccuccuaugugaccugguugugggaggaguugcuggugcaauagugcugccaugggguucugaauuaucugcucauguugcuugcuuaugucugccugucccacucaugcuucaucucaaauguaucucuuucuuguguaauuucugauaaucaucguuuggagcugcauggucaggugcucugucucuaccaggacauauuuuucaaagggcauacaguuuugcuacaaaugucaugaugucuacagguccguagaggccuguguugugauuuuuucacuaggacuugccacagauaucauaugguauuuuuucccaucacugauagcuccaacacugcaggcuucaccaaauuacgugguccaagugguggggcuguugcaccuuagccugaaccucuucagagcccuuucuacucugguuucacucaaauuuuguucaacuuuuuuugugugugucaacuaguacauuucuaaguauuaaaugaauagauuaccuuuuagaaugcaaauacccgcuaggacauuguauucccuucuuuguguuaggagguacaaaaugcaguauuuauucuucacuuaggacucuucaaauaguuuuggacagccugacccuuuaagcuucacagguucuauuucacauccucuggaaugcauguguucuuccaaggccuucagaauguuagcuaccucuugcucaucuggcaugaucaauauaauaucauugauguaauggauuaaugggaaguacuguggguuauccagauggugcagaucucuuuagacuauauuauagcagagggcagaagaguuaacauagcccugaggcaaaacuauaaauuaauauuguuguucaauccauguaaaugugaacuguuucugauugucuuuucugacugagauagaaaauaauacauuuuccagaauaauggcuuuauaccaaguuccuuaggccauauuaaucugcucuagcaauauacuacaucuggcaugacagaugcaaaaagggacuauuucuggguuaagcuuguaguuaucuuucagaauccaucuuguuuuuccaggguucagacuaguaaauuaaauaauaauguuaugagaacaaauaccucuacauucgugaaaucuauaaggguggcacuaauuucugacuccaucucccacucccaggauuaaauagugauuuugauucgcuaucuuuguugaaggauggaaggagcagguucagggacauucacuuggccucaugcugugugauagcucugaccccagugaccaaagauccaacucccaagugucauucuugauuguacauuugaggacaagagagaugaccauuaguagauacucuauaagauggacccuaaccgcaacuuaauuuaaucaugugucauauguccccuauaugcccuacucuaacaaggagaccaugaugaugggcucuggauaucaacuucaacuuaaaucuuguguccaacagccaucaaauuaucuagauauuuaauuuccccaaucaaauggccauaaucccuguagggaaggacuggaggaaucauuaucauguacacuuaccauauaauuguggaguccuuacuccuagucagugccacaucuucacugaauggguucuuugucugaaaacuggcucaggucuggaaacugggaaagggaucaugaauuuuuauugcugugacugcccucaaucuucuggucaucuaacuuugaguucuuuugcugcuaaaaucugaguaguacucauguuggcagucuguuuauuuugcccccacuggugucgucuuuuauuaacaucuccauaaccaucugugggucagaauuucuuguuuaucacucugauauagcuuucauuaccaaaaaauaaaaguacaaccccauuagauucugacaaugacgcauugccccuuuguuccuaauauuuugaaaucuuauuauccacacugacaucagugggacacaaucuguaacagccugucccccuucugguucuugcccagagagcuaucagggaauuuuuacugaugccgugucauuguuuuagcacauacauaauggccuuggugucuucuggcuuccguguggagcauacucaucuacagggucuuucaacuguacauugaauauucauucuagcauuuuccugacccuguuaucccuuuccuccagagccuaccagggcaauucuagcauuucaacuucaccuuuucuuuuuuauccccccuuugacauagauuugcauugauuuauuucuagaauaagauaugcauaugauagcaucuauuucuggagcauuuuauggaauuaguaaagcauuauacuucccaagaugauucucuuuucuuuucuaucucuuuguucuuuauuuucauguuauagaaaauguccucaacuuuaucuuucaauucuuccuuucaauuuuuaguuuuaguaaauacuugcuuaauuuccaagagcucuuucuuauucuaugaucauuccuuuuucauaauauacucuucuuauuuuacagauacaaacccuucucgaaccucucuaaggauauuaaauagaggauuacuguucuauuuggucuauaguggcauuuauuuuuauguuacuacuuuucuuucuaugcaaucauagcugaugcauaacuggauucauuuuucaaugccacugaugauagucuuuguugucggacaucucuuuucccaucaucuaauuacuaggucuuuuccaagaauagaaaagcugacuaguucuaugcauaugguggggcuuguugcugggcagaauucuaucaccaugagaagauaauaagcuguuacuggcaccaacaucacuuuuucuguguuucuaggagucauccuaguuucagaauugugccucagcuuucuuuagccccucacuagaacagaugcugacuucuuuguauaaaauauaaaaggcccacuggcuucuacaucuagcuuucaauugccuauaccuaaucuaaaugcuuuguucuauaaugcucuauuguacaauagaaauauaaugugagccacauagguacuuucaaauacuucuaguaguaacauguuaaaauguaaagcaaaacaaaacauuuuuuguuuugcuccuauggaugucguguuuuauuaauaucuccauaaccaucugugggucaggauuccuuggcugucacucugcuggagcuuuuauuguuaaaaaaauuuaccuccuuggauuuuauacauaguuuauuuuuauguauuuauuauuuauuauuuuuuagcuuuuguuuuauuuuagauucagagucauaugugcaguuucauuauauagguaaaaugcacuucacagaaguuugguguacagauuauuuugucacccaaguaauaagcaugguaccuagagguaguuuuucagaucaucucccuccucccaaccuccauccucaaguaggugcuaaugucuguuguuccccucuuucugucuauguguucuuaucauuuagcucccauuuauaagugagaacaugugguauuugguuuucuguuccugcauuaguuugcuuaguuagauaauggccuccuuguugcuguugcaaagacaugagcucauucuuuuuuuaauggcugcauaguauuccaugguguauaugcaccacauuuuguugauccagucuacuguugaugaacauucagguugauuccuugucuuugcaauugugaauaguucuguggugaacauacucauguauacgucuuuaugguagaaugauuuauauuccuguggguauauaccuaauaaugagauugcugggucgaaugguaauucuaaguucuuugaggaaucgcuacaccguuuuucacaauugcugaacuaauuuacaccccaaucaccaguguauaaguguuccccucuuuuuacagccuugcuggcaucuguuaauguuuugacuuuuuaauaauagcuauucugacuggugugagaugguaucucacugugguuuugauuugcauuucuguaaugauuagcgauguugaguauuuuuucauaugccuguuggccccaauacauauagguuaaacuagcugcauuucaaaaacacaauagcaaugcaugcuaguggccacuguacuuggcaacaugacuguagaacaccagcagugcuuagccauagccacccaauccugauaaaguuuuauguauuauuuuucauacauuucaauaacagcagcaacaucugcuguuucuaucacuacauccucacacucuaccagguuuccacaggugaaaauuuccuuuggaugccacuuuuugccaggugcagucuguguuccuccuuacuagugaucagucaucauugccugcaggugggaaauaaucuagcuccaaaaacuaaacgccaucuuccagccugcuuccucgaucuaguccugguauugacuguccagauuggauuuucuggaagcagaugcuggguuugcauguaagauguuuauuagggaauagcgccuaugaaaggaggcaagaaggaaauaagacugauaagagaaaaauguuaaguugugaugaacgucuaacuaagcuuuuccaaccugguggggaaguacuugggcuaaaauggccaccagaauuagcccaugucagcgaacuggcaggcacuuuguacuaccaucuugcuuaaccauugaaugugggcuguuugagccagguggcugagaacaaacuuggagaagcugauagcuggaggcagucugcucaccacauccccuggaagcugcaugagcaagucuuuucuuuaaaaagaguaggcacagcacaucuccaugucuacacagaagccauugguaaacuucagaugcagaaaccgugccagaauguuagagacggaaaccugauuggagugggcugaggagagaaugcaaacuauuaaaaacuuggcaaguuggcuugcuguggaggcaaauaaaggaaugggagcuaggugaagagggacuggagucaggauaguuuuugucauuuuuuuuuuucuaguaagagauagauagagaaaaaaaggaagugacaguauugauuaaaaguagauaauauuagggggaaaguuuuugagaggccauaagggauguaauacaagcacaguuugaagggcugcccuuugauagaaccaggaauauuuuauucgugguaauauucaggaaggcagagagugugggcacagaugcagauuaauugguagauuggggaaugggaacaggagcaauuuccuacuugacuguaugaaacaaagugauaugguuuagcuguguugucacccaaaucucaucuugaauuguagcucccauaauccccaccuauccugggagggacccagagggagguaauugaaucuuggggguguguauuuaucaugcuguucucaugauaguaaauaaguuucaugagaucugaugguuuuauaaagggcaguuccccugcacaagcucgcuugcuuacugccaccuaagacaugccuuugcuccuccuucaccuucugccaugauugugaggccucccuagccauguggcacugugaguccauuaagccccuuuuuaaaauaaauuacucagucucaguuauuucuucauagcaguaugaaaauggacuaauacaaaagguuuucugcuaagaugguaaaagugcauguguggugguguaaaaggaggggaaucauacagaaaguuugagggaaaagaagacauguaauuguuaagcauacaaaagccaacauaauaauaaagcaaauuaggauuucacauauugaguucucuuugaguuuucuggucaugaauuugaauucagaccaaacagcaaguacauaagcaaauacuuaaauuuuacugcaucuucugcauuuccuaaauaaguaagacaagggauauuugggauaaaaaacuuaggguguuugaaaggaauugauuuuauugaugcaccuugaaauucaauuuguguaaaaagcaaguuaaggacauaaggggugguuauuuacugauaguggaaaaguagcaaaguucuaugaaagaguaauauguuaaaccuuuuaucacuucaaccaugauccaguuuaucagugaucacuggcucacuuaaauggauagggaaaauuauaaguaaaaaaagucgaggaagaggauguucgugauggauuuuaccaauagcacauuuggcuaaagaauuguuuccucuguaccugaaaggaagggagauaccuacuaauuagaaucuuaggacuuagaauauuggcagucaauguuauauaguaaaaagaacuuugggaaggguaauacauaaugguaaagagaucaacucaacaagaagaacuaaguaaccuaaauauauaugcacucaauacagcagcacccagguucauaaaacaaguuuuuagagaccuaaaaagagacuuagguucccacacaacaauagugggagacuuuaacacacuauugccaauauuaaacagauaauugagacagaaaauuaacaaggauauuuaggacuugaccucagcccuggaucaaguggaccugauacagaucuacagaacucuccacccaaaaacaacagaauauacguucuucuuaucaacacauggcacuuacucuaaaaucaaucacauaaguggaaguaaaacacuccucagcaaaugcaaaagaacugaaaucacaacuaacaguuucucagaccacagcacaaucaaauuagaacucaggauuaagaaacuuacucaaaaccacacaaauacauggaaauggaacaaccuucuccugaaugacuccuggguaaauaaugaaauuaaggcagaaaucaauaaguucuuugaaaccaaugagagcaaagagacaacauacuggaauaucugguauacagcuaaagcaguguuaagagggaaauuaauaaaacuaacugcccacaucaaaaagcuagaaagaucucaaacugacacccugauguuacaacuaaaauaacuagggaaccaagagcaaacaaacuucaaagcuagcagaagacaagaaguaaccaagaucagaguggaacugaaggagaaagugacacaaaaaucuuucaaaaaucaaugaagccaggagcuaguuuuuugaaaaaauuaauaaaauagacuucuagcuagacuaauaaagaagaaaaaagagaauaaucaaauagacacaauaaaaagugauacaggggauaucaccacggaccccacagaaaugcaaacaaacaucagauaauacuaugaacacuucugugcaaauaaacuagaaaaucuagaagaaauggauaaauugcuggauacauacacccucccaaggcugaaccagaaagaaauugaaucccugaauagaccaauaauaaguucugaaauucagacaguaauaaauagccugccaaccauaaaaagcccaggaccagagagauuuacagcugaauucuaccagaguuacaaagaggagcugguaccauuuuuucugaaacuauuccaaaaaauugaaaaggagggacuucucucuaacucacuuuaugaggccagcaucauccugauaccaaaaccugacagagacacacacaaaaaagaaaacuucagacaaauaucccugaugaacauugaugcaaaaauccucaauaaaauacuugcaaacugaauccagcagcacaucaaaaagcguauucaccgugauaaagucggcuucauccccaggacacaaggcuguuucaacacacacaaaucaauaaagagaacuaaagacaaaaaccgcaugauuaucucaacagauucaggaaagaucuuugauaaaauucaacaucccuucaaguuaaaaacucucaauaaucuagguauugauggaacauuccucaaaauauuaagagccauuuaugacaaauccacagccaauaucauacugaaugggcaaaagcuggaagcauuccccuugaaaacuggcacaagacaaggaugucaucucucaccacuccaccacauaguauuggaaguucuggcaagggcaaucaggcaagagaaagaaauaaaauguauucaaauaggaagggaggaagucaaauggucucuguuugcagaugacauuaugcuacaucuaaaaaccccauaaucucagcccagaagcuucuuaagcugauaagcaaauucagcaaauuucaggauacaaaauuaaugugcaaaaaucacaagcaucccuauacaccaauaauagacaagcagaaagucagaucuugaaugaacucccauucacaauugcugcaaagagaaugaaauaccuagcaauacagcuaauaagagaagugaaggaccucugcaaggagaacuacaaacuacuucucaaagaaaucagagaggacacaaacaaauggaagaacauuccauucucauggauaggaagaaucaauaucaugaaaauggccauaguuuccaaaagaauuuauagauucaaugcuauuuccauuaaacuaccauugacauucuucacagaauuagaaaaaagcuacuuuaaaauucuuaugggaccaaaaaagagcccauauagggaagacaaccguaaacaaaaagaaaaaagcuggaggcaucaugcuauuugacuucaaauuauccuauaaggcuacagcaaccaaaacagcgugguacuggcacaaaaacagacacauagaccaauggaacagaauagaguacucagaaagaagacugcacaucuacgaccaucugaucuucaacaaaccugacaaaaacaagcaauggggaaaggauucucuauuuaauaaguggugcugggaaaacuggcuagccauauacagaaaauugaaacuggacuccuuccauacaacuuauaaaaaaauugacucaagauggauuaaagacuuaaauauaaaauccaaauuuguaaaaauccuagaaguaaaucuaggcaauacaauucgggacauaggcauggagaaaauuucauuaugaaaacaucaaaagcaauugcgacaaaagcaaaaauugacgcauuggauauaauuacacuaaagagcucagcaagugggaucuaauuaaacuaaagagcccaacaaaagaaacuaucaucagagugaacagacagucuacagaaugggagaaaauuuuugcaaucucuucaucugaauaagaucuaauaucugggaucuacaaggacuuuaaacaaauuuacaagaaaaaaacacaauaaaaacacaacuccauuaaaaagugagcaaaggacuugaauagacacuucucaaaauaagacauugaugcagcccacaaacauugaaaagaagugcaacaucacagaucauuagaaaaaugcaaaacaaaacugcaguaagauaccaucucacaccagucagaauggugauuauuaaaaagucaagaaacaacagcuauuggcaaggcuguggagaaauaggaaugcuuuuacacuguuggugggaguguaaauuaguucaacuauuguggaagacaguguggcaauuucucaaagaccuagaaccagaaauaccauuugacccagcaaucccauuacuggguacauaccaagaagaauauaaauuauucuauuauaaagauacaugcacauuuaugcucauugcagcacuauucauaauagcaaaggcauggaaucaacccaaaugcccauugaugauagacuggauaaagaaaaugugguacauauauaccauggaauacuguacagccauaaaaaggaaugaauuaauguccuuugcaggggcauggauggaacuggaagccauugccgucagcaaacuaacacaaaaacagaaaaccaaacacugcauguucucaguuauaaaugggagcugaacaaugagaacacauggacacagggaggggaacaacacacacuguggccuguugggggauagcaggaggaagagcaucaguauaaauagcuaaugcauguggggcuuaauaccuagguuauggguugauaggugcagcaaaccaccauggcacauguuuaccuauauacuaaaccugcaugccaugcaccuguauccuauaagaaaauaaaauaaaauaaaauaaaauaaaauaaaauaaaauaaaauaaaauaaauaaauagaacuuuggauauugagucaaaagaccuggguuugaauccuggcucuauuauuuucuuucauuaauuuauuucuuuauucaguaaacauuaaguuagcaacuacuaucuaccagacacuuuucaaaaggcugagaagaaauaauaaacaaauugaaaacuucuucucuaaaacaggcuuauauucuaguugcuuuacaugucuagagaagagagaaagaguacauauaauuauaaguaaguaauauaauuacuuacuuauaaguaaauuauaaguaaauuaaauauaaguaaguaaauaaauuaaauaguguaauuucaaauuauaaguacuaugaagaaaaugaaaggaguuaugagauagccacugacuugggccaaggguguacagcuacuauguaauaaggugguuaggaaaggaggugacauuggaucugaauaaggaagaaccaccuauacaaaugaagaauuccagucagaggggcaaacagauagcucuuuuaucucagauaaggaacuugaauuuucugugccugaauuccuuuauuaauaaauuaugauaauauucccucaagaguugcuauaaaaauaaauaauauguggcacaauacccaggaaauaguaagaaaucauuaaaauaggauuugcuuuuaauauuucgucauggagaugguuacaguuccccgaaggauuuaggagguaaauauaauccaccuuuugugcagacuccuucaguuaaaacaccuaaaguucuaaugaagauguuucacagagccuacagcagaaucuuuuggcauuaugucuauuguuaaaaaccaccagaaugucaagacaaauuuucaagaauaccuguuuuauggaaaagcaaauuugagaaauauauaccuuaauaaacaagaauuaacagauccauuaguccauucuugcgcugcuauaaagaaaugcuugaaacuggguaauuuauaaagaaaagagguuuaauuggcucacaguuccacaggcuguacaggaagcauggcuggggaggccucaggaaacuuaccaucaugguggaaggcaaagaggaagcaggcacauuuuccauggcuggagcaggaggaagagagagaagggagaggagcuacacacuuuuaaacaaccagaucuccugaguacucacugaguaucaugagaacagcaagggggaaauccacccucaugauccagucaccuuccaccaagcuucuccuccaacacuggggauuauaauucgacaugagguuugagcggagauaggaauccaaaccauaucaauaaauuugacaaaucuuaaacaauauugcucuuucaguaaacucauuaaaaagcuuuuaauguguuuccauauuguauauuugauaugguauuacaguauuaauacucuuucaguucuauucaugguuauaauuagauuaucugacuggaaaauuacaagauuuacuauaagguuaguggcucaaaugaauacugcagauccuggaagggaggcacaccauacugucaauuccauucucuguguaaaagaaaaaccaugauuucaaaaaugucauuacuguauaauuagacacuuuuuuaauaauuugaaaugaauaggaaaacagccauuagguccuagaacacaaaggaaagcuuaaccaaagcauagguuaaggguagcuuaaccucugccuuaccccaaagcugcucugcugucugucauugcuaguuaauccagagugcagauugugcaccgaagauugcuagcuugaauaaaugauaauauauuauuuccucaaacaugagcagcuuaugguucauaaccaacuucaucuggaucaaccauugcaguucacugauaauaaaaaucuuuugaaaaucuuuuaagagacaauuaccauuugucugagaugguuuuaguuucccuucaugcaaaacuuuuacguuuuuuccuugacuugcuuaaagcaauuugucuguuaggaucacagguugguaagacuuucagaaaucauguauuaaauuuauguacuuguaaccaagugacacuggagucacuuuagaauguugagcaugugaauuacuacguguaugugcgcgcacacauacacacacauacacacacacacauuggacauguuagcuucauuuugucaggaaguuauaugucauauauaauaauacuaugaagucagagaauaguuaguagagacauucuuauuuauuuaauuguuuacuuuuauucauuauugcuauggauaccuuugaaaaagugaaggauuuuuagauugugguuguucaauuaguccuuuuugaucauuuguacucauuacuuugcaaaaacuugaagggcauacuugguuuacuuuuauuaccccaauaccuaauacaaagccuaagaaauagaugacacacaagaaauaauuugugaauaaaugauuauggcaacuuagcuuacuguugcuucaccauguggguggcacuuaaaucacucuuugaaaagcaagauaaaugacauagcuagcugaauuuccacggaaguaaauuucuaaagaugagaccaaggccuauuauaucuguuuacuuaacugccuuguguaaugaugaugggaggagugugaugaugcagguuaauaaaaaacucagggaagcaccacuuuccacaagggcacacacucuuuugcaacacgaauaaauuggaaacaaugaauggagggauagccauuuuucuuuccuguguauccaucacuuaucagugcccccccgugcugcuuuucacacauggagauauguauguuuaauaagcaauagguaaagcucuuuaaaaggaugcuucucaaucacaaugcaacuaaggaucuaaucauguaaauggaaaaauaaaaccacauacacacacuccuauuagguuuuacuagccagugaugaauuggcauauauagaaaacaaguuacagauagagagguguuguuagugucauuuauguuugcuuugagcuauguugguaugcauugauuuagaagcuuuagauaguuuacucuaagaggaggaaaaucacauauuccuuuuugggugucuaccacugugaaaaaaaaugucucauuuucuauuguucuuuuuuuuucugaaauaagaauauguaacaaggaguugggggaagauauuaugcaacaaauccuauucauuuucauguuacugcuuucagaacuaguauuaccuuggauugcagagcaggugaaguacauucuuuuguuuauucuaaaaucaugcaguuacaguaaaaaguauaauaaaggcucuuuugagcugcauguguggaauauacuuguaggccugaaccagcugugugacugacaggcucccuaaccucucuucucaggcuuacuucaucuguaaaauagggaaaauauuuaccuggcauaauaacugugagaaauaaauaauauauuuaaaucacauuuagcacucaaauauauuuguuuucaucuccaccaucuauaccuauaggagggcgagggacuauuuugaguuauuucaaacagaauguaaaaaauccuuaguagauacugaagaauuuaaagugauagugaaauucauaaaguuugaaaaaucaugaaacauuuauuucuuuugauuggauucaguuccucauuuuuaaagugauuucagagugauuuucccucuuaagaguugcaacuuuuugguguuuggugguggugaucuuacuggcauguuuugcuuuuucuugcaaaaaguuguaugauaucaugugccauuuuauacauuauggaacaauaacuuuucuuauuuuccucucauuucaguuauuuauuguuugacauaaauaaaugauauuuuaaaauucuuuuaaaggauacaauauguguauauguauaagaauuagauaguagauauuuucuuggagaguggaacaaauuauaauauaugacaaaucuccuuuuuaugcauuuuuauauuuaugaaaacagaaguaaauaaaaaagaaugugcuuagaaaucucagagcuuuuuuggugaugauacucacuguuucccucucaguugcagaugagcuuuuguagugugcaaguuacucagguaggaaguaagaauaaacuuucguaagaaacugcuuacuggauuuguccccuccaaauuuuagguugaaauguugauuuuuaaaaaauuugaaaugguuuguuaccuuagacuuuguaaaugcagaaaaagcauaaagugaggcuaaauccaaauaaaauaaaaaaucagagcauuguaugcagcuaaauuaagcaugaacaauuuccauuaaccucaauuccucuucaagaggaauucauuaaaucauuagauuuggaauguaguaucacugucuacuauuucuguuuuuggccauugcaacuucuaucuguauacacuuuugaucagucuuuucacaggguguuuuauuguuauuuuuuauuguucuuuauuugauugacuucucuuuuaucuauuacauaaaauguuuaauuucucuguccauaaauguuugaaguuugcauuuuaaguuguaagucuuuuuagccauauuucagugcuuuauugcacagaaacaauaugaaaugcuuucuaauuacucuuacaaugucccauacaguauuuauuuuaaaaauagaucgacauggccaggugcgguggcucacaccuguaaucccagcacuuugggaggccaaggcuggcagaucaugaggucaggagauugagaccauccuggcuaacacggugaaacccugucucuacuaaaaauacaaaaaaaaaauuagccgggcauuguggcaggcgccuguagucccagcuacuugggaggcugaggcaggagaauggugugaacccggaagguggagcuugcgguaagcggagaucacgccacugcacuccagccugggcaagagagugagacuccaucucaaaaaaaaaaaacaaaaaaaaacagaucgacauguuugcgcaguacuuaaguuugugugguaugcuaggauguaggauggggauuaaaacuuauuaguuccaaaagacaauuucauuucagauaagucugaggccuuaucugacacguacugguuucaacacuuggggagauuaacuacccacuuuuuaaauuuuuauuagaauaagauuauugccuuauagggccauugugaguauuugauggaauaauguauacaaauagcuuaccacaguuuugggaaaauaauaauuucuucauuaguaugaaguuuugccuauauuauaacaauuuccugaaccaguuuauggcacugacaucaggaaccuguagguaaagaaagaaaaauacaugcuagauuuuuuuuuuuacaauaguggguaggaggaauuuucaaaaggauuuugaguugaaauuauuucuuacuuuuuauagaccuacacacucauuugauacuuuuuauacuacaguauuaaaaaucuuuguuaucauagggcuuuacacuuuaaccauuuuaagcccuaaaucauagggauuccaacuacaguaugaaagacagaacuuuaagaugauuguaaaaauucacauggugcuuaacuucaggagcuagaauuuuuaauauuuuauaguauauuuucuuaaaaaauuuaauauaacuuuaauauaucuucuuggccagaccaaaucaacaguugauuaaaaagguauuggucagggaacuaaccuguccaauggaaaaagcaaagguuuuguuuauugugacaugguuuuucauaauauuuuguauuuuuguauuuauugcccacugcaauauucagauucuugaguuagauauuacuuaauuuuagaaauaauaauggaaauuucuugguaaauuuguggcagauguuuugcacacacugaauuuuaagaaaguuaauagauugaaauccuuacuucauauugagauuauuuucaaucauuuuuauuuggauaaugagaacuuaagcaguuugcaaaagcaaauuugccauagucauuauuuuuucauuaaccacuuaauuucuguuugcuuuucuucugccuauuacugagaacaugaauaaaaauuugcuauucaaauaaaccaggugcacaugcauuucaauucuuugcuauuuuacauuacagcaggcaaguaguuaagcauuuaacaaaagaaauaagagaaauuguaaauauuguuugcaaacuguaaugagcuugcaaugaaauaucuagcuaaauacaacauuccaauuaucucuaaaauuauguugguguguuacuauccuugaaagugauauucaaaaacagugcaaagacaucucugugauaucgggcgaaauucagccccgauguuucacguagguucuuaucuauuuucccuaagugucggcuggucugagaaauaaagggaaagaguacaaaagagagaaauuuuaaaacuggguguccgggggagacaucacaugucggcagguuccgugaugcccccugagccguaaaaccagcaaguuuuuauuagugauuucaaaaggggagggaguguacaaauaggauguaggucacagagaucacaugcuucacaagguaauaagauaucacaagguaaauggaggcagggcaagaucacaggaccacaggauggggcgaaauuaaaauugcuaaugaaguuuugggcacgcauugucauuaauaacaucuuaucagcagacaggguuugagagcagacaacuggucugaccaaaauuuauuaugcgggaauuuccucauccuaauaagccugggagcgcuaagggagacuggagcuuauuucaucccuacagcugcgacuguaaaagacagccacccccaaagcagccauuuuagaggccuacccucagggaugcauucuccuucucagggauguuccuugcugagaaaaagaauucagcgauauuucucccauuugcuuuugaaagaagagaaauauggcuguguuccaccuggcucacuggcagucagaguuuaagguuaucucucuuguucccuuaucauugcuguuauccuguucuuuuuucaaggugcccagauuucauauuguucaaacacacaugcucuacaaacaauuugugcaguuaaugcaaucaucacaggguccugaggcaacauacauccuccucaguuuacaaagaugaugggauuaagagauuaaaguaaagacaggcauaggaaaucacaaggguauugacuggggaagugauaaguguccaugaaaucuucacaauuuauguucagagauugcaguaaagauaggcauaagaaauuauaaaaguauuaauuuggggaacuaauaaauguccaugaaaucuucacaauuuauguucuucugccauggcuucagccaguuccuccauucggggucccugacuucccacaacacugugauuccacaugugaaccuaaacuggcuggugucuacguaugcagucuguacuuacacugugcuaugaggccagcuacuggaccauggccagcagaucccuuagaacugcacugcaugcaugacaucuguucuuacuaauuaauucaccuugcaacauucacauuaguugggaagcuuggcaacaggaccuguuauugcuguuuauuaucaacuuuauaaaacaugaaaaaacaaacacagccuaagauaacugucauauuccuagcaaucaucuccaaauauuacauagaauaccaacuuuauauaaauaucagaaaugaaaugguaggguuguauacuagacuccugauuccucucccuguuaucaaccuugauuuauuauuuuguuauuauucuauucauauuuaauaaaaauauuuaaugaaaguauuaaauauuuuauauuuaccauauaggccuuagaaguacaaauaugaaggucauuauucuuugacuagcagagaagaaaauauaaauacauuuccauuaauuuaacaaaugcuuauuaaacauuuauuaucugacagaaucuauucuaggcacugaagugaacaaugaccaagaucaacaaaaauuucuauucaaggaacuuugguuuuaguaagaagggacaagaaacaaaacauauaaguaauuuauguaauacgucagaaggugguauguucuaugaagacuuuuuuuuaucaaggaagguagaaagguaaaauuuguaaacagaauguucaaggaaauaauuuuugacaagguuauauuuggacaaauaauuaaaagaaguacaaggaaaaagcuaugcauauaucugaagggagaguccagauaaaugaaaccacaaguuauagccccugagccacggaaaugucagagagcaaggaaccaauggagcugguagaaaaauaguaauagauuauauuggaaaagcaacaggauguagagaggaaggucacuguuagccauuggacagacuauaccccuggcucugagugugaugguauauuauucugcuugagcuaccauaacagaauaccaaagacugagugacuuaacuaaagauaguuauuuuuauaggacuucaugaucaagaugcuauuagggaugguuucuggugguaucuuucuuccugacucauauauagccacauucugguuguguccucacauggccauuuuuugguguguaugcagaaagaaagacagcucugaugucucugccucuuacuauaaggacaucagucauauuagauuaggggccaaccaagaugaccucauuuaacguuaguuaccuccuuaaaggcccugucuacaaacccuuaaacugacauuggagguuaggauuucaacauauaaauuugggggaacacaauuuggccuauaaaauucucaccucugccccauuuccccaaauucauguccucacuuacaauacauucaccacaugcuaagagcaccaaaagucuuaacccauuuuggcauaaauuucaaguccaaagucucaucuaaauaucaucuaaauagaauauaggugagucaagagguaugccucuuccugaggcaaaguuccuugccagcuaugaaccugugaaacaagacuuguuauguguguuaaaauuacaacaguggauuagaaauaagauaaacauucccauuccaagagagagaaaucagaaagaagaaagacaugaugagucccaagccauucuaaaaccuaucaaggcauuuuauuagaucuuaaggcuuaagaauacuccucuuuggccagaugcucugcucuccaggcccaauaaggcagcagcaucccuuccauagccuuaagcauuauccugcccccaugacucuuuaaggggcaguuuggcuacugaaaucuaggagguggccccacccucucugagaaguaaauaaucugccuuccugggcaugcaugcucugggccuauggugcaagugggagcucugaugaugucugaauuaccuucaaggucauacuuucuuuuuuuguaggauaaagcaugaucacauaugaauagcucuauuuuccugugcuggccacuggagacauagcugauuaaauccaugggcaaucucuuuauggaguacuuguucagccauaucuuuguugucccuuccagaacauacuuucucauuuuuuugcaguauguauaaacugauaauucucuaaaucuuuaaguucugguuuuuuucuguuaauaauuucuucuucucuuuauuucucuccuuucucauuuuaucuuaagcaguaaggaaaacccaagcugcaccuucaacacuuagcuuagaaaucuuuucagcuaaauaucuaaguuuauuauuuuuaagcucuaccuuccacagaucacuagaacacaauucagccaaguauuugccacuucauagcaugaacaguuuuucuuucagucucugauaacauguuccucauuuucagcugagacccuaccagagcaccuuuaguguucauauuucuacuaacauuaugguaacgauauauauguucucuaaaacaauaauagcuugcacuacugucuuccucuuuucuuucagaacccucaucaguaucaccuuuaauguccuuauuucugcuaacaacagaaugcaguacauaacagauaagaaacuauuggaguguuugggcgaaaugcaaugcaaucugauugauuuuauuagaauuacuaugacuucuguguugagaacugauugccugggacauggacaauagcagaugaaguuaggaggcucuaaaguuagaggcaaauagauuuucugauaauauauguggagugugagaauaagagggaaaccaagggugauuucaaggauuuugguuugagcaaauuggaaaaacuaguuaugauuaacugagauaagaaaggcuggcaugauagauaguuugaguggaaauaacaagaguuuucauuagacauguugagauauguacuagacaaccaugugaagauacugaacagagaauuguacaucuaaucuugaacccaagggaaagaaaugagggagaucugugucuacaauucagggaagaguucuugacuuuuuaguugguauuucaaaccauaaaaugugauggacucacuaaagcaguaauguagauaaaaggagguccaacaaucuaugcuugagaugcucuaacaucaggagacuagugagauaggaggaaaaaaccaucagagcugacuggcaaagagaggccaguaaagguuaguagaaaaccaggagagugugauguccagaaaagcagagaaaauguuucaaggggaacaaagugaucaauuauucuaaacguugaguaauauacuaaguaagaugagagcugagaaccugucacuggguuaaguaaugugcaucguuguagggugguaggaaagaagguaguugcagggaaguaguaguggugaaaguguaauuagaaagaaaucaagagaaaauuauaugaugacuacaaacacuauuuugaggcauuuuauuguaaaaugaggcaguaaacagaaaagauugcucaagagguuuuuuguuguuuuucuguuucuguuuauuuuuucuuaaagauugaagaacuauaacacaugcuaugggaaugaucuaauuaagguaaaacacuggaugaugugggagagaaugggaggauuagugaaaugaagcccucgaguaguuaaagugaauggacuuagugcucaaguggagggaugaggcuggaugggaacacaguccucucuuaacaaagaaggcaaagcauaagcacacagaggcuaccauguggaaagaaagcaaauaauuuugauugaaaguggaauaugaggacaugaacaguauguuacagggauaaggaaaagggauagggagagggacaaacuaggauuuuugagcaccuacaguaugucaggaauuuugcaaauaauaaacuuaagaacuaaaaccauacaaacccuagaggaaaaccuaggcaauaccauucaggacauaggcaugggcaaagacuucaugaucgaaacaccaauagcaguggcaacaaaagccaaaauugacaaaugggagcuaauuaaacuaaagagcuucuguacagcaaaagaaacuaucaugagagugaacagacaaccuaaagaaugggagaaaaauuuugcaaucuauccaucugacaaagggcuaauauccagaaucugcagagaacuuaaacaaauuuacaagaaaaaaacaaacaaucccaucaaaaagugggcaaaggauaugaacagacacuucucaaaagaagacauuuaugcagccaacaaacauaugaaaaaagcucaucaucacuggucguuagagaaaugcaaaucaaaaccacaaugggguaccaucucaugccaauuacaauggcgaucauuaaaaagucaggaaacagccgggugcaguggcucacacauguaaucccagcacuuugggaagccaagguaggcagaucacgaggacaggagaucgagaccauucuggcuaauacggugaaaccccgucucuacuaaaaauacaaaaaauuagccaggcaugguggcaugcuccuguagucccagcuacucaggaggcugaggcaagagaauugcuugaacccaggacguggagguugcagugagccaagaucgugccucugcacuccagccugggugacagagccagacuccaucucaaaaaaaaaaaagucaggagacaacagaugcuggagaggauguggagaaauaagaacacuuuuauacuguuggugggaguguaaguuauuucagccauuguggaaggcaguguggcaauuucucaaggaucuagaaccagaaauaccauuugauccagcaaucccauuacuggguauauacccaaaggauuauaaaucauuccaccaaaaagacacaugcucaccuauguuuacuguaacacuguucacacuagcaaagacuuggaaccaacccaaaugcccaacaauguuagacuggauaaagaaaauguggcacguauacaccaugaaauacuauuuagccauaaaaaagaaugaguucauguccuuugcaggaacauggaugaagcuggaaaccaucauucucagcagacuaauacaggaacagaaaaccaaacaccguguggucucccucauaagugggaguugaacaaugagaauacauggacacagggaggugaauaucacacacuggggccugucaggggguggagugcuaggggagggauagcauuaguagaacuaccuaauguagaugacggguugaugggugcagcaaaccaccauggcacauguauaccuauguaauaaaccugcauguucugcacauguaucccagaacuuaguauaauaaaaaaaaaaaaacaccauucaauacaagaucuuuuccccuacccucaaaaggcucaaggcucacagucuaaaaaggcagauaagugaggauauaauuuuaauaaugcagagugauaacugucuuaauauaguaccuucggcuacuuauauaaacuguuuacaccccagucuuugaaugcauucauaggugcacucacaaaauaggggauuaaagggauuauugggauaagguaucaacacucuuacucagcucugugaggagcuaagguuucuccacgaaauauguuucucuucaauccaagauuugucuuauaaagcucuacuguuuuuguuuucugccugcauagccuuggaggaaaaaaaauauuagguuucagacucagaucagcucaguuugaauccuagaucuccuaguuaacaauuaagugaucugagcaaguuaaugaauuagccuuagucgccccaucagcaaaauaggagugaaaauguuucacauaaauauugugaagauguaauucuuuaauaugcauaaauaguuagaauaguucuuggugcacagugaagauauaauuaaugcuaguuauuauuuauccuguucuuuuauuacaugcaauuguaauuuuuauugucaccuaaugucuuagcuuugucaucuuucuuuuuuauauacuuucuuugcuuacucuuuagucauuuuuuuauguuuaaccucuguaucuuuuauuucucaguuaagaggauauucaccgugaacuuucuccugaagacuuuuucuguauuuuuuucaguugcuguuugucuuuaggcuaaauguagggacucucugcuccaccgagucugauauuacucucuaaauggucuggaucagugauacucuugaaaagccagucauagcuucagggggcuggcuucucuacagcacguucucucaccuggcugugcucuguuuaucuuguaugaggagagaguauccagucuggaaggguaagaauauuuggcucuuuguguccuuuaauaucugccaucuguuggccaauguuaaagaaucauaaauguuuucaauggcaaggaaugauaccuaugacaaaaacauacagauuuuauaguugaguacuuucugcaacuagauacuauagugaugcagguuaaacaauauaaacucuguuuuuucuaaagauauucgauaaaaaugaucugcacaaauagaaaauuuaugacuaaguuaauggugcagucuaccuaaccauggaagaagagucagugcucagagaauguuauuuagaaggaaacaaagacaacuaaauaaauuaauguauaauguauacauuauucagagccauucugaaacuuaaaaaaagaaaacaggaaagacugcuuaagcucuucaauccaacagcauuuaauguuaguucuauaaagccuacauuuaucaaauacauaauuuaugucagguaguguucuauuucuguacauuuauuaucuuauacauuuuccucuaaaucacuuugauguauuuucucuaauuauccaaauuuuacagaaggaaauagaggaucauaaaauuuaagucacuuguucaauguuaaacaaauaguaagcaccagaguuucaaggcagccuaacugcaaauucuguggccuuagauuucauauuggauauuuucauuuugaaucuucuuaccaugacucaauagcuuagauccuugugagcaagcagcauguuuaauauacuaaauacaagguuuagugaaaaacaguauuggguugagacccagucuugccgcuuaugaucaguuuggucucagauuuuucuucucuuagaauuagguuaauaauuccuaauucauagcaugacugugugguacugcgaggcacauuacuaaaugagguaauggauauaaaguauguagcacaguguuucacacauauuaaguauucgagaaauauuuccugcucuccuuuggcauucccgucugucuuucugcaagcaauacuagcuugucugaaguccuucuccucuuuaaugauacaaauccugucucucaccaucugcaaauauuuaaugaguuucaauuauguaaauaugugcuguaaaaaugaccaacccauagucccuaccguuaagccccuaguaaucuuuaucaggccccuauauaaaaccuacaacuuuuaaaaagucuuucugagcacuccaggccaacuuccuucucucaacuccuccggaagugaauuuguguccccuuauuugguacuaagcaauuuacuuacuucuuuugugaugucuuuuuguacaucuauaccccuggcucucuaaagagauuguaaagaaguaugacuccugccuuaagggagcauaauaccuguagaugauaggcauuugcaaacuuucugauggauaaaauuaaaaaggaguuuuugcugcagaauucacuuugaaaaauuauuucacuuaauuguaugucauucuucacugugacaaaacaaaacaaaacaaaacaaaaaaccuuggucaccacaggcuaugccgcauccagcucgcuugagccuuucuuguagcuuuugaucucacuccauuuuucuagauuauuugaauuugaugaaaaugcacaaaaucaaaaccuguuucucgauuauuuuuucuaaagagagaaaugacuuugucuaucacuaccuccaaaauuacacacacacaaaaccuaguugaugauagugcugcacauuaacagaguaucuuuuucucaaacacaccugguacucuuccagcccagguauguaaauaggacucauuuugcacaggcugaaacaugacccaggcucuguagugccuccugagaugggaguggaaaguacacacagagggcuucuguaugcuuggaaggaaaauuguaugaauauguguggugguagagaggucaggagauuggaugagaauucaggucaacugaauguuaaaaauuagaauauagaacuauguuaauauccaguuaggagagcaacauuagcaucagcauugcugcaaaagcuagauuuuaaugaccauaagguugacuaaucugugaccuacauguacacccagaaaugcaccacuucucugggaccaaaugaggccuuugaaaugauccccaaaguucagccuggucuaaauuguagaagcucuguauuucacaguauauuuuaaacaaaacacugcucccuuccuaaaggauuggacuuuuaguuucuaaauaauaauuuacagaauugacauauauuuucauaaaugguaucauaauuucauacugcacaauucuuucccaacuggcuuuuugcacucagcauuuuguuuuucagaauaguucauauugauacacagggacccaguuaacucauuuugucugcaguugaagauuauauuauacaacguaacauuuuauaaacacacggucaauugggauuuguucagauuuuugcuuuuggaaacuguauaaucuuucauguauuuccuugugcauauaugagauuuucucuaguacagagauuccauggauaaacaaugaaauggaucauuugggaauuucuugaguauagauggcaauucaaguuuuucaggaguggggcccaugaauugauauauuuugagaacaucucagaugguccuaaugugcauucaauauugagaaccacuguuuuaguccagggcaaugcuucucaaacuuuaauguagauauaaauuaucuacagaucuuguuaaguugcagcuuuuuauuuaguuaaucugggaguaucuguauuuguaaaaagcucccaggugauucaggacuacacuuucaaaucucuacaauuucauuucuaaguauuuccucuagggcauucaaauacuuagaaaugaaauuguagugauauauguguaucuucaguuuuauuuguuuucaaauuauuugcagauuuauauuguuuucagcagugugugauuuuucauuuucucaucaacuugguauuaccuaauuuuuuaagugucaccaauauuaugaauuucaaguugugacauuuuaauuuaaauuuuucugccuaaaagugaaggugcacuucuugucaaguaauucaaauaauuggccauuaaaguuuccccuuuuuaaaauugugcauucauauucuuuauccauuuuucuauuaguagaccuuuuuuaacauuuugacuuguugaaauuauuuauauauucagaauacuaaucuuuuguuuguuuguuuaaauucucugggaaugcuuccugcaauguggcuuuauuuaaaucaguuuaugguaucucacauauaccaaaguuuaccuguuuacauuuaagauagucacauuuaccaaucuuuuucaucuggcuuguguuuuacaucuuacucuuuuuccaacuucaaugcuauaaaguaauucuauauuauuaaaauauuuuaaaauuuugauuuuaauauuuggacuuuuaaucuaugcauaacuuauuuauguacauggcaugagguccaaauucauuuguauuguuuuuuuuuccccacaggguagacaauugccuagcaccauugauugaaucuuucuacacugauuuguaauacuccgcuaucauauucaaaaccugugugugucuguucugugagugcugugaguuuugugugugccaguuuuauucuaggcuguauuuuuucccggcauuuuauaauuagcauugagaauuugaaaggauaaguuauucucuuuuauuuuucuuaguuaggauuguucuuggcuacucuugguccuuuacucuucaauaugagugauaggaugaauuuuuuaauucuguaaauaaaauggaauuuaauguaauuguaucacauuuauagauuuaaggggggaagaguuaacauauuuucuguaauccaguugaauuaucuuaucaauuccaauagcauguaucuucucuugaauauucuacaaagacaaguuaucuauuagcaaugacuuguuugcaccuuugcuuugaauacuuauccuuuuaacuuauuucuaaaucuuauugaacugauuaggaacucuacuauaaugugaaauagaaaaacugggcuuccuuaccuuguuucaguuuuaaugaaauaugccucacauuucacaauuacagauaaugagcauugugaauuuuguuguaucuuuuuagucacauuuugaaagaaacuaucccuagauugcaacuuuuuguuauaaauuauaguauuuuuauauaaugcuuuuucuauaucuauugacaugauuauauauauauacauauccuuaaaucuguauugauguauuaaauuuauaagcuguuaaauaauuuccucauuccuaacauaagaacacuugcuuaggcaaaauuuuuauauauauuacuggauucacuugaugaauccaauguugcaauuaaaaauuuucuguguuuauaagugaaauugcuuuucuuguacagucauugccuauauuuaaugucacauuaugucaguuucaugaaaugaauuggcaauauuuuccucauuuuauuuuuguuaaauuuuguaucuugaaucuucucuugaguaggcuauauaacaugaaaauuaguucuuuaaauauugguagauaucuuuuauaaaacuguguaggccuguuauuuauuuguugcugauagaccaucccaggccgggcgugguggcucaugccuguaaucccagcacuuugggaggccgaggcgggcagaucacaaggucgggaguucaagaccaaccuggccaauaucgugaaaccccugucucuacuaaaaauacaaauauauauauauauaugguuucagugagccaagaucgugccacugcacuccagccugggcgacagagcaagauuccaucuaaaaaaaaaaaaaaaagaacaucccaaucaauuguuccuacaggcagcccauauucucuagagacuaguucuauucuacuuuucauuuaugccaucuucaauaugugauuuccaauuucuaaggaaacagcaaggaggaucacuccugggagguuuaugugagccaauccuggaaagagcacacaucacuucuccucacauuccauugcuuaaaacucaagcauaaguaacuuuaucugggaaucauaauuuaguugucugccaagaagaggaaaaugaacuugguaaucaauuagcugccuugcaacaccuagaaagaaauaagauauuucucuacuacaaaagaaaaguucuuuuuucuucuauaaauuuuguuuaaugcccccuuucaaaaaguaccuuauaguaacaagcauacagcuuaguuccugaagguaccauuugaguguuacagcuuccagccugauggaaacaguuugauauuaaaauccuagcacaguauugccaacucccuaucaaaagcaccauguuauauacauaaaaaaccuucucaucagcuggugacucugcugccauuugguacauuuuauuuuucaauaaaauaacugacuagaaaaaaucaaccauagucacuguuguuuuugcaauauguuggaaaggcagguggucauccuaucucuggaaaugaaaaacaauacagagauaaaugugggaaaaaaagaggaaguguggaagaaaguguguggguuuagcuguuuggugaaacaggaugagaagggcucuuacguuacucaucaacugagaaacauauuuccaucuauuuauacuaacacaucaaucuggaugcauacacugugacuucuauaaaugcaaacucacaaaaauuugcuuagguagaaacacuugauaggauauucauaucauagggggagaaaccaacauacaaccagccauggaguuuucaaauagcaaacaguagucucuuuuuucccucccacaaagauauuaaucaaacguucuuuccauuccaagaauuaaacaaaaacuuauuugggccugugaaacuucaggcccucagaaggaauacacuagccauuuacaacauguuuguuuuugcguccauuauuuuagcaauguuuuaacucaaaguccucuauaauuuauucucauccuaacauuuuaaucuuguuucuaccaaguugagcuguaaagcuaaacugccugaucggcaaauauguccuguauguuuacuaacuguuuauuuccaaaugcugaucucacaauucucuguucauccucccaaguccaaauuuguuccauuauucaaagccaagcucaaauuucuucucaucaaaucuuuucugauucuccucuccaccugcccuuccucuaccuacuuccaauuaaaguuagucauuuucucaccuaaaguaccgugaucuuuuucucugaaucuuucuuaugacucuuaggguguuccacuuuacaguuacuaauguucucauuuucucucuuaacuacauucuagacuuuuuaagggcaagagcaugccuuugauuccucuucaugaucucaauaucugaugggaacacuaugaaauauucuauuauuaugaaauauuacaguauuuaugaaaugaauaacuuuaaauguaucuuauauauagguaaaaguugguaggcaggcuacugauaaauauuuuuuuaaaaaagccauaauuuauagcauuugccaauuuccaugcucuaaacacugccacuguggccacguucagauugauaucacuaaauacaaaguugaggagagauaugcaguagcagaccauuucuaccauauagauucaauacauguaaguaacccaagauaacacacgacaguaaaauguaauaaaauauugagaaagugauacauuuugaguuuuuaaaauuuuugcuuuuaguauaauuuaacuuuaauauuauuuaauuuuaauaaugaauaugcuuaaaauucaacucacaaaauuccugaaaauccaacauuuaccuuccacaagugcaccugauauugacauuguuugucagugcauacuuucuauuuauacaguuuuguuuaaaaaugcuguaagaaagggaaaaacuauaugugaaauguaagaagaaauuccauuucucuccucuaaugggcuuguucauuuuaucuacauuuuuguugccuccccucuuauuuuucuccuccucuuccccaguugucuaccaguccuaucgccagucccgaacaacaaaugauuuuuguucaucacuuaaccucccucagaucucauuuuucaguugcuaauagccaggcccuuuaauggcauuuuccuugaguuuacuuccucauauacaaagguauguagugcagcaaauacucaaagaaugcacaguugaaaaauccuaacaguauuauuugacucaagcauucacucaguguaguaaucccauuucuaaucccacuggucuuccauagucucuggaaaccaugugaugacagggagcuuguauucucauaaaauaguuuuuuauuguuaggauacuucuuguuuaggauacuuuauuauaaucaccugaauucuaccauacuuuuuucuacuagaucaacugagaacaaauucacaagcaaaugcaaauacucuucuccuuccuugcauuuuuuauauuuauguaaacacuccugguuccgucaucaguguccuaacguaguacugcauguaugcacuuuacuauucugucuggcgucuaauggcaaaauaacaucuguguguuacuagcauguuguaacgacugaaacugaacaccugaccuccgguauaguuuuaucauuaaaugugucucccagagauacauccaaguugcuuaaaauucagaaaacaaaacagccaaauacagauuauuauugagcacugcugacauucugcuuccauauagacaugaaucuaccaccaauacaaguuguaguggcaugaccaguuaggucucugucaggcuaugugagcaacuuguccacacaacucuauuuuauugcuuaaacugucaacaauugucaaacggcuccugaaaucuacauacacacucaauauguucauagaauuuucuuucuucguaaguaguugaccuacucaaaagguaaauuggguuauuuuggcauagcuaauccuugauguuuauuccucucaacccuuaaaauccaaauauuuagauauaguuuauacuuuuccauccuuccacuacaguaguagccgugaauaaaagguuuuaaugauaguuagguguaugcaaaaauacagaauaaaagagcuaacuuuuaccagguagcauauuuggauuuuccaccuuucagaaagaagaagggguugguuuggcuuauuuuugguggauuuaucaagugacgagacuggaguguucaaaacaagaaaguucagcagguuggagagguagcuccagagcacgaaugcccaaggaauuacacuuuucagucuuaaccacauuuuuuaaguuuuuaaaaacagaaucugauagcaucaagaaaacaaaaguaaaaauacaugauauuuuuuaucugggauaugaaaauauuuuauacacuuaguacuugagagaagcuaaagcauguuaguguuccuuauguaacacccaagagacuaguucacuuucaauauauuaauauuuuaagccaaaagggagaaguggcaaaguauuucuguuccuuggaauguaguaauuaauaugaaggagaaugacuuuguaaaugaauguguuaaagacuaaaucucuaaacaaggaacauuuagaacugacuaaaauauucccauuaaacacauucugagcacuuacuguguacuaauuaugaucuuguaaauuacucagggaucaauauaaaauaguucuugcauucaucuggcuucuccagaaauaucuacaaaaagagacauuuguuuaugucuugaaagugaauaaaggaaauaauuuuaggugugacuagcuaaguaguucaguuacagccacagggaugaauacagagucugugauaggguccucaucuuguccagccuccauauguguauaacucgaccuggaacacauuugucuauuuagacggcuacaacauauuccaaaaaauaucuugguaucgccuuugccauccuucuaucuuuaucugagcugggugaauuuuccuuaagguauacauauuuuauguauauguuucucauauaacuugauauaauuguauuuuuaaucuauuuuaauguuuauuuucuuccauaauauauaagcuacuggaaaacaacucuuuuauuacauguuaaaucaacagcaccuaugucagucccuagugcauagcaaaugacaaacauuuucuaaccaaaugaauaauauauaaaucuguaagagagagaucuuuugagaguagccuuccuauaauuagacuuuccccacuguuaccauaucucaguauaaacaaaggcacauacugauguuacaagacacacacacacacacacacaugcuuguauucaauacaguacguaucuaacuguagaucuaaggcaauauauaauauuuaauccucuugcuggaaaucaaggcguuaaagagaauuaagaauaucugaaaauuugaguuuuugugauuuauauuuaaauauaagucccagaagcuagccccaguauaaaacaauuucugucaagagacugcauuuuuuucuaaugaauaauuuaaaacacaacuuuuuuuuuccaugugaacugucuuauaucuuggcaguaggcauagcauuucaauaauuuauauacuuuugaauauaauauaguuaaugucacaaaagcaauuucuuugauauugaauuauaagagaaugcacuuagaccacugugacuaaugaucuaggagccaacacauggcaaguuaucuuuuaauccaauccaauuucagagagaacuggcacauguaaccauaggacucugcuaucucuuggcacauagcugcaugauaaccuuuguuuguaauauuuuuuuaaaaaaauaaagguucucuuugagaaaaguagauaagguaacauggacguuaaaaaauauagaugauaauuauuuuuuggaagcagaauauuaacaugaaucaugguuuuaucauuaaguuucuggaugaaacccauucucagaauguuuucuaaggcaagacucuaggccuuucuaaggcaguuacucuguaaaucuaaucaugguuaguuuuugacaggugagaaaccacacauuagugugauaauguacaacuuuuauaagaaaacaaacaacguaaugugaaaauggauuccuugugucuuucaaagccaaaauagucugaaggccuugccaagaugugaggcaaagauggcaagauuguggcucucuagcugaauccagaccaugaagagcuuucagcauauggugaagauuuuguacacacacaaaucugcaggcacucuuuacuuucauaaaccauguagacuuuuauaucaagaaaauuguccaacauguaaugaugaagugucuucauguuuuucuaauuccuauaaaggugucauuuggguuagugccaggcuaauuucacagauauuuugaggagauuguaagcuacaaaaaaaaaauuaauauuuccagucuuaaguucuagcaagccuagacuuuucuauuuuuaggauggaaauuaucagugguagcugcucucuuuagacaggugcucucuaccuggccccaucaaucacaauauguauguauacuuuguccugacucacauuacucauauauguuacuuauccauaacauuagauauuuuuguuuucaacauaaguaaucagggccuuggccaucaugggaaguuuuaucaucuauuucuggaggcuuuacuuuguuccauugucuauuugauaccaacaccacacuggcuuuguaguagcuuuaugguaaguugugaagucacauaagauaaguucucaaauuuucuuuauucuuuuaaaaacugugcccaaacgugguugcuuuuaacaacuacaauuauuuguuuuacucagaagacugcaauuugugcaauuuagauaggauauuugaggccucacugggaugacuuaggcagucagggcuuagaugagcugaagugcuucccaagcuuucucucucucucuuucuguuaucacagucucuccauguggcgaccgcauguggugccuccacauguucucuccagcaugguagccccgagguggugacaccacagugggcuagaacuccaagagugaguguucucagagaacaguaccggaaacaaauauuuuuugcuuuguuuuguuuuguuuuguuuucccaguuuggaagucaaauagcauuauuucuuccacaacucuacuguaugaagcagccaagagccuacuccaauuuaauaugagguggggaaggggagagauccuauuuuuaguggaaagaguauuaaaaaauuuguggccauguugauagaaccaccacacaaaccaacuaucacaaaagcagauggguggauggaaggaagaauuggccuggacauguagaacuuugcccuaagauggacccaaacucacucccuccaaauaagucauuagucucucaguauauuacucacaguaaauguucaacaaauacuaacccuugcuguggguaaccuuuuuuagacauguuucccguaaggaaggcagaaagccacaguguccuauuuugaauacuuauccaacuaccuucucacucccuuucuagagcacaguguugagaagggaucacuauaaauaguguugagaagggcacacuauuuauuuccagccaaggcuucagcaccaauucccuggugagcuuauuggaucauauggaaauuucuaggaucuauauaaacauaugaauaaaaagacaaaaauaaaauauaucaaacuauuaauaauaauuauuaaaugguggcauuauauuaaauugaaucauaugaaauugccaauauccauuuguuuuuaacuaaagggcaguuuuagauauuacaaccuaauaugcuacuuuuuuuucuuccuuaauguuuauguauuugucuacauucuuuucagugaauguauauuaucuucaugauuagaaaaauaaauauuauuuacaaagaacaaagaaaccagaguacuucaaagaagguguuauuuuucaaauggugcuaaaaugacacaucuccucugcaaaugcauaaaacaccagagcagcuuuuagauauaaaaaucugcuaaaacacauuuugagaaaccugagccuaacaaggaauauguauauugaaccugagcaggcuuaccuuauaaaaccaggagccagguguuacauuauaacucugugacuccaaggguagacauuggguucucucauguuuucaaaaacccuaaagcaagcuuuuagcuaugggaaauguuugcaaagaaggcagcuggguucuaguuugacacagcugggcuguuuccucugguuuauagggaaaauaguucacugccaaggaugaggcaagaaaacaguucacuugggccauuccaaaggguauuuguuggcacauuuccaaauggagcuggccaccagguuuaugggaauaguaacuacacugaaagaagguacuugcuuuccuuaauauaaauuccuggaaggggaaucauuggcucaauggaauagaaauuuuuuuaaguucuuaaaauauacugccaaauuguuuccaggaaaaaaaaaaaccucauuauuaauucuuaauaaaauguuaccaucacugaagguuuugaaguuauauaguuggugccuuaagaauuauacuucacuaggauacccacauuagugugcuguaagguauuucaauugcgguguucuuccuaucuauuuugugaccauuuucuacuaaggaagagacugaauuaugcaggcauuguagauucccugugauauacagcacgacaauaagugugcuccagccugcuggcugcugcugcuguugccugaggaaguagcugcuauuaagguccugauuuuaagcaguguuuuauaucuuugaauuauccaaguaagugaaacugaagcaagccugagguacagcagugauuugaauucugguguauaaacacucaugugcagaggcuagcuauugauccucucgccaaaacaaaucaaaaaaauaaaaaucuuuacaguccaaaauauugaaacucuuguguaaccauguuguguuuuugucuucaaaauaaaauguuuguacagcaugcgagaaauuugccugcaaccaaaaauguuaaaaucauuacauaaauguuaagcucucuaaaaccagcagccuuuuaaaagcucauuuuaucacauuuaauuuucauguauacuaaaccuacuucauguguguuucauguguaaguguauguuuuuauuugcuacugaaaaucuaacuggcaaauuguuaugccuuugcauaauccaugcauuagagaguccagagaagauggagagaaagagaaaauagaagaaaguaauuuccacuuuaguuucucuauaauuccauauccuguaggguucauucuucucagagucuuacuuucuucucuucuugaucacuaccauuuagaaccaauccugagcuuuucaagggaaaagaacacgaugguaaaauguugccuauugcaucuuucuacuuccaggauggugccccacugcacccacuaugcugcucucagugaguuugaaaauggaugcaaguuaauaagucaucauuucuuguaggguuaguuacauuuuaacauuagucccuugaaggcaaauaaauauucugaggaucuuuaaaaaaaaaaaagccuuucuacuuagagugcagauuuuaaauauaggagagagaauuuuaaggagaggucuuucugguguucuguaaaucaguguuuccaaaaucuguagacuuuggaacucacuacauacuauuggucuagaauauccuaaaucaaccuuucucccaucccagaaucacgaaaaacucauccgguuaucccugaugauuagcugggugugggaaacuacuguuuuaaaccaccaaauucuguucaaauuccaccuguuucaaaaagccuuguccaauaucagcauccccucaauucugccuccauaaggaagaguuaguuacaaaucuguguucccaauacaccuugggaauaagucuuuguaggauuagugacucugcauugugauuagaaauguuguaucuuucuaacucuuuagacauggacuccuuaagauuagucacccugagauggggcuuaauaaaugucuauuggauggauggauggauggauggauggauggauggacggguggauggaugaauuaaaacaguucacugccuauuuugccagauuuuuauaggugaccccacgaaggacagaauagauugagaaaaacucgugcauagguauccuaaaugagagaaaacaguaaaguaagcaacauaauucaaaguuugaacugaaguucgacagauaacguuuuucuuauacggauucuuuaccccuaaguuguucuggcauauuuuaucuguagguauuucaugaauuuggcaaguuugaauuuaaaacucaugcuugguaucuuuuuccuguuaucacuaucucugagugaggggauuaggggagaagcaauagaaaucucugaaaugccauaaacugugacaagucagucauagucuaucagcuggagaaaauaauguugcuggugagaugcagaccaugaaaccaucaagaacccacaagcaaaccaauuuagagaaaaaagcaugaaacaauuucuuaucucaguuugagaacaacaccuuuuccaggagguuuguuauguaacguagaucugcuuucacuuuuugggggcaggccaauacugaaaagaggagugccagcccagugaaaggaaggauguucuuuugauauugccagccauuaccagauaugggagugcaaaaaagccaauucucccaagauuuauaguuacgucuagcuuguugacucaagcaguuuggaaaagcuucagaaauauaguucauccaaacuaacccagacuccaagucuuuggaggaaaaaaacaguagaaauaauaugcacauacauacuauuagagucaaauucucuugauuuuaaauuugcaaagauccaaaaguaaaaaaaaaaaaauacugagaccaacucacaugggacuaccuaagaugugacagaccauucuguuaaaaauaaauguguaugauuauuguccaguuauuucucuggguuugcauggcaaaagcuauaguaggcaaaggacuaagaaaauauuaugcuucuaaaugaguuagaggaauauuuaaucccuaaacucagagaauccaugaaaaagucacacaggacccuugaaauuauaauuacauuuucaccauauucucagaacuuauauuaugugauucuugcaaugguauaaaauuuuauaggaucucuucacugagacaucaaagaaguauuagcuuagcaccugaaagaacaaugaaauauuuauugaauaaccuguaugugucaggcccucucucagguucuggcaauaugcuguugaauaaagcacacaacuucccuacccuaggucucuacuuagauucuaugaagagauacagauaauaaacaaaugaagaaauaaauaccaaugauaauuauggauugcaaagaaaacuaucacaagaaaugaguauaggaguggaaaggggcagagaguuaugggugcaaauaauuauuucaacaagacacauucuguccuaguacauucaggcgcuauaaaaaaugccauaaacuagauggcuuauaaucaacagaaauguauuucucacacuucuggaggcugggaaguccaagaucgaggcacuggagagggccuguuuucucauggaugacacuuucucacugaguccuuacaugguggaagggguggccuagcucguggggucuauuuuauaagggcacuaaucccuucaugaucuaaucaccuuuccaaggccccaccuccuaauaguaucaccucggggguuaagauuuuaacucaugaauuugggagagacacaaacauuguccacagugcagacccagaaaaaccuauucugcuuuaagaucaucaaagucaucagugauacaauuuuuuaagaucgaauuuugaucuuuuaaaauucacucacuaauguacauuucgcuguuucuucuuugugguaaauuuuugagguaugagaagucaccguugggagaggugggucaaagaggacaucaaagaguuggcaucacuuuuauuuuacuucuuauuuguccuagugaacauauuuggagaauagaucucauaauugugugcauaauucaaauagauauauaacaacuuuuaaagguuuuugguaaugagucuacaacuucagagaaugaaugagagggcauucggugcacuccccuauaaaacacugcuuugauuuuauauccugaccgaggaaacaggugguuuuugugccagaauauugugguuacaauaaaugcugaucugauguuuuucaguaaucugugaguguuuaugagccagauuaaauaaauauuccaucuaccuuuuagcccuggcauccuaaagacagccuccaaauggauuuguaugcacuguggucuuucacggacucuuacagcuuaagagcucgauggggcauuuaauugauuccagugagccagugcaacuauccagauccaaauaguuuaugccuuuuauuuacaguuaaaauaacugucagacgcauccuguaaggguuuuuaauaucaugugugaccugaccucacaggucaugcaaguuaauauugguucaggugcuauuuuauuuauucuuucuaaaaucaucugcacagauuuuuuuagauaaaaacuuuuaauauaauaaaauacccugugcuuauaugacuccugugauauccagauuagucaccgugaugcuggcuucucuguuaauggucauguugcaggcagcaugaugaauucuugaaagaaauuaaagcuauaucuuugaagacugcucauuaaacaaacaaaaauaauuuauuucuauacaucagaaaauauguacacauuaaaagaaaauaaugccgugcacucacaaacucaguugcucauuaucguacaaacaguggagaauaauccaaaaugguagccugugugaaggucauuagaaucugguuuggaugugcauucuaagauuuuucuuacugaaagugacucauaccuggccugaagacacccacagaugggcucagaagagggaagguggguggaguaagucaaauugccuacauuuuuuggugaaagugaaacuaacaagagacauauguuaucuuuagagaaucuaaauauguagauacaucuaaauacgcauuaucuccucacuguggaaccaacuaaauaaaaguugaagaccagguacuaaguagcaguugaauuuuaggccagugaacaauuaaagggaaagcauguuaugaaugcaagggaccaagaguaguucauuuaaauggauauggagguuuuaaaauacauuucacccaacacaaucuuuaaaucuacuuucaaccucuguugcuuagaaagcuuccaguguucuuagaucucucuaacugguaauacacaacaauuaauuaugaacacaguuguaaagucuuguauaucccuaauuagaguuucacuaggagauauucugugauuuaguaugaaaucuaggacuucugccuuuucauugucuuuuuaugguaucauauaaugaagauagugaggauauuauaauaauuguuuccagcauauuaaaugaguuuacacucaucaauauauuucuuuauaacucugcccuaggucauaaguacuuaaaguacaugacaauuuaaaauacuucuuaaaaucuguaguuauuuaauggcuuaaaaauuguugaauugauuaaauacaucugcuccuuuuugcauaaauuaaguauuuagaaaaggaugugagggagucugaaauaagaucuagaaaaggggcacacaucuagaauaguacauuauuuuuaacucuccucuauuuuuuuucuuuuuuuuuuuuuuuuuuuuuuuuuuuuuuugguuuuccuaugcaagugcuuagcacgaugcgcccugggaccauccaaaacccuucucuauaccacaccuuauucugacgacagagcugacaauuguuaucaccauccaguugaccaauucucuauaccaccauuugugcaguccuaccuuaagguuauuaauaguuuuccuggccuggugugguggcucacuccuguaaacccagcacuuugggaggcagaggcagguagaucaccugaagucaggaguucgagagcagccuggccaauguggcaaaaccccaucucuauuaaaaaauaugaaaauuagcugggcgcaguggcaggcgccuguaaucccagcuacuccggaggcugaggcaggagaaucacuucaacccgagaggcaggaguugcagugagcggagauugagccauugcacuccagccugggagacagagcgagagacucugucaaaaaaagaaaaaaaaaaaguuuuuaucuauuauaaauagucugcacucaauaaccuugugcguaaacuauucuacauaauuaacuuaaaaauaaaccaacacaaaauuaaugucuacugauuuaaacccagaaguuuuaccuauugaacuuguuuuacuccuguaaaaugggaaaggaaaauguggaaaauauuugcccucucuuaguuacuuaccuauccgcuucugucuuuuaauuuaaauuucuugagggcaaguaacaugccuuuaaacuuuugcauuuccuuugggucaagaauuauucccuucaugauagucaguaaaaguuggaaggcuuaaacugaauaugcaauaguucugaauauucagcaaagcaacaccuguuuuugucuccacaagccaccgugcauguaaggauuucacuggcccucuuacacauggcaucugcuuccaacaagugaugcauuucuggggagaggagccuugucagagggauuuucucuuacuaacauccucuucccagauguguauucccuguagcauguccugaauuaugaggcccuggaaggcaauugcaaucacugagaaugacaugucacaccuggaauuuaccacucuccccacacuacacaaucuccuauagguaaaugucaaaucuaaguuuauuucuaagggacuuaauuguuucucuauauagccaaauacuagugcugaauauuaguuuagcauaauguuuagcacuuuaaauauauguagauguguaaagauccaacuaaacuauuuuuugaucagacaguauugaccaaauaaugguauuucgaggauggaauucauguucuuauggcauuucauuauuucucuucauauacauaucucugucuaaccuugaaucaguuauauuuuaaauaauuaaguaaagucgcuaggcgagacuaagagcccuauauacuaucuucuauauaaaggaaaaaagcacuauauaauuuuuuuaauagugggcacugcuaugcacuguauguauguuuaugaauacagaugcuccucauguuaugauaagguuacauccaaauaaacccauuguaaauugaaaaugcaauuaauacacuuaaacuaucgaacaucauaacuuaaccuagccuucauuaaacgugcucagacacuuaaccacaguuggucagaauaaugugacaaaaggccuguuuuauaauaaaaugucgaauauuucauguagauuaucaaauacuauacugaaaaugaaaacauaauuguuguauggguacucaaaaugugcuuucuacugaauggauauuauuuucacaccauuauaaaguaaaaacauuauaauugaaccauuguaagucagugaccaucuauauauguauaucugucucucucucuauauauauauauguauauauauccacaugugcuuuacaguucauugaauuaaaccuauaccuacaacuaaauaucuaaaauauacuuuuaguuuaauguuguaaauuuauuauuauuaacucuccuauuuaccaguguaaugcaaaguuuuuuguacuuuccuucuaggguaauuuaauguuuuuauuuuuguucuguuuuaguuaagcugaaaagaccccucuguuugggaugguuuuaaaauuuuuauuauuugccugagaaaagcucacugaagaguuugaugauaauguguuuuaaaugccaauuaaacuaugucauuuggaaacaguuacagugguguauuacuuaggaaaaagccuucuccucaaucauaucaacaguuacacauaaucaaauacuuuauauuuguaauuauaucauucuugauuuucuugaggcugaguuuugguugucaaaaaaaauucaaaguauggguaauuuaucgucacaacagauuuuaguuacuagcuuuaaagguaaucgugaaaacaugucucuugcauaaagaaacccaaagaagggaacaauuaaaaagauuucaguaaaaaucuuauuuuucuaaugauuaccaagggguguaauugcuauuuauuuauauuugugcuguaauaguaacauaguauaaauuuuauaaaguaacccaaacuuauuuauggcauaggucagucauacccucuacaaaagugaagaauuucugagaacaauuuuaaggcauaggaaaagagcacuacuaaaaugaaauucaaacaccauauauguguuuaauagcaucuaauaauaaugacuaacacuaaugucaggcacuuuucuaaguccuuuaacauguagugacuuacuuagucuccauagcagccagauaggacauguacuauuauugucuccugcucucagauaaagacacugaggcugagauaaauuaaauaacuuacucuaaauaaugcaguuagccaauagagauuuauacccaugcucuuugaggauucaaugagacauuugguuucucaaagaauauagaaauuuaauccuggaaguuaguuuagagacuuuucucuccaacauuucccgaauguauuaugugauuaaauucugggauaaaaacuucucuagucuaauacaucagagaaaaugcaauacaauauaucccccuugacucuuauggauuuacagugcaaaagggcauaacaaaggaugagaaguccugaagugaucuguuucaaccaguguuugccagucauuauugauaagaaaacuuuauuguauccaccuuucauaguccuuagaauuuguguuccuuagaacacaaauuuugagaaagucuagcccuacuaccuggcagauagaaaauuaaagucaaaaauaccuuugugaccaugaaaucuuaccucccaaucauguacauguccuaacucacccagcuuuuaaaucaguauguaggaauaaccauucugcuauuuuaaguuucuucuguauuuccucuuuuuuaaccauuucaacaaggaaaacaucauacagugaggauccauggauaaaauagauugauuauauucuaguuuacuuaacacaaauuacucauaauacauauuuaaucaauguuuaaacauuuuuguuauuaaauauuccauuuauccugagguauuuaacauccaaaaauuaggggaaaaaaaacuaauaaaaaacuccuagaaagucuugagguucuagagaauccaucuuucaggugaggcccauaggccauauauacauuucacccucauaccuuucuugcaugauauuauggaauuaaucauacguacuucaacaaaacuuuauauauuuuuuucuaaucacugcguauuuugucauuucaguuccuccuaagauauaugacaucucaaaugauaugaccgucaaugaaggaaccaacgucacucuuacuuguuuggccacugggaaaccagagccuuccauuucuuggcgacacaucuccccaucagguaaaguaggaaugcauuaguguuguuugugcuguucauuuuucuccuguaaccucacuaaccucacuuguucagaacuuaagagucaacuuaauuuuuuguauuuuauucaugcgguaggcagaaugcauuuauuuauuuauuuauuuauuuauuuauuuauuuauuuauuuauuuuugagacagagucuuacucugucccccaggcugcagcucaguggcgcgaaccggucucacugcaaccuccgccucccagguucaagcgauucuccugccucagccuccugaguagcugggauuacaggauugcaccaccacaucuggcuacuuuuuuuguauuuuuaguagagaagggguuuaccauguuggccagguuggccucggaaucuuggccucaagucaucugcucaacuuggccucccagagugcugggauuacaggcaugagccaucgcgccuggccaaaaugcauauuuuuauacuuacucuucauacuuaaaggcauugcaguucauaaaaguuaaaugggcugggcgcaguggcucacgccuguaaucccagcacuuugggaggucgaggcaggcagcucacuugaggucaggagcucaaguccugccuggcugucauggugaaaccccaucuccaguaaaaauacaaaaauuagaagggugugguggugcaugccuguaaucccaacuacucgggaggcugaggcaggagaaucauuugaacccaggaggcagagguugcagugagccgagaucgcaccagugcacuccagccugggugcggagcaagacccugucucaaaaaaaaaaaaaaaaaaguuaaagaauacuuuucacucagaguccagaauagaaccuaugucuguugauucuuagucaagguuauuuucucuuucguaugcuggauaaucaccaaucaauagacaaaaggcucaaauggaaaugucacaagagaaaugucuucauuuaaauauguaagagauuuauuugaucagcauucacacguugauaggucagcaugaaccgcuaaaguaaucaggggagaauaaaguuaaucaaauuaugaguuugcugggucugauuucaaacugcagcuuucaaucaaagacuuuggaguuagaauuaaauuuuaacugaugagggaucuaaaaauccaagaguuuauguagcuugugcaggauugcauagcuaguagaaaugaaauauauaacauguuuauagauuuccaguacuucugcuauagugcacauccucccaaagagauuauaagucaauuucaggaagucgaccuuagucaucaucaaaacaggucuguuuucaaagucacaaugcuaacagaauuaucaaguugugugaaauuuaacuuugaacuacauagcuuugggugcacccugggagucagagauguacuuuuaauaaauaggaccccaccucauuucagaugaaugaaauuugauuuuguuucauauuuuuuuuuugugaaaauacccugagcaaggcugaugcaaugaaacugcuuuuaaugaaaucagaaaggcauauuuuauacagguguagaacaagcacaauugaaacauguauuuuaucugcuaauguuuucuuuaauauuacccuucagcgacuuucaguuuacucauuuaugcagugugucuaaucaaucuuacccacaucacaugcuuaguauugguauuaugugagaaaaaaucaauauaucugcaauauauauuuauauaauaugcauuauguccccuacaauauuucugaaguaugagugugcucuugacugccaacucuucacucucuagaaccacugaaaaaucauaaaacugauaugugagcacuuaaauucauggcaggacucuccgugggguauaagugcagcaaauucagaaccaggaguuauacacaugugcucuuaagacaaguuccuuauucaucaaaucugccaauccuugugcacaucucuuagcuguaguuaccaccagcuaguuuccuacuuucaaaaauugcaugauaauaauccuuggcuauugugggacucaaaaaauauaauaggcauaaauguguuuuaaaaaguaaaacuuaauauguaaauguaaagcugauucuuaaucaucuuuccaggaauuuaaaucugauaugguaauauaauuuuuguaagagcaaaacacauaaucucuaucuucauauaauuuaagauuaauauuaugaauuuaacucuccugcuuugcagugcuuguuauuaugcacauucuucuuuuuaaaagugcuuggauacauuuuaguuuaauuaaauaggaauguugguuagugaaguuauuagaauaaugauaacggauaacaucaugaaacugaaagaagacagauuggguuuauaaguuaaacugugcauagauuuguuuuucugauucugccauacugagcaaaugaguaaaauuagcauaaauauuaacuauuauccaaugaauaacuagacuuggcagagauuuuuauaaacacuuacaauaauuucaaauuauaauuuauuaaugaucuacauucaaauucacagcaccuaaaggaaaaagaaaaccccacaacgcuggaguuccugcuuuaaggaacauguccgauaauucuauuagcuuuuuugacuuauuaauuuauauuuaaaagcaaaauuaugaauucauugaucucuuuguauuuugccuaagaaauaucaauauuuugcauguucucagcuccucuuuugcuauauuaugaaagaaaaugugucccaaaacagcaguuaaccugugaacauguugaguguuaaaagcaguuauaaaaauaaauaaguaaauaaaaacagauguagauauaccucaugucaacacgagaaguaauggcuaguuuuuguaugugucugauugauuuaggguuuuuagcaaugcccaugguaauucuugcugacucacucauggucaauuccaguuuuaaaaaucaguaauaagugguuggucacaggaugauagcuccauacagcuucacccuuauuuacagaaaaaugaggcuguguguucaaccacaucacaaacaucacuggggccagcuacaguugccauucuacuuuuuaacucuugcaacucaacuauacuuucaccaaaaaaaaacaccuuuccugagauguuucuggauaugugagcuuccuuacaguucaccuuaucaaugauuauuucuuuuuucuguuuuuuccauucuauauuugagaauuaaauucaaauuuauguuuuaaaagguuacagaaauaaaacagagaauauucuguaugcuuuacccaguuagauucauugggauuuugucaauuugcuucaucaauuucucuguggguagacuaaguauauacauauauauauuucacugaaccaguugagagcaaguugcauacaucuuggccuuuguuaucucuagguguuuuuuaucucuagauaucuccguguuaauuucugaagaauagacauuuucuuuacauaaccacaguaauuuuuaauuucaguaaauuuaacauugguaucauacguuuauucaauuaaucaaccauauuccaauuuggucaacuaauacaauaguuuuuuuauagaauacuuuuuugucuaguacagaauccaauccagaacucuguauugcauguauuugacauaacaguuuaggcuccucuaauuuaauuucucagugucauuacugaacauugacauuuuuuuucaacaauguauauacuccccaccccuccuuguuuuuuggagaugaagucucacucugucgccuagacuagagugcaguggugugaucuuggcuccuugcaaccuccaccuccuggauuuaagugaugcucccaccucagucucccaacuagcugggaucgcaagcgugcgccaccacacccagcuaauuuuuguauucugaguagagaugggguuucaccauauugaccccuuuuuaaauagaauauuucuccuuuguggguugucucauauuuucucaugagauuucuaguuauguccuuauggaaguaagugaaguuguauccuucucagggaaucggauccggagucacauaauauucaugugucccucauuugugauguuauuuucaaucaaucaguguguugucugauuuccacaucauauaguuuauuccuuuuucuucccuaugcuaccaauaaacagucuguagggagagauuuuaagaccgugacauccaaauaucugcucuuugucaacucugcccuuagauuugacauuauugaugauucuuuugcacucagccuucacucugaugaucaaacugaugauuuuuuucuagauucagcaguccuucugcuuuuacuaguuagcacuugacauucuacuguagaauuccccuuucuccuauuuauuauuuguuuguuuauuuuuauggcaugaacucguggauucacaccuuuuuuuuuuuuuuuuuuuuuuugagacuaagucuugcuuuuguuacccaggcuggagugcaauggcacaaucucggcucaccacaaccuccaccucccagguucaaacgauucuccugucucagccuccggguagcugggauuacaggcaugcgccaccaugccuggcuaauuuuguacuuuuaguagagagaggguuucuccauguuggucaggcuggucuccaucucccaaccucaggugauccacgugccucggccuuccauuuuuguuuuaugauacuuuaaguucugggguacgugugcagaacgugcaguuuuguuacauagguauacacaugccauggugguuugcugcacccaucaacccaucaucuacauuaaguauuucuccuaaugcuaucucuacccuagccccgaacccccugacaggccccagugugugaugcuccccucccuguguccauguucucguuguucaacucccacuuaugagugagaacaugugguguuugguuuucuguucuuguguuaguuugcugagaaugaugguuuccagcuucauccaugucccugcaaaggacauuaacucaucuuuuuuauggcugcauaguauuccaugguguauauaugccacauuuucuuuauccagucuaucauugaugggcauuuggguugguuccaagucuuugcuauugugaauagugccacaauaaacauacgugugcaugugucuuuagaguagaaugauuuauaauccuuuggguauauacccaguaaugagauugcugggucaaaugguuauuucugguucuagauccuuaaggaauuaccacacugucuuccacaaugguugaacuaauuuacagucccaccaacaguauaaaagugcuccuauuuuuccacauccucuccagcauuuguuguuuccugacuuuuuaaugauugccauucuaacuggcaugaaaugguaucucguugugguuuuuauuuacauuuuuaaaaagucuuuaauguuuuucuuggucaaauugucuucaguuugaccauuaggagucacaccaaaucggucuccuguguccuuaugacaugaacccaucauuuuguuuacuucuaugcuuucuggcauaagaaaauacaacaggcucauauuuucugccuuacuucuggaaucaaccauuucauuuaacuuugauugauuuuauaccauacaauuggaguuagaaucauuacauuuugcuuuaaaaauguaacuuuacuuaacugcuuuauaguaaaauuaucaaagacucagaagucuaggcuacuuccugugauauucuucuaaaccacaauaagaccuuaaauaacuucagggugagggauagaaaaaauauuuugugugguuuuaucuaacaagaagccuggaacggagccuguaaucuguguguaugcaaagagcaccagaacuaguaagaaaaauauuuaucucaaggaaaauaaagaggguaguuguccuauggcuagagauacaaguaggcucauagaucuuuacaugugauccuacugcuucugcucaucuaugacugguucuuuaucuguuucaaauuuuucaagguuuuuucaaaauuccuagugugaaguguaugauuucauuucuaccaggaauuuacuuaugagauggugccgguagggccuagugauuaagauaaugcauuuugauuucagucgaguuugagauccagaucuuccucuuaucaaaaguaacaucuuagaaaaaauuguuaacuuccuuaaacuucaaauacaaaauggcaguaacaauuguacccaauucacagaauuguuauaugaacaguaaauggaauaguaugcaacauuggacagaguuuaugacuuauaaacauuucauauucuuagcuguuaauauacuuuugaaauguguuuaaauuuuugaacagauuauuaguuuauucucacgcugcuaauaaagacauacccaagacuggguaauuuauaaaggaaagagguuuaauggacucaugguuccacaggacuggggaggccucaggaaacuuacaaucaugguggaaggggaagcaaaacuguccuucacgugguggcaucaaagagaagugccaagcaaaaugggggaaaacccccuaguaaaaccaucagauuucuugacaacucacucacuaucaugagcacagcauggagguaaccacccucaccauucaauuaccuccuaccaggucccuuccaacaacacauggggauuaugggaacuauaguuuaugaugagauuugagugaagacacagccaagucauauuaaccagauagaauuuguaacucuguuccugaaauuaaggggccucuuuaugacucuugaaaauguaauucacauagcugcucacaaaugagguuaccaugaagguaaaaaucacuguaaacuucuggagaauaucgacaaguauacaugaggcuucugauuuuaaaaauaaagaaaaaauaaaaauuguauuacauaugauuguauuaauaagccuagaaauaguaagaaaaaauaaaaaauuaaaggaaaaaaauuucaauuauagaugaguguauuaguccauucucccauugcuauaaaauaccagaaacuagguaauuuguaaaaaaaaaaaaguuuuauuguuaaaaauguuaaucacaguucuguaggcuguacaggaggcaaggcauaacagcuucugcuucuggggaggccucaggaaacuuauagucaugguggaaagugaaggggaaguaggcaugucuuacaaugcuggagcaggagaaagggggucgggggagguucuacacucuuuuaaacaaccagaucuccugagaacucuaucauaagagcaggacuagggcaauggugcuaaaccauuuaugaaaaaucacccacuugauccaaucacuucccacuacacuccaccuccaacauugggauuacaauucacaugagacuugagcaaagacacagauccaaaccauaucauucccacacugacaccuccuaaaaaucucauguccuacucacauuuuaaaauacaauaaucccuucucaacagucccccagagucuuaaccuuauugcagcauuaaguuaaaaguccaaaguucaaaguuucaucugagacaagacaagucccuucuuccuaugugccuguaaaaucaaaaagaaguuaguuacuugcaagauacaaugggguauaggcauugcguaaauacucccauuccaaaagggagaaaucagccaaaaacaaaaaaaauuggaaggauacaggcccuaugcauuucugaaacccagcacugcagucauuaaaucucaaaacuucaaaauaaucuccuuugacuccaugucucacaaucagggcacacugaagcaagggcugaguucccaaggccuugggcagcucugucccaugacuuuguaggguucagucccuauggcugcucucaugggcuaauguugagugguugcugcuuuuccagguguaggguacaagcugucaguggaucuaccauucuggggcccucuucucacaacuccacuaaguaaugccccaguggggacucuguguggcggcucugaccccacauuugccuuccauacugccccaauagaguuauucaugaagguuccaccccuguagugggcuucugccuggaugccuggauauccaggcuuuuccauucauccuuugaaaucuaagcagaggcuuccaagccucagcucuuguacucugugcacccacaggcuuaacaccacaucaaagcugccaaagguuauggcuugcagccucugaagcaguggccugagcuuuauaugggccccuuugagccaugucuggagcuggaguugcugggaugcagggagcuauguucugaggcugcacaaggcagcucggcccugggccuggcccacaaaaucauucuuccuugguaggccuccaggucugugaugggaggagcuuccaugagcuucucugaaaugccuuugagaucuuuuccucauuuuucuaucagccuuuaccuucuuuuuaauuaugcagauuucugcagccaucuugaauugcuccucugaaaugggcuuuacuuuucuaccuaccacauagcaaggcugaaaauuuuccaaacuuuuaugcugugcuucccuuuaaaauauaaaaguuccaguuccaggucauuucuuugcccacacauaggagcauauauuguuagaagcagccaggcuacuucuugaacaccuggcugcuuuaaaauuucuuuugccaaauacccuaaaucaucauucucaaguuaaaaguuccacagaucccuagagcaggggcacaauacagccuugcucuuugcuaaaguguagcaaaagugaccuuuacucuaguucccaauacauuccucauuucuaucugagaccccaucagccuggauuucauuguccauaucccuaucagcacaaccauucaagaagucucuaugaaguuccaaauuuucccucaucuuccugucuucuuuugggcccuccaaacucuuccaaccucuuccccuuacccaguuccaaaggcaauucuacauuuucagguaucuuuauagcaaugcccuacuccucaguaccaauuuucuauauuaguccauucuugcacugcuauaaagaaauacccgagacugcauaauuuacaaagaaagaaguuuaauugguuccuuguucugcaggcuguacaggaagcguagcaacuucugcuucuggagaggccuuaggauacuuacggucaugacagaaggcaaagggaaagccagcacauguuacaaggacaaagcaagagcaagagagagaagggggagguucuccacucuuuuaaacaacaagaugucaugagaacucucucacaagaacagcacuaaagggauagugcucagcuguuuaugaaaacuccccccaugauccaguuaccucccgcuagguccaccuccaacauugaggauuacaauuccacaugagacuugaguggggaugcagaucaaaaccauaucaaggagauaaaaaaaucuagaagcauguugaaagccguuuaaaaauauucacuuauuuguggcuauuuauuuugaugucuauuuccaaguucauuucuuucuauucuuugguaccuggaauauccagacauguucauccuuuagccuggugguuuuuauuaauugauaaagguguuacuggcucugaagcuaaacaugugagcacaacacugggcuauaugucucaaacacuuuuuugucuaauuuccguaugcuuaauguuuugauaaggcauuacuaacuuaauuaucauaggcauuaaggcuauugccuaacucaagauaaagaaugcucaauuuauguucuuuuucuccugucauguuugagauuccuuuucuuccuauuugucagguccuuauuuuauuaaauauuaucuuuuucuuacaucuuuaacuuuuuccuuucuacugacccuauccugcucacauuuagaaagacucagaucucuucuuuuuuuuuuuuuuuuuugagacggagucuugcucucuugcccaggcuggagugcaguggcacgaucuuggcucacugcaaccuccacuucccaaguucaagcauuuuccugccucagccucccgaguagcugggauuacaggcgcaugccaccaagcccagcuaauuuuuguauuuuuaguggagacgggguuucaccauguuggucagguuggucucgaacuccugaccucaugaucugcccaccucggccucccaaagugcugggauuacaggcgugagccaccgcgccuggccaggucucuuauuucuuaaaucaaucacuugacacugcucacuuuuguuuaauaaacagucauugaucacuuguaaaggagacuuuaaacaagugaucuaaggcauagggauagaaucagaaugccaugauuuuaaggacccaaaagaugaaaaccuuuuuaggaauagugaauaaugucaaucaggucaaauaagauacaaaccauauagauaccucuggguuaaguaguuugguggucagugaggcaauucagugucauaaugggacagaaacagaauauggaagauuggaguaaaugaagaacuuagauguggaggcauauuagauuggugcaaaaguaauugugguuucagauccugaauuuuaaaucauuauaaauaggcucaaacacaccuuuauuaaucaaaauuggaaccauuaaaaucaacacauuuuugccaaugaaaaauaagcuuguuuauucuguagcauuaaaaaaaauccuugcuuugagauucaacaaacucuuggaaaguuuuucugcauccugcuuguuguggaaguguuuucccugcaaaaaguuguugagauguuugaaguagugguagucaguuggcaagaggucaggugaauauggcaaaugaggcaaaauuuuguagcccaauucauucaaguuuugaagcauugguugggcaaugugcagucaggcauugucauagggaaggauugggccguucuguugaccaacugugcaggugucacaguuuucaguccaucucauugauuugcugagcauacuucucaguuguaaugguuuugccaggauucagaaagcuguaguggaucagacuggcagccgaccaccggugaccaugcccuuuuuuuggugcaaguuuggcuuugggaaaugcuuuggagcuucuucucgguccaaccacugagcuggucaucacugguuuuuguaugaaauccacuuuucaucgcacaucacaauccgauugcgaaaugguuuguuguuguguagaaaaagagaagaugacacuucaaaacaacuauuuuucugauuuucgaucagcucaugaggcacccauuaucaagcuuuuucaccuuuccaauuugcuucaaaugcaaagugaccauagaauagucaauguggaauuauucagcaacuucucauguaguuguaagaggaucagcuuuuaugauugcucucaauugguccuugucaacuucugauggccagccacuacacuccucaucuucaaugcucucaucuccuuugcaaaacuucuugaaccaccacugcauuguacauucguuagcaguuccugggccaaaugccuuguugauguugcgaguugucucugcugcuuuaugacccguuuugaacuugaauaagaaaaucacucggauuuacuuuuugucuaacaucauuuccauagucuaaaauaaacauaaaauaaacugcaaguaauaagucauuagcaaaaaaaguaaagagagaaugucuauuaaaaugauuuauaacauaaccacauuuauuuaagaauguauuccaauaucaaacagcaacuuccaacaaugcaaaaaccacaauuacuuuugcacucaccuaaaauaacuaugcauccuacuagucaaguuagaaauuugcuuuucuaccuuuacauauguuguuucuucuacuaggaauaucuuugucauuuuauucaauugacaaauuucuauuuauucuucaauuuuucaaaaaaucauuccaaaacuucccgggaaaaauuguguguuucuucuuccauaguuauauaguacuucaugucaccacuuguauggaauuaacuuucugaauuguaauaauugacuuuauuugcuuuuggucucaugggccaggggaguccuuuuguccggaaauaaucuguucuucuuuauacuacauggcuuagcacaaggcuuggcacaaaguagggaaucuguaaagauugcugaaccaaugaaugcuccucuuugucuuugauuccuacauggcuucuaggaacuagauauuaaaauugggauggagauaaugagguauucacacaagcaaguguuuuuuuuccugauguuuucucacuucccuauuccccuaaguaaacacacacacacagacacacacacacacacacacacacacuccuaaauaugcaucagcccuuuauuuuccuuauagcuuuaauauggcuacacccuauuaacauaaagcucacaccaaucaauuuuagccaacaugguucaacuaacuuuuucauuaccuuccauaccauaggcaaugagggagagguauuuucacauacuuaucucauuuaagccucaaaaccaaacucauuguacagaugaacaugauacucagaguguuuacauaaauuaacccaaauaaauauaaauuauguuuuaccuucuacuuugaaaugauuacugacucacaggaaguuccaaaguuaguacaaagaguuuucauguacucuucacccaguuuuucccaauggggcaugaagaugaacagaucuucucuagucacaaggaguccccugucccuugagaccaaagacaaauaaagccaguuacuacuguucagggaguuaauuccacacaagcgguggcauaaaguacuauguaacuguggaaggaggaccccccacccaauguuuguauaacauauaugacaucaaacuaggaaauggucauuagugcaauguuuguguauauuucuauaccauuuuaucaugaguucauucauguagccagaaccaaaaucaagauacagggcuauucccucagcacaaagaucuuucuuguauuauuuccuuauaguuacauacauuccucccccaugcaccaugccuaacccccuuuuuauuuuuagcauuuuuguucuuccuuccugguguucuaagguucauucuuuuauugcuuuauuucuauguucagaacuuuuucuggcaauucuuuuauggcaggucaacugaagacaaacuuaguuuucuucauuagagaacguuuugauuucuccuuuauugccaaaugauguuuuggcuuagaauagaauacugaguucaauaaaagaugucacucauuauuuaacauucuauuuuccaauucuguaauuuugucauuuauagaauguccuuugaguguacacuuacauguaaguguacaaagguuauguacugccauacagugcauaaucuuugaaauuagcuuuuuauauucagcauaguguccuugagaucuuucccaguuauaguauauaucaaguucauucuuuuuuauugcagaauaguaucucaugauaugaaugcaucacaauuuucuaaaccauucaaauauuauagaauauuuugauugcuuucaguuuuuguuuauaacaaauaaagcugcuaugaacaaucauguuucuuuuccaucuuuuuauuuuucaggcuaaagauauuguccuauuuuaagugagucucuugcagacagccuauaguugauacaacauaugcauucuuuaaucugcuuugccaaccucucuauuuugauugauguauuuaaaccauuuacauguaauuuaauuauugauucauuaggacuuaagucugacuuuuucuuuuuucuuuuucuguuuguugccucucauuuuuguuucucuauuuucuuuuuccugcauuccuguggguuaccugagcauuuuuuagaacucuaucuuauugccagaguuuuugaauauaucucugcacagcuuuuuaaguaauugcucuauguguugccuuacaaacacauuacuuaucauagucuaaggauguccaaccuuuacuaguuccagcaaaguauagaaaacuuagugcccuuuacauuccuuuaccccauuuaaaauauaugcaucuuaaauauuuucucugcauacaugauaaaguauuuuuauuaugauaauguacuauaguuuuuaacugucaagcaaacuuggaaaacucaagagaaggaaaguauuuuguauuuaccuaucuuuuauauuuuuaccauuuuucucacuccuaccugaugcccuaaguuuccuucuuuuauuguuuuauuucuauuuagaaaauuuuuuuauagccguucuuuuauggcaguucaacugaagacugauucucuuagucuuccuugucggagaauguuuuaauuuuuucuuuauuucugaaggauauuuugguuaaguuagaauacugaguuuaauaaaagaugucagucauuauuuaacauugagggagccuuaaaagggccacauagcaauauuuggaaaucauguggguuaaaguauagaaacucagaaagauaaagaagcaguauuuucuauguuuuucacaaguauugcuauggauauaccucagcuauaaguuuaauauuguaaacugucaaucaagaauacaaaauaguuuccaaaguaggagauuuuaaagauguugaaacuguuccaugagauuuacuucaggauaaacggaguaaacaaaauaaaauagucuguagaccauggauuagcaacuuaaagccuaugggccaaaguguccugcugucuuuuuuguaaguaaagauuacugaacaucaccaugcucauuccuuuauauauugucuauggccgcuuuaacucuacagcaguagaagugaauaguugcaacagagacuauauggacagcaaagccuaaguuacuuaccaucagguccuuuaaaaaauguuugcugacuccugcaucagauauuuuaaaagagguuuaggucuuaaguuuuguuucccagcugagauauauagauuuagcauauuaaaacuucuguaauuaucuuaaauagagucuuaagacagcaaacguuaauuccuaauuaucugaaaaacuaggagacaguaaaacaugaaaauuaugagcuaaaaucuaugaacacugcugggaucuauuguuuaaauuaauuacgaaaauaguuuaagucauuacaguuauaaaccagaaaguguuauuucuuauuagugcucucaauuccauugccuuuccucuuuauucaaaggaagacuucuuagaaaugcugagagcuggaccaacaccaaguguguuaugaacagacuguguacauguacacagccugucacccaaacacuguaauucuuuaugaaccuugcuucagguugcaauccugacacuacacucugcucuuugauguuaguagaaaaaaaaauucaguaaaaccggcaaauuaugcugaugacauuucaacaauaccagaucuuuagauuacaaacuaugguucuaguuccauugcagaguugcauucuauguggagcuuuugugaauuuccaaaauggcuuuacauaauggauaauuauauaaugaaugaaucuacauaaugauggcaaguuaaacuuucaccauaagacugcacaccaauaauuuauauaugcaguuaaaauugacucuuuuuucugagaguuuucuuuauaauuuuaacuuucauuugucuguuuccaaaguccccucuacuucuaaccaguaaguggugagcuaugcuaauuuuuaaauucagagcuguuaauaccugugauuugaauaaagaaagaaaauuucuaguauuuuaagacacauauaaugccagaacaaugggccucuugauaugaugaaucacuauaaaaauaaauccacaauacuucgaggaaggugcuuacccauaaaaaaacaaaaaggaggaacccaccaaacauuucauaaaagauuuuuuuucuuauggaauuuuauuuucugagagagcaggggcauuuaaaaaaugacaugccacguuguuuccccuuggugcacugaaucuggggagcagauaaugcuuaacauuaggcuguccacauuuugugaauucgauuuuuucaagagucuuucccuuauugauuuucaucucauguuacauguauagggaaaguaguauguaagugauuauaacuaaacaaguuaggaguuuguuuaaaaguuauuaucuugggccagccacggugguucaugccuguaaucccaguaauuugggaggccgaggugggcagaucauugaggccaggaguucaagaccagucagggugacaugccgaaaccccgucucuacuaaaaauacaaaaaguagccagacaugguggcacaggcuuguaaucccagcuacuugggaggccgaggcagaaggaucgcaugaacccagaaggaggagguugcagugagccgagauggcgcugcugcacuccagccugggcgacagagugggacuccgucucaaaaaaaaaaaaaaaaaaaaaaaaaaaaaaagccuggacgcaguggcucacgccuguaaucuuagcacuuugggaggccgaggcgaguggaucgcgagaucaggagaucaagaccauccuggcuaacacggugaaguccugugucuacuaaaaauacaaaaaguuagccaggcauggcggcaugcgccuguaauucuagcaacuugggaggcugagccaggagaaucacuugaacccgggaagcggagguugcagugagccgagaucgugccacugcacuccagccugggcgacaaagugagacuaugucucaaaaaaaaaaaaaaaaaaaaaaaaaaaaguuauaaucuuggaaaaugcaaccuuuacuuugguuauaaauuucaugcuaauucaugcugaggugggauucuacagauggaaauuccauucauaauauuagauggauacuauaaguauccggaaggaacauuagguacuaccaauguauacaaugaguccaucuaauacuuacauuaaguauuauuuauucagcacuuaguauagcccaggcacugcucuaacauagguuagcacauaguaacuaguauucuugugaaguauuauaaccaugcaauacauucaggagaaaaacagcaugauguuaauuugaauacaaguugugcugaucauuugaaccccauagucaauggagguauaauuugauugcucucacccauaaauguuaaguuguauucaucaaggcuaauuuuauacacagauaaaaccuacuggaauuuugugcuguucuuggauccuuauugaaauauauaugaguaagaaagagaaaauagcuuaauaacgauuuuuuaaaaaucaagacccaauguguccuuggcaauuauagagaagagcacaugguuggcuugcaguaaauuauuauuagaagaguuuugaccucugguguaauagaguacuauaucaauuuuuucuucacucaaaaugaauauuuugcuauggaauauuaauugugcaacagcucauuuuaaaauuauguuuuucuugguuaacuugaccauaauuaggaauaaucaucacuaguagaaaauuauaaugauuauaauaaucuuggacuauauaucaauaaaacuguguuaaacuuuuaauuauaaucauucucacuuuuaguaugcuaucucuuuaagauucgggcaagugaaacuacauguuuuaagcaauuacaauuacacaguaggcauucaauaaauauuuguuacaagaaaagauauuuuagaauacuguaaaaucuuaaugugacuaauaaauguaucugauuaaucuuuuaaacauuaauaaaacuaauaauuauuuauacucauaaccuacaugacuagaucauuuucuaaagaaguuacagaauaaacaucauuuuuaugauuauuaaacuucuauugaaaaggcaauauuauauagagcuuaaaaggacuaugguuaggacuuggguuaccugguuucagauuccuccucugccagucacugcauguguuagccugaguauauuucuuaagcucccuaugcuucaguuucuuuaucuacaacaugaagaugauaauaauagcagcaauguaacaggguuguuacacaaaagagauauuacaggcaaagaguuaaaaaaaaacucauccaaaauuaagagcuuuaacuuuuuagcuauuauuauuaaaauuuaccauauacuucauuuuuuacguagaaguuguuugaggacagauaauaaaagaucgugaugaauacuguguucuuaugugauaaaaucagguaaaugcaaguuaaugauugcccuucuaaacuggugaaauuuuauuuuguauucuguuucuucuauauaaacaguauaagaggagaauguuuacugggcaaucaccagaaugauuuccagacacaaaauuuuuacuuauucagauuucauaaacucugggugaugagaggggaggacaagaaauggaauauauuagagaaggguuacauuuuuuaagagaauguuuuaucugguuucauucugugcuauagaaaaaaaaucugucaaaauuaagaacaaaagaaaagagucuuucacacagcuauagcuuccuaagcgguuggcauuagaauaaaggaaccaagucucucugagacuuccauauaacuauuaaccuaaacaaagccaaaguaaaaagauguaaaggauacuaggaccagagggcuguuaaugauggugccaaguuuuucuucuuauuauuauuaauuuuggcaaauuaucuaaucuuagguuguuaugccuuccaauuuuggccuguuaaaguuuuaaaaauuuuauggagagcauucucuaucagaagacagcacuuugacucccuauaaaaugucucaaagggaauuuuguccagagggaagacagucaaaacccaugaaaugucuccuagcauaauacaaauaucucaugaaauggugaaaagcuaauuuugacaguucgacaaaagagguaaaaugcaacauuuauugcacauaaaugcuguauguaaauuuugccugagagaucaugacuuaaaaaacuagauucauuguauauuuuuugucuaaggcucuguuucaguguaaucuucagaaauuuauagagaauauuauugcauaaauuuauaaauuaaagccauucuaaagucuugagaacuugcccucaaaauauauagaauuauggaauuuauuaaacaauuuuguuuuugaggguuuuuuucaccuuuccuguuagccagguuuuuuuuuuuuauuuucauuuugcauuugauuugaauguaauucaguaccagccguauuguuucugaacagugcugaagcucugaagauguauuacacccaugcaucaucauagcauugucauucugacgauguauuaguguaauacaucuucagaccccucaaaugagaagcugucugugaggaauggagacaggagcaaauucaauucaauuacaguacaaaagaaccaguugaagagaaggaaagaacucucagagcaagauucucuguggaguugauuacaacuggguauuucauggaaguauauucuauuuuuccuuuugugacaugacaagaaauaauuauggauuuugaacacaugucuguagagauaaaauggcuucucaacccucgcuguuuaacucaguagaggccugaugugguuuuuuuugguuuuuuuuuuuuguuuguuuuuguuuuuuguuuuuuugaggcauuugauuuaaggggaaguugugaaagcagugcuauuuauucaacauauuaauccacaguauacaguugcccuacagauuaguuuacuaaaaugugauauaaggcaauaaggaauguuacccuuucaaaaaagucuuagaugacacuuuucagauuuucacacagaagugaagaggaacaauggcuaacuaaaaagugaucagcaggcaacaaaugagagaaccaacacuuuucagccagaacuuauuuccacuagauucugcugccuggagugaucaauaagucuucuugcuaguguaacuuuuucuuggauaucucucauguauuaaaaaacagugagacucaauuucaucauaugacaaauacauuugaggcuuaaagauuucaaucuaaacuuaacauguuuugcaaaaauagauuacuuaaauaaaauauccuuaacucauuacauaaagguuauauuauaaauauuuauuuuacaucuguuuucuucaaaacucaucuauucaacacuuacuaugucagacuuugugccagaauuuaaguauauagcaauaagaggaaaaauuauagcuaccaccaucaaggaguuuaaaaucuugccagaagagacauaauaugaagagugaaaaaaauuacacauuaacaauacaacaaugaggcauuuuugcagaguugucuuuuaaacugagccuugaaguuuaaggacaggaaguugcuaauugaugggaacagcauuuaaaaugcuugaaggcaagacaaaaguuguucuguucuaagacugaagucagugggcaugggacaaacugagaggaggggaagagagcgacuuaaguugggcuuggagaagguuaguuggggcuggacagaucaaguaaggauaacaggccauggugagaguuuaguauauuuuuccccuaaaugcaaaaggaagcuauagaaaguuuuggagcacguaaaugaugugauuuaauuuuaauuuuuagaagauguuuuuagugcuauguagagaacgaguugcagagaaagcaugaagcagaagagggauaucauuuaggaaacaagaguaguagcugagagguugacuugaggguaaugacaguggaggugaagaggacucggggaaucccauaauauacagguaaaaccaacagacugauagauuggagauggggaaugccucuuaguuuucuggcuucaucaauguggaaaauaggcaugccauucaaugagaugggguagaauagaggagaggagaaggauauuugaaagaaaaaucagaauuucuguuuugcuauguuaauuguaaggcauguuagacacucaagugaaaaugucagugaauaauuggauauaugaagcuuuuucucaaggaagaggucaggacaauaaaugaaacuuggaaucaugaauguaaaucugucccaagcaggcagaguagacagacagcagagagcccaaggccaguaucugaagauuugaaagacaagagcaagagacugagaaagaguuuccagugugacagaugaagaccuagaagagugaaacucagagaggagagggguuuaguaaucagaaagugaucuaaugaguuaaaauauaacaaaagauagaauaagauauauggaaaagugucuauuauauuuagcagcauggagauccuuucugaccuucauaaaagcacuuucagugaaucucugggaacuggagccagauugaaugagcugaauagggaaugcagguggggguggggaguuuuguggugagguagagaagaaaagugggauauuugcuggacugcuguuuaggguuccagauagggaugcuauucuaagagagagaauaguauggcaacaccauguaucuaucauuuggcuucaacaguaauugauacauagcuaauuuuguucaucuaaacugccuccccaacuuaagaggggauuuuuccuuauuucaccaaaaauauuuauguuaaaaagaccauaauaauaauggaccauaagcaauugcagaacacugaaacgcuaauguaucuuaaaggaaaacggacauaguagcaauuguagaagugauuuccucugcucguuuauauuuucuuuguaaacccacgauguagaggucuucagugaggcgcucuguuugaccaacacagagagcaugaggagcccagcaccucugagguggguacugugugcuggucauuggacuccacuuccucagcucugcuacuggagccuuuccugucacuucugaggaacacaaaguuccucaguggcagcucuuucaggaaaccuucgagucuccucuuuuugauaguacccucugucucucucuuaguucuguuccauugcuuuauccugaaaucaugugugcuuuaugcucaauucaucaccccaggugucugcugcugcugacugggacugucaccuggcaguuuauugcucaaagaaaucaccaucauuuuccuuuccuuguggucuguaacaggaggugcagucuucgaaaaagucagcauuucucuucccagguguucuucugcucuccagccgucacauauugccaacugcucccaucaccauucugaaauguuacagagcauauguuggauucgcagaguuaaucaggaaauuacaaauuacaaauuagaaaucuacccaugaaaagugauauggaucuauuaaagaaacaaugacagcucauucuccgaauauaaagaagggaauguauaaccacuagaaaauucaggggagaaaucuuguuaacaauccccaggcagaagacagucuugguaucagugauucccuauagcaaaugauggaaagaguaguaucuagguauauaauuacuaauuauaaggaugauuauuacuguucugaauuaaguauugagacaugggcaaaagacuccugagauauauuacaccacugacugcugccacuuuuaaggauucauguggguguagucaacaccauuuuuuaucucugcuagagugcaagaucuguaagagcugaauauacuucuaccucgauccucauuauacuuacauauaguaugugccuaauauauuugaaugaaugauaaaacccaaaauaauuuagguaauuuuacauaaugauuugagcucuucuuucacuauccuugguagcaauaugauaucaacaguaucuuugugugaauacuauugucugccaggcaauauauuaauuuucuuaguuaaaccucaaaaaauaccuauauuauagguaguauguuugcauuuuugagugaaagaaccugggacucuuaguauuucaucauuuucccaaggacuacaacuaguaucugagucguaauucacacucaauucugauagaccccaaagccgaagcuauuaaccauuacuaaaggaagauauagaauauaaauuacuagcuacauggacuugcuaaaaaguagaauuagaaucuccagcucaugggcuuacuauuguagaauaauuuucacaucaaaaugacuaagauuuucuggaggaauuuccaauauagagagcuaguauaacauagaacugaaaccauguuaaguagcgaaucuccuguuccuggaaauaguaauaaagacugaauaaucucuuaucaggaaugcugccuaagugaacucuggcaucuaugaaagugagaggguacaugaaugauugauuccauaguauuugauuuauagaccggggagauauuuccuucuaauguggagaaggucuuuauuugaccaagaaauauauuaaacaaaauuuugccaucugcucucaccauuauuucauaaaccaaagauagguucaugcaaaagaggaaaacauagcauacacuuagaauaaaaacagcccuaugcaaaaaugaauaguugauaaucuuacaucagauauuaaucuuuaucuguuuguuugcauagcuagcuggccaguaaaaccaaaauuguguguuuccucuagaucaggagucaacaaacuacaugugggaaaaaucccuuucccuaccuauuuuuguauauaaaguuguauuagaacauaaucacacccauuuguuuauguauuaucuaugacuucuuucacguggcaagagcagaguugaguaguuguaacagagaaccuauggccugcaaguaagaaaauguuuucuaccaaguauuuuacaaaaaaagcuuagugaccccuuacagaaauuauaaaaggaccccaucucuuauuuaaagaacuuguuuccuucucaguauuacacugaauauggacuucuauugcaucuuagaagggcaauacuuuauuucgugguuacuacuccagcguauuguauaauuccuauagagaaauguuucuacauuuuuucuucaacuaauuauuuaaauauaucaacauguuuucaauuuugccaauccaguuaaccaaugacccagaugaccacuacauuuccagcaaauucuaugacuuuaaaauuucauauucucauaugacgauaaauuuuccauucacauaauguccuccacauauaugucaauaauaauuuuaaauggaauucugaaagaguauauccuugacugcauuuuucuauugauggagaaaaugugucuucuggccuucccuucaggaaaaaugcugcucugagcccaauaggcacuuaugagacaggcuuuuuuuuuuuuggaaagguagcuuggaguuagcacauuugccugggaggccugugggcuuccauugauugacagccacagaagcagcucugggcugaauagcuccuggguaguaagguaaaagucacuguuugacuaacauccaauggguagagaaagcacaagaaacaaacagugggagaaaaaaaguugucaaauaaaaucaguaaggucucuguuugggauuugggaagucaaacaauggggaaaugugugauuuaauaguauugguuuucagagacauccucaacagagccucuuaaaugcccuuaacagggauucauuguguuaaauguugaucauucacuguucuaugagucaaauacuuuucuugaagugcucaaauuauacugaaaucuaaacuauaauaagcacuaucucuaugcuuuagaggugaaauaaguaaacuguauaaauaaauaugaaauugcagauuaaaauaacagaucuugggaugcucauuacugaucuuagcuaagaguucaucucuuauugaaggggagauaaaaacugaaacuacugaauuacucagucauauuggauauuacucuguguaauaucaggcuaaaaaagggauacaggcuaaagaaagaacaaaaaaaaaacaaaacaaagaaugauagauucauaccaaauauuuuacuauauucucaccccuaaaaugaaaguacaccuguauaagaucaucacuaagguauuuugcacuccaaaguccuucaauucuguaaaucuagucauaaacuaaguucuauagauggaauauauaacauuuuuucccauuauauuguccuaaaauacauauaaaucaauuuauauacauguccacacacagaaacauggagauuugaugaaaccauuuaaagaaaacuuugggguaaaauaaaaaauaaaaaagcuucuuaaaaauauaaaugauuaaguaauacacaauaagaugguuuggcuguguccccacccaaaucucaucuugaauuguaccuccuaccauucccacauguuaugggagggacccagugggagguaauugaaucauggggguggguuuuucccaugcuguucucgauagugaauaugucucaugagagcugaugguuuuauaaagaggaguuccccugcauaaguucucucuucccugccauguaagaugugacuugcuccuccuucccuucugccaugauugugaggccuccccagccauguggaacagugagucaauuaaaccucuuuucuuuauaugucucggguaugucuuuaccagcaggaugaaaacagacuaauacauauauacuuucuggggaaaucaguagcagcucaguaaaaaucuaaaaucugaccuuugcucauauagggcaaagagaauauaacacaguggcuuaucguccaaaagaaaggagcagggccgggcgcgguggcucacgccuguaaucccagcacuuugggaggccgaggcggguggaucaugaagucaggagaucgagaccauccugguuaacaaggugaaaccccgucucuacuaaaaauacaaaaaauuagccgggcgcgguggcgggcgccuguagucccagcuacucgggaggcugaggcaggagaauggcgugaaccugggaagcggagcuugcagugagccgagauugcgccacugcaguccgcaguccggccugggcgacagagcgagacuccgucucaaaaaaaaaaaaaaaagaaaggagcaaaccauuucaucaggagagauugauuuuuguagcuuugugaggcauuuuuauaugugucuguaaauagggacauuaaacuguugacagggcuauagugacugcuucuguauuaaucauuaaauguuaaaaauaagcauuuuuugguacuuuacaguggucugacaacaaaauaauacagcuuuaaaaugcuggaggagaaaauauccaacacaacuaauugccucuucuaaauauugaacaggaauuguucuucaaauaaugaaaaagugacauuggaacuaucugaucaaguuccaugaaauggagcaagagcugguuguucuuaccuaagacgagaguagcuucugcgagauggggagucaggccaaguacagugaagaaaaacacacaagcaaaugaaagggcccaagcagcugucaaaaauaggaugucagggacacgagcucaaaauuaauaaaauuaauaacuauccuuuccuaaguaugauuaucauagcaaauaugauauaagugcugcagauaugcuauacuacauauucuuguaauaacacacaaagauguacugauauuauuauguucauuuuacucacgaaaaauaacaacugagguuuagguaaguuaagugaaaauauuaagagacaccauuguugaauaguuugccuauauaaauuuugaguauuuuuacauggagauaauauucuaucuuguguuuuauucaagauuacacuaacuaaauggugauucugugaaaaauugugauaccucaguaauagugauaacaggaaaaaguguuuucuuaguuaaacauccucuuccauauugcaucagaacauuccauucaagaugcugugauuauaaacauuauuuuuuguuaguuuuguugauguaaguguguuuugauagaaagcaucaaagaauauugaaagcaucauucuuauuuuaaguuaacaaguucucaaugauuuccagaaaaacaaaaauacuaugaucuuauuugauuuaugaagagcccuauuucauaguuugacuucauucuccuuguggaaauguuuugacuauuuucuucagauaauuuucuuugauaagucucuaauuuuuuuuuguuccuccugugugaaucauaagaaacauauuacaguccuuuauagaccacaguccuucuaugcauuagagcuucagaaacacuguccauuuuuucaugccaaagugaaauuuauuuaauuucauuuauuuuaaauuaugucaucaugugagcaccgaauaguccuuagguaaauuuuuuccaauaauuauaauacaauuuuuuaaaaggcagaaauaaauuucauuggcauuagcuaacuaaaaucuaauaagcccacugaaauauuauaaguaaauaugcaaaccaaagggcauaaccucugaacuuuuuauauguuuucuucaggauacagguaucauaggucauuaauaaggucucaauaugucaucacuauucucccuuuauuuggaaacugacguuuguuuaaaaccuaagaaaauauagcagucuaccuuuaaauuaaaagaacaaaagugaagauauguauacauauauauacucagugaauucaugcagaccuauuuguauguuucaucagaaaugaacuucaaauuuaggcauggggaacuacauuguguacuaacauuauuaauuaucaagaaacuuuguaacacugaguuuguagaggacuuuacuuaggaagcuaaucauauacugucagccaguauguacgguaaaguagggaaaauggaaagaacacuagauugugugucaaaauaauuauuuucucucaaaguucuucuauuuuaccuuguacuguugagcagaguauuuaaugucuuugggauuuggucuucucauaucuaaaugaggaaaguuacacuuguucaacugaauuguuuuaauaacagaauaaucaacaugaaaguauuuacaaaaucagaaggcuucagcaaauguaaaaaauauauugguagacuuauucuguccaauacaauuggauuugaaagaaccuggaugauaggaauuaguuuuaauuuuucuaacucuauuuuuuucccuaaaacuuuggaagccagaucccucuaacucuaaucaaauauaaauguuaaaaaaaaaaaaggugaaggaugggguauggguggaaaagaauucaagauuauuauaaaaaugagaaauccacccauucuaccuggucucuucgauuguuucuauuauuauaugaaaacggacugggcgcaguggcucaugccuauaguccuagcaguuugggaggcugaggcagguggaucauuugaggucaggaguuugagaccagacuggccaacauggugaaaccccaucucuacaaaaaguacagaaauuagcaggguguuguggcccaugccuguagucccaacuacuugagaggcugaggcaggagaaucgcucaaacccaggagguggaagcugcauugaacugaggucaugccacugcgcuccagccugggugacagagcaagacucugucugaaaaaaaaaaaaaaagauguaagaaguuuucaccacauggcuauuuucacucagaagaaagacuaagugauuucuacauuuauuuuuauguuuuaauauugauccugugcuguacugagauggauuuaauggaagaagauugacuguucugcauaucuaugauaucugauccugucuaguaaauaucuauaaaggaaauacuucauccuuuuuuucuuuuuuuuuauuaaugagauuuauaugccugacuucagaauagcucuuuuccagugugucuauuugucacuaagucaauugccccuuuauaugauaaaaagcugauguauuuuacuauucacuagaggaaauagucauaaguaagauagccucccuccuacacucaauuuaauuguuauuugaaagccaguaaugcaacugaaucauuuacacuagcuauauccuuuauuuuuggaagaggacugaaaacuucagugacccuuagaaucagauaagcuuuuuacauaauugagacagccaauauuccauuuuugauggcuaauauccaggcugccugaaaggcauuugagagagggaauuugccaugcaauuaaaagggaacuggaacuguagaaaacauucauacauuucuuuuuggaaacuuuagaaaucugugugugugugugugugugugcguguguguguguacgcguguguguguguacauguguguguauguguguguauacguauacauauuuauaaauauucuuuucaaguaaggagacauugugugaguauuuugacagaaguggcagaaaaaaaagaagaugcauugaggaaaauggauuuagcugugaugcuggaagcuaauuuccagggagaauuaacaagaaaaaaaaaaagaagauuucucaaaugauagucacuuaaggacuuacauaaugagcaguugaagauaauuggcacuuuauuucacucaaaaaugugauuuuuaaggauuuuucauagcugucaguuauaaccagauaaucuuagacuaaagaguauuucagauuugcugaaacaccuaucuaaguuugcuaucccguguuagaaaucucacaauuuccucuagguaaucuugaacucuugccucuugcagccuuaaacaacagauuuaauuauuuuauuuauucauuaauuaaacauuuauauaaagccugacacauggcucuacaggagcagaaaagaguguuuucuuuccuccucaucauaagggucauggccaacaccugugugacaaagacagguuagcaagaaaagcauaacauauuuguaugaacauacuuuuauaugacacaggagccuucagaaugaagauccaaagauaagggaaaacuauccauuuuuaugcguagguucaaugaaauauggacaggcauguagaaagggaaugaucuaaugcaaccagacugaggggggaaacucagcaaggucuguuuagaguguucuuggccucucuuuagagcauuuccuccuccuagaucuagaguaggaccccuuuggaaugaacaucuuaauuacuuuauggccagcuguuacacagaaaggcaggaugcaagauuagaguaauauuuuuaggcuuuaugguuggcuuugggaaaaacagguuaugauuucuguuuguuuguuuguuugguuuuugacauagucuugcucugucgcccaggcuagagggcaguggcacaaucucggcucacugcaauggugagagagacuuugcuucugaggggcugcuuuuuaagccuucacuuugaguuauuguuuucugaggcccaucauucccuggucugaaacuuucccaaaauuuuuacaguccagaaacuggggugguagauugucucauaagccacugaaucagucucucagucucaagaauagguuaguccaguuaaauugguuacagaugugucucacucaggcagugauguuguagaucacccaccaaagucagggcucuauauagugugagcaaucaaauauuuaauaagaggaauuucuccugaaagaagaaaacaaagcuuuauguuuagaacaaacuauaaaacucaggguuuuuguuuguuuguuuguuuguuuuaguccagagagcagccagccaagauuuuuagacguugcacuggaagcauguauagauggaaaaagaguagacaguggaaaucucacagcuuuuccugguuuauaguuugcaucagauaaauguugugaauagucgauacagcaguaggcacaaagguuaauuauacauaagccauuguggugauuuauuugaaguuuauaucaaauuguuuaacuucaguuuguaggaccucaaaaaaagagagaaguuuuaauuuuaaugauuucaaggaagaaggauaagauaaagcuuauaaaccuuaguccagagagucacagucauauaauggaaaaaacagaaaguucagaauucaguucaaauaauaauaacacucaaaaacaaugccuagaaucuaauaagugcaguauaguuuucuucugccacauaauuuuucucuguuucauucccccauuuccaccaaagguauuuaugauaaaacuauuucuuuguaaaguaaauuuaguucauuaacuugggaugauuauuugcauaaagugcaguaagaauaaugauuuuuaauauagguuauuuuaaaguuggcauugaugaaauuuuuucuuaaaaaacuaagauugaacuugugaaaaccucucaaacuaggaagcuaagccaagaauuugacuuguucucagauggugucuacauaccuguaugcauuaggugaauuucacccuucucaagguccucauuacugggccuaucagaaaaugacuuucuuuacuaacuagaagaucaaagaucuuaaaagggaacugaguagacacgauacuaggccaguuauucuaacgggcuuuuuauuggcuccaugaaagucaaccuugaucccucaaagauauauggauauggauauauagguauauguggauauagacagauguaaauauggauauauuaugacauggauauguuguuuuuaaaccugccuggcuuauuauuauuauuauuauuauuauuauuauuauuuacagaguacuugcuaugugcuccauuuaccaagcacuuuauauauauauauauauauguuauuugucauaaacauauuauuaucacccuuccuuuacaaaggauaaauuauggcugcagagcagaguaaagauuuggacccugagcuuuacagcuaucaaguucauucuccuaaacuucguguagucugaggcuaaaaaauaaauaauacuaaauaaggucaaaugucaucugcuuaagcuuaauugacaacucugucuucccagauauaaaaauacacugucagcacuuuuuaaauaauuaauccucgggucaucuaagccaugagugggagagaauugcaaaauuaaccagaagggagggcuaguaacuacaagacagaucauauuuccaauucuugacagaaaacauugaguuauuuuauaagcaauucccuguauagaggugaugcuugaaugaagaggagcaaagagugcagucuacuacuucaauuaucugacuaagggaggacaauucaauacauaagaccuaaguaccaauuagguaaaugaaaaacucaagcaugcuacacaauuucagggcagaaagacacucagaaaggcaacagagcucugcaauugcaggcugaucuucagccacacugacacagagaaccugggaaagauuugacccuuuggagaugcugcugaagguuauuagggcccuauuagagagccugagagaacaacaauagcauuuaaagggacucuauaaauaagguuccauuuucaguauagaugagauuauuuuuaaaaauaccauacugaaagacauuuuuauauucaacauaaucagcauuaguuaaaauuaaaauucuuuauuaacaaagaggcugauauaguuauaaaaauuuuaguggaaauuuuuucuccggcugccuuuggaaaaaaaaaaaaccaaugacagcugaaucauuagcuauccaaauaaaaaucuuccugaaaaaaacaaguaacugcaguuuccuagauugauguacuaucuucaccucuguuauuuuauguuuauauuaaacuacauucuacuuuccucaagaaaaauauucuguauuacauuuuuuugauccuccauagauccuggcuuaagaagcaacaugucuuagucaguuuggacugauuuuacaaaugccauagacugggugguuugaauaaaaaacauuuauuucucacaguuucagaggcuggaaaguccaagaucaaguugcuagccauuuugguuccuggugagggcccucuucccggguugcagauggaugucgucuuaucuucucgauguauccucacauaguggagagagagagauaaccucucuugugucuucuuuuaagagcacaaauucugucaugggagugccacccacaugacuucauggccucuaucacacugggagucagggcuucaacaucugaauuuugggggaacacaaauauuguguacauaagaucuggccucugaccucccacaauucauguccuuuucacuugcaaaauacauucauuuaaucccaauaaccaagucuugauguguuccaacaucaacacuaaagucuaaaguccaaaauuucauuuaaauaucaucuaagucaguuacgggugugacugaagguuuaauucauccugaggcaaaauuucccuccagcuaugagcccaugaaaacagacaaguuaugugcuuccaaaauacaauggcaggacagacauaggauagacauuuucauuccaaaagugagaaaugggaaagaaaggggugacaguucccaagcaagccaagaucuagcauguaaacuucaugagauauaaggcuuaagaauagccugcuuuagcucaaugauuuguuuuccagacucacuagaagugguggcccugccauccagacccacuagaguggaaauccugucucccaaacccaguggggcagaacucccacuuucugcacccacuggggcaguuauccugucucuauagauuuucuaggugagggucacauucccagggcucuacuugacaggggucauucuccuauagcuccaagagcccccaccaugaaggcuuugggcagaggcaaucuggccuauugauccuuaggcugauuugguuccuggugcaggucuucuucccaauuuguagaugcaugccuucuugcugaauccucaucugguggagagagagaucaucucucuuaugucucuuuucauaagugcacuaauccucuuacgagagccccacucccaugaccuaauuacuucuugauauaguuuagaucuuguccucacccaaaucucauguugaauuguaauccccaguauuggagguggggccuggugagaggugauuggaauaugggaguggguuuaucaugaaugguuuagcaccaugcucuuagaacuguccucacagucgugagugacuucucaugagaucuggcuguuuaaaaguguguggcuccuugcucucucuugcucccgcucuagccauguaaagugucugaucuuccuucaccuucuggaugauuuaaguuuccugaggccuccccagaagcugagcagaagccagcaucaugcuuccuuuacagccugcagaacgauaagccaauuaaaccuccuuucuuuauaaauuauccagucugagguacuucuuuauagcaaugaaagaauggucuaauguacuucucaaaggccuuaccaccaaauaacauaaauucaggaucaggguuuuuuguaugaauuuugggggaacauaaacauuuaauccauagcaaaauguauaugguaggugcuuggcaaauacuggcaggaagggugaauggauauuuggagagauuaaugaguuuuuccagaaagaucaaccugaaagaacugaaacauaaauuaaacaaaggaaugggagaauuggguugauaggaggaaacacauaucacaugaauuaagacugaucaguauuggcaaaagauggcagauacaguugugauauucauugucauugcuauuauuuuugcaauguucauggcuacacagaguaccauauugcuuaaaaugauuugagauauucucuaagcucuuaaugcaacuuuguaccauguucugcagcuacaauugccaaaccuccagcucaagagggaccaaauggagaauuaacagaucaaccccagacucugggugucuucuucuuagagcaguaaugaaugcucugagauuugguauaaaaugaaaucaaaugauugaaugccuaagacgccaugaauggaagaaaucacuaaaucaaaauuuuuuuggugacuaaacucauucccauuuucugaguguaaaucagacacuugagccaaccucugcagggugucgcuuucacuccacagagucacacugaaguaaagcaggagccugaccaaauaauaccugaaaaucaauauuuucuugucaacucugaaauuuccaaagcauaacuugaccauaagaauuguuauuuaaaauauccccauuccuuacuuaugaaggcaaugcaaguacuaguaaaaguagacuaaucaguauuggcaaaagauggcagauacacuugcaauauucauuauuuaauuuaauuuauuuaauuucauuaaauugccuuccugcuguuuuccagagaaaccaaugauacagucccuugagauuugccagaaauaauguuaaaauaauauaucuugaaaauuacauuauagcugaauacauaugagcuacccaaacccccacuguacuuuccuguguucagcagacaggccccaggaaacaucuuugugggaugaaguucauuuuguuuucauagguugcaaccucauuccuaggauguggauagugucucguuaggaaaauuuagcuucauauuuuucaggugaacuugauauuuaauuccacuacuaccauauauuccucucuuugaucauauuuauauuaaucucaguaucuaacaaccauauaagauacagaguagcagagcaaaccuaaagaauaaugcaaauauuacauugcaauaauggaguaguaauucauucaccauuuacugagaacuaucuguauucuccauuagaggccgaaauggagaagaaugguugugacguagaacaaaacguuucgacugccuucaaaaguuuauaacauauuaggaacauaaggauauaaacagcuauguuguagaacugaaugauauaaauuccauaagauaaguaauaaacacaauuccagggaagucgcagaugaaauaaaccagaucuaaauagaacacauuuaaguugguaucaugaagaauuugaacuuguuaauaaucuuucuguauuagagacuguggaagagaagaaugucuggaguggagugucaugaagugguaauguacaaggaguguuuugggaacaugaggaugcuuaagguacaugguagagauucuagacuuuguuuuuauuaaauaaaacuuaaaagcuauuaaauauuuuuggcaaauuaauaaucuaaguagagacaugcuuuauaaagacaaaaccuauagggaauagaaagcaggaagacaaaaaauucuacagacuucaugaaggcagugauuuuuagcuguuuguuuuaccaguguaggugcucaauaaacuuuuuauugcuugagugaaucaauuuccugauuuugugagggccaugaaaugaaaguaaacuuuuauuuuugauacuccuagaauuuuuuuuaaaugugcaauugcacacagauagaauaggagggaaauacucauuuuucggaaaagaguaagaaugauuuaagaggguuuuuuuuuuuuaguuuuuuguuuuguuuuguuuuguuuuuuguuuugguggggguguauuagucaggguucucuagaaggacagaacuaguaagacuguuguauauguaaaggggaguuuauuaaggaguauuaacucacacaaucacaacaucccacaauaggccauuugcaagcugaggagcgaggaagccagucugagucccaaagcugaagaaccuggagucugacauucaagggcagaaagcauccagcacaggagaaagauguaggcugggaggcuaagcgagucuagucuuuucacguuuuuuuuuuuuguuuuuuuuuuuuuuuuuucugccugccuuuuuucuggcugcacaggcagcugauuagaugguauccacccagauuaaggaugggucugccuuucccaguccacugacucaaauguuaauuuccuuuggcaacaggcuuacacacacacccaggaacauugcaaccuuuaauuugaucaaguugacacucaguauuaaccaucauggugggugggggguguuuguuuuguguuaagucacuuugaggcucuuuuuuguccuuagucauaaacauuugguaauuuaaacugaauaaggaaacaaugaacucaugcuauguaauuuuuuuucucuuucuuuauuguuacauacaauguauaaacauuuaaaacagaaaacaguagggauccucgugcaucccuaggaaggcagcaaagaagaaagaggucccagaaacauuuuuuaaaauauaagacauaucagugcucgaaccaaagguauggaagguuuagagccagcagagagcuguguucccugggguuguccuggcuccccgccagagccaggacacacaggcaggacacuacugacagaaaacucuacaccagacagcauucccuucuuauggaaagcagggcaacauauaaggguuacuaagagcuccuuccucccuugagggcgacaacugaggaaaaggaaaguagugucccaugucacucugauccccauccccagcugcucuggccccagaugcccucauauugacauuuaccagagccugucucagcucagacccugccuagguccaccaguugcccaaaguucucuggggaggguggaggaagaggcugggugucaaaucaagcagaucuuuauuugcaguugucacuggggauguuucuuguugcuuauuugucugcuaaccugcucuuucagcugcauggcagggcucaaggccuugaugacaucugucagggcugagaagugcuugacuugcugggccagagcggauuccacuucguucacaaaugucuccaggccauaguccggcugcuuggucuuuuuaguaacugaaaauagagacugagguccauaaaaugcuuugcagagagaacaaaugaagugaacagguuuuuuagagguucauuucaggggcaaagagaugggauaauagcagccuaggaaggagugggaggaaggaugauacuucauuacuucagcaugggcuguuuccuccuuaguuaugcagauggauaggaaagcugaacucauguacccagcaggugcuggcucugggaagagacacaguugccuaaaccgacuguaauuccugccacccgugaggacuaaaaaccugagccagagagauccuaaaauugggucacaaagaaagagggggcauuaccuguggagaaauagucacuuauuggauccacuuuucaccuucuucaggaaaacggcaauguaaggaaauuagcuaucuuuuuugucuuugccuguaagaacaaagacugaaaaauauuuaaucuuuuugcaaaucuucucuuaauuucuguguuauauccguauugguuacuuugcacugguuauuuguggaucauuucaaauuaacaaauuaauagaguuaauaguaaaucaaaauaaaauaaaauaaaauaaguuuuagucucuauuuuguuuggcauguauauaccccaaaauucuuuaaacuaauggcaagauaaaugaccaacuugcauagugagagaguucuccuaucugcuucauuacuuuuuuccuuuguugcuacaacaaaaacaugucuacaucuuaaucuccauuucgagggaugcaacuaaggccuagacuuucagucaacauuagcauucccucccaaggaaaaaaaaaaaaaaaggcuguuuucucaccucuguccaacggguguuugaauguaaaauauguagggaaaucaagaccagaauuuguaauucuagaacuauugaaaaacuaguugagcaaagguaagaguuuaacagacauuuugggauaugauauggucgagccuauuucauuucccuuuucaaaaguugaaaaaucaaaaggauuucuuuuaaaauucagguuacaucucuacuuugcuugagguuuauuauaguugaaagacugguuuuacacauaaaacuuuuuugcuuaaaacaugcaugaaugguuucugauuucuucucauccagauauuugagaacaauuuuaggaagcacccaacuuuacuacauugcauuuucaaguguucuuuccugacuccucuuacagagcccauccaaaaugugccuucaugauguuaaauaccaguuggcauuuuuaguuugguuggaauagaauugcagaauuuugcuuuucuuaauugugaaagaggcagauaguuaaccacauuuuuucuccuucugcauaucuaaaaaugcauucaauucuucagcaaauauuuaguucuuuuauuauacgagacauuggaaagcauuaaucugaagaacuaguuacaguugagguuccucaucacaagguaauauccugggaaaacucugauccaggagcacuuuucugacuccauucaaacuauuuccugaaggcaaccagcagauuacuucaugacuugaggaaaccugaaagguggcagcuuuugcuggcucagauaggaaauaagccuuuucaagaaacuguacucagugccaauuacaaagccuuuaaucaauuaauaauuacugcagcacauuaugacuuucucuaugauugcugcucgaacuuaggggaaaaaauacauuuuaaaugguaauuuaaugauuaaccguaaaguagguauuuaaaaucaaaggugcugcuuacauuuucaaaaucucuaaauauaugcaaacaaaaggaaaaaaauaguucuugugaaaguauacaagaucuuuaaauauuaaaucccagaccacauuuuagacauaaaauucaucaaaacauuuucaacaaauacaucaaagugggaagaaacuaauaguuugacugaacuaauagacaauaaucaauaagaaacuuuuaaauauaauuuuaaaaguuagaagauaguauuugcuuuucaaaaauaagaaaauucuuuuuucuaauuggcuagccuggcuuuggucaauguacuugauaauuuugagcuuucuacacugaggguaaugaaauauuaaaacaauaaucuagggagguugugaaguguauuaucaggaacucugucaauauucucuuugucuaaacauuaauugaucauuucaauaaaagguaaggacuuuuuauagucuacagcaugauuacaaaguagaugacuuucucaguacuuccuaacccuuuaauucauauguaacaauuuaauuuuuuuucaaauuccuuuaagcaccugauauuauucucagaugccucaccuucaguuguggcccucuaguaccugucaucaaaaaguagcacagagaauggaauaucugaaauaccauucaaaaguauauuuuaucuauugcacguaauuauuuauauaauuauguacuuuuacauuuuauauacuuaauuauauguauacccacgauguguguguauauauguguguguguuuauguguauucauuuuugcaguucuuaucauagcuacuagaaucuugcuuauuuuuuucaauccagugucuguaauuguacuaugcuccuauauguuuuucuauaaaucauguaaucacuccaugucauuugccauuuuaagaggcaaugucccccuuuaccagccacccaauuaagcaaccauucauuaaauaucagauuucagguucacccugccacuuuugaaguacuuugaaaauuauagugauguauuuugugcucucaacagcuuacaguuagugguggguuaaaaaucacuaucgagguaaaaauaaccauaaauaagaaagagacucaagcaaaguuugggauagugauaaaauuuaucuuggagcucuuaggguuuuguaaaggaaguuccauuuuaagugugucuugaaagaugaauacuaaaccuggcugcauuuuaauggaugaauuagaggaucaagaaaugaaaaacucaugcugagauagaagugcugguguggcauccauaugaacauguugauguaacugguaacugaaaauuaagaaauaggccacaucuagugaagaaaaauuggaaguuggcaaauuaaaaccaaaggaguaacagaguaacagagauuuccggguaaaaaguguauugauugaacuuaaagaugcagagaguagagccuuggggaaaugacuguaauuaaauggaaauggaggggaaaaaaaaguuaagguaacugaagaagagcaggcagagacaagagaacugaagaggacaaugcaagaagaaagcauuuaagaugaucaaagacugcaauggcaagacaaugacucggcccacugcauuuaaaauuauuagggcacugaugaauuuaaugaaagcuguuucagugguacacuagugguaagagucagauuauaggaguagaaaggcagaauucauuugggaggaaugagggagacuagucuuuaaggaaguguggcaauaaggagaaaaagaaagauggggugauagauuguguuagaagcauaguuaaaucagcauuuauuuuuacuuuaguaaaauuaaacaaaaagggauaagccauuguggaagaguuauuaacauaggagaaagaaaggagaaaaguuguuuggaauaaucaaaauaauuguaacaauuacuuauugagcucuuacuacaugcuaggcaguauuuuugucacuuuauauaaaauaagucaauagccuuccaacaauucugucaauguaaguauucuuauauccauuucacagauaaggagacugaagcuugcuuaagagugguuaaauaucuugcccaaaguaccugcuagggagggauaaagauagaauuugaacugagaccaucuggcuucagccaaccagcucuauaaacaaaccauucugcgggucuuacuugugcagccaguaauugccgguccuauucuuuuggugaagauguugaaccugagaaaaaucaaaugcuuuuucuuauuuauucugugcucugcccuauccuuaggguccuagguaauguuuggaaugcaucagucccaaccuuccuguacuacaauaagugaauaaauugcucacaauaauuugaggaagccuggggucuuuuaugagcauuucaaaugauuaauaaaguauguaaaauaaucagauugucuggaucugaauaguguugaaagauuuaauaguuuccaauguugagaaguuucaacauacugguugaaaucaaugaacaaguuauccauuugauaguggggggaagauguagcacaucaaguuucuuggauuuuuuuaggaaucaguacuauacaggcaguuagaugacauauauaauucugcaccauuuuauuuuggucuacaauuauaucacuacuguauuauauuuugcuguuuuaacaaaugagcucugaugaauuugccaguauuuaacuuuuccugggucucucauuuucauucuacuuauccuagcuucuccacucccccacuaacuucuauaauuuuuccuuuauuggaaaguucucagagccuugggcucuucaguagaaaguauaguaugaagcuggaagauaaauaauacaucagaucacuucuacucaaucugggcaagugacauuuacaauuuuaacaaacuggaggcaugauggcaaauaagagaauauuuggaacagaguaaacuucaguuacaauacagacuaaaauucuaagaguguucuuucucauuuggcuaauauauguaauucaaguuuacuggaggaauguucucacucagaugcuaaacugcacaucugcaaacuauucccacagaaacaaucugagcaacgcccacccucaaaacccucacugauucuuaucauuucuguaaagacaauauuucuuucuccaaagagcagcagauauaucagauguuugaguauuaaaauguagauacacuugccuuuuaaaucucacucuaaucucugacgcuaaaaucagcacacugugcagcauuuugaagagugcuuucuuuggaauaauaauuccaguagaugaucuguaggaaaaaaaaaaaaaaagagcuauccugugaccauauuugacuugagaaaagcugagcacaccugucuuggagacucacgaugcacauuaacauauuaaaggcucuggaaguccaguaauaaggaauuaugugggguuuguuuuuuguuuaauucauacuucccagguuuauuugaaaaucgaaaaacauuuuguccuuaauccuauuaagagaacuuucuauaaaauggaauuuuauuggugguagauauuuuguaguauccuucccauucucaaaaacccauuuugugaaaugccacauucucugauuugcucuguauuucuuaguacaauagcauaaagagaaaauugaacauucuugaggacuuaugugucagucauaucaauuuauauuuuuaguaauauaaaauggacaaaucuuuggaaagugucaggaaaaaaaacuugauuuuuucuucuaaaagcacugcauccucacagagguuugaagcuaacuagcaggaaacaccugcaucuuaucaaugucaacacgaaugccucuaaaaagaacacaagcuggcgcgcgcgcgcacacacacacacacacacacacacacagcauucaguaaugugucgaauguggcuaauuaauuuaaggcaguaacugauuaguauaaaauugaacacauuggcugagacuggguccaugauagaaaaucaagauaucuucaauuucuuauauacuugugaaauguaugggguuuuuuuguuguuguuuguuuguuuguuuuagauaaggucucacuuugucacccaagcuggaaugcagugcuacaaucucggcuugcaaugucggcucacugcagccccuacuucucggacccaagcgauucucccaccucaguccuccaaguagcugcgacuauaggcgugugccaccauguccagcuaauuucuguauuuuuaguagagaugguguuucaccauguugcccaggcuggucucgacucaagagauccacugccucgguuucccaaaaugcugggauuauaaaugugagccaucacucccggcccgaaaugugaauucuuuaucauugauaauaaacaccaaugccucaugaaaacuggaggcuucaauuugagucaauuaguaucuccacaauaaggaugcaaauagaagucuaauaagugaccaugcuaaauugacucuccccuuuguucacuggugaauaagggaagauaucaaguuuuuaaaguacuaaucccaaacuuaaacgaccuuaaaacuaaaucuugacaguuuuauaucagugcuguguaauuguuaugcacuagcaaagccuguggagucagaagaugcuguauaugaaaacaauauaucaguguugcaucuucuccugcagaggaagguaauagcaaugaucacuuucggcaaguccaguuuugccugcucuacugaugaacagccaagaaaaaagaugugugcuuuuuaaaggaaauuuguauuuuuaaaaaaagaaaaaucuugucuuuauguugaagaaauuguccuuuuccacuuauugcucuuaaccaaaauaauuaucucuauuagcaauaguucuguuaaguuuauuuugaacauaucccuuacauuggcucugccuuuuuaaaaagacccagaaugguuuuugaaaaguauaauuucagacaccagggugaauacuccucacccuaagugcuaaucacaaaugcugaguuccaccaucauguaaucaugcagugauggucauuuggcaguagagccacucugaguagagggggcuucuggaagaacagugcucagaguugauuucuacguauuauucuacaaaauaugucauaugguauuuuuuucaaaaaugagaggagaagcucuagaauacauaccacauaaaauucaccauguaaaauuuaccuucuggaccuagaauauguuguuaauaagaaugauaaccuugaucuuaucuucauuaaauuguugaaagcacuaauccauuuaagaacaaaaucccacaaguuucuauucgugcuuucugagccucaaugcuuauuaggaacaaaaaaaguaaaaagcccaguaaugacaaaauuaaacaauuucuuacuugcuauugaccuuuagcuuucuuuuccaugguaauuucuuuguauaaucaaguuacauacacacacacacacacacacacacacacacacacacacacacacacgaaugcuucacuacaccaguagcauaugucccuaugaaaacuguaggggugucucaagaagacucuuagauuuaaaugccaaacaauuuugauacuaaagcuaguuaaaacagauguuugugaauauugagaauaacuuuuuauuuacauuuugugacuuuucauauuaauuguagaagguaauagucuguuugauacuauuuuggaaaauguggaagugaauuuaaaauggcuuucaaaaauguguuugcagaguauggaaagccauacagacuuuucaaauuuauauauauauauauauauauauaaauuuauacuauauauacacauauaauuugaaaagucaaauuauauauauaaaacauauauauucaauaaaauuaugauaguaauuugcaucuuauaugacuugaaaacuaucauucagaaaucuuaguucaagccagaaguccuauuaaguuuuacucgauucauuuuuugaaagucaugguuaccauugcuaucauuuuggcaugaauugcacguuagacauguagaccuauuucuauggucucugacuauugucucuuuuuccaaaucauuuccuguuguuuucacuacuaauguaaucaacucucaaagcagcucccucugcugcucuuauuuuuaccaucuacuuaucugaacaaauaauauuuucuccaaaaaacuuguacauguucuaguuaucuuuccaacuaaugacucaagguuguuuguaucuucuuguaaaaaccaguuuuuaaaggagaucuccuuuuccucuugguauuagaauuuguaucugucaccaaauuaaucuuucugauccccuauuucaaugaccagguuuaacagucauuuuuccacuuugaaauuacuuugauuaauuuuuaucaauuuuuauuucaaaguuaguuuuggacucucucauaaguuauugucucucaauaaaaaagauucuuuucucauuaaaacuauucaacuaggcugggaaacauggaaaaaccccaucuuuacaaaaaaaaaaaaccaaaaaccaaaaaacaaaacaaaacaaaacaaaaaaacaaaaauuagccaggcaugaugguggcaugcaccuauggucccagcuacuagggaggcugagguggaagaaucacuugagccccagagucggaguuuucagugagccaagauugcaccacugcacuccagccugggcaauagcaacacucugucuaaaaacaacaaaaacaacaacaaaaauuauucagcuacaucucuuaaugaguuuuguuaauuuaccaaugcaaaucucuuagauuuuuaccguaaaucacaaccuucauuaaucaacagguauuuauuaaaagccuaccccaugccaaagcaugggauacaaauagugagcaaaauagaaaaaagcaucuucuagagcuuucacuccaguaaagaagacagaagauaaauauuaagcauaauaauacauuauauaauauaagguggcuagacuagauuugauuugauuaugauuaguuuaggugaaaaagaauaaaaccugguaaaguggauugggaaugauagggcaaggaagaagauguuucaauuuaaauacuuuugugagaggagccucauugagaagguguuauuggaacaaagcuguaaaggcagagagaaauuuugcacacaacugguggugugaggagcaugucaggcagaggcagcacccugugcaaaaucccugggguaggagagucuuauguuuggcgagaggaaaggaggccaguaugcuuggaguagaggagaaaaaggagagggugugagcaaguagaauaagaggucacagaacuggccagaucacaaaaaaguuuuaagccgugguaaaaaaaaaguuuccauuucuucucuaucauguucuucugucagaauuggaugguagguaugcacugucacauuaauacugcaagaaaugccugcuccuagcucccuuauccuucuccuccucucccagguggaccaucaaauuucccucccagguggacuaucacuacagaaagaauaacuuuugagaaagggaguagugaagagcugaagaaaacuuacgcuaaugagcacauaccuuguauaacucugugcugcuuacugugauauauuuuuacauuauuuagugcuaaaaacucugagaggcaaucaauguuccuuucuuuacagaggaguaauaugaaguucagagagcuuaugaaaauugucuaaaaaucacacagccaguaaaguuccuacucgaaaaucaaaagagaaaaaagcaacguuagauuuuggugaaagauuuuuugaaagagugucaguaaaaaauauguugagaacauguaagaaaagauagaaagucagaauauagaacuguucuaaugggguaagucuguggucuccaucuuacccacaugcagcuucaguuugucaugagaugggagucacuaggaaacauaaaccucagcaguaguuuucucaguagcaaggaagguccugcuucuaguuucaucucccuaauuuacccuuccaguuacucugccuggacuccaauguguuauuuuauuccucugugucuccaaaauuuuugcacaugucucuuacuucuggauguugguuguauauugauugaguugaauugaaauaaaucaacauuccacccacccuggucucuuggaucguugccuauauaagcaacccacuucagucagugccuuccuuuuugacuggauaauucuggucugccugcucacauuagaaacucuucuaagcucuuuuuuguugcaaagcaugagccuaaaugcugacuugccugaauggauuucauauaccugucccguauugaaugguccaggcuuaugacuucuugcuuagccaaacuuuguuaugccaaacuuuguugccucuuucuaaugugucucuuucuaaucccagccucuccaguugcuuccuaacuuuucauacuuacaaggcuucgcaccccacuggcuguucucaaggcauuucucacuguucuuuaacauaaacucaauauuccacuuuagcagauuaaggacugucccuuaaccacauguggaauaagaucgcuuuugccuuuguguuauaccuuuauccuuugcccuuagccugaaaugcccuccaugaauacaguucuuuucuuucagacuacacaagucuugcuuuuccuaccagugcacuccacucugaggacuucuguccauuuuaugaauuuauuuucuguuaugcuugcaccacagcacagaagaaaauggacucuguucuuucuuguauuugugcuuguuuuggugauugugccucuuccaagucagucugcaaucuccuugaaaaugaauugagugauagcuacuucucuugauuuuuucuccauggauuauugacauauuuuaguaaccuaguaauuccuaauaaaugucugaagugugaguacuaaugcaaucuuuuaucaaagcuuuagcaauucagcuucucaguuuaugaaucuuuuggcauauccugaauuuauuuuauugauguuuaauucaaagugguuauuacuuauuuguuuuuauaugguauauuaaaauuaugcacacuuagaaaucaccuuaacauuuuuaacaucaaaaaguauaaauuauaagaaauagaagagcauccagauaggaaacugaaaggaaguagguaggaauggaggggacaaaauaacaaaguuuuauacaguaaugcagaaaauaaaaucuagccucaucucacaaaugguaccuaauuggagcuauugauuauugauaaggggcagaaauaaacaaguuagcaagaauucuggcaucuugcugauguuguagcucucagucacauacuaaccauaguaaaggucccauauuugcugaaccuaagaggguucaggcuaugcacuauauuaggucacguagaguaacacaugucagggaagcauaccugaaggauuagugguauguauuuuuuacaugcguagcauuuuuuuuucuucuguggaauucaguauguauugggaggaacugcucuucguaguuaggauaggcugacucuacucugucuuguccaaguugaacaugggauggggacuucauccuauuaccucauuccuuuggcuacacugauugcccuagagauggacaugugacugcaggaccuaucaaagcuuuugggggaaaauugauauugaugcuggaaagaagaagccucaaucuuucugagauuaaagacauuaagaauaauaugagccuggugaugugggaucuaucuuuacaaucacguagagagaaccuucuugauaguaaaaacaacauaaaagaaagcauuaccaagaaauguagggcuugugaauucugaugacaaugucugaguucuuaccaccagcuccuaacuucggaaucuucaguacuuaaaacaguaaauuucccuuuuuguuuaacuaguuuaaacugaguuccuagcacuucgaaagcaaagaaucaugcuuaaugcaguuaucauguggcacccugcagagcaaagaaguaguuguauuugugcgauacacagagcaaaaucagaaggaucucucagaauuucucuuuuucuuacucacucucaaacuggguggggauaaaaaaauccacacuuuaugauuacuugcagaaaguauaaaagaacuacuuagagucuggguuucacagaaaaaaaaauaaauuccagcuaacacuugacaguaacagcuguacuugaauaaggaucacguaaguacugucuaaguuuucuaaauacuaacuccaauaacucacaacagcagcaauuugucauccagcauucuuuccaagcaucaguauuaagaaguuaucuuugauaaauuuuucagcacauguccacuuguugaggauggcauuuuuguuaauuuuuuuaaccagauugaucagagacacaaaaacaaaugucacuuauguagaaguagagagaugcugagcagauaaagucaauucuucuaucacugaggaggagcagugauauugacaucauuuggcauagaauauuguucuauucaagauuucaaaauaaaaacuagaaacuaugcuauaauccaaguguguaucaaacagaaagaggaggaaaaggauggcaaguuuagauccaucagaguguuuucaaagaaaauaauaacaauaaugacaaaagcccagccuacagagauuucgugaggaugcauucuggaaauaaguuaucaaaauacugagaagacuaacauuguguuuugaagaguauuuuuuuuaauuugaaaauaacaguugcuuaaaauagaaaauuauuaaucguaaaguucagcauacgcuucuuacuugugaugcaacuaugugcuuacacuaaaaauuaaguggaaaacuaaaagagcuccagaauugaugaaugcugaugguguaguuaacucauuuccuuaacucuuaucagcauggauaaaaguucaauccaagaguaucugcaaugacggaucaagguguggguucuauaacaauaaaauuuuccgaaagagaggaauggaagcaaugaguggugagagggcaucagagauuacacaauguacguaaaagaccuaguauuaguucuacuguuucuagaagaccaaguauaaaagucugauacauaguaaauuuuagcuauuauuaguuauugaaauucuucuaucgaucagaucuucaaaauacaucuugacuucuguuucuagccaaagaguaauauaauagauaccagauuuucucuugcaaugaaauaaccaaauaauugacaagaauauaugaaacaguuuggaaaacacugaacauuaggcaaugaagguugaugauuccucagaggcaggaaacaagggagaaccacacugcugcuucaccuuacugcuuugagagaguaacuaggcuguggguuagggaggugaaauccaagucgagccucacagacucacugaagaaaggagauaaagcugacuccagagggagcaaggugguuagagaucacaagaaaaaguaccagaaagaagaaaaugagagagagagagauaaagggagagaugcugaggguauucccugacauaugaagcaaauaccagaggcuggagaauuacacaaaagauguaaacauaacugugccugguauaacaggggauaauuagcucugggcugagcauugugcugguuccaaugaagaagucuuaaaaacaagauucaaaaagaucaaacuguuuucaagugacauaaauauacccaagaacaaagcucaagaauauucauaagaauacaaaagcaucuaucaaccaaugaaauaaaacuaacaacauaugccauccaaugaaaaaucaucaggaaugcaaagaagcaagaaaauaugaugcaaaaagaggaaauaaaucaauuaaucaaaacugauccagaacugacauguguuaaaagcaccauuaaaaucacuucuauaccuauauucuguuuauacaaaaaauaaggcaugaaauauauuucuaucuauguaacuaucaucuaucuaucugauuuuuuaaaagacccuaaaugaacuuccuaagauaaaaacuacgauguauggugugauccacuggaugcaauuaaagguagauuaaauugcauaagaaaaauuuaauauauuuggagauguagccauagaaacuguccaugaugaaacagagaaaagagaauuuuaaaaaaugaauccagcaucaguaagcugugggacaauuucaaacacuguaaucuucauguaacuggagacccauagggagaggaaagagagauaaguucuuuuuaaaauaagaaacguagauagaaaauuuuccaaauuugaugaaaaccauaagccuggugagaggacuuuuuuuuucccucuugacaccaaauacagguaucuuuuccaaugauacuucuugaacugacaccgucuggguguccaaggauuuaauucaauucuaauacucaaccugcaacuagugucagauaccacaaguuagaguugaguuacacaagacugcccccacuuuacacaccaauuacaaauccgaggacaccuguacuuuugcccaacuggcuacaaauaggggauucccacuucccccucucugguucuguaauuuccuggagaggcucacagaacucaagaaggcacuuuguuguaaggcacuucaauuuauuauaaacgauacaagugaauagugagaugggguacauagggugaggucugaaagccuuccaagcacagaaacuuccgucucuguggagcugggguacaccacaguccuggcauguggaugucuucagaagcucccugagcccuguuggauaggggguuuuaugaauguuuuauuacacaggcaugauugauuaaaucauuaaccauucaugauuagcucguucucuagccccuugcccuuuuccaaagacuggcagguggagcugaaaguuccaaauuucuaauugagguuugaucuuuuagcugagcagcccccaaccugaaucuaucaggggccagccaaaaguugucucauuaugacaaaugacacucuuauuaucacucaggaaauuccaaggguuuuaggagcucugugccagaaacuggggacaaauaccaaauauauuuuuauguuacaacaccaagagaccaaagauguucaaugaauucuaagcccaauaaagauuaaaacaacagcaaucacaaccaggcacauuacagucaaauuacuaaaaaccagugaagagagaguaauaucuuaauagcagcuagaugaaaaagacauaauauagaggaacaaagauaaaaauuacagcaguuuuuuuuuucagaaacuuucuaggaaaaguacauuuucuaugauuccauuuauauaaaauacuaggaaaaacaaacuaaugugggaugacaaaagaagcuguaguugccuggagguaggacuuacagagaggaacaaaagggaaauauugcaaagguacacaaggaaacuuuuagaggugauggauauauuccugaucuugaauguggugauaauucaauggguguauuccuaugguaaaacuuauaaaauugcauuuaagagugugcagcuuauuguauuaugguuauuucuaaauaaagcuuuuaaaaaauaaaaaaaauguaugccaauuuuuuucugacccacacaacacaauaguuccuauauuuuguagcuaaguaaagaaauaaagcaauguuaaaaaggcuugcccaagaccaauuaacaaaaaacccacaucuaucuaaauucaacggcuauuuauucccauuguuuuuugcuguuacacagacaagauuagcaaauucuaaacuuuauuuuugacuguaggaaaugaaaauuauauacaugacguauuaucauaugaagcaugcucauugaaaaguauaagauacccuuaaugacagagaucauauaucauuucaauccuuuaaugcuauguaauuuuacuuaaaaauaaaauaauacguggauaaauuaaauuaauaaaaauaaauuaaaauaauuuaccauauuucugaagguaagaaaauguuuuucuaagguuaggaaacggaggagguggucuauguacaagggaagggaaugggaagaaaacauucuauuugcaaauaauugagacaaucaucaucucaguucgugaguuguuaccuccuaacuuaucuuccauuuucuacucaugccuccucaaucuauucuccagagagaagccagagugaucuucuaaaagcacaaccagauaauagcacuuaauuguugaaaaguccccuaaugucauuucguuaugcuuagaauaaaauaaaaacgucuuacccuaguuaaaaucuacaugugaacugacuuccacuuuccacucaucucaugcuucucuuccccuacuugccuccuuucagucuuuuuauucuuauucugccuuggacucacuugcacuaacuguucucuuugccaagauuccuuuuucccuauguuaacauggaagccucuuugaugacauuaaggucuccacuuaaaugacuuuuagugaccaucaaauugcauucauccagugagcaggcaguaacucucuaucacaucauuuuacuucaacguuucuccaucgggggcaauguggccuccuacagguuauuuggaaaugcuuacaaaauuguugaguguugacugcuacugguauuuaaugauagaugccacagaugcucuaaacauccuacaaugugcaggaccacagccacacacacaaagaauuauaugguccaaaauagcaguagugccaacuuuuagaaaacuugcucuauuuuacuucccccugcaaagcauguguaauuaucugauauccuagucuauguuuacuuuuuuauuuuauuuuuuguaccaaugagaacagggaccuuggaugaccuguucacccuuauauucccagcuuuuaaaguaaugacuacacagaauguuuugucauucaguuuauauuuacugauugacugaaugccaaccacaucuuccauuaaaaaacauucuauauaacuuguugaguauuccugcaacugaccuccaucauuagcugaaggcauguuuuccccagaguaugauuugagaaucaaggacaagggauucgacuuuuuguaaguuuucaaagaaaaaaaugguguaaaugccagaaauuuucaggguagguggguggccaagcaaguguuaagacuaaaauuauuuucauagcuuaugaaauaaaucuacuuucuuaaauauuuggcagggucaaugacuuguguugaaaugugcaaacuuauugcaucucugauuuucucucugucaugcuauaaauaaauuaacacuuuucucuaaccugacuugcuucuaccuguuauauuugaaaggauauugcagugcugacugauguuuucucuagggaaaugauuauuggccucauuguuccaaguaaagguaauaguuuuuaacuguugauuuucuguagugaaagaauccacaggaagcaaggaucauaaauaaugcucacauuuaggugcucacauguaggcaaacugugaugaaacuugaaguuuggaagucaucaaaacaucuauucaguaacccucauuaaaaaccugauuuugcuuuauuuugccaauaucugcuucucucgcuaugaguuccuuaggucugacaaauuuaucaaagaaaaaaaaucaugccuguugaaaugaggccaaguaauuugcuuaggcucacagaaugguggaacuaggacuugucuuuaggccuuaagggaaaaaaguaccaacagguuuauauguguuacuucuccguuugagcauauucauuuuaaggaagaguuucuagggaaaaaaaugccuucaacugaaagaauaauuaauaaugagaggaauuuuagagacagaaaagccaucaguggauguauuugauagcugaugaagcuuuugaugcccaucacccaugcauauguauggcucguugguacacuacuaacuuagcuauauagacacaggcacuuauggcuucaaaggaguuuccuuuuacuuuuuuuguguguguaaaauggcauugauagagucaaucgauuuguuucauucuuguugaaccaauggauuccuaucagcaagcaauauauuccucuauacacuauuacaacauuguucaauggaaaguguugauaacgcuuacuuuauuuguuuuaaaaaauuaauugcugcuggcuaucaucucuguauucaucuuucuucaauauaguugucauuuccuucuuguaguuguuugguaguaccuaauagucuaacagaaaauaagauuguauuccauuuauauacuucuaugacaacuaccuuuucagcuaauguuucuuuuucauaauggcauuauaugagauauauccauuauguugaguacaugcacucuuauagggucaggacauaauauuuuguaaaacuagaaauuuuugaaucuuaaguacaguaauguuucugcuuaucucacauuggucuuuacaccuaaaaagaacacauggacacggggaggagaacaucacacaccagggccugccagggggugggggccugggggagggauagcauuaggagaaauaccuaauguaaaugacgaguugauggguguagcaaaccaacauggcacauguauaccuagguaacaaaccugcauguugugcacaugugugccaaaacuuaaaguauaauaauaauaaaaaaaaaaacacuggcuccugucuagucuguccagaaacauuucaaacgucuggaaacucagugaccauggaaggucucucuaucacugcuagugugacgucaccagaagauaaugauaaaaauugcuuugcauccauucuuagccaucaauucuagauccaccaagaauagggcaugauauacaggggaguggcaaaaagcagaugcauuaaugauuacauucuggacaggccagacaauuaauuuuuuuguauauuuauuccuugcuuauuuguucuauuguucuuucauuuaauuaucuuuuauucuuucaugugacaaaugaaaugaacauuuguuauguaugaauaagacauaacuuuuuauuucucuguuaucagcuguagcaaguguagagaguaagaacagaccuuuuuauuaagccucauauaucaucauguuguuucaaauucgagaagggccaacccaaaugauccuuucacagaaaccaaaggcuuaauauguuagggaaaaaaauauaaagugcuguagaacucuuuccccagagagugacacaauuuuauucccuaacacucuuccauaacaccuuauaacucaaacccuuagcuuauccauuuccucagcuccagcuucaaauaugaagaaaacaauacuuuuuuugcucacaacagaaaaccuuauggauauuauuuuucuuuagacuuggcugaaguuuuguaagaaggaucaagggauugguacaaauaggcacacucuuaagcauacagaagggauaacuaguuuacuggaaagagaaugaaauauaagaauaaggaugaagggaaauaugagagaagcagaaauggaauuacugauuugauuauuuuuuacauguuguaauuuuuuucuagagaaaaacugauuguauuaaaaaaauggcaggcuuuuuuauauauccugugauacuuucagugcuauuugaggauaaauaauaaaaacauauuuaaacuuuguaaaacaaaauaaaaagucaacaacugauguuaaaaaaaugaaaucaauaaaauaaggcaauaugucuuauuucaaguacuuuaaaugucaauaguuguguuaggccauucuugcauugcuauaaagaaauaccugagacuagguaauuuauaaagaaaagagguuuaauugacucacaguucugcaggcuuuaaaggaagcaugcugcuggcaucugcucagcuucuggugaaggcucaaggaacuuucaaucauggcagaaggcaaagggggaacaggcacaucacagucaacaguaggagcaagcgagaguggugggggcagggagaggugcagacauuuuuaaaugagcagcucucaggagaacucacuauaaugaagacaacaccaacucaugagggaucuuccacauaauaaaaauacuucccaccagguuccaccuucagcacugaggauuccaauucaacaugagauuaggacagggacaaauacucaaacuauaucaguaauacaucuuaacagccaugauucgccuuuacaaaauuuuuucauaugacauuuguauagauuugguaggccuaccaaaacagaguaucacagaugggguggcuucaacagcagaaauguauugucucacaauucuggaggcuauaagucugagaucaagauuuggccauguugguuccuucugagagcuaugagggaagaaugugcuccaggucucucuccuugacuuguagauagcuguuugcuuccaguguguucgcauugucuuucuccaugccuaugccuguguucaguuuuccuuuuuuuauaaggauaccagugauacuggauuaggcccaccuuaaugaccucauuuuaacuuaauuaccuuuuuaaggacccuaccagcaaauauaguuacauucugaaguacugggcuuuaggacuuuaacauaugaauuucagggguacacaacugaguccacaacagcaucuaaagcauuguuacucaaauagcauuuauugaagaauuauauuucuuuuuagaagcagaaugcuauuagauaucaaguacagcuuaaaaauacuaguagauuaagucccugaucuuggugaaauugugaauaauguacagacaaucaggaaagauauggcacauaaauaggauuagcuguacagaucuauauaggcacugggcuguuucacaaggcagaaaaggaaugucugugacugagguuuacucaaaaaaaaguaauacuaagaacaaaagaauucuuauuguguaaaugugacaauaaaaacaaauaugcugagagacauacaaugcauaacagcaaguuacaggcauagaggacauguaaacaguauuuucugauacccaguugaaacuucuguagcuggaacuauugucacuugaggaagauaguuuuauuaggcuacagcauauguagacaaauauauucagauaaguuauaauucuuacaaauguaacauaauagggguuucacauggcgcagaccaaugacauaugguucuguucagagagacaguaaauaauacauugcuaguaaugaauucaaccuggucagaacagaaccuagcuggaaacaacgacauaaacaguaacagccgguacuuuugcaggcacuuuccuuccauaauuuaucucucuugaacaagguguguguguuggaugguggggggaggcaguucuuccccaguuuaauaaauaauauguuauuucacuuuuguuuuuugcaauuuaaauuuuuaagggaaaaacaauggcuaaacuugccauugcaaauugaaucauguauuguccagguaaaacacuucuuagaccacuaaaugggauagaauguagaaaggccagaaaaauaaucauaaaauccaaaauguaugauagcagugagaaaggcccugugagugcuauauugaguaaauauuaucuuuaccucauaggaauagacauauguguuguuucuccaacuuuucacuauuaaacugcuuuucuggcucuguagguuuggguuuacaaaauaaaauuauauuguguuguuacaacacaauucuuaacugucaaauaaaaauaccauagacacugaacaauguuucauaauuuuaaucuuauuuuuucaauaaauuuuuaacaaugaaaauuucucacugcuaucauacaguuuggauuuugugauuauuucuggccuuucuacauucuaccccauuuggugggguaaaauugaaauuucaauuuuauugguauuuccacaaugcuuucuacauauuuuuacauuugaugcucaugauaacccuagaagauaggugauaugguuuggcucugugucccugccaaaaucuuaccuugaauuuuaauaaucuccauguagcaagggcgagaccaguuggagauaauuuaaucauggggguagcuucccccaugcuauucucgugauacugagugaguucucaugagauuugaugguuuuauaaacaucuggcauuuccccugcuggcacuuauucuuucuccugcugcccugugaagaggugccuuccaccaugauuguaaauuuccugaggccgccucagcaacgcagaacugugagucaauuaaaccucuuuccuuuauauauuucccagucuucgguauuucuuuacaacagcaugagaacggucuaauaugguaaauugguaccacagagaguagggugcugcuauaaaguuacccaaaaaugugaaagcaacuuuggaacuggguaacaggcggaggcuggaacaguuuggaggguucaaaagaagacaggaagaugugggaaaguaugguacuuccuagagauuuguugaauggcuuugaccaaaaugcuaauagugauauggacaaugaaguccagguugagauggucucagauauagaugaggaaccuguugggaauuguaauaaaggcaacucuugcuaugcuuuagcugagagacuggugacauuuucccccugcccucgagaucuguguaacuuugaacuugagagagaugauuuaagguaucuagcagaagaaguuucuagcagcaaaguguucaaggagugacuugggugcucuuaaaagcauucaguuuuaugcauucacaaagagaugguuuggaauuggaacuuauguuuaaaagggaagcagagcauaaaaguuugggaaauuugaagccuuauaauaugguagaaaagaaaaacucauuucugaguauaaauucaagaccacugcagaaguuugcauaaauaaugaggagccaaauguuaauugccaagacaaugaggaaaacgucuccagggcaugucagaugucuucauggcagguccucccaucacaggcccagaggccuaagagaaaagaaggauuuccuggguugggcacagggccuugcugucaugugcagucucaggacuuggugcccugcaucccagccacgacugaaagggaucaauguauagcucuggcuggggcuucagagggugcaagccccaauccuugguagcuuacaugugcuguugggccuacagaugcacagaugucaagaaucgagguuugggaaccucugccuagauuucagaggauauauggaaaccccugaauguccaggcagaaguuuacugcagggccagagccuuuagggagaaccucugcuagggcagugcagaagggaaaugcgggguuggagcuuucacacagaguccucaguggggcccugccuaauguagcuguuggaagagggccacugucuuccagaccccagaaugguagauccaccaacagcuugcaccauauaccuggaaaagccacagauacuaaaugccaggcugugaaagcagcugggagagcagcuguacccugcaaauccacagggcuggagcuggccaaggccaugggagcuucucauuugcauuagcauggucuggaugagagacauggagucaaaggagaucauuuuggaacuuuaagguuuaaugacugcccuauuggauuucagacuugcaugugguauguagacccuuuguuuuggccaauuucucccauuugccaugguguauuuacccaaugccuguaccuccauuguuucuaggacggaaccaacuugcuuuucauuguacaggcucauaggcagaagggacuugccuugucacagaugagacuuuggauucagacuuuuguguuaauacuggaauuaguuaagacuuuugcagacuguuggaaggccaugauuuuguuuugaaaugugaggacaugagauuugggaggggccaaaggcagaaugauaaaguuuggcucuguguccucaccccaaucucaccuugaauuguaauaauccccagguguaaagggcaguaccaggaggagguaauugaaucauggggaugguuuuccccauccuguucucaugauagugaguccucaugagaucugaugguuuuauaagcaucuggcauuucccuuccuggcccucauucucucuccuuccucccugugaagaggucccuucugcaaugauuguaagucuccugaggucuccccagccauguggaacugugagucaauuaaaccucuuuccuuuauaaauuacccagucucugguauuuuuuucauagcagugugagaaugaacuaauacaauagguacuguuuccuuuuuucaaagagaaaacugacccuaacagagguuaaaaauuuugccccagaucacauaaacccacugcauugacccugaggcccacauucuuaaucacuuguuuaucuauauuguuauaaaauaucuuuuuuuuacaaagacaucuauaagaacacauuguguguguuauauguauacuuccuucagaugcuaaaugguuuuuagaagccucuccauaaagaguuccuugaaugcugucuugcauugucaagguggugugacaauuauuacagcuuuucuguuagacacuaugcuuauuugcuuuuugccuguuagcaaauguuucuucuuguaaauaaaguaagguccaaaagcuuugcaguaauauccaauaggaaauaaucugauugauuuaauuuuagcacaguucugcuacauuauguguaacaaaacuauuuuccaaauaucugugucuuuauauucuuauuuaugauauccugaucuauccacauauaacuuaaugauccucaaaacacuccuuugauggagacaucaaaaguauauuucccuucauuuuggcuuuaaauuuccuaguggccuagaacaaaaagggaaacaacuaguuuauaggauucuauaaacaacuaauuuauaggauuauaauauaagaggaaauuaggaugccagagguagaccuuuuccuagugcuaaaaugcacaaauaauuuucccguaggucaucaguaaguagacacaucgauauggcagaaaaggaccucaauaaucuuuccgacaaaaauagaauaggaaguuucauaaggccuuucuuauaauguuucucagugaaaacugguguaccaccaaaggaacaguuguuaaagaaaauuugaugaagugccaagauaaggcagucaaaaggaaucauuuuauaauauacuggcuguauuagucuguucucacacugcuauaaaggacuaccugugacuggguaauuaaugaagaaaacauguuuaacugacucacaguuccacaggcuguacaggaagcauggcugagaagucucaggaaacuuacaauuguggcagaauguugaaggggaagcagcacaucuucacaugguggcaggagagagagagagagaguuaagauggaagugccacacacuuucaaacaaccauaucuuaugagaacucacucacuaucaugagaacagcaaaggguaaaucugaccccaugauccagucaccacccuccaggaccauccuccaauuggauaugaaauuugggcagggauaccagggacucaaauccaaacuauaucacugacauauucugaaaagaaaauuuuaaauagguaaagaaauaaaugaauuuuccucacauaauuuuuuaugaauauuaucucuguacuugaacuuaugauaagaauuaaacgccagaaaagucaaaguuauauucucuggccagaacugggaguacagaauauauugcucaagagggccccaagucacaaagcuaauauaauaggauguuaaagugaaccaucagcugaauccuaaagaaacagauagcaaagugaguuguaauucacaucaccuuuauagaaccuguaauacaugauuaacuaaaaaccaauuagaauacuccuaaaacucugucccucccugugggacuacaaggauugggagagaagcauuuugaugugguuucuuaggaaaaacuguucuaugugaugcacauccucauugccauuugauauuguaaaucuuuuaaaauuuagucauuuuaguaaauguauaguaguauaucaauaugcuuuugccuuuauauuuacauaaaguaaaaaucacuauuuguagcauacaguuuuauggcuuuugaaaaugcauagucauguauccaugaacauaagcaagauacagaacaauuuuauaauucuaagaaauucccucagcuauccuucaauacuaaaccagccuccccuucuccacccucuuggaacaacugaucuauucuucaccuugauaguuuugccauuucuauaauguuaaauaaauuaaaucauacaauauauagccuuuugaaucuauuuuauuuugugcauguguuuaaauaaaauaauuuuaaauauguauuuauagauuuugaaaacaauaagacaugucuuagguucauccauguuucauauguaugaauaauuuuauuagcaaauuggauugcauguacuggcaaaugaauguagcauaaucuuucaugcauugaaggauauuugggcaguuuccaguuuuuagcaauugucaguaaugcuaauauaaucauucacacaguuguugaaauuuuaaguuuuuauuuaugcaggagugagacugccagaugacauggucaaugaauguucaguuuuaugaaaaacugacaaacucuuuuccaaaguggccacaccauuucacacucacaccagcaguguaggagaauucaaguuauucugcuuccuaacagcacuaaucuuuuuuuuuuuuuuuuuguaaauuuuagccauucuaauaguggaaugucuuccugaauuugcauugaauuuuccuaaugacuaauuaugugcagcaucuuuugaugcaccuauuuaccaucugggugucuucuucuuuuuuuuuuuuuuuuuuuuuugguggaaucucgcucugucgcacaggcuggagugcaguggcgcaucuccacucacugcaagcuccgccccccggguucacgcccuucuccugccucagccucccgcguagcugggacugcaggcgccuggcaccgcaccuggcuaauuuuuuguauuuuuuuuuuuuuaguagagacaggguuucaccguguuagccaggauggucucuaucuccugaccucgugaucugcccgccucagccucccauugggugucuucuuuaauaaaguauuuguucaaauauuuuggccauuuaaaauuuuuuuaacuuuuuuuguggguaaauaguagguauauauauuuaugggguacaugagauauuuugauacagacaugcaaugcaaaauaagcacauaauggagaaugggguauccaucccuucaagcacuuauccuuugaguuacaaucaauccaauuacauucuuuaagcuauuuaaaauauacaauuaaguuauuauuggcuauaguugcccuauugugcuaucaaacaguagaucuuauucauucuuucuaaauuuuuaguacccauuaacuaaccccaccucucucccaauuccccuucccagacucuguuaaucauccuucuacucuuuaugaccacaaguucugguguuuuuauuauuauuauuauuuuuagauaccacaaauaagugagaacaugcgauuguuugucuuucugugccuggcauauuucacuuaacauaaugaccuccaguuccauccauguuguugcaaaugaaaggaucucauuuuguuauggcuuaauaguacuccacuguguauauguaccacauuuuauuuauccauucaucuguugauggacacuuaguuugcuuccaaguuuuagcaacuguaaacagugcugccacaaacauaggaguacagauaccuccuugauauacugauuuucuuucuuuuguguguaugcccagcagugggauugcugcaucauaugguagcucaauuuuuaguuuuaggggaaucucuaaacuguucuuuacagugguugcacuaauuuacauuuccaacaguguacaaggguucccuuuucuccauauccuugcuaguauuugucuuuuggauauuagccauuuuaacuggggcgagauuguaauaacaguagguuugauuugcauuucucugaugaccaaugauguugauugccuuuucaaaugccuguuugcuauuuguaugucuucuuuugagaaaugucuauucaaguauguugcuuauuuuuucaucagauuauuagauauuuuccuauauaguuguuugaacuccuuauauauucugguuauuaaucccuugucagagggguacuuugcaaacauuuucucccauucuauggguugucucuucaacucauagacuguauccuuugcuggguugaccguauccuuuguugugcagaagcuuuuuaaauugaugugaucucauuuguccauguucgcuuugguugccugugcuugcaggguacugcuaaagaaauguuugcccagaccaaugccuuggagauauuccccaauguauucuuguaguaauuacauaguuugagggcuuaaauuuaagucuuuaauccauuuuuauuugauuuuuuguauauguugagaaacaggaaucuaguuucauccuuuuauguaugaauauccaguuuugccagcacccuuuauugaagagacugccuuuuccccacuguucuuggcagcuuugucaaaaaugaguucacuguagguguguuuauuuguuucuggguucucuauucuguuccauuguucuaugugucuguuuucauacucgugccauccuguuuugguuacuauagcucaguaguauaaugaacagacacuucucaaaagaagacauacauguggccgacaaacaugaacaaagcucaacauuacuaaucauuagauaaaugcaaaucagaaacacaaugaguugauaccaucucacaccagucagaauggcuauuauuaaaaaguuaaaaagcaacagaugcuggugaggugguggagaaaaaggaaugcuuuucuccacaaaauucuccgcagagaauucucugaauugccagaaagaggcucuuguucucuuccugggaguguaaauuaguucaaccauugugaaagagaguguggcaauuccucaaagaccuagaaccagaaauacauuugaccuagcaaucccauuacugaguaucugcccaaaggaauauaaaucauucuauuauaaagacacaugcaccuguauguucauugcagcacuguuuauaauauaauagcaaagucauggaaucaaccuaaauguccaucagugauagacugaauaaagaaaauaugacacauauacaccauggaauacuaugcagccauagaaaggaauaagaucuuguccuuugcagggacauggaaggaacuggaagccauuauccucagcaaaguaauguagaaacagaaaaccaaacacugcauguucucacuuauaaagugggagcugaauugugagaacacauggaugcauaguggggaacaacacaugcugggcaccuguggggagggggagcaucaggaagaauagcuaauggaugcugggcuuaauauguggugaugggaugaucugugugccaaacuaccaugauacauguuuaccuauguaacaagccugcacauucuguauauuuaccccugaacuuaaaaaaaaaauaaaaacucuguaauauaauuugaagucagguaauuuguuuccuuccauuuaggcuaacuuuggcuauucuggaucuuguaugguuccauauaaauuuuagauuuguuuuucuauuucugugaagaauguuauugguauuuugauagggauugcauugaaucuguagauugcucacuaauucauucuucugcuugauccauucugcuauuagagcacuccaauguauuuuucaguaugccaaauacauuuuucagcuccauaauuauugcuugauucuuuuuaauuauuucaaucucauaauuaaauuuaucugauggaauucugaguuccuucuugguguuaucuugaauuuauuugaguuuucucaacauagcuauguugaauccucuguuugaaagggcacauaucucuauuucuccuggguugguacuuguugccuuucgaguucauuugcugagggcauguuuuccucaaugauguugauucuaguagauguucuucagugucuggacauuaaaaaguuagguauuauauuuauuguagccuucauugucugggcuuauuuguagcaauccuuuuuugaaaggcuuucugguuauuugaaaggacuuugguguugugaucuaagcuauuccugcuuuacgggcaucccaagcccaguaaugcugugguucuugcagacucuuagaggaauugccuugauggucuuggacaagaugcaagagaagucucugaauugccagacagaagcucuuguucucuuccuuuacuuucucacaaacauacaaucaucuccaucucuguccugagccaccugaaccuggggauacagugacacaagcaccccuguggccaccaccacuaugauugcauaaggucagaccugaagucaauauagcucuggguuucuccccaggccugcuguaaugacucccuggcuaccgccuguguucacucacagcccuggggcucuauagucagcaagcagaaaagccagccagcccauguccuuucuuucaggauggugaagucccccaggcccuggguggguccaaaacugccaucugagagucagggacuagagucagaaaccuuagaaguauaccugaucuucuauuguauucuggcuaagcuggcacucaaacugaaagacacaguucuucccacucuucccuccccuuuccaaaggcagaggagccucacccuguagccaccaccaaccuuggccaugaggagcacucucagccuaccacugauguccccuuaagaccuaaaguaucuuaggucagcuugugugaaugcugccugaccuggaacucaccauugagggcagugggcuccccucuagcccagggcagguccagaaaugccacccaagagucagcuccuagaaucagagagcccaagagcccacuuggugcuccaaccccuguggcaguguagggacccaaagugcaaaacaaagaccccuuuuuuuccuuugcuuuucucaagcacucucaaucaaaccacuuggauuggcaauuccccucuggcuagggcugguuuaaauccuccuucuucggaugggcaucagcugaguuugaucucguuuuccuuccugcucuaacaagacagcacugaguuuaaugccucacaguuguuguggucucccucccccagugucccagaaucaucagcugguaauguacugagucucacuugaauccagcaaaucucagaagcucaccaagacccucaauguaguaccuggguaucguugcugguuauucagggcccaguguuccuuaguuagcaggugaugaaugcuggcaggauuggguccuuuccuuuaaggcaguggguuuccuucugacacagggugugucuagaaaugucaucuggaagcuagggccuggaaugggggccuuuugagucugauccaugcccuauucugcuguugcugagcugguauucaaggugcaagacaaaguccucuccacucuuuauucuccucuccucaagcagaaagaagggguauuuuuuuuuuuuuuuuuuggagcagcaacuguggcagccugggguuaggggaauggggaugccagcauucucuuggcuaccccuacugguaucucaguauauugugugccucccaguccacugugucugggccuaguucuucccuaggacucaccuaagaguugcaguccuuauggcauacacugccuuucaaguuuauuuagagacugaaagcauuuuggcccuuagucauggggucugcaggcacucaaauucaaaccacuuggacuggcaauuccccucuggcuagggcugguuuaaauccuccuucugcggaugggcaucagcugaguuugaucugguuuuccguucugcucuaacaagacagcacugaguuuaaugccucacagcuguuguggucucccucccccagcguccaaagaugcucugugcaccgcacagcugcauccggagacuuggggaaggggguggcuggcauuggugauuuaggacuguuauuuuaaaaaucucuucaguacuucuuucagcaauaugaaguuaaaaccagguacugugaguacucaccugaauuuugguucuuaugaaaguguuuuucuucuguguagauaguuauuaacuugauguccuuguuggggaaugaugccuggagcuuucuauucugcugucuuggucugcucuugccuucuggcuccuuccuuccuugcuuccuuccuuccuuccuuccucucuuccuuccuucucucucucuuucuuucuuucuuucuuucuccuuccucucuuuucuuuucuuuuccuuucuuuccuuugcuuuucuuuucucuucuuuuauuuucuuuucuuucuuuucuuuucuuucuuuucuuuuuacugagucucacucugucgcccaggcuggagugcaguggcgcgaucucagcucguugcaagcucugccuccuggguucgcgccauuuucccaccucagccuccugaguagcugggacugcaggcgcccaccaccacgccaggccuggcccguuucuuaauuggguuguauguuuuuacugacuuucaaaauuuguuauacauucugaacacauguucuuuguuuaauaugugguuuaaaaauguuuccuuccuuuuauguaauuaauggugucuuuuccaaagcaaaaguuuuuguuuuuauaaaauguugaugaaauccacuuauuaguauauucuuauauaguuuugcuuucuguguaauaucuaaacaccuuuagcucaacccagagucacaaagauuuucuucuuuguuuccuucuaaaucguauuuaugguaguaugauucacauuuaagucaaugaugcauauugaguuaauuuauguauaaaguacgagauauagguuagaguagauaaccuugccuucauccucauauuaguaagaaaacaucauuucaucauuaagcaugaggucagauguuauuuuucauagaagucuuuggcagauugagauaauucuccucaaucucaauuuuuaugaaaaaaauuaaaauauugaauaaaugcugaauuuuucaaugaauuaucugcauguuaauauacccauauauuguuauuguuguuaauguagugauucauauuguuuaauuuuuuuuuugguaacacaaucaucuuuucaaccuugcaauaaacuguacuugaucaugguguauuaucauauuaauauaucccuagauugguauaccaaaaauuuguuaagggauuuuugugucaauguucuuaggaaguauuauuuuuucuuuugauauuuuuuguccugauauuaggguaauaauagugacauaaaaugaauuggagcauuaacccacuccauuuucagaaagaauuuguguagguuugguauuauuuauuucuuaaagguuuaauagagauaugaucuugaaguuuucucugugagugaucuuuuaauuacaaagucaauuucuugcaauugcauauacuaaauauucagauuauuuauuuuuucuaaauuaauauauaaauuucuauuuuucaaaaaauuuguacacuuaaucuaaacuguuaaauuaauugacaaguaguuugucuuaauauuagcuuaauagcuacuuaauuuuucuuggagguguacuauuuuucuccuucacuucugauaauugguaacuugugucaucucuuuuuguucuuuauuagucugguuaagauuuauccauuuuagugaucuuuuaaagaaccagcuuuugcuuucauugaguuucacuguugacuguucaucuucaauuuuaauaauuuaucaucuuuacuauuuccauagcucuguuuacuuuagcuuuuauuuguucuuucuuuuccaacuucuuaagguaaagguuacaaaauugauuuuaaaucuugugugugugugugugugugugugugugugugugugugugacagagagagagagagagagauucuauuuucucuuggcuugcauaguuuuaaacaagaagucugcaauaguucuuauuucaguuucuuaguguaaaauguguauuuuaucucuggcuccuuuuuagauuuucucuuuuccucugguuuuuagcaauuuaguuaugauauucuuuuguaugauuuuuauuucuuugucuacuuuucuuugacaugauuaaccucuuauauuugcuuuuuuauuguaugcaucaaauucagaaaccauucaaccuuuauuucuuaauauauuuuuucuguccccuuuaugggaccccccccaauauuuauauaugacaauauuuuauuauuccauauaucaucgaggcucuguauuuuuauuugcuuguuugguuuuuuguauuuuucucucucugcuucaauuuggcaauguuauguacucuugcucugccuucaaguuaacaauauuuuuuucuuugguguuuaauacacuguuaauuucuuccaauuaauaguuaauuucauauauuuuguguugcuguguaaauaacguugugucauuuuuuucuaucugccauuuguuucuucauuauauuuauuuuuuguaaagacuucaacauaguuauagccaacuguauuuaauuuuuuuucucuuauuuccuuuuuuuuuuuucauuucuaggucucuuucuauugacuguuuuuccacuaguuauaguucagagauuucuguuucuuuaaauguuuagucauuuuuaaaauuggauauuggacauuauguuguuaaguguuuagauuuuguuuuguucccuuaaagaguguuggauuuuuuuuaaacaggcuccuguaucaccugcaaauuauuuugguccauuaaaccuuguuauuaagcuuuaaaggauaggccaaaaagagucuuuauucuggcuuuuauucagccauacaacuaaggcauuagccuuuuggaaucuccaucagucucuggugauuauauucuuguucaucaaagaucaaugucucuuuaccuugucugagcucuagaaauugucuaucuuacaaaugcccaguuguuuguuuguuuuuuuuuucagauuugugggauuuuuugccuaugcaaguacagccuuguacucagcaacgacaagaaaacacauguagauuucuguagcuuuuugucuauaugagcuccuucucuuuaaaaccugcaccacuacuuccauccccuuggucuaccugaauuccaaucucucuuuccuugacaaugcaagaccacugggcucuaguuuccaccucugugagcuugaugcuugaaaauugcaugagauagaaagccaugaauauuaauugugggggucacuguguuuacuucucuuccauuagagaucaaaguucugugcuucuuacuguccaaugucugaaaguguuuuuuuuuuuuuuuuaaauaaguuuugcucauucuuuagugguuuauggcaagaagguaagucuggccauuguuccuaaauauaauagcgaucugaaugccagaguuaucuuuuaaaauguaauauuuaaaaauauguaauauuuagaaaugugauucuuuaaaauauucuaauacuuuuuaacuuacauuauucuaauaauuccucaauuuauaauccaaauucuuuacauggaauacaaggccuucuaggcuauaacuucucuuuauagcuccagagucacuucuaccuacuccuaugaaauuacuguucuggcauaaccaaauguucagaaaucuuccuuuaaguuaugacagugauauuaugacagcauaacacccuauauuuaccccaaauguaguaguuaucauacuuuauugaaauuguccacuuauacuuuuacuucccaauaaacuuugaaagggaaacaaucuuauucacuggucagagaucuugucacgaguaauauccauugaaugaauguauaaauggaagaaaagaagguagguaagaaggcaggaagaaaagaaacaauugauuuugaguugauuuaaaaauuuuccuucagugcucucugcuggauuauuacaaauauguaaccaaaaaaaucaaaagcuugagguuuuucuuacuaguuacuuuuauuugcuuuugaaaccuguuagaauaauuucaguagaugacuuccauaauuucaucuauccauauacccccucuuauugcuccauaaacuccauuauuucugugcucuaacaacacuucucagacuuacauuacuugauagauuugugguauagugucaugaaauuuuuguucuucaaaaugaaugucuucauuaaauuuauuuuucugaacuucauuuguauuauucagagagauuaauaacuucagcaauuuauaaauuauaccacgugucuuucuuuaccuauugccuuugaaaaauauuauaauuaaauuaaaauuuguauaugcaaguagaacugcaaaaucuaaggaaaauugguagaaaaccaugcagaauaauggcuuccaaagauguccaugcccuagucuguggaauauaugaccauguuaccuuacaugguaaaagacacuuugcagaugugauuaagguuaggagcuagagaugaggaaauuacuuuagauuaggcaggugggcucaguuuaaucacaugaauccuuaaaagugaaagaagaaaacaguagaguggucagagaguugagacuguaguagaggcaguagagauucaaagugggauaaagacuugacccaacauuugcugguuuggaaaauggagaaaggggaauaugagucagggaaugcuuguagccucuaaaagcuggaaauggcuguaagcuaacagccaccaagaaaaugaagacuucacugcugcaacaucaggaaacuuaauucucccuacaaccugaaaaacaaagaaacagaucuccagaaaagaauccugaaccucugacacauugauuuuaauccagugagacacuguguuaauuuuauacuguugcuauaaccaauuaccacaaacuuaguggcuaaaaagagcaaaaauuuauuauccuucaauucuguaugucagaagcucagcacuggucucaucagacucaaagcaagguguugauaggcugugucccuuuuuggagguuauaaaggauaauuaauuuuuuuugucagcugagggacauuuuaguuuccagaggccacagcuuuucuuggcucaugcucuacuuccuccauauucaaaaucaacaauguuuaguagagccuuuaucauuuuucaucucuuugacucacucuucuaucuaccucuucuacuuuuacgaauucaugcaauuaguauugucccucccagaacucuccuuaucucaagguccuuaacauuauucacaucugcaauguuccuauugucauauaagcuaaucacuuuagugaauaggaugugaauaacuuugggggaccuauuauucugguuaccauaggcuucugcuggauuucugaccuaaagaacuauaaggaaauaaauuugcaugguuuuaagucaguaaaguugugguauuuucuuauggcagcaauaaaauacuaauacaagugccaauagaauuuuucagauauuaaauugacaugugguuaauuuacugguuuuaagcaguaaauuugugguaauuuguuauggcagccauagacaacugauauaaguacaaauagcaucuuucagauauuaaauuaacauuuauauagugcuguauaguucuaagaaugacacauacauguuuuaauuuaguuuagugagcuaaguaaccauucacaaaugagagaauuaauguagucugucaguuguauacaaauaaggcauguagguuuuuaaguuaguucuggguuucauaugugucacugggcucuuuagcaagauauuuaaucucuuuaacuaucauaaucuuauucuauguaauggaauuuaccucauaaguuuaagguuaacuguagaauuuaagaaagcauaugguuccuuacacauaauaauaaaaauuuaaaaagguaaauauuuuuauuuaugacaugaucaaucauuggcuaaacaaauaaauugaucuaccuucucuaacgaaaugucaaauuuucugaauuuucuauuauguuguuguauuaguucgcuuucgcacugcugauaaagacauaccugagacugagaggaaaaagagguuuaaucggacauacaguuccacauggcugaggaugccucagaaaaauggugggaggugaaaugauggcgggaagagaaaaaagaggaggaagcaaaagcagaaaccccugauaaacccaucagaucucaugagacuuauucacuauuaugagacuagcauggaaagaccagcccccaugauuuaauuacccgcuaggucccucccacaacaagugagaauucugggagauacaauucaaguugagagucggguuggggcacagccauaccauauuauucugccccugaccccuccaaaucucaugucuucacaucaguaccugauguaguauauuaauguuccucauacuuuaauuuauauuuaauaccauccuuacucuuuauaauuuaaguuauauuuuaaaaauucuuggaagugaaguguuuuguuuuuuuaauauauauuucaguagguuuuacagacacauuuaagccuagaguaucuucguuauaauagugaaaauaagacuaaaagagccaacuaccacuucagaaguuuuacauuucccuucuguacaaggauuagauagauaaauggaaauacgacuuaaucauauauauucuaaacacuaaagguuucaauuagcaaacucauaguuaucuggagggcagaccaugccacaguuaauaaaggcccagacacagaagugcaugggggaacacugggggaaaauuauugggauggacuuuagauuuggagggccauaacuaaaauuuauuuuguuuguuucauuaaaauggaacauucuuacuaguucuccaacuucuauaucauuacagugguuuugacaagauagaaaggggaagauagaaauaauauugacuuuugaaaacaaacaauuuaauggaagcauugcuucauuccauaauucccuuugauaugcacuggaaugugauuuuuuucaaggccugugcaaggagguagaagggucuccucucuugaaauucacaaaggcuuauucuaccuuugccacacuucugauaauuaggauccugcucaaugacucaaugcuuucaaauaaacaaaaauuccauuauuaaaagaaggagccuuuauuuucucaaaucucauucauuugggggcagucuuucuucuguuauuacaucuuuauauuucuauucugcugcuauuuuuugucacauagaauguuuucccaugcauauuuaaaaauaaagauaauuuaguuugcuuuuaugaaaacuuaacccuuagagagucauaaugauuuuuuccaagauuuauugcgugaguuauauauagcauguacacuguaccuuucuuggcagcauuaauacuuuuggaaaccaaaauauagcaaugguuaaauauauauacuuuuuucaagacaucugacuugaauccuugaauaaggguaggagauuucccccaaaagaaaaguaacauuuaguuagguuaagugucaaguuucuagcucacacaguagagaagucaauauguaccaagucauauuagugaauuucaucuacacugcucagagguuguugaacucaauuacagaaaugugcagagucuauuugaugugugaagagguuaggagaccacaaucaauuaaaaagaacacauguauauccuguucuggggaaauaguuguuauaauauaccucguucugcuucugcuuuuucucugaguuuuccucugaacauagaagaacaaaagguuuaauaauuccccaguuucauuuggaauuguuuugucagcaguaucuuguaggaagucaugaaauuguuguuuuacuugaaugaagccucaggcggcuacaauuaaacaugcuguauucuuuuuuauagcaaaaccauuugaaaauggacaauauuuggacauuuauggaauuacaagggaccaggcuggggaauaugaaugcagugcggaaaaugaugugucauucccagaugugaggaaaguaaaaguuguugucaacuguaagugucaucaccuuuuaucaagauaaguucugagaaaagauaaaacaccuugaaaaauucugacugaaauuuauguugcuguuuuuaagagguugucuauugguaaaaaucaccuacuaacacugaagacguguagauguugaaauguugguuaaauugguuaauguaacaacaauugucccaaguaaacccacaauaauucagucugauguauggagugaaauguguuuaauacucuccuaaucccuggcauucuaaacugugguguccuuaccucaaaagcacuguagccauaugcugguguuuuccucaugagcuuuaccugaagugcacuaacacuaaauuuaagugcguaacucccaaucaagccugaugaaaaugaaguauacucaucuguacucaaagaaaagagcugaagugugaugcuucuguuaguugggugacuuauuucuauuucguuugggaaaaagaaagugaagaaagaauuuuuccauaagcauuguuguuaagaaguuagaauauaaauuggauaccugcagaaccgucaaugcuaguauguuacacacuuuuccucaaugcucccaccacacugauauaagaugauuuuccaguaacauccuauuauauaucuuaugauuucaacagcaaugacuacaaucguuuuuacuuuucaaaaaucuccccuaagucuuuaucuaaaaaauguucauacuguuuaacuucuuccaauaaaauaccuuugggauaauuguauuuuacccaaaguauuuacaaacuauaguuuucauuuuuaaaauucuacuuacuuaucuuucuauauaugguccuugcuaauaaugugcacgugguauuaugcugcagaucagaagaaauuguuccaaauauauccagaaauguuaaagcuaaucagcaguuguuucauauuaauaugagucuuucagucucaugggccaaaaaauaacuuucaaaacacuucuaacaguugagcuguacaccagagcaaaucacugucaucaacuaacauuugucagugacuaaucuauauacuuaggguugaacugucucuauuauacugcacaaaugugcaugauaccaagucaggaggcaguuuuuggagcaggauuucucauggaguguucugcaaacaaauuguaguaaaauugccaaagaaacucauuaaaaauggaaaacuccugguacccacaucagccaugcugaaucagaauccuugggguugggaguguauggccuggaaaccugaauuuuaagagguucccacugauucucaggacucuuauugcagagagcuacugcucaucccucuggaacucucugaaauaagagguaacaaacaaguaaaaauuccugaucauuuaucacuagccaugcuuuucugaauauguguauacugauuuuauuguuggaggguugagggcuugggaaguggaggggagggaagagagacauauaucuacuaaggaaagaauauuuuuagcagugagcacuaagaaaugaaaaagcagaguaaaaucuaucaaauaaacaaggcacccagcccagcaauccucuuaaacuccaagacccaagaggucuuuaaaacgaugucucugauagggaugaaauugaaaacccagcugcuguacagauuugcaugggaccuauacuccauauacaagccacaauuguuuuuggauuaacacuuuuuauucuucugacuuuaguuuguugccacuuauuuaaucggauucucuuuucccuagucaagcaggaaauuuagaccgagaaagucaacuuaaggaggcagaaacuugaguagggaacuaaauagauagaagagagucuauccauaaagcaaaagaacagaaacuggguaaaaaagauaccaggaacgcugaagagucuacagcaguuucauggauacaguggacaaagacaaaaggcaauguauuacucauagcaauagaaguagucagaguguugucauuuucuugcaucaguuccuuaagacccaguuacuacaaggugauaagaugagggcuaggugacaacuguacauaguggguuuaugucauaguugaagcauccugagcuuuggaaaacucuuuuuaaaaaaaauauauaauggcagcaaacaaaccugcccuuugccauagagagggaaauuaucuuuauuaaacuggauuguaaacaaaucugcccuuuacuccauagggagaacuacuucuuucuuccaagacugaaaagauaggaacaaaagcugucagugucucugcuuacaaagugugcagaaaugugaaagacccaugcagaauucucuucuaacacaagaugggagcuggaacauuugagguagagccugaagacauucugucgggcuaacaaagguguuuuaguggcuuugucagggugucagacacucuagaauagguagagaauaagacuuuguuaaucacuuuaacuuaagagggaaaacaguaggaaaaagggagaaaauuuuaaaacaguagggaagugcuuuuuaaaucaugacagaggcuaccuuuuuuaacaauaaauuucagguagauaaguacaguuauaagucgacauauugcugcagacauaauauuaacuugucucauauuaagaaaauagacccaacaggauuuucaaaugauuuaaacaaucaguuuugccauuugcuucucccugagucauaccuuugauaauucacccuuuuccaaauguuccaugaaaaacuguuuaauacugguuuuguuuaguacuaauuguguuuaauacugaugccacacauauauaacugauaucucaggugugaagggaugugauugugaguaugucugaaaaaguuucuuguuauaaaagguuugcaaaguguuaauuuugugaacuuggcccuuuaaagucaaaaauugagagcuacuucuagauuuugcugagcugauuuuccagaggaaauuagccaaagccuacugaacaaaguuuaguuugucaaagcccaaaauugaguacaguggucuacguuaccagcauggacuugcacauccccugauaaccugaagauucccuaaagacaguaucaugccagguucaagacagcccuuccuuucaucuuuauuaaucaauauugauugugcgcauagaauuacaguagcuucaugaguuauaauuugaagagaaacuuugccccuuuccccaaaugggguucaagaugaaauauaauacauuuucauaagcuccgguagauucaguuaugugguaagucaauuugagaagauuuagguucccugaaauuuagaaauguuuaauguuuuauuauuucucuaauacaccuuccacguucacuauauauagaaaauauacauauacaauaaauaacaucauaccugucacuguggauuucuauucaauuuaauuaccuagcacuuuguugagguaauugauauaauugacuauauaauugacuauacagauagagcuaguugguugguugaauaaaucaguucauuuugaguuauucacagaaagccuuacuauagauagaaagaaauuuuuaagcauuaaugcaauggguuauuucuaaguagggggauauuagguguuuauucuccaaguccuuauucguaacuuuuuccuuauguguuuguguaugcguguauuucuuguccacuuuuuaaaaaauuaaaauaaugaaaaggggucaugaaaauuaucauaauuaaaccuugugacacacacaaacacacacacacacacacgagaaaaaaaaauugacacauuugauuaagccaaagggagcuagugaauguagacuuggacagauuccccauuuuauuugcauucauguucuguucuuagcagaagccuuguggacacuagguucauaguuguuauuguaaauuacaaaaugaaagaaugaaugagucucagaaagcccauggauucaagugaauugaaaaacaaaacaaaaaaacaggacgcaggaaaaaucugguuagaaaagggaagaucacagugaaaaucaaaaagcugauuuauuagaaaucaaauauagaauuugaaaaauuuagaaagugugaugaaucaaguaauauagauuuguguaagaaaguagaaucccagggauaagaaaucagcaaggaguggaagaccuaccccuuuaauaugaagguuacuaauaauaguaaaaugaaugggguucccuaaucuugugacagaggccaucuguucuccacuccauuuguauguauucuuccaguuaagagugccaguuuuggaaaugugggccuuguggucagauauaauuuacuauaaguauuagcagauaacuuacugguccauaauuuacugggccuuugaaaccuugggugagguacuuuacuucucugacucucaguuuucacuucuguaaauucagggcaauaauacccuauuuauauauauuuguaaauguauaaauguuauaaauauauacauauaugugaauguaagugaacugacuccagaaugucagcucuauguggaaacggauuuugcuguccuuuguacacugauguacugauguguuccuguuacuuagaauaguaccugguccauaaaaagguguccaaaaauaguuguugaauaaauaaaggguuaaacaguuuagaguccuccaggugaaucauucuacuaggcaaaauagagaaaagauauuagguuugccucacaauuaauuuuuuuucucccaggaaaauuaguagauggugucuugacuaauauacuucuaauacuguuuuuuucuccccaaauauccagguggauucaauaaagauaaccugaaauuugcauacuguuuuuacucagagagaagcagcacuaauuccauuuuuuauagauaagaaaauugagaugcagagauauuaaaacauuuaauaauugcccugauuuugaagaacaaaacagaugugaguaaaaagagcugcuaauuggaaaaaaacaaagagccaaccagacuaaggugaaaagagcucuagacauuauuucaauuuuuacucaugaaagucagaucuaaauauugaccauuuuauuugguaucagaaauuauuuuguacacacguuuuuaguaaaauagaauugauuaauucuuccuaugaucaaauaaauaggaaagucauuuuugggugugcugugaaguaaguuuuuuauccaauaaguuacaggcacauauuugugcauuauuuugcaucugcuacguauucauuuaugcaaauaugcacguuaucuuccaauauaacuagcuccaaacauguggaauugaauguuccaauuaguauaacuuaguacaauuauacggaagcuugaaaugagaagccacuggggaguaagaggaggaggcuucuagggaaaugaccaguuuuuuaaagcuauuccuaaaguuuucuccaaagccuugggcaauuuaggcaauaugucaaacuuaagacuagaagaaauugcagaucacaaauggccaucaccuugaauaaagggaaaaucucgguguucaaaguuugaguagggcaaaggcacuaucaugggacuagaagaaaacagaguuauuugaauucauagucaucaccuuaguguuuuauuucuggauccauuuuaugccccuaacuuuacuuuucauuuacuucaucuuucauaucugcuuguaauuuaggauacucuucuguauuuuauguuuuuuuuuaagcuaauuaacacuuauuuggaacaacucaggggagaaaaaggcauagaguugucuuuuaaauaaaguauuaguuccuauaacaucuccaaugaugauacacuuugguacaucuacauuuauauauucacuuaguuauuuacuuacugcuuacuauaagagaaucaaggugcuacagccugggcuacuguuuuucaaacucauuauccaggaaaggagaaaaauaaaagaaacccauaguuuuaauacagugugacaagugcuuugauaaaccaaucguaaggugcugugcaaggauauaagauauacaccaaacucaaccuugggguuucacugaaagcuucuaauaggccuuagcccugauggaguuuaaaggauuaaauugaauucaacagauuucuaaaauuaaaaaaaaaaaaagaaagaaagaucuuccagucagaagaaacaucauuugcuuagcuucauaagaguuaugggacagaauguuguuuguuuagucaggguacaaagggcugggucagaucaagacacaaaacagaaaagaagguuaagcauuguggagugaagcaggaccggaugaggugagaguuagugaauuuccauaggcauacuuagauccaguguuucauaaugaaaaaagaauaaauuugagaugcuagaacugcucagagguuaucugaauauuaaucaaaugaauuuaaauacuuuuauaguuuacauucacaaagaauacuuggaagauuucuguuuuuuucauggcaagaguaagagaagagauuaaaacgauaauagugagaacaaugccaaccaaaagagauaugaggagcuaagaaauaugaaggaaacuuccuaaaagaacugaacauuaaauauuagaaacaucaauaaucacccaaaaaauaaguaaaauacuucuuuucuuaauacaacaaaauugaaaaaaaacuaagaauuaaaccuuuuuuauucaccuugggacuuucaugguguaaaaaguuaacauuuaauucugugauuucuauaaucccucaguugaaguaauacuguuauuaaacaugcaguuaaagaauacaugaauuuuucuauugagggagacauaauuggaccuuuguuuuaaauauuagacauacaguucaauuaaugacuagugugccaagacuauuuuuacuuaaugagucugauauccaguuuaacugaaguguauucucccaugcacuuaucuuuguuaagaggauuuaguguuaagggucuaugagugaucuuuugccuuuuguuuacggaacaucaacaugcuucuguaguaaugaaauaugcauauuuuuauuauuucuccuuuuccuaaaagugaaaaauaaaacaauuucuuuccuuuaacacaggagcaaaauguuugcuagaugggagccuguguuuauuuuguuuguaguuguuuuuagguuggcaaucaucacuucaaaaaauauacaugaaguaauaggaauaauagaguuugacuaugagcuagcaguaagaaagcaauuucuaacaggguaaaauacucuggguugaaaaugacuccacgccaaacggaagaaaagugauaaagucaaagucaggaaagaacaaacaacggcaaaucucaaucucucucucucucucucucucucucucucucucucucucucucucugucucccucuauauauauauguguguguguguguguguguguguguguguguguuauauaacuuauaugugugcauuugugaugguguauuccucuagauucauguucuaauaagcagccaaaggaccaaacccugaaaaucaucgcagggugccuuuugcuaaauauacucuucaaaaugauguagaaguuucaaacauuacuuuagucaguacaaacauauaguuuauaacguguauuuaucuaaauccagcuuuuucagcauguuuccuagugcuucuagaaaaaaaaguuuugcuucaguacgugaagcaagauaauuuauggauugaauucuuuuaagccaauaugugagagccauuuauagaaugaacaauacugaauuaauccccuugggucuucgccauagcaucauuauuaaacuucagaggaauugccaaauaugcuuaugucugacaaugcacguuuguguguuuuguguauguguauaugugugugaagggagagaaguggaaugauuaggggcagaguaugguagaaauaguauaaauaauagcaguauguacaagaauuauggcagauaaauuugggacaaaagcauccaaauuguggggaaacauccuugguacauucaagcuugcuagcuugucuucacucauuucuuucuuauuuaucuauucucucuaucuguuaaaugauaaauguuaaaauaacguuaaauaucuguuaaugauauuuacuguuauuuuacuuacauuuauuuaauguuaauuaauuuacauuacauuuauuuaauuauauuuauuauauuaaauuuauuuaauguuaauuuauuugugacugccauauuauucguuuccucuccucucuuuccucuuauuucuacucagauguauagugauacuaaaccaacuuuugaaagacaucuguauaaugaagauuaauaaugaauuuuauucagucaccuuggaaacauuuuaaauauauggauugccaaauaaucacucaccaaauauacugaauuauucagucuauauuuaccuauaaaucaaugagcauaacugcuuuuucaaaauuuacuaggugauaaaauuuuggguuuagauauuacaggauaaugaaaauaaaacagaagagaaaggcagaagauccgaauucuguuuuuaauucagucacuuaacuaauuauacaacuuugggcaaaagacuuaaaucuaggucucaaucuccccauuuagaaaaugagggaaucacucucugguaccaccuacuccugacauucugauguuuuucugauaguuauuuaaguuuuauagagacugcaugaauucaccuccuaacaggcagggagcaaagguauaaagccacuguuuggcuucagucaaaugauucuggauaaucucagacuuuugcuuugugaauucuuugagaaauuaauaaggaugauaauuucguucuauuacgcauuguuggcaaaucugggcaaacuuuucauccuuuaaaauguaauucaugugaagaauaaguacaguaauaaagacguaaauuucagagaaccuuaaaggagaaauucuguuuaugcaauggagugugacagaggaugacaaaaaugggauuuggaaucagacgugaguuuuaaucuuagcucagucacuuauaaacuaugggauacuggggaaauuagcuaauuucucagaggcucagcuuuccuauauaaaaaaacuggagacaauuauaaacaccuuaaagauugguugugagcuuugucauaauacauuuaaaacaacaagaaugacugcugcaaggccaaugauuuuguguaucaauaguaucagaaaguagcauuuuguuuacaugucaaccuuccucuguagccugugaacucuuuaaaaagggaaacucuugggaggccaaggaagguggaucaccucagguuaggaguucgagaccagccuggccaacauggugaaacucugucucuacuaaagauacaaaaauuaguugggcaugguggcgugcaccuguaaucccagcuacuugggaggcugaggcaggagaaacuugaaccugggagggagagguugcagugagccaagaaugugccauugcacuccagcucggggcgacagagcaagacucugucucaaaaaaaaaaaaagauauauacauaucuuuuauauauauaucuuuuauauauauaucuuuuauauauaucuuauauauauauuuuauauaucuuuuauguauauaucucauauauauauaaucuaucuaucuaucuaucuaucuaucuauauauauauauauauaugaaaagggaaacuccuccaguucaccuuuguuuuccgggcaauguaacacagugacuacgaagucaggcucuguagcugggcacccuggcuuuaaauucaaccugggucacuuacgaccaugcagacuuggucaagucauuaaacuuuguguaugccaauuucuucaauauaaagugagagcaugaggauuaacugaguuaagacaugagauagcuuagugcauauuauuauucccaguaccuagcacaguaacugauaaucaauguauguugauagaauaaauaaauaaauauaaaauaugcacaccuacaauucuacaguugaaaaauguucauaaaauugccaaauuucuucaucuuauagauguauguauuugaauuuagguagcuuuggaaauuaauucauggaauucauggaagggcuaagaaugaaacuuuaaaauccuaauucuaggucugaggcugcuuucacuauacuagccugcuuucacguaaauugaaaaaggauccuaauuauucucaacaaacuguguaaacuagggagacuuuuagaaagauaguaaacucugcaggaugagaagagaggaucacuguguaugaaaagaaacuauuucaauaaccagaaugugcgcaggugcuagcugucagaauggcugacacugaaauaaagugcagaaccacggaaguuaggauucccagugaauagagaaaacaauuacaauaaauaauccuuuagaacgaugcugcacucagaauagguuuguucacauacugugugaaauaagagcuuuuguuuaauagugaauauaaugaaaucccagcaucaugcagucagccugcuugcugcuacacagaaaagcuaacagcagugcaaaaaacaaacaaauaaaaacaaaacaaaaugcccacugugccaggggcauuaaacacuuauguauuucauagauaaaaugaaagauaacaaaauuuuauuuagggcacuguggguguguuccauguuuauaagauucacuacucuacucuuaaugccuugagaagcauauauauucagucuaccgauaacuuaaaagcaguuugguggcaauuauaaagacaaaauaucuuaagccuccuccccaguuguuuaaagguuuaaguuagcaauuuagauaaaacauauacauuuuuaaguaauaugagacaucguagccuaaugcauauuaauuuuucugcaauaaaucauacuuugaccuagucuaaacaaauaaguguucuguauccuagaacagauguugagaguguuuuccucauuuaguauaaccagcuaguguacauuuacauaauaggauggagggaaguauaucaguaauuagcugaaguucagaaaugcuacauuuguuaaugcuguuucaucuuugugagcauauuggguuugcaaacccuucuguuuuucccuguggaugucaaaaggacuuugaagcuccauguaauucacuugaggaugcagucucucaugaauuguucuguacugagaacagcugaugauuugugaauucuuuaggagucaaguuguguaauucugacuaauaguucaguguccugauagaauuuucuagauuauucaaugggguaaagguaauuuaucgaauacuguuuucaucuucuuccugcgccuacugcuuggacuacauugucuagccugguuugggguuagcuuuggcccugugacugaguucuagugcaagaaauguaagcagaagugacaugggccacuuccaggcaaggccuauaaaacuucccacgcaugcucugcuaugcuuauuuuccuuucuaguuaaugggaauacuaacccauuagcuuucaggaugaccuugaaagcuacauguugaagauaacaaagcugcccuugugugagccccugaaugauucugugcagcagaauaucccuaccccuacccccuuucacuccccaccuuucacugaacuaaauuauuaugggcuuuuaggugagugggaaccaaacuuuuuuuguugccucauuguauguuugagucuauuuguucccaaaguucagccuccucugacuacuacagucaagaauauagggccaaauauacugaauucaauaaaaaauuuugcaucacaucuuacuucaaaauuuuugccugaaagcaaugauaaaaagcuuccugagaagaguagagagauaauggauuuuucuuuccuccuauaugaaguauagccuaccaaauuucuguuugcaaauuuugugagucauagugaaaaaaaaaagucuaugagucucaugccuuugaggcuaccuaugauuuugcucagaaacacaacuggauuuaaaauagcaucuggccauuaaccucugacauaaacuuuucugacaauaguuuuugaaaccagcuaagcuccgucgcgaugccaaaaaauuggcauaaacaagauuucauaaguuucuucaaaaaaguauuuaauucacguuuauauaauauaaauuuagaaauugaauaccaaugaucuggauaugaaauccaagauuauacuuuuuuaaacaccaguaauugacagauuuaggugaauagaagaauggagagaaaaauaaauuugguguggggaggaagggggaaguggaguacacacguggagaggcaaugaaagcacgcucuauguuaucuuucauuugcuaaagaaaaguaaccucggccugcgguggcucaugccuguaaucccagcacuuuggaaagccaaugcggacagagaacaaagucaggaguucaagagcaggcuggccaauauggugaaaccccaucuuuacuaaaaauacaaaaguagccaggugugguggugcaugccuguaaucccagcuacugggacggcuaaggcaggcgaaucgcuugaacccaggaggcggaguuugcagugagccaagaucaugccauugcacuccagccugggcaaaaagagugaaacuccaucucaaaaaaaaaaaaaaaaguaaugucaauuaauuauugaauuugauaauccaggaaacaugaauaauaucacuaaaugcuaaaaguaaacccuauuguaaaugaaugcaggaaacauaaacagaagucuuuuuacuuguagccaaaugggaagagaaauccaugaaguauaaaaauugaaacacgcacaaaaagcgaaaaguaaaugaaaacaucaguaauguaacagacuaacaugauuaauugaacacuaaagggaaaaauuacuggguuugugcuuuaauacauugguauuuauuauauaccgauauaauaaacaaugauauauugcuuguguaagacaaaccuaaagcaaaaugaagaaaaaauaccuuaaagaauuaauaaagauguauugaagcaauucaaaauaaaugaaaacagguuaaaagauauuuuuuuaaauugugaaguuugagagaacacaguacaaagccuaguaaucuucccucaugaguuuauaaccaacugaaagauagaagcaggaauaugacaaauugaaagccaaccauauuaccgggagaauggagaggaaucaauguagguaccuccugagaaggaugguucuaaacaaggaaagcaccaagcagcauuccuaauuuccucuuccaauuuaacauucugauacuucaucuuccucucauuggaauggccacacagggcagggagauuauucucgaaagagacucuacauauagaauuaugaggucagggaaacugaaguuucuucccuaacaauccauaccaguaaacauuuauagaugaaauaauauagaaugugcacgcacgcacacacacacacgcacacaaaaauagauacauacauacacacaaacauacguuaguauguguuguauguguuuauauaaagucuucuuagaaagacguuaaaaauauauacaaauguacaaacgcuuaaagaaaguuuuaauuaaaaacccucauccuuugcaagauuacguaggaaaagaaugauaaaauaauuuuaauaauauuaguaauauuuaauuaauaugcguuauaauuuuuuuuugagauggagucuugcugugucacucaggcuggagugcaguggcgcgaucugggcucacugcaagcuccgcccucccggguucacgucauucuccuaccucagccuccccaguagcugggacuacaggcgcccaccaccacgcccggcuaauuuuuuguauuuuuaguagagacaggguuucaccguguuagccaggauugucucgaucuccugaccucgugaucugcccgccugggcaucccaaaguacugggauuacaggcgugagccacugcacucagccccgcauuuuaaaucuuguauccucagacaguaaacauuguucaucuacagaauuuuuacauuguuuaucuaccaaaccacaaagaacucaauacaucuuccaaagcagaaauuguaagagucauaauuucuuacucaaauuuaauaauaaaaguuuaaauccucaaaacacaaaaauaagaucccaaaccccugaaaauuaaaaaaaaaaaaaaauccuaaguaacuuuugguggggguaguuuaaaaauaggaaaagcaaauucacugaauaucaaaacaacccagagugaaggaaagcuguacucagaggcaaauuuauaauuuuaauagucuuuuauuaugaaaaaaugaaagaaugcuaucaaacuaaguauuuaucuugagaaguuaaaaaaaaauuaaaccugagggagauuuuuccuuuugagguauaauauguuagauacccagaaaaccacuuuggacuuaaacaacuaagaugcuggauacaauuuccaaaguauguuucaaaaggcaucauuuuaauuuacugaggaaaaauguaaguucugagcuguaaaauuaauugaaaugagaaccacuaauagguaagaaacuauaaaaaugauuuuucucucagaguaucuaguauacucuugagucuuugaaugcccauuuugaugacuaugaaagaugcaaagagaagacaaaguccagggaucuuuaaaacuagaggagaucccuucacauuaaacaaagacccccacgaagggccauaccuguaguauaagaaugaacaagagauacaucccaugucucagaaguagaugcaaggaauauuuccugccucguuuagcucugauuuuauggaaaaauucuccucggaaaaccuauaaccucaacuuacccaaaauaagucugcagccucuuaguccauuuugaguuucuauaaaggaaucccugaaauuggguaauuuauaaagaaagaaaaaaaguuuauuuggcucaugauucugcaggcuguacaagaagccucgcccugauaccugucucugguaagggccucagauugcuuucacucauggcagaagucaaaggggagcaaucaucacauggaaagaggaagaaagcaagagagaggaaggaggugccaggcucuuuugaacaaucaguuauccugauaacuaaugcaauaauaacucacucauugccaagaggaagguaccaagcccuucaugaaagcccugcccccacgaccaaaauaccucccacuggggccuugccuccaacauuggggauuaaauaucaaugugagauuuggaggggacaaacauugaaacuauaucauagccacauauccacaugucacuuuuauuuuaaaaaucuagaggcguuauuuaaauuuacuguugucccaaauaggugaaaucugcaagaaacucacaaaacaaaacaaaaacaaaaaccucauaaaucucugaagaaauacaacuucaaccuaggccucaaaaauaacucuguauaugaauaucuuugagguaaaaauuacaagacugaaaaauccagucucauauaacaaaacacuuagacaugaauaauaaucagugaaaacaacagacaagaaaaauaaacuuuacaaaaacuuuuuguagaagaauuaucagacauaaguuuaaagaaaugagagugaaccuugaauaugagcaaacaguaagcaauuuugaaugaaaauuccacuccauagaacuuccaagugugaagauuagaauaauuaaaauuaaaaagcuuacaacugaaaaaaaaaagaaaauauguguuagauauaacuaaagaggggauuaacaaauuggaagauggauauuacaaaauuauauggaauguggcuggaugugguggcucaugccuguaaucccagcacuuugagaggcugagauggguggaucgcuugaggccaggagucugagaccagccuggccaacauggcaaaaccccaucucuacuaaaaauacaaaaguuagccagucgugguggcucaugccuguaaucccagcuucuugagaggcuguggcaugagaaucgcuugaacccuggaggugaaaguugcagugagcugagaucacaccacugcacaccaacuugggugacagagcgagacucugccuaaaaaaaauuaaauggaaugcuagccagagaaaccaagagacagaauuuaaggaagaaagugaagaaauuuaaagaauagaguguaaaugucuaaaauguauaaaguauaauuccauaaggacauauuaggacauauuagaaaguacagggacgugggaaauaggcaauauucaaagaaagaaaugacucaguuuuccagguuuauuuuaaaauucucauucugaaacaggaauuccuaugaaugcaaccaggauuaaaaauaaaaagauacgcacaaauauacaucauacugaauuugaagcaaaccaaagaaaaagcaaugucaaaacaccuuaaaauaaaaaaagaucaccuguaaaacaacagcaaacacacugacuguugauuucucagcagcaacaaugaaugccagaagacagaaucauaguaauacucuuagugucuuaggauagaacaacugucauuuuauguuuauguagaaaaauauaaaaagaucuuuugacaaaaaacagaugagaguuugucacaaaaugacuuucaccauuugacauaaauguuugcauugaacaccaaaaucuuauuuucuuauuguuacagaaagaauagaaacuuguauuuuuuuacccccuuaaaguugauuauguuauuggauaaauaaauguuaaugacacacaucacuuuuaaaugaaaacacuuaaaugcugauaucuaaaaauccaccuuucuuguucacagacuugauaaucauagauguguauguuaauaugcaagugcuuuuaaauuagucugaagugcugugccaacacauggaaaacuugugcacaggagagucaccuggacccacagccuuauuuacaggaauguaaacuuuuguuauauugaaaccuagaaauugugggaauguuucuuacugcagcauucacugcccuauacugacauauauuaugacacuccuaaaacauaaacuucuggcaaaaggaagccauauggaaaucuguuauaaggaaaagauauuaggcaaauacaauauauuggcaaauaaaugagcaaacuuuaauaaauauuaacuauauauuuuaaaaugucuaaucugugggaugaagcaggcuagagcugaaguguuaagacaacaacacugaagacggaaggagagcaaugguguuaaaauauaguaaaacagccuuauaucauuaggaaaaaugguaaacccauugacuagcuuaagucaaaaauuaaaacagaaaugaacauacaguggaaaaggagaaaucuaaaagcuacuuuuaauauuaaaaauagaaaaaugagauuggacaaacuucugaggauguuagucuaauguuuaucuguggcaucuugugaaaguagaaaauuagaaaugaaauagagacagaauucuacgugcugcagagauuaaagcagauaugaagagguuguccuuaauaacaaucaauaaauugggaaauugaaauggaauggaaaaauugcuaaaaauaauuucuuuaacagucucaaaaagaaguaaaaaaucagaacgauccuauguaacuaaagauauggagucauugauuaaaauaucuuuccaaaaauaugauuuaaagcucagauguucuuauaugacaguucugucuaauguuaauggauuguuaaaauuuacacaaacucuucaagaaaaauuuuuaaaaagaaauaaaaagaaaacuuucaaauaauuuuaugaggcucuaauaauuugauaacuaaaauuauuugagauuagaaggaaauaauauuauagaccaaauucauuaaaaaauugauucaaagauucuaaacaagauauuagcauacugauuccagcaauguauaaaaauaucauguugauuuuaacuuaggaguacaaugcugaguuacauuacagauuaaaggagaaaaaccauaggucauuucauaaauucaagaaaaaaauuaauaaaacaacauauuaucauaaaaacucuuaguaaacuaugaagagaagaggacuuaaccugaugaguggcauauaaaaauaucuacauuaaacaccuuaauauugaaaaauuauuugcuuucucuuucagaucagggaaaagacuugaacaucagcaucucauacugaaccuuucaauagaggcucuuaccauuguaguaaaaaggagaauaaauaaaaagcauaagaacugaaaaaggaaaauaaaaagcugccaaauugccucuauguguggcugauuuauguucugcauuguggaugauauuguguucuguacuguaaaaccaaaaaaaauuauuucaauuaauaagaguuuagcagugaugcugaauaaaccaguaacaaucagaaauuauaauuuuuacauuuaauuuacaauggcaaauauauguaaaauuauaucagagaaaaugugcaaaucuuuuauaaaaaagauuauuaaaaugaauuuaagagauguuaaaugaaaaguauacuauauuuuugauaugaaaagucauuauaaauguaguaaaaauguugauuguccucaaauugaucugugaauuaaauacaauuucauucaaaauuugaacagguauuuuguugaacuuuaaaaacugauucuaaaauuaacaugaaaaagcaagaauucgagaagacuccauccauuccuaaagaagcauggauagacaggauaacaucauuguaauuauacaaugugauguuaguagaaggaaagauaaauagagcaauagagagacaagaaacaaaauuaugggcaaaauuaaagcugcaacuccaagccagaucuguuucauuuucaauuccuccacgucacuuccagagcaaucuuuacaaaacacaaacuugauaccgucacuguccugcuuaaacaucuucagugguuuuccauucuucaggauagaguguuaguccuuugacuggcacauuuagccucuucuugaugccgccucuguuugcucggcugccuuugaaacuccccuuuccuugcuuuucucaauaugguaucccauccucacaaagguacuuucaguuccccgaauuugccauuuuaaaaacucugaauacaucauguugaagacuuuuuucugcuuuccaguaaugggcuaauuccaacucugcucucaauacugugccuaguaaccaacaaguaacuguugaacaaaauguugaacaaauaagacaaaaguggcacauuccugauagccuguuuauaguggaaggaaauguccacucauagguguuauaugcauguacaacugaauacuuugguguagccauuuaaacuagacuugcucuggguggaccugccaagcaguaaguaagggaauauuauuaaauguguugauggccaaucacucggggaguguccacaugugagcauuuaagauaaauucugaacaaaaaguucauuacuuacuguauuauacuuguuuuguuauagaauaaaucacauuuuuaccaugacauauaauuaacugacaaaacagaugcuaagcuucauuguaaaguaguaaagagaaaagcuauuaauauauucaguuuacauauguucauacuugcucaauguuccaaauacauauaugaaaauuaucugguucaaaauugccuuuacccccuuuugauuaccuugaacuagacacaaacaaugagcuuccuaucuuuccuuguaguauaaguacaauuaugcauauuuuguaauuuguuuacauacauuguuuuggaggugugugcauacuucuucuuuuuuuuaccaugcccuacagaucugucaugaucugucaucauguaucugcaugugcucuguaaaaauaaaaaauaaaguaauggaaucugaggcucaguccaucucaggacacaaauuuugaggcaaauguucaaacugacuuaaaauagauaaguuauaauccaacuuccuguuaacaguaaaucuuauuagcauauuccauugcauuuuauaaggcaaacguugauuuaugcuuaauaaucuugauucuuucuucacaacucgagucucagauuaacaagauuuuaaugucauacgaagcuagacugcaaguuauacaugcauuccuccagccucacuaacuuucucacuuguaaauuauguuuaaggacauuacuaaaccccagaaucagcguggucaugcugagacagugaagaaugaaacacaugcuccgugaaacaggcuuuuauuuuaauuuauguuaaauugucaaagccuaaauuaaugaauagcaaaugugaaccuccaaaugggcucauguggaaauauuccuauuugugguuaucuuuuuaaauuauauuaaggguuugcucuuuuguggcuguaaaauaaauaugauaacuuuacacaagaacccaauguucacucagugaguguagcagaaaucaaauaaaagcagccaugcaacucaaauuaaaguucaauaucauuaauuuaauuauaguacauaaucauuugacagugcuaugaauuggauuuaaaggaugauauuguaauugauuguuaaucauuaagaagcaugcaguaaagauaaugcugucugggugguaguaaauuacgauuuuauccuauccggagaccagauugugggaacaaauggcuccugucaccaucaaugaaucauggaggauggaaauggaaacagagggcugcccugugaacauguguggcagaauaaugaccaucauuauagaaggccaacaaugcaccagcuuggagcuaaacagccuacauauauuaucuuauuuaaucuuuacaauaaaccaagagaguagauaucauuaucuccauuucacagaugaaauaaaugaaguucaaguaacucacacauaguuggucauacacuucauaaugggaagggugauaugucuaauuggaaagcccaagcuuuaaacugcaacuuacacuccuuccagugaaaaucuaccaaaugagcuacccucagucuuaauaugcugggugauugccagucaugacauuuaucauuugcauucuaauagcuguuugcuuaaaauguccuccuucacucagaauuuuuuugaaauaucucuucucucuuucuugcauccaugaucuauaaagggggcuuagagaguaaauuauuugacauuuuuaucuguuuuaucagacagcuauaucugacaagaaaagaguaguaagcaaaguccugugacacacccuguggguuacauugagaagagauaaugguuagcaguaugguggagauaucugcuuagaaaauuuuuaccaagcaagacacccaacaacgguugaagaaauuucugacacccaacaaugguugaaggaauccuacugcaugggagaucacuuauaguucauuguuauuguugcuguuuccuugucuuacagcaaucauuucauuguacugcuaccauauuuguauggauuucuauuguuuguagcgcacuggugcuugagguuuagcaaagauaugaaaugaggccacaagaucauuuuuuuaccagacgauaauaguuuuuaguugagaguuaaaauuuagaagacauugacuccccauauuuucauaauuaaaccacaaaaccucugaggcauaauagaagaacauuuuucuuaauaauaacuuccaaaauaaugauggucccuaauucacaguauguucacacacacacaaaaaguguccuuaguggcuuggaacccucuucccaaauaagauuaauuaaaauuuagaccuuacaaaauacuuacauacaaaauaagauuauuuuaacucucaucgucauccuacauuguaaauauuauuuuauauugcaaauguaauaacugaauucuauaaaauuugguagguaacaugguggaagucaaacaccuguuuaguaucuguauagaaacuaaaaucgguccaggcagguggcuuucaccuauaauaccagcacuuugagaggccaaggaaggaggauacuuuagaccaggaggucagaggcagcagugagcuaugaucacaacacugcauuccagccugggugacagagcaagacccugucucuuaaggaaaaaaaaaacaaaaaacaaaaaacaaacaacaacaacaaaaaccaaaaaacuagagagacugaaauuaugucccuuugaacaagaacuugguuucuuuuucuguauacccuauucauguuugguuuccucuuaguaguacacgucaguuucuaacuaucucuuugaaaacuacaauccaaguucaaacucauaaucccagaugccaagaacagauuuuuccucaugcaugcucucuuuaucucucugucucucucucucucugucugucuuucucucucucucucacucucuauauaaagagagagagagagugagagagggagauacauauagauauauagauauacacauauaucuauaucuauauuuguauauaucuauagcuauauaucuacaucuauauauaccuuucucucucuucuugcugaucuaguggugaaugggaaauuauucuuguacugcucccauagagugacucagaaugccauggauguuuuuaugcaaggacuccuggguauucaugcaaagugaguaguaggucuagugucagaccagaccugaguucaaaggcacuuaacucuauaccugaagguuuacuuaacugaaugcuauuucccuaauuauuaaccgggcaugcuaacaccugcuuuaaauauugcuucuaagaauucauauguguguguguauauauauauauaugaauaaacaugcauuuuauauauugcauauauagaucacauauauagaucacauacguauguaucacauauauauuuaugcaauauauacaacaucugguauauauucaguuuuucuuuauucaguguuggaauguuacaaguguuagguaagguugcuaagaauacaaaacaggcagguuucaaggugccuacauucuguuggaugaaaacauacauuaaacaaauauauccuaugccagauagugauucaugcuaugaaagaaaaaaaguaaaaguuagauaaaaagugauacagaaacucuauuuuacauaacauguucagagaagcccuuucugauaagguuacaucugagugacaucaaagaaugugauagaaagaacauuguucauugaaagcaaucucgucuacacauuuguccucuuaacucauugaaaaagcuaaccggaacaucacacauuuuagaauacagugcuaaguacuguauacauuugugugugugugugugugugugugugugugugugcccucccagcaaaagccugcagaguauuucgauugggccaaaggauuaugaaaauauucacuaccuagaauuguuauauagcuaauguaauacaaagucuaaacagcauaggcaacaaaauauaugccaucuuuuaugagaaaggaauaguucaguaagcuguaaugucuagugaaugcaauaauacgugcaugggcaguaucaguguguccuggauugagauuuucuugcauauuugauucauugauuuaaugcucauuuugcaguuaucaagguauuucugcaggugacaaauuacaugacucauucuuugacuuauuuaaaauggugauagauguugauuuuauauagauguuugcauuugaguggaaagaagugaaacuuccagauaguuuauaaacauauuuuauuaacaaccugggaagaauauaucuaggucacucauuugucugauaauagaagaaauaaauggugcuacccagcauaugacuuuugagaaauaaauacaauuuucaaagcuguguuuuuaguguuaagaaagaaaauguugagagauuauuuuucacguuaaauaccaacaguuguauucuuauauuaauauaaaacuaauacuaauauuuaauuguaaaaauucaaaaaaguacaaaaauguuuucuaacaguaaccucuaaauuucucuguaauucguccacaugucuauguucuccauaaagacugagcuccauagaacuguguuuagagcauaguagaagcuugacaaauauuuauucguuaguaaaaaaaaauaucauuaauggaaauaaaugcauaugggcuucugcucuguguaauuacuauaagcauugauuugauugcuucacauauugucacaaguuaaauguaacaugcccauuaguguccuaaaacagauuauuugggacuaaaauuguuugaggauuucugaauuuuugguauacuuuacuuucaauauuuaagggaaaaaauauucucccuuaagagaaauaauguuuccaauuuugagggaacugauauucaugaacaaaccauccuagauccuauaaugcuuuauuagaguaauuuguuuuccuagcugucucuuauauuaaaucauaagcuccauaaaagcaggaaccaaguuguauuaaaauuuacuguguaucuucagugucagacaugaaaaaggaauuaaacauauuucuguugaauguugaauugauaaagugugaacaaaggauaauauauauggacucucuugucuacacuucaaugccugguuaacuuguuuacaaagauacccauuaguaugauaauaggcugauguccuggacauaguauauggauacaguuuuuuggguuguuuuuuuuuggagaugcacuggagugcaguggcaugaucuugguucacugcaagcucugccuccuggauucacgccauucuccugccucagccucccaaguagcugggacuacaggcgcccgccaaaaugccaggcuaauuuuguuuuuauauuuucaguagagaugggguuucacuguauuagucaggaucgucucgaucuccugaccucaugauccgcccgccucagccucccaaagugcugggauuacaggcaugagccaccgcacccggccauggauacaguuucuaaguggcuuuuguuggguucaaaucccacaauguccucaacaucccgccaagccguuagguguugugugcuggauuccauuaauucccaauuuaacauacucucauccuagcucauucaugaucuguuaguuuuauuauuuuauaauuuauugacaccaacuauauuuuucugaugucaguuuagcuuugucucaaggaauagcccuggguuuuuuauuuuuuuuaagucugucaaagugcuuaccacaaggugcuauucugaaacuuaaguuuggcaaacauugagcacuguuucccuuuauuggguaaucacagaucauauccccauuuuaaggacuuugagauauuuuggagacuagcacacugauuaauugacccugcugacaccaccauuucccuuucauuuauugauugauuuaacaaauauuuauuaaggauuuauaauauaucacucugccaggaucuggauauacaauggugaacaagauugacuuggucucugccuuaauagaauagauaaucuuuggaauacaauagauaaucuuuggaauguauguuuuaaaugcuacucaugagugucuuaacuuucuaaauguuacaaagaugucacauguuuuaauuuuuaaugaaugcaauaauuuuaucuaauuuaauuuugucuucacccaaagcauucuuaauuuuuuuuacaaagcgauaacauugugacuauugugucuaugguuuauauccccaaacuuucucaacagcaagguauuaaauccagaaaccaauaaugaacugguaagccuucaaucuuugaauauauuuagcuaugauagcagauauuuggcaugcuccguaucacuaauguuacuuucaauaguagaguuuuuacuaugguugaaauagagagcagaaguagggcugggugugaaggcucacaccuguaauccuaccacuuugcgaggcugaggcaggaggaucauuugaggacaggaguuugagaccagccuaggcaauagaaugagagcugucucuuaaaacaaaaaaaaaaaaaaaaaagagagagagagaacagaaauaaaauaugccuucaaaauugaaacaaaaauaauaaaacauccagugagaguaguuaaauaagauguugucuggcaaguaugauuaauuggguacuaacggggacccaugauugccaaaguacaguugcagucaaagaagguugaacagaauagagaccagugagaagaacccuggccaugguauuuaucagacaaucagauacagacacuguaauggcaaugugaugaaagauaaaggauggcugaccaagauggaguugagauugugaugaacuuggcaagauggcuggcuuaugaacaauaaccuggaaaucauuacuugaguauaauacccuaaaauaguuuuuucccuuuacaauuuuauuccuguuauuuccucuuuguuuacauauuugucuuucaaacuguaucauuuaugcuuucuuucuaucaauuuccccuuauuucagugcauuauuaaaaguguagcccagguuuugccaguuuccuucauuuuacccuguuuaccccucaaagaugauguuuacuaagggcagucugaagguugcucuuuacuuuuucuuccucuuuggucuucuccaguguguccaagugaguuagcccucuacugccaggagcaagguuaaucauacauuacaggaccacagucucuuauauucuggaaccacgacaaaucaaguggaauuguucucaccuuucccuaucauauugucccaucaaccucaaguagacuaacaaaccuaauagugaugacaauauaaaguucuuuuacugcaaaguuaaaguauaaaaauauaacaauaaauaguuauaauucgcauauuaaaauuucaccuucuuugaguucaguguccaacagugacaaagugcuuugagguagacucaugcucauaaugaaauucaccaaaaaaauuauuuaaaggcaucaaaaagccacugaggcaaauacucuguguguguguguguauguguguguguguguugugaguuagcauucugcagccuuuuuuauucuaggcaucugcugauuugagguugagggcaggagccugagaauacugauuugaucagagagacauaucuaugggccagaaaaaaacagaauuguuguugaaauuuuuccagagcugaggagacaaaauggauguguaaagauucacgauccaagaaagaaaauacuggugaagaauuaagccuggcacacaaccauguucaugacucgaggaucacuugagccaggaaggcagagguugcagugagcugaaauuguguguggacaacagagugagacccccaucucaaaaaaaaaaguaaaaaacuguuacaacuuauuaaaauuguuugacucauaauagcuaagacuuuuucaaaauuguuggaagacaugaacucaagguuucaagaacaacaacaaaaaauguaugaaccagaaggauaauacacagauaucuaugcuaaguacaucauaggcaaacuucugaaaaacaaauacagugagaaaaucuuaaaaacaaccacacacacacacaaacacacacacaauaucuucaaaagaacauuaacaaggcagcaaauuuuucaacaaauuaaugaaaucuauaagaacauggaaagauaacauuaaauugcuuaaaaaagcacaaacuagaacuguauauucccuauaagauuauucaaaaauaaaaacaaauaagaauacucucugauaaagcaaagccaagauaauucaucacugguagaugagcccuggaagaaaaccuaaaaauguucuucaggcagaagaaaaauaaucacaaaugguaacggagaaaggaaggaaagaaugaagaauaauggaaaggguaaauauguaguauauauaaacaaauaaugaccaucccaaacacuaguaauaauguuuuagaauauuaaaauacuaccuaggauuggccaggugcgguggcucacgccuauaaucccagcacuuugggaagccaaagugggcagaucaugaggucagaucgagaccauccuggccaaccuggugaaaucccuaucucuacuaaaaauacaaaaauuaacugagcauggcggcacaugccuguaaucccagcuacucaggaggcugaggcaggagaauugcuugaaccagggagucgaaaguugcagugagccgagaucgcgccacugcacuccagccugggaacagagcaagacuccaucucaaaaaaaaaaguuacguagcauuaaaauauaugguggcaaugacauaaaaguaagaauaauaaaacuaaaguguccuaaggcccuagcauuguaggugaaauuguaaaaguaauaauugaaauuuaacuucaguaauucaaggcugcaagcuugacuauccaguaaaaacaucaaaagacaguaacauauucuaaacuaaaaaaguuauugagaaagaauaauauaauaaaaauagcuacucuacagaaaguaaaaaagaagagaaaauggaacacaaaauaaguagauuuuaaaaaacaaguagaauuaugauagcuauauacccaaacauuuuauuauauacauuaaaaguaaauagaauauauauucuaauuaaaagacuguccagacacacuuuaaauagcaggauccugcauugaauuuaaaagcauagaaagagauagaucaugaaacaugaaccaauaaauguugguauaauuuuacuaauaucaaauuagacuuuaagcuaagaagcauuaugagaagaaagggacauuuuauaauauuaaagcggucuacagcuaggaauauauaaaaauucuaaaucuacauguacucaauuacacaacauugcaauauauaaagcauaaauugauauaaguaaaaggagauauaggcaaauccacagucauuuggaagacuuucacaaaccucucucagcagauaaaugauauaacaagcaaaccaaaaaaaaucaggaauuauauaaaacaacacagucaacauacguugacacaugucaagauguuagcucacgccaagcagacugcccuugggaacauucccuccauucccugccuagcucuccauccuuauauucucaccaaaaaucacagguauguccuucugcaagacuuucuccccugccuuacgaaaaugccaacccuucuacacaaggcauucucauuuuuuguucuuuuccuggguuuccaggaaauaucaguugucaucuagauaucugauguuuucaggcucuagguaaaggaugcacucuaggccccaagauaaagugaauauaaguccuuucagucacguuuuaucuucccacuacugagaccuguggaacugcuauuuccaguaccaaugaagcuuuaacgacguuucucucucaaaggcaaauauucuaucaauuaaaaaaagaauaguuauccaaugagcccuaacccuaacuuuuaauucuccuguuugcucaucguuguacuaaaaagcauuuggcucuauccuccucuaucagccuggcaguaacaaaaagaugacauucuagcucucaauugcugcuuccacugcuacccagggaacggcacaggcuuuaauuaccuggcucuuccucuaauaaaaggaguuucaguuuucucuggccaaauauggaugcauucuucucccacgagaaagaagagcaaggguaauggacaauuuaccagcugaaugaaccucugugauaaacugaggguuguucaaacaugaccagaugacacacaaaaaagauauuccuaucaggaaaauauuuaguuaaacccaaugaaaauaaugguuucaacuguuaguuccuagcauguauuuaaagacaaaaaauagauaacagaaaauauugaguaucuuggcaaaaaagggaaaaaacauaaacugauuuaguuauaauacauucauauguauuaugacuacauuauaugcuacuuucauauguauuaacaauaccuauaauaguuaaaauguauacagugcauaaaucaugcaaaauauuuuuguaagcucugagcaaagauuaauucuuugcaaccuaauaugacccuuauuuuacaagugagaaacugacacuaggaguuaaauagcuugcccacacucacaaagcuagugaggauaaggaaagauuugaacccgauagucaagcuuuggagauugugccuuuagaaauuuugcuauacuaaauucaaugguaaauuaaaaauuuuaguaagauuugaucaaacaacacacuguugagacacauuauucuggcuuccucuuugccuugaacaaaauuaugaaguaaaagacuauuuucuuuaagaccuucccagaaacucuguacuacauuuucccccauuuacacagcugucucuuaccagacaccaggguguagaauuggagcuagaacccagaucucccaaucccacccagggcucugucccucaugccaccagauugcaacacugauuuuuccaucuggugucauauuucuagagcuaucauucacagucucgcuucuguguauuucacagaccuugguuuuauugcauaauugcacagaagagcuuaauucauuaccauucugagaaaccagauuugacugucauuguggcagguuguauugaauuacuaaaaacauucagaauuuacuuuucaacugauucacaagagucacaucgaagacuaaacucuuguguuucuaaccuuacaccuaccaaggaauaaauuaugugauuuuugcauuugcuaaaauucuguuuacucaccuguucuguuagggcacguguaacaugggugacacugccuucucuguacagcccugcucacauuucuuuuguguuauggacuucauuauaugaccagauauaauuuuuuuccuguagaaauguauacuauaauaguagaaauguuaauaccagacaaaauauuuguuaauaucuacagauagaugcuugcagaaaacuggaaauugguuaaguaugaggucaugagacauuuuucugacuguuuuuauaguuggaaaauaauagaauggcuuuaguagaaaaauaaaucuuggguugaaugugguuugcaaugaaacuuaaaaaaaucauucaaaauuauacuuuaaaguaugaugaaauccaggaguuacucagcccugucugcagaacuuuuucugguauguuaaaccuuuggagaaacaacaagaucuauacuuugccauaaauuuacagaacaaaaggagagugaacuuuuacuacugaguaguuaacacugcuagauagauuuguaguaaaucccaauauaauugcaguucagauuugaaauauuuagcgauggacaugguacauauguuugugaaaggcuucagugguauuuccaaagguaaacacugccuauucuauaccucaauugaaauaaagaucugcaguaacagauccaagguggguguuuguauguuucauuuuuaaugcugguugagugccuaugcuuuagcuucuaaaacaauuuacuauucuauuuccaugauggguacuuuuuacacauuuacaaccaagggccuucuuagccuguggcuucaagaaaggaauuauuuucguuugagacccguguuuuuaaugcaaaugacuauuguuaggaguggucuugaaaauccuaaaaaagcauuuuaacuauuuucguaauagaaaaauuguaaaaaaaauagaacuaucacuugcaagugagucauauauaauguucuugagugaugguaaguuuuagaaaaucagauuaucugaaguauuuacguucauuugugcauucacauggaggaacagugauaguguuuaauauuaguggaggguaacauggaaugagacaguugacuaaaccguuaacuucuugaagguagaggcugucucuaguuuuuuauugaauccaagacaucaagcacaagcucugucaaauaaacacauuuacucauuuaagaaaugaaugaguccuguauaagaauuuugacuuuaucuuguaggcaccaaagaaccaacugagguucaaaacaaaaugcauacucuuagaggaggauaacuagagccauaggagguauggaacacguguucuaucuauaagauauaauuuaauuaauugugaauguuuauuccagaaaaacaaggcuuuaggaagcuauaaucagucuccaaauaaauggcgcuccacuguaugaaaagaggaauaaacacugguguagauucaaagaaaaaauuagaaugaaugguuaagaguuuagugaagaaugauggagcucaauguaagggaaacaaaucucucuaauuuagaauuguucaacaaugggacaggcugcuuauugagugugggugcuacgucacugcaaguauucaagcaaagcugaagaugaguuucucaaguggggaaaccauguuguaguccuugcaucuauccuccuguuugucacauggcaggauccaacacauguuuauagaaugaauauggcacaggcuuaauagaaaucucucagggauauuguaacccugcccauuuccccauguuuaacauauaccucuauuuucuuugcaggaacuccacaaguucucuguaauuuaaagucaauaggaaguacauugaacuucagaauuuaacugaggugaaguguauuuuuauccccagacagcaaagaugaaugaaaaugcuguguaaagaaaacuauaguuuuagaaaaauuagcuuuauuauugcagaauauuauacuuuuacuuuuaaguauccuucauuuuucacaugaaagccagccuauuuaaaaguguuuaauauauuuucaugaaugauuuaacuuugcaaauagcuuugguaaauauuugauaugcuguuauuaaauuuucuuuugcugaccuaaccuuuugacaguuauuuuacuuuggccugauauuguuggacuuaagucauuuccacauuuggauagucauuccaaaggaagguuuaauagaaaauguauguuuauaccuucuuauuaaagguuaucuaccccagaaacuuacauuucucuagauaaaguaaguccaaauggcagccuacuauucugcugcaauaguaggaucaacuuaaacagaucaaggggaaaagggugucagaaacacaaagagauauuuuguaaaauauacucuaaccuuaccaaagagauauauauuuuuuuuucucaaagaagccaaauagcacugagaggguuuugacugauaguaaggcaaaggaaacugaugaauuuucauaagguuucauuauaaauucuguucaaaccaaauuuaauugauuuaauauuauuuauuuuaguacaaaauagcaaaucugacacacucaucucccucccuucucuucuaaauucccauggaaaucacacaaaaaagauauguaaaaaacuuaagaaaaucauaauagucuuggucaggagagggaggccauggaaaacuggaaauuguaaaauaucuuacaagaaaaaguauuagaaaaaauuagauugaaguggaaaauaauagaaauuacaaggauaggaacuaccauauccaaauucagaaacaucauguucuaacaucagaaucuucuggcaaacauugcaguaauuaaugaaagaacuauuuguaggucagcugccaugguggugcuccauuuguucaucccacaugcuuucacucaguguaaaggcauuguauucuaagaagagaauuuucuacauacagugagcuugugguacagaugcaaggaucuaagaaaggaguaggguuugaaacugccauaugugaauagaagaaaugauaauacaaauuaaaucacacacaaaaaggaugucagcuauacuugagagagaaguucacuagauguuuccaucauugaacuaaaaccaacucuuauuuugacauuuaaggaucccagcacguauggaaauuuuaccuucaugcauucuaaaauggaagugaccagucaguauauugcuuguauagaauccauaauuaacucucaauagagacagcuaccuuuucaagagagaagucugagaaacagguuuauccaccugcagaggaaagcuauaacuguugcccaaauucacaaaccuaguccuucaauaauaugcaugaacaacuauaaaacaauauuuugguccuagaauuucauaaaaccaaacuaucaaucauguaugaaggcacacggagauauuuaaaaauaggcaaagacagaauugaguucaauuuucuaaagagguacuccaguaaaauuguaaaagacuaucagaaagaagauggcaugggauaaauuaaaaagcgacaacugaaugaacugacaaaagcaaaagaaaugcaaaaauaauucaaugggauuccaguagacuuuggcauuuuggaauaucucuucagaaguaaggguuuuaugacauagcaaaacacauuuuuucuuuuguaauuaagaauaucuauucauaaaauugcaaagauugaguuuguugaauuaaauuacuagguucagcauauagacaaagaagcaaguauaguuuaaaaaauaagcauuguacaaauauuaaaaauauaaaauaauaacaugauaagaauuaagauguagaagcugcaauaauaugcuauuucaaguugcacacguaaccacuauaaaaaaacuaaaaaauggccggucaugguggcucacgccuguaaucccagcacuuugggaggccgaggcaggcagcucacgaggucaggagauagagaccauccuggcuaacacggugaaaacccaucucuacuaaaaauacaaaaaaauuagccaggcaugguggcaggcgccuguagucccagcuacucgggaggcugaggcaggagaaugguaugaacccgggagacggagcuugcagugagccgagaucgugccacugcacuccagccugagagacagaacgagaccccgucucaaaaaagaaagaaaaaaaaaacacuaaaaaacaaaacugguagaaguaauuaauuccagagaguggguagauauuacuggauauaaauacuuugauauauuuuaggcguuucuguauaaaugaaaaguugucauguguacauauaaauuuuaauaaaacugaacuaguuuuaguuacauuuuuaaaagucaucuaugagauacuaagggguuucacaucaauauaauuuuauagaaauguuuuccguguguauuuccauuucuauuuuauaauauuauauauauauucuugauuguauauauuuugacguuauaaauauaaucacauuuguguuauaauuuucuguaugcaaaguacuuuaaaaucacuucugauggacaggguaauuaugcaauacauccauuauuaauaauacucuuuuucaggcgaaaaaacugaggcucaaaaaacuuaaauaucuuauuaauaaaugguagaaccaagguucagucuauaaaucuaaggugugauaaugccugaauaugccucaguauuugcaaguuuacaacaaagggaggagcuauucucaauagcugcuuuugaguuccguucuccaugcauaaccacuuccaaauuccuuuagaugccacuaaaucugagaaugauaauaacaaaaacaucuaugccuguggauaguucaaaacccuacuggcagugugauuauuuuugcuuauuuaauucuuucccaauuauugugagauagucugugauguuauuuccauuuacuaaugaggaaaacugaggcuuagagugaucaaauaauuuguucaaggucuugcaccuaguuaauggcagaacuuggauuuaaaccacaaauuucuucagacucuaaaaccugcucacuuaaguccuagaugauacugcuucccauaaaaaguucauugaccauuuauuaugugccagacauggugcuaacaacucuacauauguuauuucauuuaaucuuuacagcagucuaagagguagucgguacuacccuuauccuuguucuacaaaaggagguuaaaucauuuuccagucacacaguugauuaguggcagaguuggguuuguaaaaccaucuuuuugguuccugaggcuaaaauccuaaucuccaugauacaguuucuucuaagcaccuagccugaagcuguagaacuacuaagagguagaauaaugggagaaauauuuuuaacucuauuaauauaguuaggcuagaugguaguaugaaaagaagggacacagaacuuagcaucagaucaauuuguguucuaauucucauuuuucacauucugauuaucugacuuugaacauguacuuauuuuauuuguaacgggggucauaagauuuauaugacaagacugucauagggauuagagacaauauacauaauauuugugucauaugguagaaagccaguaaauuguaaaaauuucuauuacauuuucacuuguccauccuuuagauaaacaucucuacuagaguuuauuugcagaauggaaaaacagaguuugcacuacauguagaauacucauccuuuacauuauacaguuaaauuaaagcacaauuagcuugucccugguguggugauccagcugcuguaaugugccuuauaaaagacccccacuaacaguguaaaaguauuccaauuucuccacauccuguccagcaucuguuguuuccuugugauuccucagggauuuagaacuagaaauaccauuucacccagcaaucccauuacuggguauauacucaaaggauuauaaaucauucuacuauaaagacacaugcacauguauguuuauugcagcacuguucacaauagcaaagacuuggaaccgaccguaaugcucaucaauguuagacuggauaaagaaaauguggcacauacacaccauggaauacuaggcagcccuaaaaaaggaugaguucauguccuuugcagggacauggaugaagcuggaaaccaucauucucagcaaacuaacacaggaacagaaaaccaaacacugcauguucucauucauaaguggaaguugaacaaugagaucauaugggcacagagaggggaacaucacacacuggggccugucagguaguagggggcuaggagagggauagcauuaggagaaauaccuaauguggaugacggguugauggcugcagcaaaccaccauggcacguguauaccuauguaacaaaccugcagguugugcgcauguaucccagaacuuaaaguuuaauaauaauaauaagaagaaaaagccaagauguucaaaauuaguaaucuguuagauauguguagaauuccacagcuaugguuugugguuuuguuucuguuuuuguuuucagaaucagagccucaucuagcuuaugugaacacauugaaugaauuacaaaaacauacuuucuaugagcaguugcagcccugaggauauaaaacucuguaaagagacuuuuuuuucuuuuuuaaacuuuuauuuuauauuuagggguacaugugaauguuuguuauauagguaaacacgugucacaggggcuuguuguacauaugauuucaucacccagguauuaagcucaguauccaauagcuaucuuuucugcuuuucucccuucucucacccuccccucucaagcagaccccaauguguguuguuuccuucuuuguguucauaaguucuuaucauuuagcucucacuuacaaguaagaacaugugguauuugguuuucuguuccugcauuaguuugcuaaggauaauagccuccagcuucauccauguuucugcaaaagacaugaucucguucuuuuuuuaugacugcauaguguuccaugauauuaugugccacauuuucuuuauccaaucugcuauugaucaacauuuacauugauuccauaucuuugcuauugcaaauaguacugcuaugaacauucaugugcaugugucuuuaugguaaaaugauuuauauucuucuggguauauacccaguaaugggauuacugggucgaaugguaguugugguuuuagcucuuuaaggaaucaccauacugcuuuccacaaugguugaacuaauuuacacucccacaaagaguguauaaguguucccuuuucuccacaacaucaucagcaucuguuauuuuuuaacuuuuugauaauagccaucugacugguuugagauggcaucucauuguggcuuugauuugccuuucucuaaugaucagugagauuuagcuuuuuuccauaugcuuguuugccacaugcaugucuucuuucaagaaguaucuguucauauccuuugcccaccuuuuagugggguuguuuguucuucucuuguaaauuuaaguuucuuauagaugcucgauuguagaccucugucagaucauaguuugcaaauauuuuauuucauucaguagguuggcuguuuacucuauugauaguuucuuuugcucuauagaagaucuuaggucuaauuaaaucccacuugucaauuuuugcuuuuguuugugauugcuuuuggugucuuugucaugaaaucuuugcccaccccuauguccaguaugguauugccuagguugucuuccagaguuuuuacaguuuuguguuuuacacuuaagaguaauccauauuggggaguucaacaucaguacucacaauuuggcuauugaagagcggucugaguuucaagccuguuuguucuuuuucuuggccucuguacaacacacaauuggcuuaacucuuuaugguugcauugcucaaauaacccugaagauuaaaaaaucaaaaaccucugaagauucaaagcaguuuguaauccagucucagagaaguuaaguacuugacuaggguuaaagaacuaguaagaaagcugcacuucaguaaaagucuuucuaccucaacccaauggucuuuccaugagguccgcuuccuccaaugaugucuuaucacauugggucaagcauauuacagaaaauccaagauuuaauaaucuaaacaguuaugacacaaaaauaauaaucaagaccuuuaaguauuuccuuuucaacugaaacuccuuacuucacauuuuaguuuuacucaacaauuaguuugaauaauaguuuugugaccuacaauaauguuuuuacauaacugucaaguauaaaaauucuaagaaauucuaaaaauucuaagaaggacugcagucugcaguuccucaacaagaucuccaaaguuauuuuaaaauaucuaagauaaggguauauacuuucagaaacucuguuuaauuuuauuuguacccuuuucuaauugucuauuaguauuacuuuauuuaacuuuuaaacacaccuacuuuuaaucagggucuucauguuaaaaaugucccacccagaagaaaaagaaauuacaugcaugagaugaaagugcaauagacaccauuugccguaauaaacaacucagcaguucuuuaacacauggcccguauuaagcaauugagaaaucuggcaccuuugcaaauaauucuggcacagacuugaaaauguggauuucuggauucuuuggaccaguuaaaaaaaaaauguaguuuauuucuaaccaaggacgacaauaguuauugccaaauuaaugaauaaauaauaaaacaucuagauaacagaaagaagcucauuuuauuuagaauauaaucauacaucaauuuuucccuaaacaaauaaacaaacaaaaccuuaacuuauggcaauugcuauacgucacacacuaugcugaguauuuuggauuuagugauaaaugaacaauuccugccccaaggagcucacucucuaauauaguguaagagauuguaaaaacaacuuucaacauaauacagauaugcuuaugauauuuugaaugcauagagcaagaggcaauuaauuauguuuggcuggagcugugcagggaucauggaaggagaugacauuugaauuguuauuaaaaagauaagucauuuggcagagagaaaaaaagaauguuuagcagugggauuuuggacaagucacuaaaacuguuuagguuaauguuacuaugaaagaguacuagaauauacaguuuugcugcugugcugcuauaguuauuaauuuacuuccaaaucuagcuacagauuuugaaaacauuucuuuucuguauuaugaaagaaagcacuaguuaaguauugcaaauaguuuguuguaacaaacuuuuuccucauuaucuauuaucaaaggagggcagucaccagggaggaucaaaccaucaaaacuggcauauguaaaguucauggcuagcguccccagccugcucuuuguaaguuuguuuuccuacuuguuggcaucugcugccuucuccugccagaccccaauguuuccuugccuuuuauguuugccauuauuaaaauaugcuuuccugaaugauuuuuuuguuucuaaauuaguuucuucauguuggauauuucuaaugagaaaaaaacuaaauguuucuuucuaaauauaguaaccaaacuuuggagcaucuuugugacuuccgauuugguuucauagggacauaaagcaaugaaaaagugagcauucauguuauuuauuagugugauguuuagagacaaacaugagaauuuaauuccccaaagaagugauguuucacagagaauuuuauuuuauucuugaucuugagccuuuuuuccaacacuuauuacauuuucuuuaaaggucgagacagaaucccuuugaaccauuguuagagcccauucccagagaugguuccugugaagaaacaugagguuuuguuugccuuuuaaagaauucacuaguucuuuauacuacugugauucacugucugaguguaaagcuauuucaagacauucuuuguggacugcuguuucagauuuccuuuaucaaacuacagugguccaugggguuccuugcucaauacucuugcaucuuucuuuauuccaugugacaaauccuggcuauuauuuuugaagccaaacaguauuauuagauauccaugcugcaauauuaugaccuuugggccaauuuugggacacccaacccauguguuaaaugaauuagagauauguugcaauuauuuagaaaaacgaaaucaaaauaucccagagccuaacaagaugcauccagguaauuaagacucugaagguuuuacuuaaauuauccauagauauagaacaccaaauucucucuuuuaugaggagaguuccccuugugucaggucuauagaagcucaacaauaaaaguuuucauaauuuuaacaauguaaaggccaggcgcgguggcuuacgccuguaaucccagcacuucgggaggccgaggcgggcggaucacgaggucaggagaucgagaccacggugaaaccccgucucuaccaaaaauacaaaaaauuagacgggcacgguggcgggcgccuguaaucccagcuacucgggaggcugaggcaggagaauggcgugaacccgggagguggaguuugcaguaagccgagaucccgccacugcacuccagcuugggcgacagagccagacuccgucucaaacaacaacaacaacaacaaaaaacaaaaacaaacaaacaauguaaaaagccuaagagaugccuagucaacccucucauuuuauauagauaaaccaaggcucagaaauguuaagggauucuuuccuguuagaaggagaauaggggccaucagaacugucuuuccuucuaacggaaaauucugcuuucuuuacuacgucaugagaguuuaaugauaaugaccccauuuuuaugucacugcgucugauacuuaaaacuaacagugcagauugggaagugggcuguggggauaaaguuugggaucaauuaugcccaaguaagaacucauuucuggcucuuaaauacucugaaguugggcaagcuucauuuucuucaguuauaaaugggauauucuaugagguuguuugcaggguuaauaaaaugcagagagcuguuaccauagaauucaacauagauuagccacuuuaaaaagguaauaaugugaaucuggcuaauaacaaugacacuuauuguuacuaagcagaagcuugcuagggugacuguuuagaagaccuuggcauuggauuaagucacgaugcccucuaauagaccguuguggcaacugcuacuuucccucugugaugccuuucacaacucaaaugagacaaucauuugcauaauaaacuucucaguaucuucuagacugugauucugaguaccuauagaacucugugagaacaaggacaggucugucuuguuuaccauucuaucuauugcccugcaacccacccucaucaaguaauauaugucacaaaacaagaauuggugcuucacuagauacuuccauccuuuaggauguugguuuugugauuagguacugauuucugccuccugcaaaauuuuuauucugcauuuguuuauauuaaugcuagggaauucccaguacuaaaggagcauucacuguaggaagaaaggcaguucacaaauguccuaaaauuggaugcaaauauuuguguguaaauguguccauguaauuuuuauauaaggagucuauuuuuuacucuaucugaaggcuuuagguauaaauggugucauuuucauagguaucccugacuauuucauacaugugguuugaucacuucucuaaaauacacuuuucuggaauauucuaucauuuuucuugcuugagauagcucuuuaacauuuuuguaagcuucuuaaugguucagaacacaaauauaauuucuuuuagaccuuccuccacagcaauuaguucuagacucugccaaaauaaagauacucaauaaaaucuccuugaauaaaugaauacaagcauacuuaauaaguucuucuuuaaauggaauuaaaacuguguaguuuuuauuccacaggaggaguuucaauuggacguggccaaaaacagaacugaaauuucaacugacaaacacaaaauucaaauguauauacauuggcucugaugggugauuucacuucaaauucaccagugacucucacaauacaaaauguguugccuuuuuaaucacuauuuauccagggaacuuuuuuucucagugggaaaauauuuaguauuccaugauuaaagcuguauauuagacagaccucccaaauuuauguauucauugaaaacuagcaacccauaaugucaaaacuuuauuuauuuguagaauguauccacuuguuuuaaaaaguaucacuugucauuucugucagaaugauuucauaaauuaucuaucacuugaccuauuugauauuaaccuaugauaaaucuuguguucuaucuuaucacuggcacugccuuuccacaccccaaugaauauguucaggguacagaauauucacuuuccaaaaacccauaauagaugaaggauaucaaugugaguuaagucacaaccauauuuaugguuuauuuauuuugaacauauuuuauuuucugagcaguugcagcuuuaggaaaaaaauauugugcaagaaguauacagagucuucauaugcucccucuacuuccaaccccuagcuuucgguauuauuaauauuuugucuucauguaguauauuugcaacaauugaucaaacaauauuggcacauuaauauuaaucaaguauuagguucacucuugguauuguauauaauacagguuuggacaaaugcauaaugucauauaucauuacaguaugauacagaauaguuuuguugccuuaaaauacucuacauuccaccuguucuuucccuacacccggcccugagccccugacaguuacuuacuuuuugcugacuccauaguuuauccuuuuccagaaguucuuaucuuauaauuugaaucauaacaguauguagccuuuacagacuggcuucuuucgcuuaucaauaugacuugaagguuccuccccaucuuuuuauaccuucauagcucaucucuuuuaaguuugaauaauacacagccauauuuauauaaugauuguuuccucauaacaaagagaguuaucugaggugucaugaaguggaaagaauaggacuuuggagccugaaaccauggguuuugaaagugacuuugcuguguuucagcugugugaacuugacaauuuauuaaagaucuuagacuuccagguuugcugucucucaaaugaaaaauauuaauauauaucuugaaauguucaugauaaaaaaaaaaucacacguaaagccauagcacgguaccugggcaugccagcaucaacagaagcaguagcugugauggucauagaaguaauaguaacaugcauggcauacaaagauguugcuuuuuauccagugauaaauaucuaccuuuaaugaauauuacuuauuuuguaaauucagauagacuagaacaauaaugacuaguaaucagauaaggguguacagucaauugauuaaaaaaacacaauaaaugaaaaucaaagaccucaaucuaauacaaagaaauaagcaagcaacguaaaaagaaugagguggaaaaagaacucccauuucauacacagaguuggcuaagaauuucugaaauggaaagcuuuuuaaguuguugacguaauuuuucaguuuuagaaaagaaaaguuugugcacaugaauauuaggcuauuuugaaauauuuuaaauugcuucauguuuucuaaguauguguauaugucuucauaaauauuccaacaaguauuuuaguuaaauuaaagacuguagauuaaaaggagaguaaagagguauagauucauagacuguuuacagucaccauuuucucuuucuuccuucaucccuuuauuaaaauuuuaaugaauuaugugccugaaaaacauuugaauuuuaaauacaaaaaaagugaagaaaacaaaauauuuguaagcauuaacuaagucagagcuuugaguucucagaccuagcaucagugaauguacuuugaaaugggggcagggaggucaaugagucagugaauaccugugucugacaagaugauuucaaauauuaagugcaaagagaagaaaauaauuuaccaacaauaagaccauaaaaaagaacccaagauuauuuagaacaggggguggcaaacuuuuuuuuuuuucugagaugagaucucacucucucacccagccuggaaugcaguaguaugaucucugcucauugcaaccuccaccuacugggcucaaacgauccucccaccucagcccuucauguagcuuggacuacagcgcacaccaccacaccugguuaauuuuagaauuuugguagaggcugaguuucaccauguuguccaggcuggucucgaacgccugggcucaagcgauccaccggccucagucucccaaagugcuauacgcgugagccaccacaccgggccagcuuuuucuauaaugggcaaaauaguaaauauuuuaggcuuuguuggcccuauggugucuguaguaacuacucaaugcuaauauuguaguauauaaguagccauauaugucuauaaaaaauggcugugcugcguuuccauauaacuuuauuuauaaacguagauggcuagauuugaccauguugcugacuucugguuuaaaaaaugagaaaaaagacuggaauuaaccagaaaacauuuuauucaguuuacaaacuaaaauagcuaaccaaauuacuuuuuaccaaagacugaguaauugauaguguaaaaaaaugauaaagauuaauauuaugacaucaugcaaauaauugugugagaaguaaugcagcuuuuuaaagaaguauuucucaagcaauuggcagaaauagacauugcuguuuuuggauaauggaagaaugcagauuuuaggauuggaauugggcauaucuugguuuuuaauaugcucauuuauggguuuuauggguauguugcuuauccuuucugagccuuaguuucucuaguuguaaaauacaaauaaaucccaccucauaaaauuauuacauacuugaagcaaaagaguuggcauaaaacauuuaguauaauuccuggaauuuaguaagcacacucaagaaauuuacagggaauuauucacuuguuggguaacauaaauuucaguauggaaaguugaaacaaaaguaauacuggcaccuuauaaaauuguaaggauucaauaacguaugaaaaauacuuagugagguacuuggcaccuaguaaguguuuaguugauauuagcugcugcuuaugcugcugcuguuguuguuauuauuaauauuaaauauacuaauauacaggauauauacauucauaagugaguucaacauguacaggauagaauaugauaaaugccaugacaaagauacugaagucacauaugauugggggaucagaauaggauucagagagaaaugacaguugagcuaucuggauaaaaugaaaaguauuuuaauuaaagcagcugaaagauauuaaagauaaaacaaaggacaggagcaaaagaagagaagcaagguuuuaaugggcacaugcaaugagcaguaacucaauauaauacuguuuauagacucugcauuucuuacucagaccucaaaacaaucccgugugcuggauaucaucauacauacuuuguggaaaagcagucuggauucaaaaaaauuuaaugaguuuucuuaagaucauacaaguaacauucugauccuggaauugagcuucagucauuuccccccaucaaugcaaguguuauauccacucuaccaaacagacucucuacaagcaaguggagcuuagcaaaggcauaaucccccauauauaggucacuguuauucuuugaucauguaaauauauuuuacaucucacauuucauucacuaaucacaaauauuuauaucuuuaaauucauuugucuuaguuuuucuuugaguuccuaauacgugucagguacuauacuagagaaugguguacaucagccaagaaaagagauaaagcuauauucaacauaguuauggguuucuguuuguuuugcuuuuagaaaaguauuuucgagacugaguuagguauaugguagguaaacaauguuaguaucucccucagaaaaaagcacaaaguaauguauuaucuaauuaucauucuacugcccuaaauaaaaguaugaaaaagcugaugccucaaagucauuacaaagcaaaauaagaucuccauauagcagauaauagcugacacuuuuaaaauuguauuuuuuucuuuuauacuacaaaaucacaauuccauuuuagagcacauggugaugacauuguauuuauuuuaaucaaaauuuacaaaaauacaacuuaaagaauaaagcuuuauggauagaaaguuuucuugaaauagucaagaccaaaaaagaaaagaaaacaaguaugcuuaugagcaaacaacagggagaaaacuugcacagccuuuucuugagaacagcaauaaaaacacagcguuuguuuauaauaagacaaaugcagucuacauuucaaaauuggucauuuuugcauuuauaucuucacagguucaauguacuuuuuaaaaugugaaacuuguucuuacuaguuuucaguccuaaagauucagcuuccauggaacagcuggaucuaauuagaacccaaaguucugauuccacuugaucugauuuccccaucuguauggagucauuacaccauaaauaguguaagcuauaacuuccaguucaaaccagaaaggagcuggcaaucacagcuccuguuauucaggggucacugaaauuucuguugaacaucccagcauuuccauaugggcugacucaaucguuucgaauuuuuccaccucuaagaguauaaguggagaaccgaggcuuuucugcaguucaucuuuucauuucuuuuuauuugaagauacauaaaaaucugcaguaucagauuuagggacaaaauauucucuauuauuaccaacuccuuguugcacauuuuuguuacuuauuuuguuuuauauuccauauggaguauaauuccuguauuuucucauuuuuccauaaacuagguauuuaauggaauuauguaaugaaaaaguaagaauaucaaagaguucauccuuugccaaucccaucauuuuacagacacagagacugaguggcaaaaguuaucugacuugucuuaagcucacacauaagagacacaggaaugaagcugcagacuucugaguucucaacuggcauuuaucucagccuucaggcugacgagacuaggaaacucugccagggagaacauaauguuucuccacauuuauagucugacuucuucuuuuuauguaauauaaguucauugucaguuuuacaaauuacagaauaaagagaaaaauaauauucauccaaaaagaaucacuguuaaaaaauuuagauuucauguuuccacacauuuucugcauacuguuuuucacccuuccuacuuuaauguauuuuaucuuguuccuagguaauuaaccaagccucaugaccaugauuuucaauagcuaaaugguaucuuguagaagugcaccacaauuuaaaacagcauuuuauugcuagauagcuuguuuccaauuuaguuauauaauaaugcugugaugauaauccauguacuuugcucuuauguacaucuuuguuuauguccuuaggauagauucuuugaauuggaauuccugggucaucagauauacauuuuaagccuucugauauguguugccaaauugucccucugaaaaggcuaugcugguuuaaaguuauacucucagaauaugaaaguuuugcuuuuucugcacauacaacuaguacugcauauuaucauuuccuaauauuuucauguuugagagguaaaauaauaacaucuuauuguaauuggcauuacuuuuauuaaaaguaaaacuggacauuuuuacacaugcuucuuggauauuucuacauauacaucaauaacuacagagaaugguaaaauucagaaauuguagaugagaaaaagaauaaucaauuucaacugagaagaucagggaaagcauuuaacuagucuuuagaaggagucauuggaaaaucacuuugaaguauggaacugaauggaacgaaugaagaaguaaaagaagauuuagguuucauuauggaaagauaauagugaaaauugaacacagcagagauauauaaugaacaagccagagagagacauguaaguuuccaaauccaggccugugagcaaucaacaagaaggguugugaucagggcaucauuuaaaggcucaaggaaaagcaaacuaaaggaacaagaaacaacccagcaauuucugugauugaaccguagaucuuuagagugggaagggaccucuggagaugcucuaacccuuacauagaguuuccacgugaggaaacugagcaguuaagugcuuugccuagggucucaucuuguucgaaaagccagaaauagaauccaggccuccuauucccuuuugaaugcucucuguacaguuuuacaagauggaaacaucuugaggcagaguuguaauauuauguuugucccuugaaugaauaauuuaacuucuguguaacucaguuuucucaucuucaaaaugagagaacaggaccaaauaaacaugaacauucuuugauguuaucagaauuacuggacuucaucuguguauagcucacacucaaguuguuuguuuccugggccaugcuagucuuuaaaaaaacauuguguuucccugcauauauaccuuuaaauagcugaacugcuuucuucuucccuguggucagguaauucagaaacuguucugguuuuuguuuuaaauugaauuuucugagcaaaauuguuucuaggccaagaugauuuauaagauauuuuagaccccaaagcauucuuuuaagaaaguuauaaacaacugugaauggggacagggccaguuggcugcauauuuuucaggcucaagaaaaacuaguaggauauauuaaauauuauguuucacuggaauugaaaguguccuccauugcuuuucacuauauauauagacuuuuaccuucuuuccuuacuguuuaugcuuuuguggauaauauuugaaugagcuaugacauaacaguuuaauuucagggaaauaugucagugguguggccacauguauacuauaauaaguuuacacagugucacaagccaggcuguuuaauguuuguagguaugaaguggcugcuguaguucaguauauagugcuaauaagauugagaucauguguucaauuccugguuucuuucacucuuagcugcaaauagugacauuagucauaaaggugaauaaaggaaaaacuguagaagacucaguauaaaucugucucuaccaugaggaaacugacaaaugaacaacagcucucacuugaaucguugaauggucacuguggcuugucaggagggaggaggaagcaaaaagaaaaauggcuuacaggaaguucaucugcuaacaccauucaucuacuaacaccaucuacuuauguuuauuguguuuaaugauguuucuuguggucaaaugacuauuucuucaccaauaauaauaugaauaaaaauaaaaaugugggaaagacauagugcuuuccuucuuuacuagacaugagaccaaugcaaauccugugaauugagcgaaauuuuggcagaucaaacuucuaacaguuauuuguaaggcuauguuaaggaccccugggcuggaaaaaaaugauuacuuucugugaucauuuagaaacccuaccaaauguauuuggggacccaguugguucucaagaaugaaaauggugagaaaugaaacuuuccuguggguuaggcucagggcugaauaaagguuaugaaaaaaugagugggauugaguccaaagagcccugaacacuuuagggccaauauaaagaauucucucgguuuugcuuuuaccaauaaaguagcuauuccauuggcauaucuucuuauauaaugugaauuugacauggcucgagucaacaacuucuaaacaugaagauuauuuuuaccuaaggugagauaccauauccauaguucacuauugucuuaguguauucgcuuauagucuguuucuuaaauaauaauuauuaguagaaauauuaauauaugcagggacaauaauuuauguuagaauuguuaauucaauuguguaugaguuguccuuuauugaugucauugauaacauuucaguauuucucuuguaaagucccugaagagcccucucaguaaugcagcaauaaaaaaagaucaguuuucucucugagacuuaucuauuauuauuaccucuggucaaggauaaacagacucaguuauggcuugcugagaaauaauacauguauuuucaaacauaaagagagaagccauuuuucaaauguguggugcucauuaauuauuuucauuccucaaacagauugucuugcucucugguacacauucuaaauuaggggagccaggaugaacuaauguguuaaaagcuuuaaccuaagaucaaucuuucuuuuaauugucauguccuauaauuuucaggaaaaaauaaucaauuaauuucuugauauuucuggcagacuuccuaaguaacaaggguucaggucaguuauauucagagccauuuauaaauuucuagacuaugcuucuuuuuccagaggagauauuacaccaguucagguggccuucuaauuuauaugcacuauuccuuaggagaucaaagaaaagaaaaugaacuacuguuuaaaaaaaugugcauuauucauagacauguauaugaauguauauauauguguuuauguauauguauguguauauauguacaaaacaauauguguauucauguacauauguauucaacuauauguauguguguauauguauacauacacaagcacauacauauauuguuggaaauggcaaaaaaaucccucccaguuuggaaagacuaaaauauugucaugguaaacuuucacauuuuggggcaaaaugucacuaguauuuccacuucuuuaagguaagggggcaauagaaggauaggauaaaauucugagauguaauuauucuucccuaagaauguuguaauccaaaaauaccugucuagaguccauuaccuaugcagugcuaggcagccaagcagugauuaaauauggaacuucccaaucauuacucaacuucucuacagcccaauauaugucagcugauuaacccugauugaaauuuaauacccauuuuuccuacuguaccuaaucugucaaagaacuacagacaauguggagauaaauguuagccucuuacuuccaguauauucuucaaacguccagaaacuucagacuuagucauuuccuccaaaagauguuaaaucuuaccaagagcuucaaaaaugguucuacuuaauauuuuaaaaacauaaaaaggccuaagguaaugacuuauuucacuuauucguuacugcauuauaaaaauaauuauugagagaagauuuuuuuucugcugugggaaugagaaaaauccccuuauucaggaguguguuguauuucuaagacuauauuauaugaacaaauguugguaucugauaaauagcacuaauaucaaguguuuauauuucuuucugcuuucaaaggguaaacuuuuugagaggauuacugcuguccugaauauuuaguauauugagcuguuauucuuaaacuguaucauaaaguuuuauuuaccuaacagucaacaaauaucagugaguacuaugcauacuaugugcaaagcacucugaaagugcuugcauuauucaaaaucagcaagugugugguuccucuaaaaauaacuccacaguagaacauaaucaaagauaucuccuagaacugaaaaaagcaaaacugaaaagcgugaugcaaaccugacuuuuuacauagguugguuuccgacuugaguuugaggguggaaaaaagaacaccuuaauauagauugucaagguagcaaaguuauauaaaguuuagagcuguauaaauguguaaauugugugaguacagcuaguaggaaagccaguagaaaaaauaacuaaagagagaaauuguuugaggggaaaaaauaguccuuuccagcagacuucagaauacuucauuuauaauaaacaugugaacagauaguagccuggggaaguuauugaaauaagccccuggauaagcaucucucuaguacuggaaauaacacaagaggcuucuggucccagugaagauccuuucaauguuaauaauaauuacuucuuauaaauguuguuccaggcuugcuguuauguaauuuaauauuuuuccuauuuaauccuuaccguaguugacaucauuuucauuugaaauacacagaaauugaagcauguauuuaaguugcauucucaagaucucacacaccuauuauauuuauucaacaacuauguauugaguacuuaucauaugucagacauugucucacagucuugagauacaugaauaaauaaagcagacccuggcuucacagagcuuccacuuuagcaaaagacaggccauaaacaguuagcauuaaaagcaauagaaaagaagacaagguaaaugauauauuagaaaacaauaaacauuauggaaaaaagagaagccuagagaauguaaagagagauuggguuuuaggaauuauguucuuaaugguguuuucaguguaggacucagugagaaugugaugugugagcggggacuagaaggaagcaggaagcuaguuagguggcauucuagggauuaguauucuaacccuggggaaaaacuagugcuaaaacccacaggugaagcugguguggcuagagaggaacucaaaucaaauaaagaauagaagagucagucaggggaucacaaaggccaaagaaucagcucauagggaccaguguagugguuuuagcuuuugcuuccaaagaaaaguggaacucuuuugggcagcaaggaccuguccauuaccagaucaauggaaugagaucuuagcuguacaagaaaagaauucuccuccauuacuugggguuucuuucucuguggcaguguaaaauuuuuuccacaggaaguuaauaucauacuuucuagaaguaauaaaaacugccaucaauuguuuauuguucauuuaaauuugauucaguuuuugcaaaauccauaggaaagcuaaugaaugauuucuauugacuguuuauaauuccaaaucauaucaaauacuagucuugaaggcauucuauuuaccacaagaugagucuggauuauuucugaauucuuauuggagucaggaaaauuacaauauuucagagccugaauuugaagaaguuuagaguuuacaaguuguagaaaccaccuacaugcauauacauuuguguuugaucaugauuggaauggugaaaauuuuaagaauagcaauauccuuuucucucuuucuuugaggcuaauuccucuauccauccugcuuccuaagagugggucuuggaaacacagagucaacauaaaaggcugauauauguauuucagauaaauuuaaccuaguauaacugaaaagucaaugaacuauguauccaaugcaacuuuuguugccuaucuuugcaaugucuucccauauuuaacuacugauuuuccagcauaucauuuuuuucuggacgaaaguacucccacaaucacuauaucaccaauaccaucgccaucacugagaagauguuggcugauacauaaggucucuccugcccaaauacguugcauuaauguucucugguaacuguguucuguagauauguugacaagccuaacaucauggcaagaauaugcauggaaaaaagucaggucaggagaggauaagggcaaauauuuggggauuugugugguuuuaauccauuuuauaucacacugaggacaaggcugccuacuucaucaggcugaccugugugcucaaagcaggaauagcugcucugucuauuugaagggauugguagcaccaaguuuaugguuuuacuccuuugucuggucuuuuuauuccccuucuuuauuaugaacuuucuuuauucacuucugaauauacuuagcccuaccuaaaagucucaguaauacuuacaggcccaauccuagauaaaaggguaacuaccugccugggacucuugcugcuacagcucucagaaaaagaaagaccacaaaagauaagggagauacacauuuaacuuuuauaggacauauauuuauaaauugccaagauagaauaaacauuuauagauuucccacuagauaccaaauaccaaagaaagaccauguuacuugauuaguucuagugagucuacugaguaaacaaaugaaaaagcagauuaaacaaagcaacaaaaaccguacuuccuucauugauuugugaucucaaaucacuuuuuuuuuuugacugcauaguccuuuauugaauuacugucuuaaguuggguuccuugguaaauagagucugauugguguuacagcaagauuaugggaaagugauugugagaucaucuuugagagagcaagggcuuacaaaguugaucucuuucauucuauucucucuuuuucucucccccccaauuuuuucucucucccacucuuccuuuucuucuucucuuucuguccuucucuuucucucuuuucuuucuuucuccacauucaaugaauuacacuucauucauucuuccuuucuuucuaacauuaucagcuuuauaaguuaucuguuuuccaugguuuaaacauuuuaacauuggcuuaagcacuuuuauucuccuggccauauuacacucauuauuagcagcacuuacacaauaaacagcugagaguuuggcagugaugagaggcacagcccugccaaccuaucccaaugaacgucugaaugucacugugucgcuccccugacccacagacauguugguuauucugauccugucucucauuuguauagaggccagaaacucugccaaaauaugagaugaugacaaaugggaacuuggacagagcuaucagguaaaugcacuaacucaccguacuuccuaaggccccaagcauauggaucauccuaaagaagagcuuagggaacauaaauuagugaaccuuucagagaagaccaaaugaguaaaucuggugcuucuuguuccagcaagaugucauucuugucacucuucaaauaacccuagaauaucugaacuauucuuaucuccacaucucuacucagacaggggccgugugcugcugaaacaggagcuuuucagcauugaaaugaauugucaagucugugcuagguaguguguaccgcaccugcuugcauuaugcaugacugguucugcuuacugaugucauucccacucugcuuaugguauuccuaccccaaguucaaaacugagaaggugauauccucccccaacccauauucauccuuugacagucuggagauuuaagaaauggaaugaaugugccucucccaaggguucuguguucaccucagucucauuugguugcaaauaaaacuccaugacaggaggaucagcuuaaagaauacagaggaaacccaccacugggucaccaucaugcuuuuucaugcauuuguguguuuuuucuguacacaaaauguuuuuauacaccgagggaccugcuuuauagaaacuucauucuuuuuuaaugugguucauagaacuguaccuucucaaccuuucgugagucuucagcaacggugucauuuuucaugagauacauauguauaucagcuauaacacacugucagugaacagugguuuucaaucaaauaggcugucuauaaagcugaugcacuaacaagaaagcugucaagcugugacagcugcugucuuugcuacgcaaacaaucuguucugugcuaauggugacuugugcacuuccauuuauuauacagucguaaugagcaguguccucagaaacauggucugaguuaguggauuuacauacuuuguugugugguuucugcaaaaucaacaugagcagaauuugcagcugguuuucucuaaaaauuuuguaggaauuucuuuguuucagaaguuuugguuaauuauccaauggcaaggagucauucaccauccaucccauaagccucuguugaguucuuacucaacaguguccagaacuccuaguucugggcacuuuuuguguugggaauacaaaaagaaauaagaauaaugucuguuuucagccauucauuucaaucuauuaauagagaagauauuuggucacuccaaguuagaguaguuagacauuguguucuagucagaagcucucgauuuuuaauaaauaauaaaugacuucuuaauuuuccauucugagguugaauauuuaaguucuucuauauucagcuguugagauaauuuccucuagucugauacugaguuauuaauaaagaacuuuauuuuucaagugacugucuucuugggagagauuuagauuugugagcacauuuaaaaagacuuaacacuuaccaacugcuuaucacguuccaucccuuuuguuaagagaggaaauucuuaccauucacagauaccaggauauugcauucauguuguuucccuggcuugaaucaguagggaaggccagaggaguguaugaaggggaauaauuccguuugacacucugagauaucaaugcauccuuuguuucaguuucgagggagcuccauguugcaagcagguuagaggucugugucccaugagucucuacagagccaaaaguugcauuacuacacagccaucuucauggccaagauuuucugucuuauuguuacagcaguguggccacacauuaacaaagagaaucccaaguugaaugcauuucacauguaauuuguuccugcacaggauaacccauaccggaaacuguuggcuggagagcaguucauucacauugcaaauauuacuaguucuuagagaauaauagagaacauuuaguaggcucauaauuguggcaaggaaaauaugacuuguaagagcaggcaacauauaaggcuaaaauuaaccauucaggaaaagaagcagagcaguucugcuucgauccauggauauuuguuugcaaaaaguauaacaauuauccuugggaaugaauggaggaaguguguguuaagaagaguggccugauuuuucuccuuguaaguccugauugguuucauguuuucccauucccuuccuccaccccucuacuaauguaucaugaagacacucuggaugaaauguacgucuccauucaugcugccucugguacucaggugcacuaaugacaugugcccauguugggccuauaccacauuacuuggcaggucgcaaaugccuggggcccaaacacaagugaguaauggcuggugacucuaauuuccccccucaccagcagcacaguguauauucugagaaaauguuuuaauauacugguguccaaggacuaugccucaccuucuaacuuccuacaaacaugugcagaggugcgcauacacauauucuuccacuauacuucaagaccaucaugcagacucacccacaagcugccugaaacacagagauugagaaaauauugacaaaacaucuucagcaagaguagcaacagaggaaauaggagcagcaaaccuuugugaugagauacggcuuuguugagccagcucuuuguagcugcacauugaagaacuguaaaacugcucaguaauugcaauucuguuuuucaguugaugaaaaucauaaagcacaaacucaccuaguugacaaagccugugauugggcaugggcauggggaacuuguuuuguguccuguuuuuuuuuuuuuuuuucccugaacaucuguucaucuucaaauaugcagaaguauucuaugcaaggaugguguauuuuucuguuuacuuacacuguacucugagcaccagcacauguggcagagaaaaucaaugugugcuccuuugacacaaugguugcagcucucaugugaguauaugaauuugggauauaggccuacucucauuuuuauuuuauucuuauuuuauuuuauuuuauuuuauucuuccuccuugugauaggugaaaugaaugugaguauagcuguuaaaaacuacaaauaacuauuuuucucucaguacuaagacacuguguuauuaucuagugacauauuuugaauaugggggaaaagggcauuuuaaaggggacuuagaaaauacuaacagcuugcauugcggacacauggguaaccuuaugggagaugccacaguauauuaauaacguucuucucugagacuguaaaagguuauuaaaugcaaagguuuacuauccauaagauaguaaugauuuagaauaugaccuuagacaccuuacuucucuuugccuuaguuguaaaauggaaaucauaauaguacuuacagaacuguugugaagguuaaaugcauuggcacaugaaaugugcuuagaauaguuccuggcauagacuacaugcucaauugaugucccuaucacugugcagcucacaucuuacuugaagaagcaagcgucaaacagaaauucuuauuuuugaguuccuuucuugagccagacacucacaaaaugcuuuauuuuuauauucucuaaucuuuacaacucuacaaggaagaauucauucucauuuuaccaauaauaaacaggcuuaugaaggcuagagaacuugcucaaagacugagaauuuaaauacauuccaaaacuaugacaugcugcccaugaauaggucucaagugauucauaugaugagagcacacuggagggcaggaugucuccguggaaggaugucacggggcuucaaagaagagguaguggcacaauugagaugaaaauaauauuuucucuaagauuaauugagcagagauagccauguuuaaagugcuuguggaauaauccauauuuugucaguguaaugagaauuucugagugagacaauucuggauuugaauccaacuuaucagcuacgugagcuugggaagauuccuuaaccucucuagcuucagcuuucucaucuaaaugauaaaaauaauauagcaccagacauaugggguuuuaaauaaaauaaugcauuuagagaauuuagugcuguuuuggcaaauaguauaugcuuaguauagauuaauuaucauugcugguguucagauagggacucuaugagugaggagagauugcauucauaaugcccagagauauccaguaacguggguuaggugaccucugcaugccuucuccaugccuaccgccaaugaugcuucuuugucucccucugugucuucacccucuucuucuuucuuuucuuuuuauacuuuuauucuccuccucaugguuuuagagaaauauauacauaguauauauugauuaaccauggugacaucaaugcgacugcuucccuauucuaucuucuaauuauaauuacauaucauguacaaauuuuuauagagauuuuuuuauaauccucuaagcagugaacauuuagacuuuauucuguuacugcugcuuugcuaucuauagaaauaggguugcaugauaccaaauuauauacauaaaauaaucaucacuuuaaagcccaucucauuaaacuaaccccccuccuuuaauuuuauauuaggauauuacacuuuuuauggucauauauaauugaacauauacucaagcaauaacaugguaaaagccucuuuuugaaaggagaugaaucuguuuuauucauccauaaauacccuaaaguucuaggacauauaaguuacuuaaugaauauuugcuuugaauaaacauggaacuugaaaauauguaauaauaugcuggcaugcuuggugugauagacacaugcacaugaaaguagggaagaccaaacuauaauaguucaaaucaaugauaugugcuaagauuuauacacuauaguacaagaaccccaugauucugggaaauguuaaauccuauuuuuugcucucuaccuuaaaacgggagaacuagaauaaacaucuguugguccucuucauaccauaaauuuuacacaauaaauugucuuuucauacuauuccuauuccguacauaaauacuuguaaggauuuuuacacacauuuaccccagucuuucccgugacuucaaaguauugggcuacuauuaauauuaucaaaacaguaccuuggguauguggcaaaagauuccucuaaggaccuccaagaacauuucgaaccacuaucuagcuuguugcuaaguggaacacaauucuugguuauuauuaaggucuccauugaauagcauucaguuaugaaaauaggcauuuugcaaauuaaaaaauggcaaacaauaugacagccacuccacaauaguacagacauuucuuaaaauugaauacaaauauacccugaaugucugcagcauacuauuugauaaugccuguuagaaaauaaucaugagcaccugauagaaucuuauggaaccuuuccauuggagaagcuugcuuuugauggcaaugauucggugcuauuuccugucaauccaucaauucaugauuaaccuuccccuaauaauaauucuauacuuucaguguuuugcucaucacauagaauuuaauuuaccuuuaauuaucuguggccuucaaaaaauguuucugccauuuugugauaaaaaauaaaacugaaagacauaacauaaaaaugaaaugguuuaauaaagaugaggaagguacgaaauacucauuaaagaaccuccagauuauuaauuucccuggaacuaguuaaaauagaaaugauuuucuucacaucucuuggauauuuuaguuccuucucuuauuuacuuuccauuuuggcaaggccaacaauauuucuucauuaggacuuauuguaauauauuuuuaacaaaauguuuaguuauuugugggucuacccuaacaauaccacucuuaggauugcuauucaaaaauauuuuaaaacgaugaaacauuuaucuauugcuauauaguauagauaauuauauguauaugagaaagauuaaagcacuuuuaaaauaccaguuacuucuauuguuuauuugucaaguguuuacuugauuuuuuuaacuuuauaaacaucauuuuauaaaaugauaguuaucccagaucaagaaccuaaaauaugacaaaauauacacaauaugaagcauucuuaagguguauauuaaaaguaaggacacgauaucucaaaaucucaucccacccaugacaucaauuaacacuuuugcaugggugacucaagcauucauaaccccaggcuagcuuucuccucuaagccccagaucauucuacauaucucuucauuugauauugacucuucugaagagcuuaucaaacuccacauguuuucaaacugaaguuagguuuaccagacagcugcuauuauuaaccauuuacaguguggacuggcaugaucguccagccaguugugcuagccacaaacccaagaacaauuuuuaacaucuccaucuuuuauuucccucagauccaaucuauccucaacucucuccauuuugccucaaauacuucucucaaaccccuucucaucuugcaucucuacuacuauaacucuauaguacucuauacuacuaugccucaaccucaauugcugcaauauguccugacucuucucuccuauccuuucuggcucucuuccaaaauuauauuuaggcugcagccaaagugauagauuguuuuaguuuuguuuuucuguguuuguguguguugguucugggguggaagugcgggcggugguuaaagucgggagaggcuucuuuguuuuguuuugaaccaguaauaauuaauguguaucucccuuuucuuaaauccugauuagaacaauggaaaccacauuuauuuucuuccaauauauacuugucuuuuggguuccauuauccuguguuccccuugauaucuaucugaacuggccacucagauuucauccauuuuucugcaggucucucuucuaccauuuaaucagucuggauuccuucuauuucauuaaucauuguuccucaauuauaagacuggaacaagcauuuucuuucuugacuuuuugagcaaaccugguuucuuauuccugcccaggccuuuaaaacugccucuuaaaccugugagucugcaguaguauuauugaauugcuucucaaccuucauccauagagauggacuauuuuaauaauaaggacucuaauuuuacuuguuaauaauaucuaagacccuucuaugaauaaagccacaauuuggauuucagcaauccagagccauuuccuaagacuauguaauuaguaagucuagacccaccuugagaccacaguaauguggagugacucuuaauaaccuguggacaggccucguguuuccaagguuaccccuucauacucucuucuuuuaguccuaaaaucaauucaagacauaaaagagaaacagaauuuguggcagcugaacuaguuuuuaccuauuuaggaacucaggaucucuuugaugaaaaggaucuggcuuuccauccugcagccuuggcugaaaaacauaauaacaauauggaagaguccuaccucaucuauguuaccaggccacaugugccaguauaguucaaagcaucagcagccuacacauuaaagccagcuuggcuggucccugccaagcuuccauggugcugccugcauuuggccaugguuggccuggcuuauucugccaauaacauuuugcugagccacccacugggugcaccugcucuuuacuuaagaucagagauggcucaucugcuugcucaggcugcaccuguacaaaaugacucuguuucuauguuauuuaucugcucaccuguagaauaauggucacucucccaaaacaaagacccauuagcuagugugaaaaaucccacguggccuaaaccuaagaccuaaagcugcauucuuggucagagcaguucaaagauagccacauaaguauaaaauaauccacauggugugccuauaacuccaaguccaaaaaacaauggauccaucccaaaaccuauaucuaugaaugugaauuuuuucuccuuaaauuccacuccuuguuuauaagucucaagguuuuugguccagugcaccagauuguaauacucaguacaagugaaccuauauuccagucauagacacaacuggaaacaacagccuuggcuaaaaaagauaauaacuccacaugggcugcgugcuuuuguacaacuuccuccagggagacacugagaacaugguuauauccugcugacagcuugccaaucaggagaaaagaaagcgaaggggccaaucuauaaaugcccauuuccucucauguacuugcaaauaccaguuguucuucuuucuuuggguggcaguaagcaaggagguagagagaagccaaagacauuaaaugaaaaucucuccucucucccucucuaacuuuccaugguaauaaacauuucuccccaguuuccauguuuaguuaauuucuucccucaggauuuuccagucauuuugaaacugucauaguucagcccuugacuucugaacugaauugagccaaucuucccacuuuuagacucaaacuccuccauuccauucuucccagaacauaaucacaaaagaugcaaauuuaggccacagaaaaauuaccaacaauacaauuagugagcuuuuggaauugcucaguuuaaauuaagaaccauaaacauuaaaucugugacugccaagggacuguaauauauaauuacugaagagaugacaaaaaaauuucuguggcaucuacugauggcaaggagguguagguguagaaaacauacaaacugguuaugaauguguguagcucauaagugaaauugggcauguuaguugaaauucauggaugacaaagaaauggacuaaaaacugagaguguuacauauuaaauuagcacaaacaaaauauaauuuggccugaacucaauuugaaaguaaaaacuuuauagaauuaaauccuauuagagauauuuuaaagacauaugcaguuauaucuacuuaauaacaaaauaccugauuaauuaauucauaacagcaauuauucagaaaaucuugccauaaaaucacuuaaugaauugacagaaguuuuaccuaucacuuuguuauuuuuaucuagccuguaaacacagccuaugaaagaaaaauaaucuuggaaaugcuuucccauaaguuaacagauuguacaguaggaaaacuauaauucauucaucuguucagucagaugacaaauauuuauuauauucaaggcauaguucuagcugcuaaggcauaacagauguacaguaaauccucaauaaauguuuuguaauuuagagaauaaaaugacaauuaagaaauaaacuuuaucuuagaggcauaauguacuuauggagauaauagcauaauuauuaauaguggugcuauaauaugcuauaucaaucaauauucaguguauauuuuuacaaaaauauauaguauaauguauauaaaauaauauaauaguuuaugcaaucauuuuauuauuaaauaguacuaauagcauagaaguucaauaaaaucaauuuguaucauauuaaaauaucauaaacaucuauagauguugucauaagaguaauguuaaaggugagcuaggaauuugaguacauaguaaacaauggaauuauuuuggagauuaugauauccaaaguugucagcugauggcaaguuaauuguuuuuaauaaaauuuuauuaaaauauucacauauauuuacauauauacauauauaaauguauaauauguacgugcauacauaauugcauauguauacacacacaucaagaaagagauuauacugauauggaaggauuuuaggaagauguagguuccauauuuacaguucucugccaauaacuugaaccagagugauaguaguauuuaugcaauagcaccucauuuucaagaguuuguuauaugccauaccuuccuuguacucauuuuuuauauaaauuaccucauuuacuugccacaacaagccuuugaaguagauuuuauuauuccuguauuacagaggcaggaauuacaguauuaaaacauuaacauacuugcccagcaucuggaaguuaagauucuaauugaauuacuccuuaaugcaaaccccuuaauugcuauacuguaugaacgugcauauuuagaaauuuuucaaaaaaaucuuucuuguuaauucuuguaugaucuuugucuuucauauccucuuuuguccacugaagguuaauguuaccugggucaagaauaagaccaucugggguccaaaaauguagaccucaucugauaaaguuaugguuucauucacauuuaaauucuaguuagucuuguuuuucacuaagugaaugugaauuuuuauaagaccauuauauuaccauucuaauuaccaauaaauauguauugauuacccacugguaaagccuuauacuaaauuucaaggauggaaaaugaauauggagcuauuugugauuuuaauauaaacaacuugccaaagaaauaacaucuaagacuuuuggaaaugcauuaugccagaugggaagagaauucuuguugauagaugacaacuauucuuaauguuuacaaaaugugagaauuauuuuaaaaagcugcauauuuuuaucuuuagaauguaaauuagcugacaucucagaaagcuacuuagcuuuacuuacccuagcagaaaguuucuaaucaucugauaucaggcucucuauugaaugugcuaacacaccuauaauauuuuaaguaauuaagaaagaaauaauaauauuuacuuaaauauuuuugaaaugagcuuggauaguaaugaaauuagcuguggaaacaaaauaaauuugauaaaaauuggcaaaaagcaaaacaguggacacugcauuuugacuuuuacaauuaauucccacacaaauauuuguuuaaucagacaaugugguuaaucaccaaggugaaauugaaaguuaccaacagugaaugcugguguaaaaguuaauaaauucaguucauaaucgcuaugcacaugcuaguuauaauaauuuacuguccauaccaaaucuuuauaagcauuguaauuaaauauaaaaugcacauuagaauuauaaugaguaauuagggcaacauaacuaauaugcaugaaagucccaaagcucauuaaaauguuaaaagacaaaaccuguucuaccuaguguuuuagcauauuuucuauagcuaaaugaaugccaguagaaucuuugcauuauuucaccauuuuugguuuuuauaaauuaugcauuuaaaaugcccuggaaacauuuguuucaguuaccaaaugcaggcugauuucuauuuuggaagaaucagagccaacaagacacacagacacacaaacacacacucaaaacccacauaaaaaauuauuugauacuauuacuaggcuaccuuguuggauuacuucaggaagaagaacauaaaaccauaauggaccauuauuuuauggggcacacagcagaacacauuggagagagcuuucagaugauagaaccaauggggagcaucaucuuguccaaucuuuauacauuuuacaauauaguuauaccuccuucuacaaauuucuauuuuuuaaaauggugaauucaaauuaagacacugaaccccauuuaacacuuuaccaaaaugauaacagaagcaggacaucuugcuucuaacauuguucaggaaucauucauccuguaucguuuauaaacaaacacauaaacugcuucuaauaggcccaguacacacagaguaacuuucuagcugaaucauauccugcaguuuacauuaaaacugaauaaaugauuuuaacuccuaaauacauuuuggauucagcuaauaacaaagauuuuuaguccaauaaauucuucuuuucuuaacaaggauaugcauuuauuugagcaaaauauagcucuauauguccagaagguagaacauuuucagggaaauuuuuagcuuuauauuaaauuagaagugaaauguacacagaaauugugcuauuuccauagucuuuucauuacaauuuauucauugaaaaaugcucugagaaauggaaauuaugagaaaaaggcauugaugucaguauuuggucauauaauacaaauguauuuaucacuuaucaguuauguaugacaugagcauugcaagaccauccacauuaaauucuaacuuauuggauuuaacucuauugaguuuuuaaaaagucuagaggugaucuuugcacauugauuuuguauccugagacauugucaaauuugcuuaucugcuuaaggagauuuugggcugagaugacuggguuuucuacacauacaaucaugucaucugcaaauagagacaguuugacuucuuaucuuccuauuugaauaccuuuauuucuuucucuagccugauugccccggccagaacucccaauacuaugucgaauaggaguggugagaaaaaucacaagcauuccuauacaccaauaauagacaaacagaaagccgaaucaugagugaacucccauucacaauugcuacaaagagaauaaaauacuuaggaauacaacuuacaagggaugugaaggaccucuucaaggggaacaaaccacugcucaaggaaauaagagaagacacaaacaaauggaaaaacauuccaugcucauggauaggaagaaucaauaucaugaaaauggccauauugcccaaaguaauuuauagauucaaugcuauccccaucaagcuaccauugauuuucuuuuuuuuuaacaaccccaucaaaaaguuggcaaaggauaugaacagacacuucuuaaaaagaagacauuuacguggccaacaaacauaugaaaaaaagcucauuaucacuggucauuagagaaaugcaaaucaaaaccacaaugagauaccauuucaugccaguuagaauggcaaccaguaaaaaggaagcaacagaagcuggagaggauguagagaaauaugaacacuuucacacuguuggugggaguguaaauuaguucaaccauuguggaagacaguguggugauuccucaagcaucuagaacuagaaauaccauuucacccagcgauccaauugcuagguguauacccaaaugauuauaaaucauucugcuauaaagacacaugcacacauauauuuauugcagcacuguucacaauaguaaagacuuggaaccaacccaaauguucaucagugauagacuggauaaagaaaauguggcauauauacaccauagaauacuacucagccauaaaaaaggaugaguucauguccuuugcagggacagggaugaagcuggaaaccaucauucucagcaaacuaauacaggaacagaaaaccuaacaccacauguucucacucauaagugggaguugaacaaugagaacacauagacaaagggaggggaauaucacacgacggggccugucaggggguggggugcuaggggagggauagcauuaggagaaauaccuaauguagaugauggguugacgggugcagcaaaccaccauggcacguguauaccuauguaacaaaccugcauguucugcacauguaucucagaacuuaaaguauaauuuuuaaaaagucuagaggguaaauuauaacaagaucauaaaacuguaauauuuuauggacauaaugcauucauuuauuguguucauuuauucaauaaacauuuuuaaauuaucaccuauguuucugauauugggccaagucuuagggaaauacauaaguuuaugacauaguauugaccaguucauaauuccacuaaaaucuugagcuucucuaaggcaggaaccauuuuaaucuauccuugaccucgagcacugaguaaauaaauuauuaaaagaagagacaauaauucagaauaaaaguagagugaguagaugacauauaaaaauagaaaguaauuuucaauuuccaaauacauucccuguguggucacugaagaaaugggaaguccucccauggugaguuaucacccuuucuugggaguucucauaacacccuccugacaugcugguuuuccagacucuuggucuguguagcacuugcugucauuuugguuuucacaggcagcucuauucucuaugguuaucuucauucacauaauauucacauugaauuacuguggaauccacaauucauuuuagacaguuuauuuucucaacagaagauaaaacaaacuuucucuucaaggcagacccauagagcucucuuuggcuuugguacauaggagauuuugagaaugaauaacuuuggaaaacucuacuccaaguaauagucuggacaauuccuuggaaaauacugacucuccuucgcuuccaaauguacaugaagagucuuucuuagccccauugaugacaggcuugaccauguggcugcuuugacuaaugggcauuaaagauaugucagagacacaggagugagaaauagauaauaauuguuacaugucacuaaaauguagugguucuuugucacacagcaucacugugucuauagcugacuaaaaaauggcauuagucuaacagugaucugugauuucuuucugagucaaaauauauuggugggagucauagacaaaugcuacuugaauuuuuucuagaacuccgaugcccagauauauaguauuuuaaugccuaguuauauaguguuacaugugauauugcauaauauauaagauaaaaauuuaaaguuaaccauuuaguguauaugugccacauuuucuuaauccagucuaucauuguuggacauuuggcuugguuccaagucuuuacuauugugaauaguucugcaauacacauacaugugcaugugucuuuauagcaucaugauuuauaauccuuuggguauauacccaguaaugggauggcugggucaaaugguauuucuagcucuagaucccugaggaaucaccacacugacuuccacaaugguugaacuaguuuacagucccaccaacaguguaaaaguguuccuauuucuccacauccucuccagcaccuguuguuuccugacuuuugaaugaucgccauucuaacuggugugagaugguaucucauugugguuuugauuugcauuucucugauggccagugaugaugagcauuuuuucauguaucuuuuggcugcauaaagucuucuuuugagaagugucuguucauauccuucacccacuuuuugaugggguuguuuguuuuuuucuuguaaauuuguuugaguucauuguagauucuggauauuaauuaguccuuugucagaugaguagauugcaaaaauuuucucccauucuguugguugccuguucacucugaugguaguuucuuuugcagugcagaaguucuuuaguuuaauuagaucccauuugucaauuuuggcuuuuguugccauugcuuuugguguuuuagacaugaagaccuugcccaugccuauacagcauggaauacuaugcagccauaaaaaugaugaguucauguccuuuguagggacauggaugaagggacaucauucucagcaaacuacugcaaggacaaaaaaccaaacacugcauguccucacucauaggugggaauugaacaaugagaauacauggacauaggaaggggaacaucacacaccggggccuguuguggggucgggggaggggggagggauagcauuaagagauauaccuaauauuaaaugacgaguuaaugggugcagcacaccaacguggcacauguacacauauguaacaaaccugcauguugugcacauguacccuagaacuuaaaguguaauaaaaaaauaaauaaauaaaguuaaccauuuaguuucagauaaucuguuccuuaucacagcaguccccaaaccucuugguaccagagugguuuugugguuuuguggaagacaauuuuucuauggacugagggguuggaggggauggugggacuguuccaccucagaucaucaggcauuagauucucauaaggagcaugcagcuuacauuccucacauguacaguucacaauaggguucacacuccuauuagaauauguugccacugcucaugugauaggaggaggagcucaggcaguaaugcuugcuacccugcagcucaccuccugcuaugcagcuguguguauagucaucuaaauauaaaaaaaaauuauaagguauuauuacacagugaaacaucaaaaaugugaaagcaauauaugcagacauugcauuauucauguuagaggcacacgauauguccagcagugguccauggccuggggcuuggggacgccugccuuaucauaaguauucuaacaaauauguuaaauuuauuuaaauauauauaaaauauagaaaaauaacacauaaauaucaacuaaacacauauauucauucaucccucaguauccauggaguauugguucuagaucuccucaaggauauaaaaaucuguauaugcucuagucccuuauauauaaaauggcauaguauuugcauagaaccuaugcacauccucucauauaauuuaacucaucucuaaacuacuuauaacaccuaauacuauauaaauguuauauaaauagcuguuacacuguauuguuuuuaguuguagcuuuauuauuguauuguuauuuuuuaguucaaauauuuuuaagcccucuuugguuaaauccacaaauauggaacccaugaauacaaaaggucaauugugugugugugugugugugucuguguguauucauguaaguauaaagaaaaauauaagguaucauacacacaaaaaaaucaaaaaugugaaagcaauauaaaugcagacuuugcauuauuucuuuuagaggcacaugauagugggaauguuaaacauucaaaugauaauacuacaaaaauguucuacucagcaaaggugaaugaaauuaugacaucuuuuuuggccuacaucaaaaugugcaacauuucuguaacacaaauaguuugaugauuacuuuauucuuuaaacaccaauaacauuuuauuuuuuauugagugccuaguaugcuucaggcacuggucuuaggacuuggaauacaucauugaacaacacaaagacuguucccuugugaauuguacauuccaaugcgagaggggagacaacuaacaauaaagaaguaaauauauaccaugucagauggagauuauuggauggagaacaguaaggaugguuaagaaggaaagaauuugagaguaaggggguaggauugccauuuuauauaggaggucagggagcaccuccuuaauaugguggacuuugagcacagacuggaaggaaaugaggauguaagcacgacaugucaauaucugagggaugacuauuccagacugaggaaguaucaaguaaaaagacucugaaguagggaugcucuugguuuguguuccaccaauuugaaauaguccaauauugcuagagcagauuggacaagggaggcaauggacagagauguggucacagaaguggcaagaggguugaucauuuagagacuuauaaaccauuguaaugaauuuggcucuuauucugaaaaagugagggaagugaagcauaguuguguguagcaaggauguaggauuugucuucuuuuaacagaaacacuauggccacugugcugagaaugauuuguaacaggagcaaaagccaaaaccaggaagaccaauuaggagacuacugaaauauuucaagcaagaaguaauguuagcuagcaccaauaugauaacuauaggagugaugagaaguauaagauuucagaugcauuuuaaaggcagaaucaacaagauuauagcaucucucaagacuuagaaauguuucucaaugacauugaugaacugguaauaguaacuguucaucaaauucacagauaagcuuugcaggaugagagcaguaaauagacaggaucuggcgacuuugacugaaagggcauuaaauaagauugagauuauaaggagaguaucagcugcauuucugagcaaaauguguauguauuccugagcaaaaaaggaaggaacccaaacauauucuuuaauaauuuauucaugugcugcucuugcugacauggaauuucuguuuugucagugagacuuuuccuuucuugauguucucuucacuugucaaauuacuuuugcuauuaggcagaguuuucuucucauaccauguuguuuaaucauuuuaagaaggaugacauuuucuuucccuucuaaaacagcuuuggccccaaauacacccauacuacucuuucugaaaauuacaguuuuucuaccaccccuccucccacaucuucugauuucuuuaagcuacacuauuuauagguaaaaugucucuccuacuuugucuucucauucuuuugcuguuaguuacuacuuauugugcauguucugauuuagcuuucuuucuccauaaauagaaguguccaaaacuauguuuuucaaaugagaaaaaacauuaccucucaauucuacaacuacuaucacuucccacuaggauguuuuuccccccuuguucauaaguucauggcaaguucauggauaaagcacacugguugcacaguuacuaccucuguugccuuagucuuugaaccauauagaaauauuaucacauuacauccuccaagaugcagguuugaguaggcaauugccaugucaaaauaaauggcgggggggugaaagugguuuaauguucauuuuuuacuagggaaucuauaucuguaguguuggaaaaugucauucgcuuaacauauuuucuguagucuugcuagacuucugacacugucacguaacugaaggcgggguugaggcagggagaaauggguaguuuacaacuauauuucuaugauauaaaucuuauuuuuuucuuuuucuuucuagauccugaaagcuuucuuuuucuucuuauaagacaguguguuuggaaaguaauucuuuagaauauauuagcaaaaugaauuauucauuuuauagaauuaaacaaugauaauaacugaauuuuaaucaacuuuuuaaauguucuuuuuuaagauuuuugaaggccauaguaacaagaagaaauaauaaaccauucaguaagcuaagaaaucagauccaguuauuauucugagagggaagaagucauaacaccccaaggcucccuucugccuuuggauuuacuauuagaucuuuggaggaaacuggcucugagagcagaaggaaacaugauccagugaggaacuggccuaagggaagauccaaccaaugcuauccucaucuauuaccccauguauauuuacugccauuacuuuuucaauugauugacuucaccuaucucgaauguauauaugagccuggcucauucacauuuugagagaucaaugugagucuuugauggcauaccauggcuuaaaacauagcaauaaacaucauggaagcucuaacaacauaccuugaaugauuaauacaaguagaaacauauuuucauuaauaaauuacaaaaaaauucuuauguuuuacagggaucuaaagagucugcacguuucuaaucuucauuuuuugaagauucacuaaaaauaauuuuuauuuaagaaaguuuauaacgccuucaauauuagaaaaaaugcauucaaauauuuuaggauuuguaagauuuguacugaagggcaauuuuauuuacaagauuguacuugcugauaauagagauacuuucagagaaucccaacuuuuacaauacuugcaaacuuguccaauauauccaaaucaaucacauacagcuauaauuucagcaugacugacaacagagaagagaucagaucaugaacaaguugaaagaaagaaaguucggcaaacagcuaggaaaacagugaaccauuuaauuccuguugauacagcugguggcccaauaaauuucacacauauuuuacaguggaugcaucacuggagugagcauugcugacuacaaggggacagcuauuucaagcuauaauuucaccagugcuaaccguugucaaaagaacaauaugaauaaauucugcuuuaacaucagcaaacuacucaugauguaagccuuucucuucuuacugcacuuuuauucacuucaugagucacagguaacucauccauucauccaucaucuauggccucuaacaugugcauacucaucaucaacacaguaucagaucauuuauaccacaauauaaugacuaaugauagcuuaguaaauucaaccccuugaaaaaguugaauauaauaacauugaacuugaucuuaggaaaauaaucucuuagguuaauaguuucaaacaaugaacagauuguuauugaggguuuagggaguuagugcuggagauuucauucauccuccuaaaaucagaauucauauguagucauauaucucugcgcuccgaaaauuuuuuuaccaaauaauuuuguuuuuuuucuguaccuuuucaaacauaagggaaucaaagaucacagcuuaguacucugucacauugaauauuaaauauuaaaaaaacauuaaggucaaguuaacauguaaaauuucacuuauugucuuucuugugaaaaagaaaaugaccucaucaauauguuuaauguaacugacaugaucuuuuauauacccaaguaauguaccaccacaguugcauauuuuccuggaaaggauaccuuuguguuacauacacuuuucacauuuuuucacauugaacccaagccucuuauuucuuguucaaagaggaauauaagguuuaccacaucugccuuucagaaagauuuucuugauuacgcuaaaaaaaguaggcuauggauggaauucugggagaguaaaaugugauauacucauccagguuuuaauuaaauuaaucacaugcuugcagugccaaggcaaugaauuuuuaaaaauucauuuuucuuuuuugcccaugucuuaucaugauuccaugcccuuaaaaggaagcaggacuaugauacucuauucucuaguaauaauccuaauuuaauaauagcuaauguuuuuauugacaacuaacucagugcaaagcaguaugaagcauuuuccuuaaauuauuuuauuuucuccauacaccaauccuaugaaguaaguacugucuauuuuacaggugagaaaacugggauuuagaaggguuaaguacuucagacaguaaauguuagagcuacguuuguugcacugcaaagcagugcuuuuuuacugcauuauuucaccacuguguaaauguuuaaggucugggggaagcuggagguacauuacaaacuagauuauuuucauccccugugaaugcugaccagaggcuuaauucaaugugaaagucucuaagucauaaagauugugauucaacuauauuuuggaaguuugauuuuuuuaaaucuuagcuuccuuuaaggugaaauuaauucauuaggcgaagacauauuugcuucauaaaaagaguugguugaccuuaugauauguuucuaugagaucuauaaaaaccuuugaaagauugucauuguuucccacccugaguuucaaccugucuucaaguaagaaauuuuuaacuaccuauaacucuccuccuaugaaacaauaauauauugaacacaucuuauauuuuguauucucugugagguacuugaaaucuuaaaauuuuuccaaagacuguccauuugacuaaggcugccuuaauguaguauguaaauccuaaauacagacuaaggucaacaugcuuauuuuccacagcguuuucaaaccauguggauucuguaggaccgauuuuuccucuuuauagacucuaaauucacuaaugcucuacgggcaauguuauuuauacuguugcaguauuuaacaugaaacacauuacuacucuucuucucugggcacccuuuuuuauuguugcaguuauuuaacauggcguguucauaaucauccaucacuuuaaggggauagggugguguucaaauucuuuugccauuggaacucuaaaguuucauuucaacuaccucaacuuaguaaggauauuaaaauaauuauuggauuuacucguuuuuaauaauaauaauacucucuacaugacuaaagcucccauugaggauggcaugagagaaagaagaucuuugguagcuauugucaaguaacuaagaaaaugaaucuugauuaggcuuguugggugccaagugcagaguuucuguuucuugcaccugcagagccuggagauuuggaugaagacacuuucauuaucuucauccugaaaugacuagcuaaagaaugcaaagaaauaaucccacugagcaaauuagaaaggaagacuccuccuuugugagccucuaaucacacagguauuaaauaccucaugcugacccuuucuuucacugcuggcuuucuccaacaucuguuccuugcucuuacucacaucugucuaauaacauuccucugaaauugauuuuauuuccacugugcaauugcuucagcucacaguccacuccaaaggaugcuauucuacuggugaauuugagagacucuagcauucacuuuccuugccacuuuaauguuauugaaagguuacaucuaagaagaacacaaggcuauauauacaaaaagaaaaacaguucuggaaacauaaacacaugaagaugcauaaauuuauuucccuacucccagcaaaaacagcuuacacuucaggugccaggccaaaauucacagagcaauggagggaguguaguaguaagagaaauaggcucuggaagcaaucacucagauuuuuucauuugaucaucuuucuaagaaagagcccacugugauuacuuaaaacauggaauauuguaguggaaaaugaguguuuuguacaacuuggccaaauauauuuauaauuuuuuacuguacagcuccaguuggagauuuaacuagucauaauuuuugucagguacaucuguuccagggaaauaaaugaccauauccuuauggcacaaauaauugaagccuucuccuuacaugaaaucugugaguacauuauagcucaugagcccuuagaaaccucuugagccaguaaugacaguucaccuuaaaagucacggacaacauaaccuaugauguagaauacagcuuagagauccacuauuccaguaauuugacacaugcagaauauaucccaagaaauaucagacccacaaaaugcucaaauaaaaccuuauagaacgcugugaccacauaaguuuggaaaagggucuguccaaaaagacagcagucucuaaccuuuuuggcaccagggaccgguuuuuuggaagacaauuuuucuauggacuguggggugggguagaagauuuuuucaggaugauucaagugcauuauauuuauugugcacuuuauuucuauuauuauuauauuguaacauauaaugaaauacuuauacaacucgccauaauguagaaucacugacagccugaguguguuuucuugcaacuagacagucucaucugggggugaugggagacaguggcacccgaaguguguugcuuuuccagucuacuccaugaucucauuuugguggcugugacugcagaaaacccugcuucacaaagacaggauguuggaaauggaagcagguuuuucaguccuuuguggcaacccaggauauucugucuugaccuuaauccagaacuuauggagauuugagguugucccaaacauacuuuuaaggccacagucauuuguaaucucaaguaagugagucuuuucuggcagggacaaagucaauacaccuggcuuauucacaaaugggucgcagauccauuccuuccuaguucgggugucuuuugugauuaggaaguaaugcucaaagucuuucgaaagcugagcaagacgaucaugcaccagcugggagaaauaagguccuggcucagccucuuuuaaaaucucugcuaauguuugaaacaugucaaaaaucccaguguucacuuuucgcccccauaauuccaguuuggcuuugaaugcagccacuuuaucugccgaucugaacacaguugucauucuccccuggagugaaaggcugaguccauugagcagguugaauaugucacauaaguaagcaaguuuugcgacccauucuaugucacugaaaugugcugccauuggugacuguguuucuaaaaguaaucucugcaguggcuuucauaacucagauacucugcucaguuauccaccuuuagaaagccaucucacuucuguguauaagagaaaacaugugugcucuguguccaucuccucacagagcuguggcaacagaugugaguuaagggcauguauuuuaaccugguugguaauuuuaaucacauucuggaaaaugauuuuaguucagguaacauuuuccagcuagccagcauuuaucuauggaugacacgguguguagacuuacauucagaagugaccuauuugacccgaauagugaaaccagaaagcugucaagucauggcagcaacuccguccaugcauauaccaacacaaaauaaccaauucaguuuucccgaauucagaggcuugaauaguccugcagcugugguguugguuggcaacgaaagugcacauaacauauccucacgaacauccuccugaaaaauauaucccacauaaacaagcauuguugccuugucaacaucaguagauucaucaaccuagauuguguaccacagugauucguuaauccucucuaacaaucgugccuuaauauccucugcuauuucaucuaguuauggugcuagccaaaggaggaacacgugccaccuuuugaacagcagccucuccuaaaaguucaugacaaauauccuuagugguaggcaggaucagcucuucaccaauagggaagggcuucuuagcuuuagcaaugugguuagucacgagaaucaugcuuuuggugcagacacauuugaugaagugguggccuucaauaauugcuucuguucuuuguguuuauguuuuuuuccuuuugaaaaacuccaaagucuugucuuuuaaugcaaggugcuuggucuccaugugguacagcaguuuugaaguuuucauggccuuguuggauagccagucaccacacauuauacaaagugggcuuggagaaugugaaucaccuguuacaaagaacuuguaauuuaaguagcacucuuguuauuuucuuuuaaaugcagcuuucuuuuguuggcagucuuagaguuguugggucuuuuccccuuuucaaagaagcucuccagugauguuugguuuuuacucauuuuggcuaggguuagcuugugggcuuaccaaaacugugacugagacaagugcgcaguguaggaaaaagguacagacagaagugguaaauaaaauaaugugugggccacaugcagacuaaagugucagauucugacuuaaagccugccaccagaugcaguugugcaauugaaguaccucaacuuauuugccacuauaaagccugccaccagaugcagcuuaauuguugcuugccacucacugauaggguuuugauaugagucugcaagcaauugauuuauuauggccuauguguauaauucucuguuaacauuagucuguauuugcagccacuccccagugcuagcaacacugccucagcuccaccucagaucaucaggcauuagauugucauaaggagugugcaccuuagaucccuugcaugugcaguucacaauagcguucacacuccuacgaaaaucuaaugcugcuguugaucugaugggagguggagcucagacaguaaugccagcgauggggagcauuuguaaauacagaugaagcuccauuugcucaccugccacucaccuccagcuguguggcccggguuccuaacaggcccgguuccuaacagaccccugcaauaaaagauucauaagacauacauguacaucacaauuucuaagaaguaauguagaaaguaauccucugggcauuaucagacaugucuguacccacaaaauccuuuuauuuauacagaguaauaggguucagaaugguguaaacuuggaauccacugaaaauucucagucaaugccugcuaacuaaaaugaguugauucagguccaaugugagcaaugaucuauuuaauuacauucuauccucagcuucugccuuuucuaugcauuggccaaugacuuucucauuauccuaaggauuacuacaacagccucguaguuauucugccgguuuccucuccugccucuuugcagaccauguuccacacaacagacaaauaaucucuguaggauuuuaacuaaaucaugucacuccucugcucaaaaucugcaaaaccuuaucagcuuagaauaaaauucaaagcuuuuaccaugggcuacuagacccuauagaaucugggcuccagcccccugccccaccuucucuucuagauuauucucaccuauucuacucaagcaaugaugaccauuuugcuauuucuaaaacaguguguuaaaccuaauccuguuaaacauguuuccaccucaaguaugcucuccacucaggaccuuugccuuuccuuuuucuuauuauaauuuucuacgaauugccaaaugauuccuuuucucacaucauuuaauucuuuguucaaauauuaccuuaucauccaggaucucugagacugcaacauaguaaauaacauaucuugcucuuccuuuuucuuucacccugcucuguuuucgucuuaguuuguaucacuucauaucagcucuaugaggccaggaauauuuuuuuuuucauuaaugugaucccugauaaaauauguguugaaucaacagaggaauaaagaauaaauaaauggaugaauccuuuucuuuuugaacaaguuauuuccaaaagaugcacaguaauaugaguauguaauaagaacuuuuaugucuccaaguaaaaucaauagagguuuuugguucaaguuuauaauuuuagccacaaagggauagccucaugagaaucuucucuccacauugauuacuucacaacacuuggaccuuuaacucuauaccuugcaaaaugcucuuaggacuuuuucuuaugcauauuuauucauucuuuauccauauuuccaugugacauuuuagauaucuuuccauuuucgguguccaucauagcagcccacgaagcccuagauaacaggaucaugucccuuuaacuugugugguaaagcacccaguacugagccguauguacacuguacugcacaaaagccuuuuaaugaugaacuagauuuugauuucgguucauuacgccuggguuuucaggcaauguuccgguuuucaggcaauguuccggauuucaugcuuuuguuuauaaugagucauggcccccuugacaaacaagagaguaauuaaacuaaccagguuaucaguagaagcuugugauggaucuccuguugcauaugguuauuucaucuucaauaauaguuagauaucauaaaagauuacagucuguuugugugacaggaaagagagauuaaagccuaugagaacaauagugaaaauacaaucuuaccuguaccugucaugagcagugucauaauaauugacaaguacaugaaguuuuauuuauagauuuuuuaauauauuuaauuggcuuuugcaggugacaugaaauuuugcuuaacaaaacaauuuuaaaauuaugaaaugauuucuuguguuugugaauauacguauauguauacacccauauauagauaaauguguauauauaaggguauauauguauauguacauuauaaaaguuauacauauaugauuuauauauauauaaaacuggguguguguuuguguauauguguguaucuauauuaucuuguaacaguucucaugcaaacauuuuuuggaaauauuauuucauuuuuuucaccaauuuauuagcaaguacuuuagcaaaaauauuuuccuugcaauguuuucuagaacuauaaauaauaagaauaaaaacaccacagagaaauagaagugcaauaauuucaaaaagaaguauuucccuuaacagaaaaugauguauuuccuaggguauuuuuuuaguugaaaggcaauguuccauuguaagaguuuuuauaguuuucauauguugaaaacuauauauucaguauucacugaauauugauaaaccauuaagugcuguacuuuuuaauugcuuuccaaagaaaucaaaauacauccauagugcacacuuaggccauauuucugaaugaacuaguuuuuguaucuucaagauucuaguuguugauuaauaauuuucuauaguguuauuugaaauaugaauuauaguauguuaaaaacuuggcagaauaggaaauauuuaugaaaagacgcaugcauacaacuccuaauguuucccuccaaaauucuuuuuuuuuuuuuucgagauggaguuucgcuuugguugcccaggcugaagugcaauggcagucucaauucacugcaaccucugccucccggguucaagcgauucuccugcuucagccucccaagccucccgcuucagcugggauuacaggugcccaccacuaugccuggcuaauuuuuguaauuuuaguagagacgggguuucaccacguuggccaggcuggucucgaacuccugaccucaggugauccacccgccucggccucccaaagugcugggauuauaggugugagccacugcacacagcccccuccaaaauucuucuauuuacuguccuuuucaucucagucaauaaccuuccagcuacucaagccaaauuaaaucacccuugacuccucuuuuuuucucuaugucacuucagucugucuagaaaucuuaucagcuccaauuucagaguagaccacaagcccgauaacuuuccaccacuugcacugcuaccacccuggagugagccacccaccuucauuugccuugcuuacugcauucccuacuuuaucccuagacuuuuauccuagccucacuauggucuuuucucaacacagcagccagagucaucuuuucaaaaaaacaaucagauuuuaucuguacucugcagggacucaccauuugucuuagaauaaaagucaauuccuugaaaugaccugagagguccuacccagucuuccauccuuuguuucucuuugguguaaacuuggaauccacugaaaauugguccuaucuccuccuacucuccuucuuucucuuugugucggccacaccaaucuugcuauuuauuaaacaaacuuggcuagcuucagccucagugucuuacugcaagcuguucccucuuccuucaagguucugucucuaaauauccacauagcuaacucacucauuuacaucuagucuuugugcaaguuuugccaucucaaugaggccuacucagauuacccuaucgaaaauaguauuccauuccauucucugauuccucuuaccuugcaacuauaaggguuuuguuuuuguuuuacuguauuguuuaucaccuucuaacauuuuauuuaaacuacuuauuugugauauuugcuguuuauagucugucuccccauuuguuaccccaucuagaauauaagcuucaucacgucagggcaauuuacugcuuuguuccuugagaaaugccuggcacauguugacagcugaauaacuaugugaaggauaaaaaaaaaaguuaugcuacaaaaaaagcuuuuuaagcaucacacugugcuaggcacuguguaaugaucuuggaauauacaaagaaugaaucagauauuuaacccugccuucaaggaacugaaaaggaaaucuggcauacccauaaauacaguacaugauacagugcaauacauuucuuuuuuguuuuguuuuguuuugagacggagucuugcugugucgcccaggcuggagugcaguggcacaaucucggcucacugcaagcuuugcccccuggguucacgccauucuccugccucagccucccgaguagcugggacuacaggugcccaccaccaugcccggcuaauuuuuuguauuuuuaguagagaugggguuucacuguguuagccaggauggucuugaucuccugaccucgugggccacccgccucggccucccagauugcugggauuacaggcgugagccaccgcacucggccaaugcaauacauuucuaucaauacaugauagaaaguugaugguaugagagauccagauacucagaggcggggaaacuuuuuccagcuagagcaauagggaagagcauggggacacugaugccuaauauggaucuugaaucuguggaaauggggaacaacggcauucgggcagaagaaacuacauuaaagaaaaaaucacuaaauuacuaaagcauagggaggaggcaggaaaaaacacagaauauuucaagagcccaggcuuugaguuaacaugccugacuucaaaggcaaauucugcaacuaaguagcugugugaccuugacaauucauuuaacaucucugaacuugacuuuucacauuuguaaaauugagauaauaccaucaagcuuagaguauuuuugugaggaaaucgagaauguaaagcaccuagcccagugacuggcucccugugaucacucaauagaugagaacuauuacugcaguagaguuggacuggaguacagauggaguguuacccucaccaaugccauuuuuccaguaggaagcaaggccaaaauguauugcauuuacucugcacucccugaaaacauucaucuauuguucaccuugaaaaaugaagcugaaaaugacuagucuuguauuugaagcauaaaacacugaaaaugugaugcguuggucuaucaggcauaagauugcuuugaauauagaaggaauaaaaauauaugugugucauauuucuguugaggauuauuuuuacuuaucuacuaguauuuguuuguuuguuucuuuugcaguugcuccuacuauucaggaaauuaaaucuggcaccgugacccccggacgcaguggccugauaagaugugaaggugcaggugugccgccuccagccuuugaaugguacaaaggagagaagaagugaggacuuugugauuauuacuguguucuaagcacuuugagcuaacgugcuuguguuucagauacuuacuuuaggcaauuucuuuaacuggcuugaaugauucucagcagccuccucuccagcaagcaaacugaaggggcccacgugggagggaugaguagcuaauagcauccagaagaaauguccacuuugguuuguaugaucucagaaaugccugcaaauccuccaucacugaugcauuucauuucuuccccucccuccugaaacugaguugcuggcaacucaguuuauuugggaaguaaaccagcucuuaaaggacgugaguacagcuuccacaagagcacuucaaaagcaauaggaacugcugucuuugccuggcuuccuugauaagccucaacccuuucaccugccuuauucucccacaagauaguuuaacauuuuguuuuacagaacacuauguuuuagauauucugucacuaaagaggcuguagaggagauaaaauacaugccuaaaggacuaaccagugggauuuuagggcugcucuuauuucaacucugugugauuacucccuugagaagacccaaaaaccuuggcaagagcuacugaauaagauaagacaggacuugacaacuuucucuuuacuuucaaccaguaggcucauucagacaucuucaaauucuguuaucaaucgaucaaaaaaucacaggaccccugugggugaacuguauagagucugcgucaaaacuagggaggaauauauucaagcaaaugcuagguuaaaccguaugaaauucccacuuucgaagucaaaaaagccaaauguuggcaauuccauacuguacaacauauauguaggggguuuacauacuguauuaguccauucucaugcugcuauaaaaaacugcccaagacuggguaacuuauaaaggagagagguuuaauugacucacaguuccacauggcuggggaggucacaggaaacuuacaaucacaguggaaggggaagcaaacacuuccuucuucacuaggcggcaggagagagaagucccaagcaaaucggggaaaacccccuuauaaaaccaucagaucuugugagaacucacucacuaucacgagaacagggugggggaacugcccccaugaucuaaucaccucccaugggucuuucccccaacauauggggauuacaauucaaauuaaauucaggaugagauuuuggguggggacaccuccaaauaauaucauuuacuuaugucauggcucauaaccaauugcagcuaaauagcugaacagaaaacuggugaaauuauauaaagacuuagauauuaccacaaaggauaagaacguaugugaugcaagcagguauuuuuuucuggaacuggaaucaaaagauuuguggaagacaauaucccuuuuuaacaucaaccuuaauaauaagggauaauauccccauaacagucucauuucuuuuuuuuuuuuuuuuuuuuuuuuuuuuuuuuuuuuuuuuuugagacggagucuugguuugucgcccaggcuggagugcaguggcgugaugucggcucacugcaagcuccgccucccggguucacgccauucuccugccucagccucccaaguagcugggacuacaggugcccgccaccacgcccggcuuauuuuuuguauuuuuaguagagacaggguuucaccauguuagcuaggauggucuugaucuccugaccuugugauccacccgccucggccucccaaagugcugggauuacaggcgugagccaccgcgcccggccauacagucucauuucuucugacugguuuuaccuaaaauuuuuuuuagcuauuuuauaugcaacuucuauaauuuggguuguuaaauuuuuaaauucuuuuuacuaauuuauauguuuuuacuaauucugaauuugccuuuuuauagcuuaguagaagacuccauauuuuuauauauugagaauuagauaaacuggucuguggucacucucauuucacccuacaauauuguacaucugccaauauagccuuucucagauuuugauaaccuagguugagaaguuucaguuuguaauuaucuauauggacaaauauccagaaaagugguucugaauccuuuauaaguuauggaacucuuuguucauguacaaucuuauuuggaagcccaagaaguaauauuuaugaacacagcacuucucgagaagaugcuggguaaauggagccucaauucuaccuguucacaacccuucucuaaauuaggacaucauugcaggaguuccccaaaucccugguucucuacaaaacacuguauaaguaacacugacagacuauuuuacauaccuuucaaagucacuuuuuaauuugugucauuaauuucuuaaaagcuaacaaucagagcuccuuuguuaaaggccauuuuguuuccaauauuuugugaagcaauguccuggauuuuuuuuuucugcucucucuuuuuaucuuuucuaaauucagcaaccauugucaaaaaaaaaaaaaaagcuacaguaauccucgguccacuuucuuggccuauaguaaauauagaaaagggccaauuggugcccacaaucauagcuucagugauuuuuuuuuuccuacuguagagauggacuacagcuuuuauuagauuuucaaaggaguucagaaccauuugcuaaaaaggaaaagguagauugauuuuccccaaucaauguccuccccaacacacucacacgcauagaaaaaugcagcugugaaaaucaaaugcacuugugaaaggcaaacauauuuucaguucagagugaagcauacauuuaucaucuuuaggguuauauuugaggcaauacucaaauucucaaauaucaugguaaugaauaauuucguuucaaaacuuaaguaaagcaaaguugagcauaugcagggaguaggaaaaagaaggauucugguugcugaaugguugcgcucacuaugcagauucaccauaaacgcccaggccauucaauuauuuacuucaucaaaaucaaaagcuagccaggcacaguggcucacgccuguaaucccagaacuuuggaaggcaaagacggguggaucacaaggucaagagauagagaccacccuggccaacauggugaaaccccaucucuacuaacaaaaauuagccgggcaugguggcaggcaccuguagucccagcuacucaggaggcugacgcaggagaaucgcuugaacccaggaggcggagauuacagugagccgagauugcuccacugcacuccagccuggagacagagcgauacucucucucaacaaaauaaaaaaugaaaaaauaaaaauaaauaaaaagcugucuauuuagcaagcaccugcuauuggacagguaguguucuaaguugauaauauuuacccauuuuacucuuauaacaaaccuguaagguaaauauuauuauucucaacuuuuaccuaaggaaaccaaagcauagaaugcuuuuaaguaauuugcacaaguucauacaguuaguggcagagcugggauuuaaacccaggaagucuuauaaaucuucaugcagaguccauggguuuaaccccuauacuauggcaccuaguguaggucaaggcccuuaagagucuaucaaaacuaauuugaaaugucaaugugaaauaccaagggcaaaagcauuucaaguuguuuauggauuugcaaaauaagaaacugcauguacaaacacucacuuauaauuucccaauuuauuuagucaaggacacagaaaaauggagucaagaggaacacagcagaaacagauacagcauguuucagaguugucuucuugaccucugaggucuuuaacugggaacaugaagcugucagagacccugucagagaggaacagaguuuauuucugcaagaucuagaguuuucuuuccuagagaccuuuuuugauuugaggcucacauaaauaaucagaaauaacuuauacgaucgcuuuacuucuauguaagagaauguuuauaaauauucauuuaucuuaaaucaagaucuucaaagccagcucuucauacagauaaacauaaacaaauaaacacaaacaaaaaacaggcagugccugaacacccauagcccuaucucugccugcaguucuucaacauccuguaaaguccauuucugugugcuaagagcaaucagcuuaaaaccccuuaaaagaaggaugguaaaauuaagcacaauuuaaagaaaagaaagaaauauacacuuacugaggaaaaaaaaaaaaaacacuuuccaguuucuuugaauucuuuuaucucauuuacuguucagaccucugugaaauaagauuuuauuaucaucaauuuacuguugacaaaacugagacacaagggacuucaccugaagagcacucagcuuuaugucaccaucaagacauuuuagaugugauaaccucucggcccauguucuuucccuuguuucugaugccauuauuaguuaucuauugcuaaguaacaaauuaacccaaaacuuagcaacuaaaaccaguaagcacuaacuaucucaagcagccucugugggucaggaauccaggagcaguuuggcuggaugguuaucacuccgggucucucauaagauugcagucaagaugucaccuggugcugcucaucugaaggcuugacuggggcuggagaaucugcuuccaagaugacugacccacaugcccaacaaguagugcuaguuauuggcagauggacucaguuaauugccacguggaugucaccauaggcgacgagcuuaauccaguauuagugauccaggagagagcuagauagaagcugacauguccuuuauaaccuaguuucagaagucaugcucugucauauccauaauauauuauuagcuauauggggaaaccuuauucaaugugauuucaugucaucaaaaacauuugcuuaauaggacuuuggaugcccugaaauugucauugugagaggggacagcacagggacaugaauaucaagaggugagagucaucugaugccaucuucaaagauggcucccacacugucucucucaugcauuaucuaaguauuuuuuauauuggaaauauuagucauguggcuuuuaguuuauuccaccaugagaguggcuaaugcuauauacuaguuauuaaaauauuaccucuuaggauaagguagucauuuuuuaacaugauaguuucuuucagcacaccuggaaugaagaguaucaaugggcuuaauuuuacuauguauuuauuuaagccuugggaaaauuagaguuauaaagagagccaaauauuuaaacuuuuuuccucaauacuguagaagguuguuaaguagaaauauacucuuuauaugcauaugcagugaaaagacaauuucagaacauccaaaguaucauuaagcaaacguuuuuggugauaugaaauucaauuaaucuauguuugagaauaguacauucauuuaggauuaaggcuaaaaacaugaauuguaauauacuggcauuucaauagguauuacaaaaacauggauugguauuacuuugugaagaugguauuaccgucuugucuuagaugagauuuuuguuauuuugccugcaccguugaauucccuccucuuuuucuagauuaccucaaauccaagccugaggucuagaaauacaugcuuucugauuucucaugaccauuuuaacugcuccaggcuuuuaggcaacugauauguuagcuugacuuagucauuucacaauguauacauauauaaaaacacuacauuauacccuauacauauauaaaauuauuauuggucaauuaaaaauaaaguauuaaauaaaugaauagauuuuaaaaauaguauuuuacuuacuuuuccuguuuuuaggcaaagggcuaauuguagaagugcuuuuuuggaauuuuuuagcugcaaccgcauuucuuuccuauuccucuaauauaauuuaauauagggaugaaaacguugcaaaugagguaaacauaaauuacuccaaugaaugaaaaagacauuaaaauuaucgauauacuaguuuaaaagcuguguaccuacaaaauggaaauuuuugcauuuggcaguguggggccuauaauaucuugacuuuuaagcaacauauuucaaacuuggccuauucucuuuuaagucauuccuuauaacacugcuauagaaaaaaaugugauggucauuaucauuuugcccuggugagaaggguuaguuaucuaggugcauaaaauaugcaugcauagacaaguacaaaaugugugcagauacgaaugaaugcauaggaaaauaccugaagucaaccuuguagaauaugccauguucacuuuacauagaggcauggugaccuuuuucaguaagguuaauguuaaguuucacuuuagauaacaauuauuuuucauuccugauuuuacaaugguaacaugaacuugagaaaucauaauaaagaguaaugaccauuccucuccucuuuucuauucuaaauauuuacuaccugauugucuaagcaagcuauaaauuuuaugugaguauuuacuuugcugcaggacugugggagggugggucuucuccccuucuuauauuuuugaggaaaccagcaaaaugaguuaaaauuuuuuuguauguaggaaaauuuugauuccccuuucuuuacuguuuucaugcaauuuauuuaugucaaaauuaugaauacauuacauuugcauagcagauuaugauuuucaaggcuuuauuaugugugguggcuuugcaaaauguucacauucguucacuuacauagagucaauucuuaagccuggggugcuacaugacagagagaggaagagagaaaaugcuagauagcacauauaauuaaacggcaugacuuacuacucuacugcuucaaaaauacauaccaugggagauaugaaacuggcucucuuucagugggucuucauucccauguaucucugauaguaugagcaucucucuauuuuuaaugagguuuuaauguugaaaauguuaguuuaauguaacauggcucugaaacaaagccaacuacuuuagugcucacucaucaacagugagguaaagcagggaucagcaacauuuuuuaaaacauauguucccaugaguaaaauaaaaaaauuagcaaaaacuaacaauauuuccauacugauuuuuacuuaugguuaugcauuucugaacuaguguauucaugcauuaaaugagcugagacagaaaauuuuaaaaaugagauaagaauacaauacaaauggaccuucuguuauuuuuuucucacacuccaacuagucauuuauuucuacuuuaagauacuugcuuuccauuuuggaaacuauuguaaaguaugguaguuugaaacaaggaguuuaaggaauuuucaagauuaauuuuaacaacaugcaacuuuaccuuauaugcugacuuugcuaucuuauaacacauauuuuacaacuuacuacauacuaucuuacucauuccuuguauaauucuaaccggauuacauaugauaauaaaaacuguaucuuuugaaggugaaaugacuugaaggaaagcagaccuaauuuccagacuccuaugucaggauaucucucuucuagauuuuacauuacaaguuugauuauucagaaaggacuagaaguacauucuguuucucuuuugcuuuuaucuuaucauucacaaggugguucuuaccaauguaggcaguuauaugcaacguaggcaguuauauguuuugauuuagaagaguacuagaaauaaccuuauuaccauuucagauuaacagugaucuucucuucuaacuucagauuucacuucuucauucaccuguaagauaauuugaaaaguuucacuucuucauuaaucugugagauaacuugaaaaggaaagaaaaguucuugaauugaagaaacuugcauuucuaguguuaucucauuauuauauuuugcuaugucguguuauguuguuuauuauuuuauuuauuucauuugauuauauuucuuuuaauaaccaauguggugucaguacaacucuuaccacguuugugacgacuuuaacauucaaggccagagaugcaaauaaauauaugaaauaacugaaagcauuucagcuacugggaacugaagagcacaugcccgugugagacacaaauacauauuauuacauugaaaacauugggucaaacaaagaugaaagugggccaccuccaguuuauauccugugacuuagaguguaggauuugucauaaaaaucagcaaaaugaaauaaguacuaaguaagaaaauuuucagggaacccuaagccaagaccugugaaagugcacaguaagagcccauucaacucaaauaaaaggguuacagaauacuucagggcaaauguagcuuuuuugcuggaugccaaaggaugaguagcacuuccaaacauuccacgggguuaagaauaaucaugggcggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggauggcgugaacccgggaggcggagcuugcagugagccgagaucccgccacugcacuccagccugggcgacagagcgagacuccgucucaaaaaaaaaaaaaaaaaaaaaaaaaaagaauaaucaugggcaagagaagaacgugaucaaugucauguaagcauuaugcggaagguuuuuaaaugucuuggugugcaggauaugaaaucagguauaacaggaguuagggcuagaaaggcaccuuagggaaagacuuggagggucuuaaauguuacaaggcauuuggacuggauuccagaaguauuggaaagcuauugaggggauuuucaagaguacuaaaacaaucuagucccuuuuuuguguguagcaguaguuuaauuuaauuaauuuauuuauuuauuuuagauucagcagguacaugugcaaggcuguuauauggguauauugcauaauggugagguuuggguuucuagggcacccgacacccaaauagugaacauuguacucaauaaguaauuuuucaucccucacuccucucccagcccucccacuuuuggaauccucagugucuauuuuccauuuuuauguccauguguacccauuuuuuaacucccacuuauaagugagaaugcaguauucgauuuucuguuucugaguuauuucacuuaggauaauggccuauaacuccauccauguugcugcaaaggacaugacuuuauucuuuuauauggcugcauaguauuucacugaauauaugugccacauuuucuuuauccaaucaaccauugacggaugcucagguugauuccaugacuucgcuauugugaauacugcuaugauaaacauacaagugcaaguggcuuuuuaauauaauuauuuguuuuccuuuguuuaguggaauugcugggccaaauaguagcucugcuuuuauuuauuugagacaucuccauaguguuuuaaauggaagcugaacuaauuugcauuucuaccagucauguacaagcauacccuuuucuccacauccacaccaacaucuguuguuuuuuugacuuuuuaauaauagccauuuugacuggugugaggugguauuucauugugguuuuaauuugcauuucucugaugauuagugaagcugagcauuuuguguaugcuuguuggcagcuuguaugucuucacaaaauauuucuuagaguaguuggaagaaauggaugggaaaguuaaaauauggcuuagaguauuagauaugcaguuaaaaagcaagagagaagaaagguaguauuugcuuauuuccgugacuaauuggauauaaggaaaggaaaauuugaacguaauucuauguuuuccaucuagacaacaagauaaagagugaagccacuggcugaggcuggaacacaggaagaaaguuuagggagggaccacgcucaguucgguuuggaacauacuagaaucaagggguuaguacugcacacacagagucuacccauaaacagcuggaauuagguuguguuuuuaaaaugcguaaugaucguucuaaaauaaauaguugaucuuacacuuuauguaugaagccugucgguguuucuucacugucccuggaauaaaguccucacaacagagggugguauguagguuucuucacauucuggccccuguauuccacucuggcuaugaaucuugccauucuacccucacacaacaggagcuguggcuauccugaaauauuuccauucccagacuuugauaugagcucucucuuucaggccucuucacauguuggcuccuuuguuuguaagccccuuccacucacauacccauuccuggcugccuuuggcuggcagccuuccacuaccuaguccuucagucuccuuggggaugucaccuucuccaggaaagcuaccacaacgagauuuuuucuaccugggagggagcucuucaaauguacccucaugggcucacaucuaacaagcacugauuaaacuaaacacaaccuauuuuacuuuuucaucucuccugcuaagcucuaaaucuaccuggaaaugaggauucugccuuguucacuaucauguccccaacgcuuaucaugguauuuggcaugaaugauacacucuguuggaagacugcguuauagccuuuuacuaaauauaaaguagagccauucuuauuuuaacacacuuucaaguuggugagagacuauuaguacaaaugaauccugucaccuuagauugcaggacauuguaaacccaauauaugaucagagaaaggaagcugauuucuguugcucaauucuggcuucucaggauuuuuucuuugugaauauaguuucugagaaaugguugugcuguuauauuaugggguaauauuuuacauuaaaaucaugggcauauugauauuagaaaaauaguucaagugguggggagaaauccagucauaggccagguugccagggauacaggaacucacagcagucagggaggcuugacaucuguacuguagccauuguuuauuuaacguaggguuaaaagggaauauccucccaugcgaaucaaauugucacaaggaaagcagcccaaauaucucuaaucuaaaauuauuaauuucauuaaaauugauaaaguaaauaagacaugcauuuuaaauagcuuaauaaagucuagauucauuaaaguguucuaauauauuauaauaacauuaauuuauucaaaugcacaacuaaagauagauaccccuuggggcuaagacagugaugcaugauauucuucaaccuguuccuaggaauaaaugauaucauauuguuuucaagccuuaaguaucaagcagcacaauaaaccaguagguugccauagcagcauauucacauaaauuuucguuucucucugguaucuagcaguucuugcuccuccuccucccuuucacuuuucuuuuuuguuaaaucugugaaaagcuuagaugagauugaugaugcacauguaauugauacugaguuuggcacaucuugaaaucaggaugccaugaucuuuucagucacucuccuagaucuuuucuuuaaaaauaauuuccugaaugcucaauauuuaauauuuuucugccaacugagaggaaauguaucuguucuaggaaaaagacucuaucauugaacaauaacaccuaucauaaucuagugccuacugcauuuggcauauauguacauaaauauuacacauuaaauauuuuuaaaaacauuuuaacauuaacacuuugugauuggcuucauuucucccauuucacagaugaaaaaacuaagaauuacaaaaauauaaaaacauaauucauucagacaagcaugcaacaauuacucuauaccuauucagaauccaacacuauaguacaugcuuagaauacagugaauaacaaaaucaaccuugaaccuugcccuaacagaguuauacucuaaugaggaagauggauauuaauaaaaaaucacacaaauauaugaaaacuuaaagcugaaaugauguuagaaaaagaaguauuugacguuaugaugauaauuuggccaagccaagcagaauacaguaaccccauaccaucacgauaacuggaacuuuacagagaauuuuaggauuacucuaaaauacugcauucuugucauuuggauagguugcauuuuucuuccauucuugacuauauucuacauauacacuaugaggagggacuuucuuccauccaaauauuuagugaaccuagaggaagaaaaacaaacaguaauugaugcugagaguguguguaaguuggagagagugugagcagggaaggaggagagaaccuacucuauguuucucaucucaggcuacaagaagccuggaaggcugacuaugugaagcuagacacagcugcucuaaaagccugcacugaaagacauaacuaagccccaaauacauagucaagaggcuucugguccagagauauauccagauaguaucauuuuuuuaguuaauuuuuuacccauuagacucaccucuggaucaaaccuggcuuuccuggcauaggugacacauaccacuuggcuauuuagcucccuugguuuuauuccuuggcuugacucgauuuucuugaaguauccaugauuucugauuugucucuccaaacuuagauacaauauccugguuucuacuuagcgauuugaaugucaguugcuacuuucggaggguaccaguagucagaggaccuauauuuaaaucuugauucugccacuugucagauggugcaagauaaauuaaccuaaucuucuuaaaugucuguuuucucaccuauaaaaugggacuaauaacaacuaccuccuaggauugcugugaagauuuguugauacguacauuucaacaugcuuaaaguuuucugugugucgauuuuucacacucguaacacgaaacauuauuguguacaaugcugaauuuuuuuuuuaauuuugggauggagucucacucuguuguccaggcuggagugcaguggcaggauuucggcucacugcaaccuccgccuccuggauucaagcaauucuccugccucagcccuccgaguagcagggacuacaggcgcccacugggauuaccacgccuggcuaauuuuuguauuuuuaguagaaacgagguuucacccuguuggccaggcugguaucgaacuccugaccucaaaugauccacccgccucagccucccaaagugcugggugagccaccaugcccagccacaaugcugaaaauuuuuaguaugagauuacuucagucauaaauguauugagaacagauaaaaugucccacauacauaaagcauuccuggucacauugaaaagacuagaaauacagucugauucacagccuacacacacacacacacacacacacacacacagagagagagagagagagagagagagagagagagagagagacauauauauauauauauauaaauaaaacuccauccuugagaaaggcauuauaggauguguuguggaagggaccuguaugcuaucuucaugucaucuucagaguuucagguagaacuaugguccuugagguaauaacuaugucauaauuuuccucuaugguuccuaacucucuuucagcauagaaggcauuuaaucguaauuugauaaccaaauaaaaccucauuuuuguuaaguccauguaagaguucuaccaucacucaugacuucuucuaaaucuuucucuuuuguuuuaauuugagcuguaucuuuaguucacacaacaucuuggaauucuacaagccuacagucuauugcugacauuaacauuccuugucuuuguaaauaaaacuuuuaugauucaaggguuaacuucccccaccaucuaauaccaaagauugauuaauaagaccauauuaaucuacccacucauauaaaaugauauaucauuaucauguucucucauaauuccagucugauaaaagauuuaucauuauuugagaaugccucccucacucuuauuccaaguuauucuaauauuuaaaauguugucugauacuucuuaauauauauguccuacauuaggaaugaagucuuucugaggcuguuuucaucugcaaguugguuucucuagagauaucuguuguuauuccugaccuggaaagacagauagugaacaauagucuuaaaauguggauugagacuggauuuauauauaaaaugaaugagguccaguguagcugcuccauuuauuaauauuuuuguaaucuuaacaaucagugcugauggcuauguggccaguuuuuuggggugauguugcugcaggcuuuucuggucaucccagauagcugcugccuggagggagguuaugacuguaaaguuucuguccauuuugugagucagaaauauaaguaucuguaguuaucagcaggcuuuccaugugcuacuucugacugacacuagaaaauauaggggacuauucuaauucagaacuaguuaguggguugggcuguguuacuuaugagcugacagccuuggcuagcaaagcaaauagccugugguucacagauuuaugaggcauuggcaaaagccagaagggagaagaggagcgagaguuaugguucucgauguggagcaaacuucuauuggugucagagaguagaggacagcaggguccacagaaauagaaggaucuuauaacuauauucccuaugauaaaaacgcaaugaagaaaaaugaccagguauuuccaaguaggcaccauauaguacugaucuaugcugaagaaauggaugucauauuuaacuccgagcucuacagaauuuguuucucuuuuuuuuuuuuuuuuuuuuguggcagggaggggcaggguuuggcaggggcuauaagaaagcauauuucauuguauaaucuaagucaauauaagaaugauucuuuuuacagaaauaaaguuauagacaaucauauuagaauaaaucaauuuuguaaagaaaaacaugucaucaauuagagagcucuuuuaucauuauuugguuuuagucaaggagugaaucacauuagggucauauaugcuggagcuucuagcuguggcucaaauuuauauauccaguaauuaaggguagauauguuuauauuaacaaguuccccacagugaccaaaauacccuucuguuguaaacaccuguuuaugugcuggauucuucuccuuggcucugaccuucucaagagcagagaucauggguugcccagucuugucccuagucacucagccagcauagagcucaucuuuguagcaauuuaaugaauauuuucagaauugauuugaauaauugagaaagcccgucuucauaccccagaacucuccaggaaaaucacaaaaguacauucucuagacauauacaccauaucagaagucacucucccacaaagucagcuuugcaaaguccuucuuccagccaucuaccagaugaagauagguucuuacgugauguuugaggaguuagcacuucuaaaacacacaacugcagaagaaaguaagcuuuagauuucucuaguaauuucagaaaaguagcuuuccccagagggaagaaaauuaccucggggaacuuaguuuucuuuuuuauuggccauaauaaccugccuggcugauccgaguagcagggguuggagcacuaaugcuccacucugguaaggaugcacacgguacugcuggccagaggcccaaaaugggcccacacauacagaguauggaugcgcuacaugauucagcaacaucuguggcugugccuucagauacauuuaagggcagggaacuggaagcuaauucacccagaaagacagaaagacagccauaaggaacauaagcauauagugccauggagugucugaauuuacuuccucaaguauuuccccugggucuagccaguugaaggcccugguuaauuucucucucaacucuucggcagguaaauaguccuacuguuggucgauggagcacaacagggauuuaguagucuagggaguuucugaguccucuggagaaugugucuaucacaaagaugcgggcaaauucaaguuauagugcugaaacuugcaaggcaaugaaacugguuuuuuacacagcauauauacggauuaguuaaaaacgaaguuguuaaugugaugcagaaaauauauaauaaugacuaggggaauuuagcauaaauguugcuaggcuaaaaauaugagagagaagaauaaaagcugccauauccaugauauuuuaugccccauuaucuuaugucagaguuggagaucauuaaauuuauugcucaagcuaaaguuuguucaauguuuauuuaacucacacuuuuauuaaucugauuaaaguuugcauuugggguaagccaaauucagcuauuacaugaaauauaaguaauucccagaguaaucaaguaugacugcucauuuuaaucugcauuuaacuacaguauauuucaucuaaauucaggugcaagccacacaguauaaugcaaaggaguucaaauugaacucucaggggaugccauuuauuagcauuuucauaauuuaaaaaaauacaaaaacuugaacacauuaaagagagaaaaacuacuaugccauuuggacuaucaguuuacauagccuauguugugaucagugcaucuccuuugcaauaaacuugggguaaauuguguagaaguuauuaucaaguugacauacucauuguaggaaaauuuauauuuaaagagauaauuucuugaagaggugacugaagcgggcuuacuaaugccuauguugggggaacaucaccugaauaccauugaccuuuguacuauuuauuauguauauaggauaucacuauuaagugcuuuguaggauucaaauaucagagaaagcaugugcauuuagccuuuccuuuugaggaauuuaaaacaauucaauguauuugcuuugaaaagacuuguauauauggaaacugcuagagagaauaguacaaaagaaacauacagagagagauauaagaguccuuuaagauaaauuagaaaaagagagauaagucuuagguuagaccuaaaugaggaaggaagaaucugacuagcagaaauagaagguacaagagauaggcuacagauuuagaaaaagggugaagcagaaguagguacaacaugcauugagaauggugaagccaugucagccuauuucagagugagggccucuggugguaaauccagagacuguuggacaauuaguuugaauuuggguauagcugaaucccaugcugaaguccagagaguuuuaaagucuuuccauggcacauuccuaaaaugugacagugaugggacucaacuuuaaaugcuaucuccaauacuauaugacugucucuuuuuagguuuaauggaaguuaucugucuggguuguacaagaguaaagugguguugacucuggacucagaacuauccuaucacaguuguaggguuaacuuucaagggaguuauuuaauaaugucugaaaugacccagacauacucucgccagcuuaccuagaaaccaucaguuuguacuuuccguggaaucuuuauauuuauuucccuuaaacuccuuccugacuuuaauagaugagauauuauugguaugguauguuucauuuucuaaaauauguaacagugccuaaauaggacauguagcuauccaagcucaguuuguuauauagcacaaauaaucccacaggaacaaucuacagcugacaugcaaccucaccucccccaaaucuacuaauguaagugaaauguaaauugcaccauuaucacguuauaugcuaacgucagcguaguugaauugucuauggguugccaugacaaccccagcuaagauaaaaaaaugaaacugguauucacaauacauauuuaccuagagcuuauuuugucuucuaggcucuucaauggccaacaaggaauuauuauucaaaauuuuagcacaagauccauucucacuguuaccaacgugacacaggagcacuucggcaauuauaccuguguggcugccaacaagcuaggcacaaccaaugcgagccugccucuuaaccguaaguaaugcaaugguaccaaaaugcuuccaggggccucugggccccuauccaucuguagagauaaaaccuaagaauggaguacguucauuuuaaaacucaaccugaugugacacauuccuuauacaucacgcaauccuuacacauggaaacuuugcucccaaaucauauaguuguccaaggauuuuauaaucccuguagaagucgacauguguuuaaaaaaauauguuagagcugagaaaggaaaaaauacauaaauaauagggcuaacugaaaaagugucuuuuggcugaagucaguagauuuggugagauuuuguuguuuuuuaaauguauugcauauucuugaaguauagauuaacauggcuugaauuuacucuugguugguuuucauaaaacauucaucuugggguagccagaauuucacaagccauacauaaaaugaaacaguaaguaaaugaucauggacaaaauauuuuauccauauagauaauauuuuuacucaaaauuguauuuuaaaauaaaacuuaagauuuuauucaaauaaauacuacauuucuaauguaucuuacuuccuaaggacuaaaaauuaauaaagaagcacaaacacaaggaucggguaaaaggcuagaaaccuccaugaauguuuccuccuauaauuaauuuuacugcuguuuagaagcugaguaaccaacaaauuguugcagccacaaaauauucuuaauuuugaaaucaaauguuucucaaaauguucaaagaagacuagagagaguauacugucuuuucagugccacaaaguuaucugaauuauccuuaucucuuagaguuaauauuuuaugguaacuugacaaauguauauuugucuuacgaucuuguuauaguaagcuaucucugaaaaaugcaaauauuguauaguucaucauaaauaucauuucuguuuugcagaaauggggaugggauauaugauguuccuacaacuuaaaaauauacuguaauaaguuuccaugauuuaugagcuuuacauuaccauaauuuaagaaugcugaugugaaauaaaacauaucaguuuauauuacaucuuuuauuaucccagccuaauauccuuuagcacucgauuugaaagaaaaacauugcuugccaugcaauaguuauaguauaauaugcuugcuuaaguuccuuccaugaggaugauuuauuuagugaaauuaugaauaauauaaaccauugaaaauauuauaaagcagugugaauuccaacuuaauguaaauauugauacuucuuugguauauuauuaauauuuuaaaugguuuaaauauucaagcacuugaaagaauaaaugaauuaacacggcaaaguaaagaaaaauuuaaggcuuaauaacauauuacguuuugcuauuuaaauuucuaaauuacauucugauuuucaaaacugaaacauuaaugaaugugaaaaauuaggaacaaaugccacuuguguaaacauuuguuuuacucuggcaaucuuaacacaaaugucuggaaauaauauagugcugaaaaggcuucuaaacguagugccuucagaagagacucucaucaucucucucugccauugacuugcuguaugcugaggugcuauuaaguacauacaauuugauuaauuuguuaauaaaggcaaaugugaaaaucuugucuguaauuaugaacauagcccugggaguuugaaaaaauguucauauauucagaaccccugguaugaccucaucugaagcucuuacugcacuaagcauuuuuauuuugucuuauaguuauuuuuauauauauuccaucucuccaucaaauuauaaguucuuuaaaaagacaggaucuaugucugauuaguuauuuuauuucccauaucaccaagcacagcaccugcuauuuaauaagcaaggaguaaaucuuuagugaauaaaugaauuaaacauugaguaaaugaauggauggauuaaugaauaaauaaaugagugaaugaguuuuagcuguagaauuuguacuuguaaccucuacagauacaaggcaauaugacuguaauuacaaauagcacauuguuagcuuacucugaaacagacccuauucuuauuuuuuauauaaacuuguucauuuaauucucacaaaauccaaagagcuagauucuguaauucuccucuucuagaaaaggaaacuuagagaauauaaauguggcugaagccaaaugguuagugacaaagcaaaaccuuaaacccugacaaucuggcuucagauucuaagcuuuuaucuacaaugccuacacccggcaaagcacggcacuagauguuggaaagaaaagggugaguaggacuggaaccccauccugaaggaguucucagaugagugagaagugagaaacagucaagcaagcaacgauaaugcaauaaggucagugguaccauaauggggcagagaaggugcucuuacuauagucucaagggucaugaaagaacuuuuaucuagaguagccaauaccacuaucugaauuauaucuaagguacaacucaaaacaucaucuuagcaaugacuaucucacuuucuggggcagaacuuugcaggagcucauucaacaacaaucaugugcacaaaguauagugacacaaaaaagagaaugaucaacucagucagucucaaggacucagggaaaaauauaaaggagaugccccuugagguaaaggugauuaggaugagccugggugugggaauggugauggaagaaagagagaggcaagcacucuaguguugaaccgcucauguaaagacauggcaguaugaaacaauucaauacauuugaagacacaauaguacuuuaaaauggcuagaauaaaagguagaaggagaguauugagagaugaggguagacaaguugacacgaugaagaugagagaguugaaaugaguuuuggcuguauccugguuuuggagaguuacggaaggauuuuaacaagggaaugauacaaacagauuugguuuccaaaagacacucuuaggcauuguggacugcuaaacccaguauuaaacuuuuaauucuaaaggcaaaauagcaauaauaguaauagcaccaaaaagaguagcagaggugagagaguugagagcuaauuaggagauagccauuaaugaccaaaucuggcaagaaaaggaagggaguugcaaggaucuagauaacugcuaauguuuaguuugcaugaaauuagccagaauaaguacauaagaaaagaauuaagguuuuuagauuuuaaaaggagguagaaauuaaaagaaaaaauuaggucauuucuagauauuuuuaguuugaggcaaugucuaauagguagcuggguauaaaguccagaauggagacauagauuuaaaguuaucagaauggaggugauaguuucagccaugagaguaaaugagacuucucauagaagccauguagagugauaagauuaccaagaacagaaauccaaguaaaauuagcaucgagugagccuaggaagagaagcauccugcagaagcaagcaaauucaguguggauggagaugccugaggagggucagcacuguggagugcugugaaagcugugagagcagcccauuuuaggaagaaugaagagucagcacuguccugugcuacgucuacucagggaacaucugaaaaucaaccacugucucugacauuugggcaguuaguuacuggugaccuuugccagagcaguuucuguguaaaacugagaguagaagccagauuucuguggauuaagguuaaauaaauagaugaggaaauagagacauggauaauaaauugcgcuuuucagagguuaggcuaugaaaagaagaagacaaggcugauguuaugccuuuaugucuagcugcuggucugauuaggauugcuuucugauuaauaggcccaauggcuguguguauaugagcagcucccugauccgcaaagauacaacacccuaacauuugaugaacuauacuauagugaacuugcaauguuuucuguuuuucugcaagucuccaucauuuucagcuuguuugccucuuucucaaaucuucuuugggugcgagggaaauaagcaaaaguuuugauuuaacaugaagacaacuuaaaccccuuuaucuuccauggccuguaggcuuuaggcaguaauuguaagaggaccuauaauuuuaaguagagguuuuaguaauuucaucaauagaauuacuuuaaauuacuuaagguaaaaauguauguuuucuaaaauaaagagaaagcaaacuuuaugguggaaaaacuacaggaaagcuaguauacaaugaagaucccucauccucuagauucucuguccaaaaauuccugaaagauuucuauguuguaaaaaguacaaaauuggaagggaagagaaggaaaggcagagagaauauugugcagaucacuguauauuagcccucaggaaugaagugcuuuaacaaaauuuauaauggaugacaguaugccaacuauucauagcaaaauucuuauuaaauaaaaaauuggggauucaaagauauuuguuauuuuauuguuauuuuucagugcguuuuuugcuuccugaacaugagcaacuaaaaaaauguuucuuccaagucuguuuuuuaaagacuaugaacugaguggucccauccugccaucuauggguucaauucaucaaauguaugcuaucacuuuagugggaauucaguaaucaguaaaacauaguuauuucuauaaguaaaacauguuguacacgcuuuguuucucacuuccacaaaaguacaaauauuuauuauaagacacguauucaaagacuugccaucuaaagggaaauagaauuaauuaagauggaagaaagcugcauaagcaaagugcuuagaauuuacacagccuuaguuuaauacaacccucuccugagaccuaauauauggaaauauuugguacaaauugagucucacuauugaugaagacucauugcuuagagucccaaaauagguaaugauaauauugcuaugauguguggaugcuaaacucccaucucagguguaccuaaaaauauagugucaaauccuuuacuguaguauagguucuacaaguccuaaugaugcuauagggauaucugugugugugugugugugugugugugcauguguguguguguguguacucguguaugcauuuauucaaaguaacaaagcauuugucucagaaauauuacacauaacacauucaaaggaccgaucaaaacugucuuuucccugccuuagcagccuuguggagacaauaaugaagucccaauuuuaaaugcuuuaugcagucagggcuuuuuaacuuucuggaaugucuccuuucauaucagagaaaauuucuucccagccuguuuaaugugaugggcuucuuuucuuuucagauaaaaaagaagucaguagcuaguauccaaaaggaaauggaagagucuacuggagaaaguaagagagaguaauguaacuguuuuucccugguuagauucaaccgaugcaagcgaacaguaccuuucaacugauuuguugaauaugaaacuagcuguguccuugcaaguaauauuucagcucucugcuugcuucagauguucccacaugccaguaagcaacuguaugggcucuguuacuuuuaccuauuauaaugaacccugaaaggugauaccacagaugugaaugacucccauuuuagauagaaauuuaucucuccucuugcaacuuaaaggagaugggguuuucauuuugguugaaagaggcaguaauaaauuuagacuuggugauuauugaagacagagugcugugugagacaaccugcuuuauccucgcagcuuugagauguuaaugagaaggcuuuccuuggugcucugguaauaaauauuugacaaaaauuagguuugcaguuguaggcagaauuugauccagcuacacaggccuaucaagucguucucuaccaaacaaaaauaacacacacagacauaaucaucacauaagucaugaaaguauacaaauuugcugaaguguaguaugaguaaagcaagagaauauuuuaccucuucaaucucauaccuggaacauguauguauuuucaagaagauagacaccaaauggucauuuaguggcauaugggagagacgauaaccagcaggcugaagcagucagagugacuguugaaguuuauggugcuccaggucaccaaauugccucuagugaaaaccacauaucaguuagcggagcuuuaguuacguuugucaauugacagaaauuggagcuagaagaugucucagauuuuacauagucaauucuuccaacuuucuuaagcaaugaaacccuuuauuccuccaaauaaaaccuaugcaaacucuuaauguauaacaaagauaaaacuggaguuaguuugguuaaguuggagacaaaucuuauuuuccuacccaucacauuacauagcggccuugaagccucucaaggugucauacaguuccaaauaauuuguuuugaaaacuucuugucuaaaccaguuuuuucacuuuauaggugaggaaacugaaacccaaauaggaugagucagagaccaaagucaagcaacauaacuagggcuagaauuucguuuuuacuacccuuguuccagugcuuuucccacuacacagguggaacaccaaaagcuuugaaucgagcagauccaaguuaaaacuauaauccuucaugaaggauuguagauacuuuagucaccugaccuauaaaauaggggaaaauaaauuauuuuuauaggauuauugugaagauuaaaugagaggacaugcaaaauggccaauacacuacuagucuaaaacaagugccuauuaaaugcugguuuccucuucuguccuucucauguauaauucaaauguugaaggguaaacacaggcaagcacagaucuauauaaccugaauaacuguguaacuuuauuucacuggauagacaaauuagcagcacugguccuuugauucauuuguuaaugcacuauguauaucauuaugauauuguccuuuuuauuacaauuauuaauuaaaucagccaugcacauaagcauucacuuguaaugaguaaaaaaaaaaaaaaaaaaaaaaagauggagagguuguacaagauuaauuacucuacugauguguuucucccagauugaggcaauuugacaguggcaucuucaagcuacugguacagcacauacauuucccacagcugacaaagggucaguaaauuuggaagggaaaggaagcuuugguauuugguguugucauugaucagccuugaaauauggcuugcuuaugaggauuagguaccaaaaacacauagaaaaauaaauuagaguuuccaauuuaaucacaaaauuuuacuagaagcccuacccuuggagucaaacuggccuuaaauuggagagcuccauagcaauuuacugccuggccucagcauaccaauuuauaauaugaggggacuagacuaacuagucuccauguuaccuuucagcuguaauguuuucagauccuaagaaaucuaugcauguuuaaaagauaguauguauugauugauuguuauuuuuuaaaguuaaacuuacuccuuaacaaaguagaagugcugccaauauuuuuaccuucuguauauuuuuguuauugaacucaaaauuauuuuuauucgacaaaaaaaugcaucuuaaugugcuugucucuguagugaguuuccauaaaacuuagcucaagagcacugcuggccuaaucauuuugucaucucuacacagaauuuuacucuccagagaaauuuccuuuauguucacaguugcaacaaccuuggccaguaaccuaugaaaaaggcacuagaauagacauucuugcuugcuauuuuauuucacacagcucuaauccuauaacuaauuaggccaaaaugugacuugaguauauggcguugugacuauuaggacuuuguaaaaaugaaaacaugccaacauuuccagucaaaagaaaacagauuaacagagucuuucuucaguaugacuuuccugaucuuuucucuuacaaagccuuuuggagguccugugagauauuucuuucccagcacuucugagaaguuucuuggagcauacuuaucaagcgugcacuguguucccuguaauuuugacuccaucuaaagugggauccaaugguuugagcacguaauaagguggcaaagucugggccacuguaucaucuucgcuucugugcugugauuucuuucucugaaaauggaaaugugaccccuaauaaaagauccaggaauacgugugaacaaaaugauuauuaugaaggucugaguaucauuaugauuaaacuuccuauuucucuuuagucagagugaaacauaguuacuaggguacuccacuaaacgaaaaaguaaauugaaauuggcucuuuuuuuggccauucugauguuccagauaaagguaaaaagaggaggaauuaacugugaaagcaauaauauuucagugggccacucuuucucuaaagcacucuaaauucaguuuuagaauccauaaaacugcuagggaaaagacugaaaauggcauguccucauugaaugugucuauucaguguggacaggguuuccuuucuuuauaaauguaauucaauugggauuucucugcagagauacaaauuaacuauccacccaguauauaguuagacaagauuugaauaaaccaagccagacuugcuugcauggaaauguuauuucaccuaugcucuggccaggcauuuauaguagguuggauuuuccgaauuuuagccuauuuuuaagcaacacuucucuuucaacaguuuuaaagaaaugaagcaacuucaguuuccuagcucucaaauguguuuuuuagauaguugcauaaucuucgguuccuuucuuugagucaauccaauuagugcauauguggagcugcuuaauuagugaggcagaucauaauucuugcugaagaaccauuaaagucacuaaucaguccacuuagaaugaauuccaaguuuucuaaaacacuuccuaagacaagaguaacaacauauauguuuuccuaaaacgggcagaauaauaguauuugcucuaagaauuagugaccauaacuauagggaaauuuguauuuucucaaaaaaauuauaacuccuugggagcacuuaguuuaugauaugcauacaaacuguagauaauaacuauaaucaaacugacuaacauuaacuaaguaaacacauuuuuuaggaagacuugcauaagugauagaugcacaucaacucugcaggcuugacucugcuggaaaaggauaaauugaaaggguuuauuucucucaggcuagcaugugccuguuggaggccauauuugacauccuuucuuacacccauuuugcuucauucugcagaaccaccuguauuucucuaacauucuuccugccagcaacaccugaaagaaugagccucacaugcuaaaauaaucuuaggcugccacauaucaccaucaugauaaaucuuccauuuauuauuuucguuuccuuguuaccauccuccuuaauucuuuucccugucuuauuguugugauagucauauauuuuuuaaaguuuuuuuuacguuacugacucacauuagugauaggcucucaccuauuuauuuauuuauuuauuuauuuauuuauuuuuacuuucuguaucccuuccucuuauuuucuuccucuuauuucuccucaacuccaggacuuaaucaucaccaaaagagacagauagaugcuucucuaaccaggaguauagauucagaacggaaccaaacagccucugaauagggaagcccaaaauugcuuuugaaagcuucaucacugaaaauguaaucaaacuuagcuuacccaaaauugauuuaaguugcagccuaagggccaaccuuugaccagggcagcguucacacuugcauugauucugccugcaauugaauuacucaggcaauucugugcgcuuucagcuuuagcccuggagugcaaauggccaauuugggaggcaacuugcuugugcuugaaauuugcagaaagauuuucucauacauuucuggggaaaagcaggauuacuuuuuuaaaauauuaucuuagucacagaauuggcugcccaaagcauauuuuguuuccuuguuuucauauuuguuuugauuugagaaaacuuuguuucccccagagaaucucuucugacuuugaaaagaugagaucugcuccuuccauauguguacuaaaauuuagaggaaaugaaaauuaaugagaaaaaauaaggcaaaauaauaugcugcuauuagauagagagaaaggccagaaacacacuccauuuuauaguucuagaggcaaaaguuaaaaaaauauauauaugguuaugaagcaaaauaauagucugugggucuguauaggauuguauucuaugacaaaucccucccuuucuuuccaaaauauuuuauaagauuggcaugaagaaacauuacaagaugcuuuucugcaucauaacagucuuuuguuaaacacuuauauuuucuauaguuuuucccuuuguacuguauaucaauuguacauuaucuacccuccucacaaaacuucuuucauuuucacauaaccauaccaucuccauguguuuauuuuacaauaucauuaaaaaaaucaauuguauaccuugcaaaaaugucuccauauuuuuauucagucuuccuaaguaauauuuuaauggcuucacuaugauacauuuaguggugaauuguuaaauauuuaacugaaguaaaggauguguguaggucaggcauagugccuugguccuguaaucccagcauucuguaaggcugaugcagauggauugcuugagcccaggaguuuaagaccagcuugggcaacauggcaauaccccaucucuacaaaaaauacacaaaauuaacugaaugugguugucuacaccugucaucccagcuacuuggaaugcugaggugggaggaucacuugagcccagaaggucaaggcugcagugagccgagaacacgccacugcacugcagccuggacggcagagugagacccggucucaaauuuaaaaaaaaaaaaaaaauuguguauaaugagacuuacaaauaguaagaaaauaugcaauuaucuuuauuguaaauuccauauagucaguugcuucucacagauucuuucacugauuuuuggcagaaucauguaucuguaaccagcccaugauuauaauccaugcaugugacaugcaugauguuccacauggagcuguauucuaccuaugaggauuauucuaacucgaauaagacaugauauuuuugugguaaugaguuagaugaaaauaaccugugcaacuuuuuugcugaaucggagaauaguuuuggaauacugcaagaaaauuuccccaauuuuuugugucgacauuaauguaauggccacagacaugacacauuacguuuaaucccuauuaauauucacuucaucauuuucuuaagucucgacaaugaacuaagcaauaaaucaaccuguaacuuggaccauuugccgguuuccaugguauaaacauucccaccauggcugauuucaagcuaccaagugauguuacugaaugcagaguugggaagagaugugccauaucacacaccauuuuauaauauuucuacaauacagacacagggaugcaaguaaccucaagauuauaaauaauaguaaacuguaguaaaguaauuuggagguaaugagguuugaauagcuauugcauuuguguuuaguaucauuuauuaauucuaaacuuauagaauucaauuuuaauaauggcuguauuuaauaaauaaaucgcagaauuucuaaaacuuucucaauuggccuuaaaagcuaguauaagccagcuuuagcaugccacuaucuacuugaauggcuauaaaggagaacacaauuucuccccauguaaccuacaugacucuagacaaauuacauaaccucacuuaucuucaauuaguccaucuguaaaauggaguuaaaggaguaacaccuagcucacauagagguggaagaauuaaguaagauagacauaaagugccuggcuccugguagggauuuauacauuauggccuuucuuuauccucuuauauaacuucagugcccuccccccauuauuucuauaauuuucuucacuuuauuuugauguaggaaugauucuauucuguaucuccaaaucuauauaaugaccucugacaaaauuaggauuuuauuuugucucuaugauaaacucaugccuaccuaaauauugucacaugcaugccacauuucuuuuuuuuuauuuuuauuauuauuauuauacuuuaaguuuuaggguacaugugcacaaugugcaggauaguuacauauguauacaugugccaugcuggugcgcugcacccacuaacucgucaucuagcauuagguauaucucccaaugcuaucccuccccccuccccaugccccacaacagucuccagagugugauguuccccuuccuguguccauguguucucauuguucaauucccaccuaugagugagaauaugcgguguuugguuuuuuguucuugggauaguuuacugagaaugaugauuuccaauuucauccaugucccuacaaaggacaugaacucaucauuuuuuauggcugcauaguauuccaugguguauaugugccacauuuucuuaauccagucuaucauuguuggauauuuggguugguuccaagucuuugcuauugugaauaaugccgcaaugagcauacgugugcaugugugugccacaucucuuguuuaaauuugcugcaacacaaaccaauucuuucuuacaacugacucuuacuaugcuucauucccacuccacaguagauuuuaagcaauaucauucauuuuuuccuaagguaugagaccucagaggaugcuuauuuugcaaugucuuaauucuaugaagccagagagaaaaacauauaaccuggucauaaaaagcauucauauauuagggcaaauaagccacacauuaacaucacaauagguuccaaauccauuguuaucuuuccucuaaccuggcuagaaucaggggaggaggaaucuauauguuaaacugcuuugaaauagguggaaucaguucccuuucauaucauccucuccacuacaaaaaaaaaaaaaaaaaucuuaaguaguuguauuauuuuguauuuuguauuaaaaaacuuaaguaguuguauuauuuuguuuuccaauucuucuuaauuauuuaaaggaagaaaacacauuuguagacugcaugcuugggacauaagauuaaccaguaaugucauaaucuuaaaacuucagcauuuuucacuuauuaaguuuauuaucuauaugccuagucucaugcuguguugggaauacaaaguugagcuaaaauaacuugauucacaacauuuuggagauugucaauuuugaaaagggguuuggcaacacaagcaauuaucacaaaauguaauuaauucuuaggggugauagaaagaaugacuaauauaagugaauaauagaaaucccaugugacuggaacacagagggcaauuacaggugaaguggacagagcugggugaaaagaaaggcagaugcuagcuucuaaaguggacuugcaaggaaauguagcagaaaugauaugagccaaaaacauauuuucauauacuauugcuagcuuuuaaaaugugagugacaaaugaacagugauuaccagaauacuguaaugcuuugguucguaagcugugucauaaugcaugugaaauuaucccaguuacuaagaugaagccuacuguuagucucugccuuaaauucucuacgacuuuugauauuccucaauguacuuauuuaucuucuccuuauauauuucuggaaaaucagauaugcuugugccaauuuuuucuuaaagaaauaguaauuacuucacuguugaucuauuaagcugaucaaauaguaagauaauaaguacugaacuauuuaaugaaauauuuaaccuuuuucuaauauaaccuucccuaacuuuuuucuaguacacuguuagucuauucauuaauucauaccauauguguuugaucuaaucucccuuuccuucaaauuauacaggauguuucaagaagccccccaaagacauuuaugagcaaaaucuuucaucucugaguaaaguaauaccguuaaauagucuugccccugagugaauccauuaagaacuuuucuauauagauguauaacaccuugucuugugauuagagaauugccugauugauaauggcaugauaacagcugauuaauaaauauuaaaacugauuucagugaccuggaaaucaccccauaaagauaguuuaccaauucagcuacaguuuguucuauccaaugaauuacuagccauaguauauacugucaccagccccagaucaaugaagaauuaaguucucuaaagaagaacuugccuuugcauguuaguuguuuuuuguuucauuuuauuuugcuuucauuucuaauaacuuacaucucuagucccagccuaccaucuuaaaacugguuauaauaggagcacgaugagagagcugagauggcuuaacacaaauccagcaucacuguuaaucagcaaguauaauauaaauguuuauguguauuauacccuacuaacugaugggugugagaaaagagaaguguuaggaaagaaguaucgcagccuuuauucaguauggcuccuguaagaucagacuuaguaucuaggcucaauuagagaauaaggaaaggcagaauguaaugcacugcuauaucuugauacagauaaucaugacuucaggaguucagagagaguguguaucaguacugggaaaaaaaauagcuccaagcaaguauucugcugauggugauucagaaucauuaucuucaaauauaaaggacaacauuauuaucuuuugugauuuaacaauaguugaauucaacgugagauaggccuagcuuuuaacaguuuuggaaaauauuauguuagguuauuguuguuguuauugucauuguuuacaaaggagaguucagcaaagagacaagcuuagacagaggacgcuuucagacuagaaauuggucugauuaccacauagauggauaacagaaaaaaucuggaaccuauuauaacauuuugaaaugacuguuuaaagugcaugugcauguauauagcuagauuaaaaaucacccaauauugauuucaguucuuccuggccacuacuauguguauugauuguaaccaaccccuucuaaaagaccaggagauacauagucaucuggguuucuguuuauauuucucacuucagaguggcuuggcuucuccuccaacauuguugacagcuuuuugaagauugcagccauguuauaggcuucuuccuaggugaucccuuaaagcuauaaaauuauagcgugacuucuuuaaaauaacuucugaaaucuuaaugucuaaaacaaaggucuagaaacaaaagcaaauuauuucaucuacauuuuauuucaccauuaaaauucuauucaaccaaagugcuuagagacccuccaccaaaaaggcaggaauauucugagaacuaauuuaucauuuuuuauucauuacuauuaaaauccuuugagacuugaaaagaacugacaaaaaaaauuacaauucugugaauaacuuucuagacaacuucucuaaagcaucuguguuaguuagaauuagaaacaguggcaagugacaaaacccaaaauaacaaugacuuaaacaacuuuauuuuucucucauauggaagcccacaauagacaguucagcacuuggaauagcaucacuguaucaaggacauagccccuucuaugauuuuuguuccaguuuguaacauucauucccaggguuauuuuuugguccaagguggccacuucaguucaaagcaucaaaucuauacuucagacuguaggaagaagaaaagagggaaggaaaaggucucaucuccuccuuuuauaaauacuucuccaaaucuguagacaucacuuacacuuauggcccacuggccuuuaccuacauggccacacuuagcugcaugggaagucagaaauuuuguucuucgcuaguauucuuugccuaaaauugugguuaucuuauuauaggaaaaggauaugauagauaugaaaagaaaaccaguagucuuuacuacagucuaccccuuugugaugcaaauaucuaggccugcccuuccuuguccauauagaacacacucauuccuaucaaagauagaaaaccaugguuucuucaucaagauucuagauaacugagggcuagaaucucugagugauucacauucuucuucaucagccugaaugugacauguugucugaugaucucuggguuaaaauaaguuuuuuguuuguuuguuuuuguuuuuucugucauacgcaaccccaaaauacuaugguggaauaucaaccagaaaacugcaauaggacucucauucugagaagaggagaacaacaacaacaaaaaaaacccaaaacagcagccauuuauacaccaaugaucagcuccugccaguuggaagagucaagauucacuuuuccagcaguauaguauguuccuuagauaacucuaugggcagccacucauucugugcucugggaagaacucucaaguucuuuguccucuguggcucuugucuguguccucuggaaguuguuucuuggacacuaugcuccaugacuacauaucaagaaagcacuggggcugagcagcuugcauggcccauuuuguaccgcugcagacuggggacacagaacucucuuuaaagguugaacaucuguaauagcagacaaggcucguggcuucuuugacaaaacaauuugcucaaaaaccuaguagccuuccaauacaguuaauuuaauuuguuaauaacauuagggaaagguuuugugcuuuuuguuuuuuguuuuuguuuuguuuuguuuuguuuuuguuuuuguuuugagccggagucucgcacugucgcccaggcuggagugcaguggcgagaucucggcucacugcaaccucugccucccggguucaugccauucuccugccucggccucccgaguagcugagacuacaggcacccgccaccaugcccagcuaauuuuuuguauuuuuaguagagacgggguuucaccauguuagccaggguggucucaaucuccugaccucgugauccacccaccucggccucccaaaguacugggauuacaggcaugagccaccgugcccaacugggaaagauuuuuaaguagaaaaggcuuugaaugcugauagcuccaaugccucacuuacuauccucuuuguuuucucucaaccaaacagcagcuacauugaggaaaucugaacugcugugguugguuggaagggcaauacccuuagucuugucugugcccucaaauuucacagacuucccacagcaaguguguuagucuucuuugaugucaagguugaugcuuuguagcuauuucucuacugcuuugguuggaggcagaagcaacugacuuuuucaauguugcaauauauaaauuaccaggcucuuaaucaauuuagauuguaggguguaugagcuccucccuuagcagagauauguauauuccuuccucucucuguagaucagcuagcaccauacugaguuuaugagugaaaguggcauaaugcaggcaacacauaugagcaauccacguucuccuauuauucuucuucccugaaaauuaucacauuacagauuuagucucagaauaauuuugucucaaacaacaaacaaauaguuguucuccuaaagaugucuacauuccauaauaccccaaaugaauagggaccuaagaauuauuaaaacuaaauggacccagagauaauccaaaugguuuauguauuuugaguucaaugagaaguuaauuaucuucaccgaauaaggcaucauauauacacagaacauaugcacaucacuuaauguagaauaaguaugggcuaagggaaauaaauuauuaaggcuucuaagagguucccaagucccuugggcuaaaauagaacauaaauuuauugauaugugcuguaucuuguaguggugagacaauaacaaagaauuccuaagacaugaaugcuauuuuuaagucacuaauuaucuauaaacucccaucaccuacuucauuucucucuccucuccucauuuuauucaauaauuucuggaagaaauuauuccagaaagaaaagguaguaacuauucuuuggcauaauuuguuaauggcagagccuagguaagaacucaguuuuccuaauacuuuauuuuuugcaacugugcuaaaaaagacuguagaaaucugagucaauaacugcaaagcgucugagauuauacccuacuuacaagcuaauguuagcuugccacaaucucacugaugcugguagaaaacacaagacuccugggucagagauauaaaacuuuauuucucacagcaaaaacaauaggcagaaagucaacauguuugugucaguuuccuaagccccaguucccauagggauagcauggcuggccauuauggauguguguacaugcaguagugucuguuacaagagaacaauauugaguuuagggaaccuaguauuuuccagaagccaguaaguaagccugcucuuuuucucagaggaagacauuacuucauccuguaagaaauggccugaauaaaagcauuuacuuuuuauccucuacuugggucuuucauucuuggcauucccaacaaaacagggaacaacaaagcaugcagcagugcaagagacccauaaaggagugucucccaauaaucugcagauauauagagauaaaaaugguagguguauccuuuaaagggccacacuccauuaaauagcuagguuuuaggggaauucugguuggguccuuaaaaggccuuuuuuaggucaccauaaucuagauucugggcuucgauuucaaaagucuagagagucuuucuugucaucugccuaggacuuagcagacuaugaugacagacugacagugucuaaaaaauauaagagacuacaacauauauucugaguagacccuagaauaucaauuuauuaauuuauaauaagaaauugacuugguuuauaauauucauauuggcaugaucagcucauucuguucuuaaaaugaacuacaagagaagccacaucaaagucagaagucauuuuauuaauucauuaugauaaaucacugucugaggacagaaaauuguugaagucuguaggaucagccauucauucucuguaguuagacuuguaaagaacaccagaucacaaugagaagguugcuuggugaccauggaaucagaaggggagauaaagaaauccaacauuuaaugguauuagccuaaaaucaacauugauuaauucaucuaaaaaaauggcaauuuugccaauagcauuaaauaugcauaacauucaauaauucugacucccuuuucucugagugguacauacuucguaucaaucuucaaauucauuccuuuucccuccccaauuuuccucugugacuucccuuuaucuauucuauucauguagcuaaccaguccuagaucucugcuuccuuucccuuaguguaacaucgaaccuacaauagccauacccauauuaagcauaccuacaguguuuccaaaccagaggcaaugucaucauguaauuuuguaugugggaggggaagcuccccagcacaagggaauuuucugcaaaacccuuauccuaauaagaauucugccucuggagguuucuuaaacuacgcuuauccaggaguacuuuccuugccagucuucacaguaacugaaaauugcuuucaagaugauauuaggaagccaaucuaaauggucacccuuuaucgacuauucauugauuacucuucuagggucccuuuaaggagguaacaaagcagaagccgaggugcuauguuuauucaguuauuagugucuagcacaaugauaugugaaaucaggcauuuauuaacuaguguuguuuccauaguaauaacuccaacgucgaguagguuaguacacuuacgcauuugcaaaauaaacuugaacacauagagaugaauuuaaaugaauauauacccacaagucugcuauuuaaagccuccagaccucacgcguacauggcugaccccuaugcuggaaaucaaugcuuaagcaggacuuugcagugauauaaaaugccuagcaauuggcaacacgagaugcuuugcuuuucucaauagugagaagaguuaaugugcaggguacuguuguugagcauauuauuuucuguucagaauacugaaaauaaguauguguuaagaguuugugcucacuuuagaaauagaagcccugugaaacagaugauaaugacguggucuugaucugaacagagccuuacguuucagcuguuuacuuguccucuucccuaggaggaauuagaauuucccagaaucucaacagccugcuuucugccuuuguuuagacuugcuauguguugcaagacuaauggguaauuucuguaguugugauuaagaaaaaggaacagagaucagaggggucaccaaugcuuagauggcuuguuagaguuuuaaacucuaaugaauaacuugugguagggcuaaauaaagcccguuuaaacccagaaaucaucaguauucuaauauaaaagacaaaggcuaauacucagagcuaauuugaaaaauuaaagcuccaaaauauggccuaaauaugguauaaauuuacagaacaaagaauugucugucagcccugcccaguuucagucuuauacuugauauugugugaaaauuagcuuaaaaaggaggcaaggcauauuacuuugugccauuuuuaccucuucaacuuuugaaaaaauguauacuccaaaaacugugaaguaacugcuuugugcauaaugagcucaaauuucagauuuuuuuuuuuuuuuuuuuuuugagacaggggcucccucugucacccaggcuggaguggcaccaugacaguucacugcagccuugaccucuugggcuuaagccaucuucccaccucagcccccuggguaguugggacuacaggcgcaugccacccugucuggcuaaauuuuuuuguauuuuugguagagacgugguuucgccauguugcccaggcuggucuugaacuccugagcuaaagcaauccacccaccugagcaucccaaagugcugggauuacaggcaugagccagugcugccagcaacauuuugaaaacuuuuuggugauguuguuguuguugcuuuugcauauuuuagccaauuacuuuguuugacuugcaucuuggcaaaaucaauuuggucaaucauauagaaaacugcuauuuauuuuuaaaaaugguaaaucugacuaugauucauaauagauguacuugugcuucagagaauuaugagaauaguccuguagugauuaaauaaugugauggugccuuuccugaauaugcuuugcgaagcaaauaaacacauauggcuccuccauuuuuacuuucagaaaacuuuagauaugucugucccaaaauauauucaugaauaagaaggaagugaugauaaaaugcuauucauggcuaaaauguguccuacuuucuaauaugaauuuucacaacauaucugaguccucuacccauuaaucuauguuuaaugcagaguucaaaaugaaaacuugcuuuuacuuucuuacauaccaucaguuuaauuugguaauuagcucacauaccuggaaucaaagauagacaucaguaauuuggcaauuagcucacauaccugguaucaaagauagacaucagucaauggugccuuuuucuaucaauugaaaaauauaaaaucacacaaacacaauaacaacaacaguuauaaaagcuuuugacuaagucauaagcuacaagcgaaauucuccauuuuuucaauuugauuaaaacuuauguuaauuuucuccuauaaacuaugaugacuuguuugaacaaauuuaauugguaugccuucaugugcuuuauggagagaaauggcuagagacauccaguaacguuucagaacauuuuucuuagaaaguaauaauaauaauaauaauaauaaggacccaguauaaacaaaguuuauaaguacuauuaaggaaaaauuuaacuguagcauaaaauaauuugaccacuggaaguaugcauuaacaaauaagaaaaguacuuauaauacagugauuuuguauugcaucuuauaccuaaaagauagacuugacuauugggcaguagccauaugucacuuuccaacuuauaaauguagauaauuuuacuucuuuuaaaaucauacagaaacaguauaucacuccaguuaauguaccaugggcaguuuuucuaagauauauaaaaacccccaaugagcuauaguuuuaagcaaggaggacaaauuuauaguucuacaggaguaccuguggcauugggguauaaccaucugucacuugucaaagaaaaugccauguacaaaaaaauccaagccauacaacaaauuagaaacagcuucuuguuuaaaaauacauaaaaauuuauuaaaugauucccuccuagaauucuuuuaaaucauggacuccccuuggaaaacuccucugugagucaacagauuauaagaaaaugguucgcaaauuaucuugcauugaaacuuuuuuguuguuguuuuuaaggaaauaggcaucaagaaauuaaguacauagaugacagucauaaaacuaguuaguggcaaaaugaagcuagaaccuuguuuuguguaauucagugauuguuacucuauaaccaccaacacugaaaaagaaacccagugcuucagucacaaagggggaaaugaagugaccccguuggugagccacacuugugucugaucuuuucuaaaggucauuugaaacaugguucaaaucaccccuuuacaacucagcaaggaagagaaucccucaaugacuucacauauaaugacacuuucugucuucuuuugccagcaagucacacugcagcucucuccugaaguaaaccaaauaaaaucuaagcaccagauauuuaucaucugaauucugcauuuagugagggcaagaaccauguguaaccccaacaaaacugaauugucaugcuuuaaaaaauaaauaaauaaacuuuaaaacuuuaaacgcccaaacgguagucuagaucauuacugaacuuuuuaaaggauauuuuuacagaagagaugccagauuauuucaacaacaauaauggauuuauuuauccuugaaaugcacuaagccucauguuaacugcucaaauagaguuuuuucucucuucuaagcucaagcugugcuggcucuauuuccuacuccuucuuucccauucuuucaaccccuccuucuaccaccagaugauaacuuuuucuuucuuuuucaguuccuuucucaugugaagugauucauucauuuaucuaagauucugaaauuuauauaauaucccuaacaacagauaagguuucuauaggcuuaaaaaggauccuugcuggccggguacaguggcucacaccuguaaucccagcacuuugggaggccaaggcaggaggaucacgaggucaggagaucaagaccaucuuggcuaacauggugaaacccugucucuacuaaaaauacaaaaaauuagccgggcaucguggcaugugccuguagucccagcuacucgggaagcugaggcaggagaaucaugugaaccuggaagguggagguugcagugaaccaagaucaucccacugcacuccugccuggcgaugaagcgagacuccgucuccaaaaaaaaaaaaaaaauuacaaaaggaucauugccccugaggcaaggacacuuuaauauauacguauacacacacacacacacacacacacacacacacacacacguauacauauauacacauacacacacauacauauaaaacauaauucuuauaauuuuauuuuauaugugcauaaacacauauauacucacauauauauaauuuacacauauguagauauauauacacccaccauauguauauauacaaacaauauauguauauagauguauauauguguauuuuuuuccuuauauuuuuauuuucagguguuuauucauguuuacauuucuacauuuuuuguuguuauuuaccacuggaaauucaauacucaaccagaacuugucacaugguaacuucaauaaauacuugauuggcuaguaaugaacaaauuucuuauuuucugagucuccucaucuggaacacauggauaaccuccaagguccucagggacuccuggaagccuggccuucuuccugcuuuucccaaguucucucccuguuugucaagagaaucucucauagguaaaagaacagaaacagggcucauggucuguaaauuuaccagaaaugauucuucacuagaguucaucauacuuugugguuuaagauagggcucucugauauggaaugcguaucccccaucaaggagguuuuaaaaggccucuaauacaccgauuucauagagggguuaauaaaaugaccuuacuaaaacagcuaaggaagucaauaauccaacugacaauaaacaagucuuuucucuugauacacagaguaauugaauagaugggaguaaugcuaucauuuugugaaucuuugaacuuauacauugcaucuguugauugucuuaguuugggcugcuauaagaaguaccauauacugggugguuuauuaacaacagaaauuuacuucuuauaguuuuggagacugaaagucugagauuaagaugucagguucgggugagggcccucuuccagguugcuaacuucugguugcauccucacaugugagaaaaaggcugcgaaaauucccuggggucuaucuuauaaaaaaaaaaacaaaaucucauugaugacagcuccacccucauggccuaauuggcuccccaaaaccccaguuccuaauacccucacguuaggcuuuagaauuucaacauacaaauuugaggcggaggggggacacaaacauuuaguguauauugcacugauauacuuuauugugagcugaacaauacagaaaucaauuauaagaugaaaucuagaaugaauaacacagaaaaaugaauucuacauauuucuauuauauauaaaucaggcaauagcagagcaaaggcacaguuuaccugaauuuuauucuaaguaucaugaaaucagaaaagcagcuacauauaaauaaccacugcuaguaaaugcaauuaagugaucaaaauaagcauaggcuauuaaauuaaaguauagguaauaggaaaugcuuaccaauuccuauaccauuucugucuuuugcuagaaauauuauuuuuagaagaguuuucccucaagacauuuuucuaauacucagcuaccacauucauagcagaaucuauauaaaaauacacuuuaaaauugccuuaaacucugcaauacuuaauccauuuuuaucucaagcagauaguuuuuggaauaugauggaaauagagguaaaaauaaaaccacacacacacaacaaaaagaaaagaaaagaauguugugggucugcauuggucuaaaacuugagauguauucucuucugucaguuucacucuuuuccuccaauuuucugcaagaaaccagaaaucuuauucuagacuuuugcuauggucuaaauguuuauguccccucaaaauucauauguugaaauccuaagccccaaggugacgguauuaggaguaggcccuuugggaggugaacagaucauaaaaaggauuaguacucuuacaaaagaggccugagggagcuuguuugccccuuucacucuguaaggacacagccagaaggugccaccccugaagaacgggcccucaccagucacugaauucaccuuuauguuggauuucccagccuucagaacuaugagaaauacauuucuauuauuuauaagccacccagucuaugguguccucuuacagcagcccaaauacacuguuauuuuuugcucauguauuaucuauaaugacaugaucagaaaugagaaguugccgagaucauuuggccugcauagccaaaaauauuuacuaucuggcccuuuacaggaaaauuuugcugacccauguuuaaaagcauggacuuagaauagacagcucugguuucaaauccaacucuguuacuagccuguuaccuaaucuagagacugaaauacuuaucucaugaagaguagucuuucuaugaauaaaugagaagaugcacacagaccaccacagcaauuaccugauagagaauaacauuaaauaaacacuuuuuuaaaaagcuagcuaagaauuuuauuucuaguugcugucuucucugugccucaguuuacuuauauacgaaauacggaaaauacuauaaaauguuuuacccuaguuuguugauauauuuuucucaugacuaaauacauuaaaaauuaggauacuuuuaaaaguauaucuauuauuagaaauccauucaccuaaauaucuauauuaguuugcuagggcugucauaaaaaauuacuacaaacugggugguucaaaacaacagaaauacauugucuuauaguucuggagccagaagaaauccaaaaccaagguuuuggcaggguuguuuccuucgggaggcucucagggggaauccauucugugcccauuucccagccugugguagaugucagcaauuguuggugucccuuggcucguggcaacauaacuccaaucuccgucucugucuucacauggccuucucugugugucagacauuguuuuaaauuagggcauauauuuucaauauuugacuuacauguggacauagaucagcaagaagagacuagcaaauuauucaaaauaaaaaaagaaauuuagaaaaacuuauagaauuguauaaaucuauuaaaggcuccuauugaaauuguuccuaagaacauuauccucuccaaccuagucugguuccacugaugcccucaauauuauucucugcuuuucaauaucuuaucuccauugcaucuaucauauuuauuucaugugccuuuucuuccuucagcugugugcuguuucauuuuucugucucugcacuguaccuggugaagaaacugaagagucagcuggcacucucugcagguuuuugucugcaugccaauacuuguugcucuguccuauuuagagggccugaguucuugaugaggaaaugugcucugcagagagaccaacaccaguuuggcaaucacagggagaaacacuuauuuucccugcuaagcaaauaccuuguuacugaaaaaccacuaagaacugagaugaagucuguauacaagaaaugacaugaaucauaaaagucuuagccaggcuuaaacuauuguguauacauacauagaagcauacccaagcacacaaacuccagcugcuuauuuuuuccuuuucuuuuccuuugaauaugucuuaauucccuaguaaccccaagccaaggauuaagucaaguaggaucucaguaagaaucugauccaacccuguuuuggauagaauucauagaaaggcuugaagcuggggaagcauggcuuccuacgaggaaccaccagggaguguuugguuuacaaccauuuuauuuuaucugguuaccucucaauaaaugggccuuugauugguuugggaagaggaucucaguacugauucuucgccuuaaaauaucaugcaaaauuuguguacuuaccuaaugauaucuaauugauaguuacucuuaacuuccucuuugaagcaguaugauacauaguagaaaaggaugaacccuacacugcaaaucugaauacuugaguuuuaaccaugucucugcaauaggugaccuuggaaaguaaccuaaugucauagggcacaggaagagauuaucucuaaaucuuuuuauagcugagucaaugauuauaugaucugugaguuccaguuuuauccuugugaaacauaauuauaaauagucuaucauauccauauacuaguugcuuugacaauuuuauaaaaacgacuggcauccagaauugauaaaacauagucauuuauaaaaaauuuucuuauuucuuugaacuaucaacaaaaauugcgauuaaauuuuugauguuuucuuacuguauagagcacaucuuuguacauaucaacacuaagagagaagauugagacagggaggaaauaugaguaaaggaaguacuggguuuugacuuuuaaaaaauugagauccaaaggaagcagagcuuuuauuuuuuguucuuuuguggguacaaaaauaaauguaagaaaagauagcagaauggggaagauaaagauuguggagucacagaacuggguccaaauccuuaauccacuacuuaacauauguaugauuuuucccaguuuaugaaauuaaguucucuaauucuuaaauuuuggaaacaaauacuaugaguguauguggugaugauaauguaaaauaacauacgugcauuccccuagcaaggggcuacucauccuagaucaguacuucccaaacuuauuuaaagugcaaacagaucaccugagaucuugcgaaagucagauucuaauucacuacaucugcgcuggggccugagagucugcauuucuaacagucucgcagguaaugccaaagcuuugcguugcauggauaaaggcauuugauaaaaauguagaauaccuuuggccuuuuuccuuccauuuccaagcauaaauacauauuuguuuugaaaugauagaguggaagguuggucuuuuuuuuuuuccuccccgaucagugugccucuucuguuccagucgucugucaccuauagucagggcaaaggacaccaacaguguaucauuuucaagucaaauugugucaaccugcuaggacaaguuccccaaacuuucacagggcucugugauccuuccuuuauuuuuuuucagccaucacuuccaguucacaaaugcuagauuuauuuauuaaagucuucacccucuuuuacacuagaaaggcaagauucccagugaaacucuuuucuuuugcuuguuccaaacuucuuucuguuaaaaacaaauauaacaacgacaaaaaaaucuuucucuuacauaucugcaggcucaugucuuuaccauuuuugugcucuucuauuucucuaaaugauagcaaagggccuagcaaccauuuacuugucuuucuaguucuuucagucaauaauagaugauaauuuacucucccucuguaugauuggagcauauuuugaauuauccauuuaagcuucaucuguaauuaaaauuaugugggcauuuaugacauuauucugcaaaaaugcucugugggcuuucucugaucuagcucauggaguccaggugcaaagcagcauaaaaacauugagggaaaaaucaacccuaucuuggguucaugcaccggccauuuaucugccagcuuacaagcaaaauucauagaugugucuuuccaggagauuaaguaucucccagagucagcaggaaaucugaacuguuaucuuguugcacuuaaguaaaagguagucaguccucucucucucuauuccaauauguuucauggagaacaagcacucuuuuauaagcaaacaaauauaugccacgugagauucuauuauuauucacaaauauucacuuacuuccccaugagaggauuacacauuuauacccauuuuuagauaaugugcaaggccuucuuccuauugacauuggugaucaugugacuugcuuuggccaaugaaauagcagaagugaugugcaccacaucuuagcacaggcuccaagaacuacuaaugguuaugucucagacuuucccucugccaugagaagaauaugagccagguaagugauaugaaucugguccuagaaugaggaagacacauggaacagaagcaaaacugcaguugaacuguuuacgugagcaagaaauaaauuuuauuguuggagucacuuagaccuugacuguuauaacagaauaaccuagcaaaagcugaacaaaucacugcuuuuaccuacacaaaugauuuaaaggaaagaacacagccccuaaauaaaagaaaagaaaacaagcuaaauauccaaguaauuucauacauuuuuaaaaggugagaacuaaacaauuacauucuuccuugugccuuaggaaaucuguacuaggaaaggcuuacagauuucauaagauucuagugccacuuaauugaaaguaccugcuucucaaguuggaaugaaaaugacuaugagguauuagaugaggaaaaaacccagauuauuaagauuugucaagagugugacgggguaaugguaagcaauguaauauauuugcucuucauauuuuagaaccaggaaaaauaccaaggaauaccugaagauuuauguccaguguuuuaaagaaggaaauaagaucuuucuagauucuagggcaaauucaugcuuucaaauaguuaucaagauagugacagaauagguaacagagcagaauaaguucuacuaagaaaguuuauuuuuccuuuucacugucucuuauuauuauuauuuugcccgauaaucuuugccauuuauuaaugacaaucugaauuaaacccuuggcaccuacauugucacuagaaacguuuuuggcuacagggcaagauaaagaacuuuaauaagucauuauuagcggaucuucaugccuccacuugauuccagcuuacauaccaccaguggaacagauucaaaaaugaccucuaaaaaaggaauugcaauugagccaaaaguauggugacucauaaguucuuuaaaaaaaaaaaaaaaagcucuagcaaaaaggcaauuuaacagucuccuacaucucagugauucaugaaugcuauauuuaugcauauucaugaaagaaagaucuaaaaagaauacugugucacuuuuuucuccuuuugaugcaggcagagcagauacuaaaaggacaccuaagccaucugcucaaccccaaaaacucuggaacucaacauaucuggccauacaggacucuugaauguucaugcuuucaggauuuaugguugucuuuagcuguuugaauaccaaagcguauggagaaacaaugauauaaaaaacuuagcacccuaaacauuucuauuucagaugacuauuuguuuuaauagcuguuuuauuuucaugauacaaaauuuugcaauuaucucuucaaauuuggcuugagauuggcauuucauaaauucaagugaguacauaauuuuauacaguucagcaaguaucgucuacuuaucuuuaaagagcaaaaugcaauagaacuagugagugccaaaaaaaaucccuuuuaagcagugugaucucauaguuuaucauccaaacugcggaaauuuuuagaggaaaaguaggcccuauuaaaauuauaugagaauugucucaggcaaaccuagauguauaauaacaugggcuaugggaaaaauugaaauuugaguguuaaaucaaaauuaauaagacauugaucuuuguuaggggcuugcuuuaaucauguuuaugauaagcuucucaaacuuccuuggucuccguauuggcuagcaggaggcugggacugucuaaaugguuuagugaguuugacgguuaccucuucuaauaucugauuucaugaucaugguuaggaugugcuauggacuuuauguacaucauauuauuugguccuuaaugcaacauuaugaaaucuuuucccaauuuuucagaacauaaaauugagucucggaaacaugaaauaacuuguccaaauucauaagcaaguaugaaguggagccugauucaaacccaguucuaccuagacagaaaaagauacauuauuucuuaaagcuuuugagaauuuuucccuuuagucuugccuucagagggauagaaggcaaaugccaggaaaaucuuuccuacuucagggaagacaauggauaugaagcuuauccuuuacauaguaucacacuauguaaaggauaucauacauccuuucucauuuaauggcuuuuagaaucuuggcuggucuuuuaagaaaugcaaaaugaucacuuuuaugagacacaaaauguuuuuugagagcuaagaguaauucuaauuaccuuaaccaaaacccaguaugauucuauuggaaagaaagggaauuugugcucacacaauuuggaguugaaauaugcugggugacuuugggaaaguuguucugcaucucagaguucuaguaucccaaucugauagcaguuuucuuagagaauugacagaaugaugguuaauuggaaauauauauauacauauauauauauauauauaauggagaauuacacagggccuggguuauauuaaggucauacauaaugggcaucaguuuuauuuguuuucucuccugauagcaccaaaggauuucaauguagauauugggaagguaagaaauuugaagaagaaaaucugaguuuaauuccuagcuacuuauuagcuuaaccuugagacagauaaucucugaagcugaaauuccucaucuuuaaguggaaacuauaagaauagaugucuuuaauaucucucaggaucuuugucaguugcagauaaaaggaacaaaaaaguucucauaaacgaugacuuucauauauaguuaucaucaucaucaucaucaucaucaucaucaugaccucuuagugacuaguaaaauaucuguguaguugacaaucaugugcacuagacuucaagugaagaugaugcagcuggucuuucaauaacacuuagagaaccacugggauagaauauaguuggcaaagggagacuaggagaaaguaagguugaaaaagcagguccaaacuaagauccugggagcuuuuaaagaacaagaaauacgcauagcauuuggaauuccugaagauuuuuuuuuuuuuuaccagaaugauaauguagacuguauugugauuuaagagauuuuaguguguaugcaguugaugguguucugcugaguauuagauugccuguaaacaguauauuccaucuagagugaauccacaguccaaccuggcaggcacuucacauacauguuuuaggaauuugauuaaaaguuuaaaguguuauuuuaauuuguuuuucuuuuaaaggaccuuucugggaacuuuuggggugaaagaacuaugucgcaggguauuguguuaguggauauacaacuaugugcauuugucaaaauccauagaaaugugcaucacaaaaagagaacguuauucuaugcaacuuuaaaaaauuaaacaggauauuugagaaacacaagauggaaugcagacucugagaaaugaaucuaacuguguaacaaaugaaucacauaaccauacugaaacagaugaggaagaaaggagcugaucuaaguaacuuugugaaauuaucuuuugauuugauaauguaagacuaaagauuaaaaauaacuguaucauaauugguaaauccauuucucauuagauuauguguuacaguucugaaacuaauauuacauguauacuaggguugaaaaauaagaaaaauauaguaauaaaaauuagcuuuccaacugccuaagaaagaaauuaaaaauaagcaaagccaaaaugcuagaaugaaccauaaagguguuugacuggaguuggagauaugaauaugaagucauguugauauauacauauauauaugcauacacaugaauauauauguguauauauauauauauauauauauauacacacacacagagaagauaaauaaauaaacauaaaugauauguguauacaugcacugguauacauacauaccuucccuaacacugucugcugagaagucuagaagcacugacaccccaguagugacuagugcaacuaguucccagaacuuggucucuauuaccauuccucaauaacagaaaccaggaaucguuggagaaauggcuaauucuagggcugggcagggaaacuucgagaugagccuagagcaucugguggugcuaggauguaaagaagugcuaaaaaaaaaaaaaaaaaagaaagaaaagaaaggaugaggugcaugucagaaggacacagacacaaucuaaagaccuccaggugaccaaaacuggaacaauuuaagcuacaaaacuggaacaauuuaagguacaaaacaaauauugauggugcuauauuauaacugaaagaauaaaauaaauauccacuaguccauacugauauaaauuauugaauacauauaugaaugacauggaaggaauaguccuccagaagaauuccaauuaaaaauaaaggaaugagggaacagagaaacaccaucagaacgccauuauaauaauugcagcaggugacauuugcugacguauaaugauaccucaaauaauuaggcaauauuuuaaagagaaauaggauaucaguauauccucaauauaucucccucaugaauauguuuuaauugcuauggcaauuuuaauauguucacagguucuuugauaauauuuuuauaaagguggagcuuaauuccuaucccuuugaguguggggauguucugaguagauacugauacugaguagaguauggaaaaagaaaaauagucacuuuacaguggagaaauaugacaaaaaacagcuuaaccaaauuauuaagguuagcaucaccagaaguaagacacauuaauguaaucuauccuuaauaugauaaagaagggcacaucagcucugugguauuccucucucaaauacauaaguugagucuaaucaugagaaaauaucagagaaauccaaauagaggggcuuucugcaaaaauccaaccagugcucuuccaagugucaagauaaugaaagacacugaagaaacauuacagacaagaggagaucaagagacaugaaaacuaaaugcaauaccguauccuggauuggaucuuggaauagaaaaaagacauuaugggaaacauuugggaaaucugauuaaauauucaguuugguuaaugacauugugccuauguuaauuucuuaguauugaaaauugcaaugauaauucauaauugauauuugauaauugucccaugguuauauaagauuuuuaccuuaaaggaaacugaguagaguguauauagggacucagcuucauuauugcaguuucuccauaagucuaaagcuacugcaaaguaaaaaguuaaaaguucuugagauaaggaauuugucuuauuaaaguaaugagcagauuaauuuaguccaaugagauuaaacaacuagagacauuagaaauguuuuaucaauacuugcuuucucccucacauuuauuuucuccaagugcaugacguucauugucacuuucaaagcacucuaaaguugacauccuucuucucccacacuuccuuuaucacaaagcuaacauuugucuggaagaaagccuaauuucccagacuucgccauacucuuuaaguauuaccaguuccaagcccucacaugccaacuuacucaggauucaaggcucugcugccuuccugucucuccacaauccccuucaguuauuuugugguuguuucucacaugugcucuaccaaccaaaggcauuuguguuccaaaacaaaagugcaagaugaacuaucucuaccauaaaggacuaaaucuuuaacuacagacuaucaggcuucacaguauuuggguggcuguagugggaaagaccuuucaugaauacuucaaauaaauccauagaauguuucuaaaaccauuccaacucauagccuuucuaauuugagggcauuuucauacuuugcaaaaugcaaucuccacauuccuauucacuucacgcaaaauaaaaauuuuacaucuguugagguguuucauuuugcuauuuuacacaucuguuguucugugacccuucuuguuaggcccauuugucaccauauguggucauaauaaaagacaugagaaauagguuaauugaacauuuauagcugccuucaaaaagaauauaucgaccccucucccagccacgguuuauuuugggaguauaaaucucccucucucuuucuuuguguuuuauuuucucugaguguggcagugugagugaguuuuugugucuccauggacuuguguguguguauguguguguguguguguguguguaauuacaaaauagauaaaaacccauuugaaaacauugucgccagcaugaauaacaaauuauugcacuuugauggauuuucuuagaauguuguguauauccaagauaaugugugcaccaggauauauacauuaucauagcaaacgcuucuaaaauugcugaguaaaccauagcauucaguuugacuuaauggucauguuguuuuaauucuucagaccuucaagaaauucuuucucuuuaacuaacugagcuguguguaccucucucuucagcaaacuuuuuccacuuucugucuggccagucucuuaacuagcuaaugaaccaauuguuuuagacauguaaggcagaaaaguuugcagaaauauuucauaaaaaugugaguucuaugcuucaaaugcuaaaaggcagcagagaaaccccagauuuccuugcaaaacagagagauugcuauugugcauuaaaguuugaugaaucugaguacucagaauacauccucaaacuauuuuauuuucauuugaagaggucuaguaaaugacaucucaugguauauuaaguaauauucucuaaguauaccaaguucagaaguucauaccauccuuuaugaucuaguaguggcaaguauauucauauuuuuuagauuacauagcaucauagaaaauacauuuuacuaaauuuacuagcugauauguaauagcauuaccaaacagaaaccugagaaaaaucuggaggaaauucucaaguacgucuuccucaaaccuguauguuacuaacaaguuggggaccaguggauggaaaaaugacuucagugagagugaaggacauuugaagauauucucaacuucuuggauuacagaaaacgaaaaagggguaucaaaagugauuuccaaacauucaaagagggaauacauacagucuuacuagagaguguuuauuaucuuucaguggaucuuugcugaccuuauguucacgagugacuuaggaaagaaagauaauuugaaaaaaugucacacuuugaagauugagaguggcuaauccuaugcucugagcauacucagcagugcucuuaucaaauuaucaacuuuuuagaguaguaaguuaauuuucuuccuccuuaugggcagaggacacaugcaugccaucuuuauauauccugugcaaguauuaaauguucuaaaaaugucuauuuucagguaacaaguaagaucaugaaccaagauucagaaaggaaauuacccuauagggcaggaaggguaacauggcacgugggcagccucuuccucccaguccucucucccaacacacguugcuucuuggaauucuuugcugcuuagcccaauuacuaccuccaagcaucuacuaccaauucaucaguugguaugaaaggaauacuuaccugccuacagagcuuuaagaauggcuagcggucuaaaccaggguuugauguaaaauauaggcaauuucuaauugggagugagggggauucauggcagcaauggccaacuagggcuucucaauccauuacucaaaaaguuaguaacucauugucucaaauugaauucgaaguggcugcuccuuaggaaggcagcugugccaacuacccauuuauuggaggaaaauagauuccuuuuaaugagcacuuucagaagggauggaaaaaaaguaagaccguugaguauuuuggggaucacuucuuggaguuuuucacuggguuacugaucuugaguuaaagguucuuggauuucugggacuuuggugcucuaaagcguccccuuuaaguguucucauucuaaucuuccagaaggcucuaccugcaaggcaccucggauuccagcaaccuaauuggugaaaucuagagaagaaauucaagaucuugaugcucaaaauguauucuuugauuaagagaaauaauaaauuagaccuccaguuuuuauucuagaauguccaaauuuuuccaccaggaaaaaagaggagaguagguucugugaagacauccuauucaggaauagaaacuuaauauucuaucuuguguuuuuuggaguuugagggcaaaaacagggugcaggagggugagaaaucccaauauaagacuuucugguugcaaacucuucaccccuugaacaauuaagugucucauucuuccuuaauacagaaauucucuauccugguaaccgaaaaauacacccaggccgaacagguagccuacugauagguaacuaauuggccccugcuaaauaaaguguaagagaauaacaccauuguuugauuuuuacacuaauauuccauucuaaaaaaaaagaugucuccaaugugcaauauaauauugucuaauuagcaaauaauauuaucuaugauuagcacuugauugacaccugucugauuuacacuuguuuagugcccaguuuuucaauaauagaaaaacaaucaauguucuauaauagaaauuuugggggcuaaaauguuaaguaaauuuauuuauaaagaaauaaacccaguuuuauuuaauuaauuacccuaguaucuaauaugucugaaaggcauaaagaugaaagcaaaacaacaaacuuauuucuuuuaauucucaaaaguauuaauuaaagcaauggaucuucauuuaggaugcugacuuaguuauugcacuaaaaaacucuuuucuguaagccuaaguuacuauuaacucuuauuuuuuaaauguucuaugaugaagauauuuucuaucaucaaaaggaaauauguuaaauaagaaaaagauuuuguacuuaaguguaauuauuagaagugugcuaauaauaugaagauauuugugcuauaucuacacacucagacaaauuugaguuuaggcaaauagcaaauuacuuuaaaagccaucaccuaucaaacuuuuuuccagguuggcucaugugaacaaccacagucucaggcaaaauuuuuuaaaauuaugcacaaacagaugugaaauuaucuguguuuaauuccuagaaaaggauagauacuguuauagcaauauauuucagaugaaucauuucucagcugugaauuaaaaauaucuccauuguaucagccuuuuuaaaccuuuuuaucuaaaauuucaucuuugagucagauuucuccacucaugacacauucugauagugucuggccuacuucuacagcuuaaagaguguucauuaaaaugaaauacauuaacauguaagccacagacggggaagauaaaauugcuuuaaauaacuaccaaggaaguagguguaaaugaaaacaguuauaaguugaaaauuaauucaggcauuaauacuuugauaccagagagauuucagguucagcaauuaauuauucauucugaaaugcuugaaauagccuuauuauuuaaagacagaaaaacuuagagaugagacuggucauucaaaaagaggcuagauauaaaucaaaaguuaagauauuuuggcacuugcuguuaauaaacauaugcuauaguaagaaaugcaguucaaauauacucuuauuucuagaaaguauauacucagcagaauuuuuaauaauagaaggauaaaagaaagaaacaggaaauugccuagguuuuuuuuaacauuuuuacaaccugacucaauuuuucuguggaacgaaauagacugcaaauaaauaaaaucuguguuacaaaaauuuaagaauagaaaaguuucuauaugucccuauauuuaggucaaaugcaaagaaaugucuuuuccugucaaugccauuucucugcauugucaagggauugggcaguuucaauugcugaauacuccugagaauaugcuguaaagcaaauuauacuuuugccuacuuacauaguccaagaaaaaacagaguugggcaguaguuaaagcaguaaacccagauuuuauucaggaacuagugcaauaagggaaagagaccucauuauggaacugagcucaauucugaauauaguguggaauauauaaugucauauauacaauacuauauauacauauagauguguguauauauauucuccuaauauagaauauauucuucuagaaauagaauauauucuauauauacagagaauauauagaauauauccuauauauagacuauauccuauauauauucuauauauucucuauauauauagaauauauucuucuaauguauuauagucuuggcuguggucucaggagcuagugcaggggccgaccauggccacaagguaguauaugggaggaaguaugaauuugugggccuacacagguuuacagccugaaugagaguguggauguucuauaucugugauccuagugucccuauauuauauauauauauauaauagaagggccacaggaugagaaucaguggaugaaaaauuacuaaaggaaaacauuagaguuaaggaaggugucugguuaaacagaucuaauaauauucuugcuaaaggcagaacaagugauuacauaucaccuggggaagauaagcaauuagguauuggaucagauaucaagugaugauaugaagagugagagauucucuccaaacuaacugagcaagauucuugcuauagcugggugcugcaggggcaaaaaggacaaaugucaaaguugaggccuauagggcuuaggagaagccugacucuaguuagaccaaggaaagagucuuugucaauauauagcguauucuaaaaagaagaagaagaaaaaagacuauuuuuaauuaaagauauagaaguuuucacacuuugggcccauguuuuguuacuaugcacaugaauaugaauggauuauuuuuaggcuccaaacccuuucaauagaaaagaaguuguauucuuuaaaugaaauugcagaggaaacauuuaagaucaucuucccaggaugaccaauggacuuuauaucagguauaaaaucacaucaauuggagucucugugcagcccuaauacugaaaaggguuuugaaacugacauccuggccagcaggaaagagcacugugauugauuagcaaugucuaccacgggugggaaagggaaaacuaacaaauauauuauuuucccugauuuaaauuuuucauuguauagcugucuaaacaaaguuaaauaauuuaccuaagaucuuaaauauaaauaagugcaagaaaagacaagaccucagguauccugauuugcagucuuuguuuuuauauaucacacugaauuuaccugauuaaauuuuuuguguacauauucauauacuagaaacauuuguguguauauguacauguauggcugucugaauaugccuucgaaacacuuaaccauaugaauaguucauuaggccauuauuucucaauuuccugucucauuauuuauuuaacaguaagagaaauuaugauugaaaguacguaccccaaaacuaaaguauguuugauuuuucuuucauaauugucuuuaauggaaucugauauuuuccagaaacuuuuaauguucacauuuuugaugaaaugaagaugacuguaaaagaaucaugcuugcauuuuuguguuaagcuaggagaaauuccacuggcaaucccgauggaauaugcaauguuauuuaaguacuuauaaacaauauacauagaaauucuucuuaagagcauacaauguagaguaccauacuauauuauacuaaauucuucuuauaaugcuggucugagagacaacauaaugcccaugauguagauguucuaaguuauucuuaagagaugcauuauacacuuaaauguauacguagugaauacguagggcuuaucucauagcuugcccaacucgacauugcucauaauuuggcauguuucaguguuguagaaagaaacuaaauuccuuaaauccuuuccuacaauuugacuguugcccuuacccuauggguagauuuuccuacaccaaggaaaaauugugguccaguuuauccuacuaagugauuuagauaaggaacagaauguggauguuaggagggaacucucagaaacuagucuaggcuguggucucaggagcuagugcaggggcugaccauggcuacaagguaguauauggaagaaaguaugaauuugugggccuacacagguuuacagccugaaugagaguguggauguucuauaucugugauccuagugucccugcaugaagggcuggauucaagucuggagcaguagacaggaaaaaaaaaauggguaaguaacaaagaagucaacucugaaccuugccaggagcaagugugaguuaggaaagauccuuuaaaggaaugcugcuuccaggaaauggcagcacugggaccuaauaagggaagguacucuuaaggacacaacauagugucaauuguaaaauauuaugccauuuauagaucaacauaacugaaaauaucuaugaguggcugggaagguauaucaauaagaaugagaaugaaaugaucauagauggagaagcuaaucugugcugaacuugggggcuccucacaacacaugaguggcaaaggaugacgaggcuaaaaaaacucaaagacugucugcuccaccauuuggacuuggacaguagaaaugauugucccacaauacuguuaaauucauaaaggaaugggugauuuauaacauagcuuacuuuuaccauuuuaccauauaaaugaggaaagaaguauagaucauuggaagcauccuuauuauucaagugugcacuccagauccugguauguaagcccuggcacagauuagacaugcauucaauagauuucaacugaaguuuguugaacacuugcuauaugccuggcucuauacuagaagcuugagcuuucaaugguagucaauugcugacagggucccuccucucacucaccuaagggaucugaaauaaauauuugaaagaauccaugaaauaauguuauucuggcaaaguagauauuauaugacucuccaccucucuucaaucacugcuggaauucucuaugcauugcuuaagagcauggggcuuuggguuuuaacaaacccagguuuagauucauccaguuucacuacuucucagguaaaugaccuuggaagaucccuuuacugcacugugccguaguuuccucaucuauaaaauaaauauguuuuuuaaaaaguauuuuagagauucuagugcuuggccaguuuuggcucuccucuccuuccagaggcacuugggaagauuuuagacaagaucaugugacuuuuucugaccaaugaaauuuugagcaauuuugaucguggggcuucugugccaaagcauggaggaaccagugcauaacacucucuuuccccgccaaguugaacaaagauaacuuuuguucuuuccagauaauacaguaauaagacgguuaaucuagucucacagggauauacaaauaugcguguagcaugguaauaaauaaacauuuguuauguuaauucccugagaucuuaagguuaagaucugaaguauugucuaauguauucugacuaauauguaggccuagguuagacaaaauauuugaauugcuuagcauaauguuuaggauauaguaagcacucaauaaaugcuagccuuuggccuagacacagaugguuucucugaaaacauuuaauuuauagcucugguguccagaaggauaaaguuguagacacuucucuaaguauaagaacucuccuguucucaguacagggaaacuaucaaccucuauccacacagacucauaugaaaugacuagcucuuucuuuuauuuaaaucacuguacguugacaauauuugcuguaccaaaggggcucauguuauucagcucuacaaagucgcaaauaauauauauuugaaaacaagugguagcugauguaagcaccagauggcucaaacauaaaaucaagggagcugcuuuuagcucuaccccagggcucuuaaagccgccuucucagugcuccuuuauauguuguaguuuauuucugaagugacaauaaaauugggaacggcagaauggaaaggagcaccacagccucggcauguuuuaacaaucugcuaugcauaugagaugaaacguugccaucacuagaaucaacaacaucuugacacaugauucaaacgucaagaauauccaagaauguaagaugucuuugaaacagcgacaagaagcugaagucaaauccagauuggagcccaaugccuaaaaggaucucauuuccuuuuuucugaagguugacaaauuuguagagcacaguuuuagccuucaggacugaaccucuaagagauccauuauuauaauuauuugcauuugguggcagcauggagggugccucacuuagugugaagguaucacagugaaguguuguccccaaagcagcagaaauguuaccagcuacagaaaggaucccugagccuacagaaucagccccaucuccagaaaauaagugauggagcuguauuaguuauguuuugaugcauaauaaauaucuccaaauugugcagcuuaaaacaucaaacauaauaucuccguuucugugggucaggauuccagcgguggcuuaccaaggugguucuaauucaaggucucucaugagacuguaaucaagaugauggcuaaggcuguaguuaucugagguuugaucaguccagauaauuuguuuccaagaucacucaggguggcuguuaguaggaaaccucagucucccacuagguggacuuuuucauagagcugcccacaacaguagccuucuuccaggcuacugaucagacguggugggcagugggugaagcacacaagacacaaauugcagugacucuuuuaauucagagcaaaguuguauaccagcaccucugucacaugccuuuggucagauacaccgaucccaguacaaugaugugaauaccaagaaaccaggaucauugggagccaucucaaaagcuggcaaccacagaugccauggcugcauagaacuggcaaagcagugcucuccccugccuucuuauuuuucucugcuaggucaauuuuccaaaaugugcaugaaaucuucacuucugucuggggccacacugauaugaaagaauauccuauuuauuaaucucucauuuuguaaaucuuuugacaucucgaaauaucuuucucuuucuauucuguuucuuuggugggcuauucucauuucuaauuuucuucaaaugacauuaaagcugcaauguugugaguccagguuuuagaagacguccucuccaacagggaagacacaagaauagacugugagcagaaacagccuaucccuuuuucacuccgguaacuuugcuaaauugcaaaauacacaugcucucauuuccaauuaauuaucgccuaacaaauacuucccagucuauugucucugucucuugacaaaugaacaaguuagaugggcaguaccagacaacaagggaagggacuauugcuuggaguuggcaguaaaaucggauucaaagaaagaaauuuagaagagguuaauagggagcuauucauaaagaguuuuccucuuccuacuuuagcuauauggaaacaaaaacaucaaaacuuucuggaagaaaaggaauuugguggacacaauugucccccaguucaauaaggucauaaguguuagaaaauuuguuuuaaaaauaagagcaaaagcaacuugaacagugauuagaguaucaaaccaacuugccagccucucucuacuuuuacuucauuaugguccaucuaaauuugcggccugauugacuaggagcuagaaaagauauauagagguggcaaccaauagggcaccucuuuauauaggaaacugacaguagauaaugcaggucuuaaccuacauuguucuuguuccucaaguccugcaggcuuucuuuucuacucagucacacugagggccaccccuuacccaauacuuuauaagaaucacugcuuaaguauuaaguacacaggcuccagaguccagacccucuggauuugaacucuggcuauggcacuuacuaucugugucacuuuguacagguacucaguuuccauaugccuaguuuacuuuucuuuaguaaugaugauaguaauaguacugccaacuucucugaguuguugugaauauuaaaaggguuaauguguuuaaaucacuuaaaauuuugucuggcauguacucaaugcauacauacuacuaucaucaccacuuuuaaacaccuauaugccuucuuuauuuuuugguaaaauuuuaaguuuuuauguuauccuauauuuauuuuuauuuuaaauaguuuguugugugcccacuagaaagcauaugcugucuuauuuaucuuuguacccuagcacacuguauaauacuuggcacaucauggguauuccaucaacuuuugaauagauaaaugcauuaauuaauaggugcaucaaguugcuuuauucuucacugucaaauuuucauuuuacccucuguugagugugucuggaaauuguuuuugccauggacauuccuuauguauguagauuucaaagaagguuggaucaaaucaccuuuacacuaacuauaacugaacgcugguuauauaacuuuguaauuagaaagacuugugaccaaagagcuguugugucaauuaaacaaaaauccuaaauauuacuuuuccuucuggugguuuaacuccugucuguuuaucagacacagauuuauuuccacagauauaaccauuugaaccauagaaaugguugagccauaauauuuccaaguuggauuacaucauggauaucauauauuuagauugcuaauuuuacagagaggaaaguagcaaauggugccaaaauuacacagcuaauuaggauccaaaauauagaaauauaugcaugggaggaguuagagagaaauuccauccucaccaacgcuagaguucugcuucaaugggcuacuucucuacacacagccugaguuuuccccucgggccugaguucuuucuauagaggcggcugccaguaaugcccugcuccuugucgcuuaucagauccauagaaaauagaaauauugagagauuuggcacacaaugaaucauauucugaaaaacaucacaguccacacagcuaaaaaaaaggaaaagaguuaagaauaugucucaagaaggggacagaaagagagagacagagucagacagcacaauagacauagauagaaagacagaagauauagaagaugguggacaaucuacaagacuggauuuuuaaaaggauauugacacacugaaaucagcaaagggcauuggcuuccaaaggaguuuaaucaccuccaaucuaggaaaguucaggagagcauuucuugccuaccaaaccuauuuggcaguugccaugaaagccagaaaaacuccuaaaaaaggagggguguguagguugcaucuaccuaagaagcauaaagcaccccuuguuccuucuguagacuggucaaaggcagacaaacagauccugaauuucaaauaugggacuuguucucuagguccagcaugggaccuuguaccccacaccacucccccacuacuagaugaagggcuucuuuggggcaguucauuuuuuuguuguuguuuuugguuggggggcaggcuguuaucucucagucaucuaacauagcacucagcauauaauaauuaauagucuuucuggcaugaaauaaugaaugagaugcuucauuaagccagcagccaaucagcugcuauagcaagagaccugcccaggcacucaggaaaccugaauacucaucucaguuuuaggggaggaaagagccuggaaagagguuagguuaaguugcucaaggcugcagaauuaacaauccacaggaccagaaccaggguagauuuccaaguuuccauucuuuccacuggaccugcuguguucuuauaaaguaaaaugaaccucaguggaauuauaaacuauucucauugauaccaucucauccauagcuacucagacugccucuccccugucucaccaacaaucuccuauacggggcugucagacaggagauaauuguacugucuaauacuuaaaguguauauaaucuguugaaguuacauuaauaauaauacuaacuuuauaauguuuuuuaugugccaggcacuaagaucuuuacaaaaauuacuaaaaucuuuacaaaaguuacuucauuuucacaaucaccucaugaggcaaguuauuauuuucccuguuuuuuagguuaguaaacuguagcccagagaaaguauuuaauuuacucaaugucacacuguuagauaaaguaggcagauauuacuuagauuuucucagugacaaaguggaacucaaagcauuugugacuagaccaaaauuaccaaacuaguaaaugacaguaccuguucccaaacccaagguuugcagccucuaucaaaaauauguuuuuucuccuaucacccuugccccuagacacuuuugaugcaaaacuaauauuaauuuagcaaaaaauauauacuacuuaaaugauuuagauaaauaaacauuaaacagauaucaccuaaaacauauacuauuucagcaaauaguugaaauauuuagugagcuggaaggaacggaaagccuacagguuggagaaaaucucaaaagugacugcauuucacaaggcaguaucuagauaagguugguuucuggcaguugccucaaugaauacaucuuccucauaaacagcugcaggggacaaggaagucaaacaaacaaauaauguuaaaaaaaaaguuuugacuucauauaaggccuaaaaccucauaugguuuuaauggcuaaacauucuauccaacuuaaccacuuagugcuuuuuccuggauucauuuuccaagaguuuaauguuguaggcauaagaaucacuuucuucacugaaagauguaauuugguacaagacuuggucauaacugagauuuuucucaaaugaauaaauuuaaggggacuauuaaaguuuuuuauauuaauaucuacuagaagaucuagaccaagcaaaaccuagauguguugaguuugauaccaguuuguucucuaaaaucaaacuuuacugaaaucacauauuucuuuuauguauguacagugaauugugcaauuaggacacacuuagguccaacucauuaugcccucccacauuauguuuucuuucuguugauaaggaaucauuuuguaacuaaauagcaggagaauaaaacauuuaaaaauuaugauauggucaggaaagcacauaucuuggucagacucuacuauuucaauuugcauaauagaaacugcuuuaacuuuuuaagacggguuuuauacgcagaucaagcugaggcuuuuauuggcacuucguaauagaacucuuaccaucuugagaucugauaucaacuaugaaaauguuugguuggggugugugacuacuacucuccaugaauccuccuguuaccagcagauuuugggggguugucacaagcacaugauguaagaauguacaaauguccacaccaaaacauacauauuugcaauuguguauguguuuuuucauuuaucuaguaaauauuuacugaguaccuaccauuugccaagacuguuucaguuauugagaauaaaauaguaaaacaguuccuggcuuuaugaagcuuacagucuagugagaaagacaggaacuacauaagcaaaagugguuuuucaugucauauauacauacucaugucauaucacauacacacacauauguauguguauguauguauucaccuuacauucugcuauauauacguacacacaguuguacuuguucaggucagucugagaguggcaauuuuuuccaaaguuaaaugugcuccagaauugguuggaucaggaaaaauugcuuguggagcucuuaaucuuuagucacuugcucucauugcaucauggaguuaugaggagcaaagguuaucauaggagugacauuaugauaccaccugcccuggcauauugcuaaaaacacuuggcucuugcugauuugucauauuuagaguaauguuguuguggugaaacauugcaaagauuuucuucuucauugucacucgauugggagugaaaaggccaggcuucuaauuccaucccugcaguauacuggcuguaugauuugggcauaucacuguaucugcugggcccucauuuuccuucucaauaggaggaacugauggaaucagaaugcccucuaaaauuucaucaggcuguaacauccucugccuauagcuggaaucauuuaccuuaguaccucucuguucaugcccugucaacaucucauauucucaacagcauugccuaguacagaaugugcuguugcuaaacuugucaacaggcucguaccagcaaagaauccaucugacuuccccuucugguguugucugucaccagccuggacagagcauaugauucgaauauggaaacuaagguuuaguauggcaguucucagagaggcuuuuuccaacaccuugaccaugagagguuccccggcuucaugcuucugaagcaccuuggacuuauuuuucauaguuccuaccauaguguuaucauagaaguaccuuggacuuauuuuucacaguuccuaccaccaggacuuauuuuucauauuuccuaccauauuucccaccaauagugucaauuauguaauuguuuuguuguuuuuauuuauggucuccguuacaauacauuuuacagagaauuucuuauucacucuuguaucaacagcacuuagaauagugucaggaaaauggaauacacucaaaggugcauugaaaaaggaauaaauaaguccagaauaaucugauuugucaguguggcaaugaucgaacagcucuucuguaggaaagccucccuggucacccuucauggcuuugcuccuggccuuugguauuuuuucuuaacugagccaauaguacagcugcucuuuggcaggccugguuuucugcuggcauugguuucccagaaagcugcauugcugcuacauugcuucaaguacagcgcugagacaacuguaauaaugcauauucugacagcccguucuguuccugcuguuccauguugaaucuguccuuacccaccuggcuuacagaaacugcaugaagugaaacuucauuuaaugccuauaacgcaugucccguagcauccuucguugucagagaguuugccauuguagaccauuucaugcugcucagcaggucgacuuacuauuuauauauccccaaaauguaaagccaauacuccagggauaucugucuuccacccucaagcugccuuuucauuacuuguuuucagcuucuuuauuugucagucgucuaauaugugcuucucaaauaaggccuaagcauggcuagaaauuaagggcuuucuucuauuaugucagaaauuguggacccaggucagaaaugagagauacaaaaauugguaucuaccuguauaugccagucacugugcuagaucucucaucuuggauauucuuuuuuuaaaaaaaaccuuuccuacaaucaaugaccuacaaaauauaucacagcuaguuuauggcagagaccuguaaccaggucugucugauucugauauaguuuggauauuuguccccgcuuaaaucucauguugaauuguaauucccagugcuggagguggggccggguggagguguuuugaucauggggguggaucccucauggcuuggugcugucuuugcaauagugaguucucaugagaucuugucuucuaaaaguguguggcuccccgaccuucacucucucuccuuugcucccguucucaccaugugaugaugugucugcucccguuuugccuuccacccuaaauaaaagauccuugaggccucccuagaauccaagcagaugccagugccacgcuuccuguauagccugcagaaccauuagccaauuaaaccuauuuucuuuauaaauuacccagucucagguauuucuuuauaacaauaccuuaacagucugauacagauuccaagcauuaacgacauaccucauaugacuaagucuuaguuagagugccgauuugaauuugccaaauccccuuuuagauucagcaugucaaacugaugaguaauguguuaaucuguggaaugggugucucaaagcauagggucuuuugcuaagcccuuggagaucugucaauacuccagccaaaacaaaaaaaucagaagcaauaacuaaaagccauuccucucuauaaucauacaugaggaagaacuggaaagagcuaacagguuguaauucaguuccuaggaguaaugaggguuuucuagguauaaggaaauaaacaguccgacucuuaauuaccagguaucuaggcccugccuuucuuugcauggcaucaauacaauggacuuuuauaaaccuaucaguuucuguuggauucuuguuguauccuugaccacauucccuuuauuuuuauuuacauucuaauuuguauuagagagaaaaccaagugaguuugcugaaaacuaagacauuuauucuucugugauaauggaagaaaauaauaccacacucucaucagaucuuuuccagagauuaguaucuacacaauuaugaaagucagucuuuagccucagagugcuguaugaaauauucacuaaaacccaaaguucuucaaugcgcuuuugacuuaaugcucuauuuacugaaguagauagaaacauaccuagaagucugggauaaacauuuugguugguuguaauucauagccuggaccaaaauacuuccaaaucauucuuucaaaucucagcagguaggaaaauauauuggagcaacuuugaauauaaguauaaaguuauuuuauuaauuuuauuaagcauagaaaugcaccaguuguuaucaguacuucuuuuuuacuacaaacgauguuuuucuaacucaaaccagaauuggcuuuugauuaacuaagaggauuuuuuuuauucaaaguaguuuugaccuauuaaguauggcaauauuuauacugucucaggauauuuaccaggaugauaauaaacacgcaucuuuucuuaguuuugacauuggacuuuuucuucaaaugaauacuggagguauauauauacagagauacguauaggaacacuguaauccuuagcccucugugaaucuuccuuuacuccaucauauacacacaucuacucgaacaccuccaaacaauagcugcauguagggacaaaaaacuuccucuacaaaauaaaugcagucuaucuugugcauuuguuaagucacagugaaauuuugguggccgagugcagcuaauguuuuccuucguaggcuuuccuuugcaaacauucagaaauauuuuuuggcaaucuguuuaguagauuaauagaaaugguuuucuugagggaaaaaaauuacuuuuaaggcugaauuauaugauagucacuuacaagaugaaauauucauaaugcugugaugauuuuaaaguaauuucaauuagaaaauaagcuaacauuuauagagugaugcuuauuugcuaagugauuuguaugcauugucucauuuaaccucacuacaauguugagugguagauaucaucauuaucuccauugaauaauugcacaaacuuagagaaaaugaguggcuccuaaguacuggagccaggauuugaugcuaaguaaguuuccuccagaaacucuauuaucaaccacuaugcuaaaccauccuuuaaacaacaaccaugugauggaaacaaaaguaaccuagugaaguauuugaaccaacuauuauaaccuauuaguaauguauaagaaaaaugaagucuggagcuucgguuagagucacacaccuaagaucaccagaugggauggaaucugagucuucugacuuccaggacagugcugucuguauuagacaguaacaacuuguguacucugauguuagcuauaaauacaugaaaguucacagaucauguauuucuucugcuuagggcaaaagugugauuucuaaauuguacuccaugcacgaagccucugcuauuccagugcucuaagaggcuuggcauauacuuuaugggccuucucauaaaggugaaaaguaaggguaaccuucuuugccuucugugucuaacuuagcucacaguuugucuccugaggcuucaucagcacuaaccuuggucauuccagggcaacccacucucauucuacugugaaaaugacauugcuuccacuccacaaugacugggagucagagcuuucagaugaaaccacggcaaccaaaaggauuaauuucugcugugucucaauaacacaaucauguuaucucucaacagucuaaaagauaacucacacacaccucuacuguauaauaacauaaagauaaaauaacaaccuagaaaccaaauguaaccuuccaaaauacauagaaaugaaguguuuugauacugaacaauuuuaauaauauaucgugugugcagaguuauaaaacaaucauuaauguagucuauagagagggccauuacaaaugguuccuucuuguaacacaugguuuccucaauaccuuguuuuaauggaauuuccuucuaucuggccaaaauuacguuuacuaaggaaguaaaauguuauuuuacaugauaccuuauuuucccacauaacuauugaaaaugucugucuuggugaacuucucuucaccucuguuuuauguacaauuaaaacuaucccuuugcuaaggucauuccccacaguaaugcaaauagcccacagugauauauuccaccauuagccuuggcaugcucacucugauucuccacauaauaagacccauaagaaaaucucacugaggaccuuuacuguugcucaucagaaaagccuacuuggcaccucgugaagaauauuucacugcuuacaaguuaaugacuccaaugacaaaacaggagcucaaaaaccaauccauauaaaaacaacaaaguucuugaaagcuaaguaauuucugguuaaacuacuguuuuaacagaauaaggguuuacaaguucaugaugcuuauuuaauuguguaauucuguuaugcuaacauccucugaacuaucagacgaguugucccucuauggcaucaaggcuuauacagaagcagauagcuguauuugguguuggcuuaaaaugugagaacaagauuggaaaauuguguguaaacucuuuuguccugcaaaguccauuaugauagaaaucuccaggaauuaacauugaauuugccucucuuccaguuuuggugacaaaagcuacucacuuauuagguaccuuuaauaaaaagacccuauuauugaaaaagcuacuaguacugaagucuuauaugaucccuugcauaggaauguccccauuuaaguaauuauagauauaaugaauguuaauaggauauuucuucuggaagguagagaaugggaugcuaagacauccuagcauaguauuucucucaucucuacuccuuauuacaugugugacuauggacaagauauuuaaucucucugugccccauuaucuuauuuguaaaaggggaauuaaugcucauaucuaccucauaguuguugaggggaggaaaugaauuaauauauguaaaacauuuaggacuguguuuguuacauaguaggaguuagauaauucucagaauuguaauuaauguaauuauaauaaugacuuguuacaacagcuguucaauaaguaguuucugaaauacugaaucaaugaacucugaauaguauaaggaaaucuauaguagauuuauuggcucuaguuaguuucaacuauuaccuacaauguauuuucucaguaauaaaauaucauuauuuucuuuaacaaaagagcuugacuauauuaagucagugggaucauucugaucuguuuagagauauaaagggagaaaguuuaauuuuaaauauuucuuggauguguuaaaaauacaugccuguaauuuggcacaaaauucccauuuuaggagugcauuuguccuucacaaaaauuuuaagaucuugaucuauaaauuuauacucuaaacuuuuacaugaaucagaacuguuaaaaauacucuggauucuauaguuaucuucuagcaaccaguaugacucccaaaauuguccuaguccauuuauguugcuguaaaggaauaccugcggcuagauaauuuacaaagaaaagaguuuuauuuggcuugugauucugcaggcuaugcaagaagcaugguaccagcaucugcauuuaugaggucucaaguugcuuccacucauggcagagggugaaagggacccagugugugaagagaucacauggcaagagggagcaggccuaagauucccggcucuuuucaacaaccacuucuugugggaauagugaaaacucacucacuccugagagaauuucaucaagccauccacgagggauccacuuccguagcccaaacaccaugggcaucaaauuucaacauggaacuuggugaagcaaaacauaccauaugcaagccauggcacaaauaauuacccuaaaacacaauauauucaccauguuauaauuggaaaaaaucaaugucuacaucguagguagaauuuuguuaauuauauaguuuccuuacucaugccauucuucuuugcuucuacuugguaagguugaauuuucccuuaagucuaacagucugcuuaauuucuucuucauuguuucauaugcaaauuuuuccauucacuucuauaaguaauaauaagaaauaacuacauuuacucacucucacuugguuguuuauauaaaguacagugucuuuaauccuuccaaacccuauaaaauaggaacuguuauccaaauuagauaaaugacgacacuagggguuggagagauucauuaacuugcuuucuaccaugcagugaaauaauuaguuagguuuaagaucugaucccuauuuuaucugaguccuuucuaacucacugaacuaucucacaucaaggaaucuagcugacugucaucaucuacugccuguagcaccagcuuuuccaaaucucuuuguuuugaucucacuuugguuucucuucugcuucauccucaucuagcccugugugcaaccaugaaucuccaacucaaccaacuucucuauucucaauucuuguuuuacauaaaauuaccucgccaggaauucuacuuuaucuuggccuacguggggaaaaaaaucuuggauugacugugaagcugaaauuauagaguggauccugcacgcaacauaauuuuuuaugcaguaaauuccuguauucuuuuaaaagccuuucuaugagacaauguggcuuuacauaagcaauuuagcucuacauaagcaaguacaaagaagagcuugguucauugggauagcuauuuguuucuacuauccuuuuauugagaugaaguuguaguuguaugccacccgucuuuuucaaugaacucucaaaucagcauuagaaauucaaaacaaugggagccaaacagucgaggaaauugaagaucacauguccaaguuacggaacauagaaaagccuguucacugucccauuaaauuuaguuuucccaucaauaaauauucugauuaaacuucuaccuuucaagccauuuuaugcuuucauuuuuuugaauuauaaaauguuuucauuugagugcauacucuauaaauuacgauguauuauauagcauuaaacuaauuuaacauaaauuuuaauuauuuugaaguucauuuuuaaaaauaaaaguauaauagucacaaaaaaauuuuaagagacuauugcuagcccaccaaaaggacaguguucauuagaacaucauuucucugauauaauuuuuuauuuaaaauuuuguuaaauuuuuauaaauaauggaauuuggggauaagaaugcucucacauuuugaaaccugacauuuuauagucaauaagccccaugaggccuggcauuucuaacuguuuuauuagcuccuaugauuucagcuccuagaauauugcuugacacauacaaggaauuuaaauauuauuugugaauauaauaauugcuauccuugcaaauggaaaauggaauaauucucacaucguuaaguagucuaauacagacucuccuuaguaagauucuacuucucaauaacaacaaauugcaaugucugauagaugacuggacuuuugaauuuuuaauuguagcuuguuaugcaauuaauuauuuuccauuugagaguaucuuucuucaaaaguauauucuuucaugccagaucuguuguaacuuagacuaugauccuguuggcugucagcuaggcagcaugauccauggcccagaacagucagaaaagggcccaaagaaucagcccugcagaacgggacacauguaaacuuuagucucccacauacccacaaaagaugucuuuuggacagcuuauuuuauaacuacugcuaaacuaggguuuuauuauucaaaccaauaguucgacuaaaaaggaaggaaugugaguucacuauuaacuggaauuggucauugccacugccuuuucagagaaaaaccaagaguuccaaagggacuggaaauuuuuuuuaaagagggagggguuguaguuuuguuuguuugcauguuuuuugcucagcaacauuucuuguaugucaugggaacauaguugaacagaggagagucccaaggcaagauuuuacauaagaaucuuugcuuuuacuucccacugccacacucgcugugugaaguuuuaagaaucuaaucugguuuucuuacuauuauagaauuuccuuauuaacuaaguuaaaaaggaguagauuauuuaugugaaaugagugcugaauuaaggaucucaggcuacuacauuagaguuucucaaaaaugcaauguuuuucugguauuugcuuuauuccuuaugaaaaauuguuaauauccuuuagcauugccagugaugguguuuagucuuuguaucacugguacuuuuauuaucaccaucauuuaacacuucaaaagaaacaauucuauuaagaagauaaguuuaaaaauagaaaucuuaaauacaacuauauacauuguuuaaaauaccauagaauuuauuuguuagauauuugcuggaaaauuauauugauauuccacugacacagauauccuuugauuugccugagacauagccaacagugccuuguagacacacaaauauauuccagguaauuuaaaacauguacauguuuguguguauaugugugagauguauagggauaugugcauguguguguauauuuacuuucuacacaaaaacauaaaagcagauauaauugguccucuauguggccaaguuuggagguauguuagugaauaaugagauuuuaccuuugaaaaguuauuuuggggcaauuugagcuuuaucaaugauuuuuauuuauagaacauauuaagaaacaacaugauugaaagacuuuuuagggaacugacauccucuaagaggaagacauucuacauguagguuuuaauauuuuacuauaagaaaaccuuauaaacuguugauugggaauucuaagggcaugucuuuaaccuuagcacagcagagcuugaugcuauagucuaggauauggaaaugacuccuaaauguugccucagaaugaaagauggccuaauaucaaagucagugaugggguguuguguaaaccucauaaaauuggauuuuggucaauuguguccacggucagggaagucuucauaucaaagaccaucuguguauauguugcaugacuguugauugucucaugaguguuugucuuuuauguaugauuaauacacaaaauguuuuucuuuucuuuccuuuucccuuuuuguagaaauuauugaaccuacuaccucuaguccugucacaaguccaggucaguauccacauacauucucaaaguaugucuggguacuuuuccauuaaacaagaccuucucaucauuauagaaauaaaccaaguugauuaugggccgcaugcuugcgguacugcucuaaugucuguuacuuguccucgucuaucugugauauguccuccuguuggauuuugugaucugacccugauuugaaguuuacgucuuugauuucauucuguagggcauaugcgguaaauaugugucacguuguagaauaguugcaaggugauuagcuucugcaaugccuuugcaaacagagcuguagagaguuuacaaggcuuuuggaguagcuauuaaaaaacuauuuacuauggcuugguauuccauuguuauaaaaucauuaugaagcaagaagguauuuagugcuucuaaagggaacaauagcuaggggaaaaccuauacuucuacucuugcaauauuauaguaggagauuuuggucucuugaaacuaucaaguuagaggacuuauuucaguuguugggcuuuauuuucagauuguuccuaauucagccacaaauacuuugaaaagauaggccauugcuguuaaguguguuuuuaaaaguuguuuucaacugugaacauuucugagugacaugaaaucgagauaaaagcaauugauauuagaaacaaccuuuuucucguuauauaggaauuuagcaguucauucugaauguuggcugcuggcuauuuaaagaagaaaguggaaaugcuaaaguuauucagcuuugaaaaguucauagggauuucuuguaacugcugaguuaaaggauuuguuggugcugccuacacauaaagagguauaaguuaguuaaauaguuuuuucuccucucauuccagaaauggcacuaaauuuuagucuaaaacaggauuugcugaucugagaaacugaguguuuuagaaaugaaaaaaaaaauucuaucucaaauuguaaucaaucaaaaaugcuuuaaauugcuuuagaugauuaugaauuacccccaccccaaaaugaaacauguuugagcaagucuaugauuauauauuuaaagaaucucauaauauaacacuuucuggucaaauuauagaauacuuuuucauaaccucucaaacugaaacauauugaguggucuauuuaaaaucauuuuauaguuaaugcacacaaaguuuaaguuuugugauuaauaacaguuucccauuuuacagggguuagucucucaaaguugagugucauauuaauauaauuagaaccagucaucaugggaaucuaauuuuucuuuuaacuuauaaagacuuauuaggugugauuccuacuaaugccuuuguccucuacagauuaauauaaucucagguucauaugagaucauaaucuugcuaguaaacuuuuugaucuucuuuucucuaucacuuuuaaugaggauauuaaguaacuuccauauagcuaugucaccugauggguugacguaaagauuagauaaguucuuacuuuccuuuuuuggucauugcccuaauuauugguugaaguccucauaaauuaaaaggacacaguaccuuucuuaucuacucaaacaaagaauaguagaaugcaaaauauuuuaagaagugguaccuaguggcauccaguaauagcauauuuucugacuucauguuuuuggaaaagguuuuauugggaauagguauagugagauuauuuuuucaguauguuauuuauaucaaaagaucuuuccaugguugggcuucuuagaaaaaaauucaagucagguuacuuaaccacucuauacucagaguuuccauuuguaaaaugggguggguguacaauaaggauaguaccuaguacauggaguuauuaugaaaauugaguaagucaauauugguaaaguaacuauaaguguuccuaguacauaguaugauagaaguguagguuaaauuugggggaaaaauacacacacacacauacacacacaccuccucaugacacccagauauggaaaaaguuuacuaaugugcuuaaaggcaaaaauuuggacugcuuagccuuucaagcacucugagacauaauaauuguuggcacgacuucuaaaaugcccaagcagcagccauuaugucccagaauuggucaauuuguugcuaggguuaaauguuuggaaacuaugaaugugugaaaaauagucuaaaauugaauuucuuagcaccacagucuuuaaaaaaagauaauauaaacuuuuagaaaugauuauuguagggaaauuuaauaaauacguguugaauugaauugaaagauaaaaaacaagugcagcuauaaaugaaacucacccuucauuaauugugaauuuguugaaggccuccagggaacaguuugguuaggcaaggauuuaaagaguaugugguuauagcaggauugaaagagcgguauaaaugauaaacaaaagcuuuuaaaagaaugugcaaucugcugagcaagauacaaaggagaaggauuuggcaauauauaacuaagcaaaagaacauaaaggcaggugggaaaauaauuuacucugugaauaaaaucaaacuacuaaaaguuccaguuguuucaaacaaagcuuuaaaaaauguuauccaaaugaaaauaguaaaugaaaauucucacaaaaguauucaggagauaauaaauauuagauuugcaaacuaccccauuuacugcuucuacauaaguggaaaaagagaauguaaaauaacucagcacagaucucauauuuccuaauauuacugccagagaguuaaagcagagauaaaguggauauaguuaugaaaauauuggacacacugaaaauagauugaaguaaguggauuuauaucauuuaugaucauaaguucugaagaaaugaagguccugaagucauaacuuaugcuuuauauauucuugacaagucagaaucuguuucaaaugaagggaaugaaaauugaauuauuaacaucauuauucaagaaaaggcuaugaaauauaguacauaauaagaaugaaagaaaacuauucuuucauuagucucagucucaguuugaaagguaaggggcguuuuucacaaugaaugagauauauggugaauuagcaaauucauacuaccuuuauuguaauuguugugcuggacuauaaguuauucuggacaauggccaucgagcuaaaaaugcuuaccaucucuuacuaaaccaguguaaucuuauucaaugacauaaaucauuucuauuuacuuuuugaaaaaaacaaacacauucuugagaucaucuucgaaguguauuuuaauauuuauguuggacuuuuauuuuaaagaguggaaaggagcuuaaggguaucuacucugccuaaaacaaacuauuaauccuaaaauuauuuauuggguugcuuuguguagccugucugucugaauacauuacacaaguagucugugaccuugaucccugcaauucaagacugaacuucccaaucuagauuaaauucacaauaaugcccuaaugcugguuuuauauuccuaggucauaauuaucucuaaagcaucaagcuaauaaucuaaaaaguuaaaauuguaguccuaccaguauucacuuagcuucauauagauucaaaacauuuaauaaacauuaauucggcaaaccauuuuuagucuauaggcagaugauuaaaauuaaauauuuguuuaaugcaccgcaaauaccccaccuagcaucuguccuuacuuugucccuagaaauaaucuuuagcagucaucaacuaaaaauuuuuauucugaaaauaauuuaaucuuuaacugaaugcuguuguuauucauaguaaaaaaaaaugcuuuauuuaugugucuuuagacaaauggagaaguaguuuugaaauacgauucaucuauaccuaaaaauaaaccaaaaaaagucaauguagacucuuaaguuggacuuguacagugucacuauuuuaaaauggcuaucauuaagcacauuguauuuauggguguuuuaagaucauuuuuaagucuaugaaacaaucuaguucccguugacagucaagggaaaaaaccgaaacaauuguuuuuuuaccaaaggucacugagcaagcauacagccaaaccaauauugaaaugccuacagcuauaucaucaaauguuugccucauuuucaacaacagaacuguuuuugaaaaaacagaauuuaauguuuguaaacugaauuauuuaaauucaccacaagauaccauauuauguaaagaaauuccacuuuaaauugaauaaaugcuaucugauucauguacuuagaaaauaauuuuucacuuugcuaguuuacuguauuuuguuaaaaaggaaaaugucuuuguuuaacuuaccccaggaagauccauuuucuauuuccugugaaggauauaguuugucauuuagcaaaacuuuauugaguaacagcuguaucaagcacugaguacuaggagcauagguuauuaucuuaaagguguuuauaaucuauaaaagagauaggcauauguauaacuauccauuacuuaauaugauauauucuauaguuucauacuaaagaaaaaucagacaauuuugccugggggaaaucuucacauauaugaacagaaucuucauggauuagguauaguuagcaagaaaugggaguaccauagcaagcaaaaacuuaaaaagucaaaaugguagaaaauguagaagacuagggguaaaaacugacuuaauuucuauaucuuuauuaucuaauagagugcuuaguauuuagcaggucuuccauguaugccagaugauuucagcaaaaaugcugaaccacuuagcaaagcguuugaaccaaaaaaaugaauacagaaguuaguuuccugacaaaagcuacguaacacuguuugcuuuacauuggguugugucuaacuuucaucauuuaaaaaacccauguaagagaagacaauacaauaaaaaacagaauuaauuuucuaccaaaauuaacuuacuaccaauauucacucucuugugauuuauagauaauagagguuucuaaaaauacuuuuuaugcuagcauuuccuaugguaauugaaauaggauaauaaacaaccuuuuaaaauuguaucaucaaguucuaugcuaaaaaaaaaaguccaauugucaauagauuaucuuuccuccauaagugaauaaauaaauuagugaaugaaugcuuuagaaaacccauaaguaauccacagaaguagaacauaaaaggaaucucauagauugugauaguguacucuaauaaaacucauucgggaauagagaggggugaaaauauucaacuaucaaauaaucacacaauagcaagaagguuggguaauuuaucuauuuauuuacuaaacaaaauucgaaaaucuuaaugacuagaccagaugcauaugccugauuacccauggauggauggauggauggauggauggauggauggauggauggauggugguuggauggauggauggauggaugguggaugaauggaagacacacuuauuugugguucauagagguagagcuuuagaaaaguagggaaacugguggaaguugggaguaagucaccuucugugguuucugucaguucucaaaaaauuauugagcaucugaaugugugagacacugaaccaugcaucagagaugcaaaagugauuggaccauuauuuauuuuugugaaucucacauuucaaugaaugagagggacaugaaaacaaaacagauuuauguaauacaauaugugcuauaagagaaauauguguaaugcacucuucaaacucagauauggcuuuaaaaauaucauaaaaggcuuucuagaggaugugauucaugaauuuguuaguuuaggcaaaagccauucuagacaaacaguucaauguggacaaagguacagagacauagaagaauaugguguguuugagggaaacuucaaauaauuucuggaguguaaacugagcagaaagugcagugaggcugagaaaguagacaggcuggaucacugaagggucuuguguuccuugcuguaagcuugaucuacuuacccguaggcauaggcugauuauuaggcuuccuauguaacucugagagucaggaucaaggucuaauuaacgugaauaagacgggcaucagaaaagguuauuauauaaugccaggaaagaaaugaugaaaaccucauaugugauagugauaguaggaaggagagaauggaacuaauucaagaauuauugcaacggcaaacauaucagggcuuacuuguugauuugauucugaggacagggagagagugaaacaaggaugacucccaccucucucuguggguggugggguaccaaccgagauggggaaaauaccauaaaugucaugccaaaugucuuggacuuuauccuguuguuuggaacaaaagauucaguguuuuauuuuacuuuacacaggagaauacuauuacuguguauacugugcagacauaauacuguaaaaguaauaagaaagguaagaaugagagugaggaggcaucaagcaaagucuauuauuacaaagcuuauuuuaagguuuguaggguuuuuuccuaauuuaaaauaaucaagcuuccauuauucucugauuguuagaguguaaaaaauuuaagacagcucagaauauauuucaaauuccaauuaauaugccugaauauaaugaauucagauauuaauuauaauuauccauaauuaguugauuaauuuccagauaaaaguauagcagaaaaccuacgaugcaauuuagaauaugaugcucauuauuuaaaaagauaaaaaaguaggugcuuucuaaucucuguuucucacuauucaauucuuucuuccuuaacauaucuucagcucugucucaaaauauuauuuuaggcuauuuggcuuaugauuuacucucggcucaaaguaacaugccacuaaagauauagaucaaugcuucaaagucaggcaccacguguacuaaucacaaguauuuaauauguuaaaucaaaugauuguuauauagcauaaguauuaaaaugacugaugauuacuauuacucuguuuuauauacauaaaacagacuuauaaauguaaguccuuauuaaguauauagcaaguaucuuguacugucuaauuauagagugacaucacaauuaccaaaacacuuaauaccuuacauuauauuuggagguaugugucugcuacaacucuagauugcaagauucuuuagaacaggaaacaaguuuuuuguuccuuguuaaaaaaucauucucuguacagugucugaaagagugagugaagcaugguaagaacugaacucacugcauaaaugcauaaaugaaugagugaguuaaugugaggaggauuucagcuggaugggaaauuagaagaauugaaauaccuaucuuuauaauuuagauuuuaagucaaauaagcauugauuauugcaaguccagcauagaggccagauuuauaaugggagagcauuucaaaaauauaucugcaaaaaggaagggaaacaaaggcugguggaaaauagaauuuccccccaaaauuccuaagaggaagggaaaaauuuuuuccucaccuaauuauuucugguuuaccaguggaaagaaagaaaauagaaguuaacaaaagacagcccuacaggcugaacacugauuagaugaaugugauugugccuugcacuuaggaaacacauaagauuuguugaaugaaagaauggaugggugaaugaaugauuuccuagguguauuaauuuccuuuuguugcuguaauaaauuaucacaaauaugguggcuuaaaacaacauaaauguauuaucuuauaguuuuggaggucagaaguccaaaaugggucucccugacuaaaaucaagaugucagcagggcugugugcuuuucuggagcuguaggagaaaaucuauuuuccgcauuuuccaacuucuagaagcuguccauguucuuuugcucaugugccucuuccaucuucaaagccagaaauggccacucaaauuuuucucaugucacaucacggugacacugacucuucagucucccucuuuugcauuuaagaauacauguguuuacacuggauuuacuuggauaauccaggauaaucuaccuauuuuaaagucagcuaaucauaauccaaucugcuaccuuaauuccccuuagcuacauaauguaauaaauucccagguuucgggaauuagaauguagacaucuuuggauggucaucacuccguaaaccauaccaggugaacaaauacuuccuuuuuucuacaucuaauauuuuccuucagaaccuaccaagccuccuugaauuuuuccaauauucagguaaugaauuuuguuagaguacaagcuauuugaauauugacuuuuauaguaaauguuuauaagcaacuauuuuacuauuaaaaagguaaugauuuucauugaaaagauuauauuuaucaagccauauuaccaauaauuuuacaauauuuuaucaaauugguugauaucacacacacacacacacacacacacacacacacacacacacuccuauuuaaaaagaagacuccaagaucuuaauguaaaauauaaaucccaacuggcccacugauaguuagagaaggcaucuauaacaggaaagaaucauaaaugcaaguaaaucuugaaacaauuagaguuaaugacuuucggucuaauaaaugauuagucuuucaauaaugcauguaggaaauaguuucuuuccuggacauaggauucuguaaaagccaacaagcaaaugcuugcuugugguuauucuaaguaggcaugcauauauuuuaaguuggccuuaauuuugaaauagcaaaagcaaacagaaaaugaaaaaaaauuguuuaaaugaagauuuugcauuuagaagaauaagguaaaauuacuuagaauaugagcccucuaauuuuugcuuuucugucaguccuccuagcccagagcuucucgcuauacugaggaucacaaauaaugccuguaguccaaaauuagcaaauuucauccaguuguuauuagcagaucaguguuaaacugaugcaugcuugcaaauaugcaccuuccuagaguuauuuguauuuuaaaagaagcuuccuauuuaacccuaauuuauuucuaaugauggaaauuagaaacaggcucauugugggaauauuaguaggcaggagagccuuccuguugccauauaaaucgcuaaauccagaaauccagaugcuuggacucugccuggucaucuagccagcaucaguagccgacuuugcaucuuuaucccauuguuuaccuuaaauaaacuagguagauauuuugcaagugcaaauagacaaggcuguuuugugcuuuguuugaaggugguaauauucauacucauauuucaaagugaguuauaguuuaaaaaguauuuucaacaaacaucuacuucucaaaaauaaucuuacaauauaugaacagguaaggaauuugaaguucagagagucugaacaacuuacccaacaacccagaaauucaguaaauauuucauguguuaaggaucuuucugcauuauguuaggaucuuccugcauauguaaaugaaauuacauccucacaacaacccaacauccucacaacaacccaacaacccaaacuuaccugcucauuggcuccucccauccucacaacaacccaacaacccaaacuuaccugcucauuggcuccaagaagauuaucagggaggcccuguuugggcacuuuuauuuaauaaaaugcuaaccaguuuucuuccugaggugaaccaaccaucuuuuguucauuuaaacaaacaacaaaacaugacaucuuucauaucacacuuugagucuuaaagauuuuugugguuuucaaaagaccauuggcuggcucgugggcauaaggccaagaggacuuuaugccucugaucaugcagccaggcaaucaaaaucuuuccaauucaugaaauacucaucacauuuacuuauuguuuuuuauuguaucuggcucaacagggcauuacaguuauuaggcaagcacacauaggagcgugugagucuguaccuuuacuguuaggcuugguuuuuaaaaaguauugugcguguguguguguguguguguguguguaagggggggguagaggggaggaaaauagcagcauuuuaucuacccauuuuacaauucaugagggcaagcugacuaggcccacaccaugaguaaguaauuucugauuacuuauuuacuuaaaauuuacuuaauuagaaauaauuucugcuaccaagcagaaaugaugacauuucaccaaucuuuguauuucauucauagcacuuuuuuugucccuuuucuggccuuaccucuuucgcuaccacucuccuccacuuaaaccaccaaacuuccuugauaucaggauuacucugauuuuaaaaugagauuauacucagacacaaagguagucaucauaccugguugaguagacagugaggacaaauuggaacuguccacuuuccaagccagugucuucucucuugaaauuucuuaaauucaaggauuuauauaacauuuuugcauuaaugcauucacuaauucaacaucccuugccuaguauauauuaugugcuacauacugggcuucgaauaaaaauaaaucuuagaauauaacccuaaaauacaaugguggagucaggaauguauuauauccuuuuuaaucccaucauacacuagaaauucuauuuaucauauuuauuuagaaccaaggacaugugugugcacccauaagagcaaagcacuuugauaaauaccuuauguuuuuauuuuugccuuuguggcuuucaaaggcuuucaguucauuacucauuuuauuuucugaauuugacagagcagaaaaaauuaugaauagacauuuauguuauguauuuaaagaugacuugaaauauuaauauguacaaaucucaucccccauguuaacuaugcuuuucacagccagcagaaugcagucacuagguggcaccucugggcuauauucucugcugaagacucucaaguguuguuuccauagacugauuuguguuugaauuuuguaguaucuucuccccucuuauaaaaauauuucaucagacuauuauuuguacuaaucccuugaacaagaguugcuccuauacacuuaaugguaacauauugaaacuguucauaccuacugacaauugaaaaaugaaaaauguaguccuguuuccugguuguugaaacauacugugccacacaaucuguuuguauuuaaauuuucauuuguuugggacugagugagauaggaugauguacucaagaaauauaguagagugugauuaggaaacucuuacuuauucaaaagguuugaagucuagucaauuauguuuagggcuucaggcaugucucaacucauucagaaacauugaugaaaaagauguggccccuguacucaacaaaucucauuccacugguaacauagucucucuauaguggagggauugggccagauaaucuuaaacuuugcuuucaucucuuaaauucuaugaguuuccuauaaacgggguaugaaaggucuaugggucuaaaucagcugugaaauugcucugguauccuuauaagcuuaguuaaauugaccguuuuccauucagcuggguauguagugcuuuuguacuugaaauaucuacauugaaucuaggacuuuagaaugagaaaaacauaaaucucugaccccaaguaagagucucugggaaauaagcucaacuaagagaaaagaacucuacaaauucccaaauuaacgggcugcuaauuaagauucccuagagugacaagucacagcuaacuugucccuuucuccagcaacuugcaaaaaucauggaucucaugcaaacacagaaauuuucaguggguuaaucuaaucacagauuaaugaaccuucaguuccugcuggauugggguggagugacagaaggcauuugguggcaaguaaaagcaggguaacuuguaauuucuuaagucauaugugaaaucaccuucccauuuucuccaucugcucuccuguauugucuuucccugccccagccaugccuaugacacuaaauaggagcuauaguuaguugauuuuacaugcuuuuacacaagacaggcuucacaguaggguagugcacaggagcugaaaugagguacuacuuauuugggacaucaaucuucccuuuaaguguaaagagcaaagacuuaaacacaauucugaauaaccaaaaaaggguucuaggcuuuugaccugaguuaauuuguaacuaauucauuaauuauuguaauuaaagaauguauauauuaguccauaaccugccagugggaaucauugagacaaaaccauguauugacucccucacuuaagccuguccaagggagauuucucuggcacacaaaaugcaacugaguuugcuucgaaaagagcaauggauucuugagacuacaucugauuccacgcuuacggagcaacguuaugacauuggagguaggucagccugucuccacagcaugucagcauugcaguggaauccaaauaaaaggcauuacuauuuacuaggcaauuagucuguggcagacacuguguuaaauaauuuuaaauccauuaucucaguuaaccaucaugacaaccccaccacuggucauuuucaucccaauuuacagaagaaucugaagcugagagagcuaauaaguauggucagaguucgucugacuccaacuccuacaaacuuaaaaauuaagccaguuucucaucccaccuucucacccauauuuuuagggacccacaaauucugugaaaaaaguugaaauuuugucuuuuuuguguauuagauaauccucaaauaaucauuuuacuagauauuuuuuaaaagaccuuuccuuagcugugaauaaugagaaaguuuuaaaaaccccagguacacacaccuagucucaggucuauaauuuuuucauauuuucucuuaaaauguauuccuacacaucucaguuuggaaguaccauaucaaaaugggcugccuaagacuucagugugcauuugacuuugugauucacuugcugugugaucuuuuuuuguuuuuuuuuaauuuuuuuuuuuuuuuauuauacucuaaguguuaggguacaugugcacauugugcagguuaguuacauauguauacaugugccaugcuggugcgcugcacccacuaacgugucaucuagcauuagguauaucucccaaugcuaucccuccccccucccccaaccccaccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaacuggugugagaugauaucucauagugguuuugauuugcauuucucugacggccagugaugaugagcauuucuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcccuuugucagaugaguagguugcgaaaauuuucucccauguuguagguugccuguucacucugaugguaguuucuuuugcugugcagaagcucuuuaguuuaauuagaucccauuugucaauuuuggcuuuuguugccauugcuuuugguguuuuggacaugaaguccuugcccacgccuauguccugaaugguaaugccuagguuuucuucuaggguuuuuaugguuuuaggucuaacauuuaaaucuuuaauccaucuugaauugauuuuuguauaagguguaaggaagggauccaguuucagcuuucuacauauggcuagccaguuuucccagcaccauuuauuaaauagggaauccuuuccccauggcuuguuuuucucagguuugucaaagaucagauaguuguagauaugcggcauuauuucugagggcucuguucuguuccauugaucuauaucucuguuuugguaccaguaccaugcuguuuugguuacuguagccuuguaguauaguuugaagucagguagugugaugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuguaaauuaccuugggcaguauggccauuuucacgauauugauucuuccuacccaugagcauggaauguucuuccauuuguuuguguccucuuuuauuuccuugagcagugguuuguaguucuccuugaagagguccuucacgucccuuguaaguuggauuccuagguauuuuauucucuuugaagcaauugugaaugggaguucacucaugauuuggcucucuguuugucuguuguugguguauaagaaugcuugugauuuuuguacauugauuuuguauccugagacuuugcugaaguugcuuaucagcuuaaggagauuuugggcugagacgaugggguuuucuagauaaacaaucaugucgucugcaaacagggacaauuugacuuccucuuuuccuaauugaauacccuuuauuuccuucuccugccugauugcccuggccagaacuuccaacacuauguugaauaggagcggugagagagggcauccuugucuugugccaguuuucaaagggaaugcuuccaguuuuugcccauucaguaugauauuggcuguggguuugucauagauagcucuuauuauuuugaaauacaucccaucaacaccuaauuuauugagaguuuuuagcaugaaggguuguugaauuuugucaaaggcuuuuucugcaucuauugagauaaucaugugguuuuugucuuuggcucuguuuauaugcuggauuacauuuauugauuugcguauauugaaccagccuugcaucccagggaugaagcccacuugaucaugguggauaagcuuuuugaugugcugcuggauucgguuugccaguauuuuauugaggauuucugcaucaauguucaucaaggauauuggucuaaaauucucuuuuuugguugugucucugcccggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaaacuauugauuauugccacaauuucagagccuguuauuggucuauucagagauucaacuucuuccugguuuagucuugggagaguguaugugucgaggaauguauccauuucuucuagauuuucuaguuuauuugcguagagguguuuguaguauucucugaugguaguuuguauuucugugggaucgguggugauauccccuuuaucauuuuuuauugugucuauuugauucuucucucuuuuuuucuuuauuagucuugcuagcggucuaucaauuuuguugauccuuucaaaaaaccagcuccuggauucauugauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuuguaggcauuuagugcuauaaauuucccucuacacacugcuuugaaugcgucccagagauucugguauguggugucuuuguucucguugguuucaaagaacaucuuuauuucugccuucauuucguuauguacccaguagucauucaggagcagguuguucaguuuccauguaguugagcggcuuugagugagauucuuaauccugaguucuaguuugauugcacuguggucugagagauaguuuguuauaauuucuguucuuuuacauuugcugaggagagcuguacuuccaacuauguggucaauuuuggaauaggugugguguggugcugaaaaaaauguauauucuguugauuugggguggagaguucuguagaugucuauuaggucugcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucugggugcuccuguauugggugcauauauauuuaggauaguuagcuccucuuguugaauugaucccuuuaccauuauguaauggccuucuuugucucuuuugaucuuuguugguuuaaagucuguuuuaucagagacuaggauugcaaccccugccuuuuuuuguuuuccauuggcuugguagaucuuccuccauccuuuuauuuugagccuaugugugucucugcacgugagauggguuuccugaauacagcacacugaugggucuugacucuuuauccaauuugccagucugugucuuuuaauuggagcauuuaguccacuuacauuuaaaguuaauauuguuaugugugaauuugauccugucauuaugauguuagcugguuauuuugcucauuaguucaugcaguuucuuccuagucuggauggucuuuacauuuuggcaugauuuugcaguggcugguaccgguuguuccuuuccauguuuagcgcuuccuucaggagcucuuuuagggcaggccugguggugacaaaaucucucagcauuugcuugucuauaaaguauuuuauuucuccuucacuuaugaagcuuaguuuggcuggauaugaaauucuggguugaaaauucuuuucuuuaagaauguugaauauuggcccccacucucuucuggcuuguaggguuucugccgagagauccgcuguuagucugaugggcuuuccuuugaggguaacccgaccuuucucucuggcugcccuuaacauuuuuuccuucauuucaacuuuggugaaucugacaauuaugugucuuggaguugcucuucucgaggaguaucuuuguggcguucucuguauuuccugaaucugaacguuggccugccuugcuagauuggggaaguucuccuggauaauauccugcagaguguuuuccaacuugguuccauucuccacaucacuuucagguacaccagucagacauagauuuggucuuuucacauagucccauauuuuuuggaggcuuugcucauuucuuuuuauucuuuuuucucuaaacuucccuucucgcuucauuucauucauuucaucuuccauugcugauacgcuuucuuccaguugaucgcaucggcuccugaggcuucugcauucuucacguaguucucgagccuugguuuucagcuccaucagcuccuuuaagcacuucucuguauugguuauucuaguuauacauucuucuaaauuuuuuucgaaguuuucaacuucuuugccuuugguuugaauguccucccguagcucagaguaauuugaucgucugaagccuucuucucucagcucgucaaaaucauucuccauccagcuuuguucuguugcuggugaggaacugcguuccuuuggaggaggagaggcgcucugcguuuuagaguuuccaguuuuucuguucuguuuuuuccccaucuuugugguuuuaucuacuuuuggucuuugaugauggugauguacagauggguuuucgguguagauguccuuucugguuguuaguuuuccuucuaacagacaggacccucagcugcaggucuguuggaauacccugcugugugaggugucagugugccccugcuggggggugccucccaguuaggcugcccgggggucaggggucagggacccacuugaggaggcagucugcccguucucagaucuccagcugcgugcugggagaaccacugcucucuucaaagcugucagacagggacacuuaagucugcagagguuacugcugucuuuuuguuugucugugcccugcccccagagguggagccuacagaggcaggcaggccuccuugagcuguggugggcuccacccaguucgagcuucccggcugcuuuguuuaccuaagcaagccugggcaauggcgggcgccccuuccccagccucguugccgccuugcaguuugaucucagacugcugugcuagcaaucagcgcgauuccgugggcguaggacccucugagccaggugugggauauagucucguggugcgccguuucuuaagccggucugaaaagcgcaauauucgggugggagugacccgauuuuccaggugcguccgucaccccuuucuuugacucggaaagggaacucccugaccccuugcgcuucccaggugaggcaaugccucgcccugcuucggcucgcgcacggugcgcacacacacuggccugcgcacacugucuggcacucccuagugagaugaacccgguaccucagauggaaaugcagaaaucacccgucuucugcgucgcucacgcugggagcuguagaccggagcuguucaccggagcuguuccuauucggccaucuuggcuccuccucugcugugugaucuuaaggaggcuaccuaacuuccgugaaucucaguuucuccuauaaaaucaggaugaaaacauauaccuaauaggacuuugagauauuuuaagaaaaugucuacaaauucuauguacuucauaaacauagacaucagauuuaauauuggcuugccuucaggagaaagauguugauccaccagaguuuuuguuauacguuuaggaaauggcauguauuccuuagccuguucagaauuuaugcagcaagagucccuuauccaauuuuaucaacucaaaaacauagaaaaaauagguuucuggucccacaaaacugagacccagacccuaaauaauggcagauucuccaagaugaaaaccacccugugugcuuuuccucauaacucacuuuuuugagagguggagguagggguagauuucuguauuccucaaacagaaaacagguagaaaaauauauucagcaaacuagugaacuaaauaugcuuaguuaacaacaaaaaaccucacauuuuaaguuuuugaauuauauguaguauaauuauaagguaauaaaauugauuucuguaagauucaucuaaauccacccucucugaauuguaucuauaauuguauccauaaacuauuccaucaggagaaauucuuuaaucugcccuauugacuaguguacuauaauuaugagguauuuuuugucgauguuauauguauaguaaaacuguuaguuucuugauaauuaauguaaauauauuacuuuccacuguaucuuauuccuauagcuuauuuuauuuacacauuuuaaaaauucggauaguauggccaggcgugguggcucacgccuguaaucccagcacuuugggaggccaaggcggguggaucacaaggucaggaguucaagaucaaccugaccaagagaguggaacccugucucuacuaaaaaugcaaaacguagccaggcgugguggugggcaccugcaaucccagcuacucgggagguugaggcagagaacugcuugaaccugggaggcacagguuguagugagccgagaucucagugcuccacuccagccugggcaacagagcaagacucacucucaaaaaaaaaaaaaaaaucgauuaguauuuaugcuuuuuuuucuaagugcuacuuaaguuaggaauguuauacauaguuuuccugucaacagaugcugugcaaauuuugccuuuaguugagccuguggugcacaauugaauguaauacauacacuguacucaaacuagauaucauaacauuuaaaaaguuggaaauacagaacaagaaagaguacagauucuuuuuccuugaguacaguccuguuaucacaagauaaucugcuuccauuuucacuuuuguuuaguaaagcauuauguuauuuuuuuuuuaauuuauauacuuuuaaguaaacuguaggggugaacuguuuuuacauuugauauucccaauagagaacauuucauaucagaaaagauccauuugaauguaauugauaguuauuuuaaaaacauaacacuugauucuacagaaagaaagaaaguuguguauguugagaggauaauauugguuuuauuugagaauaaagacuauucauaguacuuuaauuaaacaagauauucuggaguuucucaugcaucguaucauuuacuugcaucuaaaauuucaguauaucuaacuguuuacacguuucuaacaaaucugccuaaguuuucagaauauaauucuacuauaggcucuauaauaugaaccuaaauuggacauauucuuugacuuuaauucuaaaauucugauguagaauuuggccaauuuaaguuugaacauaaagaaagaugggccucauuauguuuucucaauacauaguuauucagaucaguuauauuuaauauugacuuugugugucuuuaacuaaucuuuucagugcaaauacagcugcugauacuuugugacacuaagaacauuaacaaaagaacauauugcucuuugauucagcuuaucucaacacaaccauaaaagcaguuccuaucagaugauucauuucacaacauccugacauugaucuacauagaaucaauaaguaaaaauaaugcuucaauucuguggaacuucuagggaagucucugggcucuuagaagccuagacucuuuccacuauguucaguugagccucugaugcacaauugaaugcaguauauauuauuuguaauagugaaacaaaggcuuuagaagacagaagggaauguauauacuucauagcaaaugcuggucuuguaacauauuuugaaagaaaaugguucuguuggucaacuagauuuggagacccugcauacucuaucacugucuuaaaaacucaauuuauacaugagaaacuaauauuagagauacugagaacuucugcaauuaaaagcaucauaacauguuuaauucaggauucucaaaacuuacuucagcaaggaauacugccuuuccuuucuuacuagugaacauccaguuugcagagcauauuaugcugaaugcuggugucaacugcgguuaaaauagcugaaaagcagucaaaaugcucugucuuaccaucucuucuccaaggcacccucuaaaaguuccuuguagccugcaucugcaaaauuaucaagguaacccuguggaagucugcccuagacuuagaacauuuugauauuguuucaggccucaagaguuuuacuaacuaaaucaugccuugagagacauuucacaaccugagaaaacuaugaguacacucaauguaccaaccuuccagucugaguguugcuuccuuuuucaaaauauuuguucucugacugugagaaacacacauucacccacccaaacccaaagaauggaccuggagacacaaaguauagcggaagugagacuuuuaauagcagucuugcaagaccaggugucugauaggcaggcacaccuggagcagauacagcagguaauuuaucuccuagaacgcaagucccuccccuaguuccucauugguugaguucuaugugguuacaaucuuccuggaugucaccuaaguuucauuauccccccauaagguuauaccccauccccuucucugcuuaaguuucaauuucccaauaaugaaacuuuucccuuuuaugggcugaccccuccucuacauucuguucgcuuaucgugaccuucaagcugcaugagccaugugguuuguuacauuuguaggccggcuggcauuacuuagauuuaucaugcuuugaaaaugaaccauuuaaaaugguuucuuucaaauucccuccucuuuucuauuuacuuucuuuggucucauuuucaucuaaaccuuuugauucuugaaucacucuagaaguuguuugcuuuuuuccuuauaggacagugaguuuaauuugguuuuuaauaguaucagguuauuuugcugguaaguuaugggcauuuguuuauuaauagcuguuuuaauuaaucucugugcuaguccccuuacacaagggauaauacaacaucccacugcuguuaagacucaugccacaauuaugagagauauaaggauugaagccaccauuccuuuuuauuuuccaaaccaaccuucuagccaacccauuaaugggucauuaauuccagcauuuucugccaguucauuggcuagaguuguuagaccuuguaaagcuuuugugauggucccaucuggggcaguauuguugagaaugaaagugcaacauuucccacccaacauaacacauaugcccccuuuuucuucuauuauuaugucuagcacaagccuguuucccaagccauuuggcugguggcaucuaacuggcuagccaccccuuugagggcaucccaaguauaacugaugaaucucuguugauuauaauagauguaguuaauucaauccacauuuucauuaauagucgaacaccagaugagugcugacuuaaacccagcagcuauuugguuucaggccuuaaauuuauuaggcacccaccugggacuccuauugaguuaacauauauauugggaucaaaagaauuuguuagaucucuccaguuucaguggccauguguauuuuuggguauuuuauggaaugccagagugaagggaauggccaauuggacugaagcauaaguccugguccaauuguaugguaacaaguuacgaaguuuccuuuucccacaauuccaccagacauaagcccaggguauauggagagcugaguaacugccauugccugacucaccaguggcaugucggauguggguacaagucaagaguuaucccaugggcucugcccccugccuagagaggcaagaggagugguucauauuuccuauaaagaacuaagggauuacucugggaucugaccucugcaaugugggaaagagcaaugacagacucuuacaagucugauuuccccaugcauccuuguccugguauagagccaauaugcaaugcauuccuuuaggauugguaucucauccuaggggaaacggaaccacuuguggcugaggucaucucacagcacaugcauagcaguuacucuuccugagggcuuguaccaaaaauuugauccauucgacccaggcauucacauccccuuacccugucucaauuucuaagguucacuuuuaccuuauuuuuauccuuuuaugguuauuauuugguggacuaaaguauuaggguuugggguuggaauaguuccaggcaaaugggagguugaguucuuaauuaguuuaagaacaaaucacccuagggggucuuccccugugaugucugccccucacccauauacccgugaugcuacuuuugguucuugguuuagaauggcuggauuguucauggugauaaguauaggacugcauucuaaauucuggcaguuaucuggcggggagccccuggacagaugcaguuuaaucuuuaagggucuccagcuuggaguuacccaccccguguuuacuguccaacccugaaauuggguaguccaccauacauuaucucagcugcggcagggugaugcccuacuguaaccuguauucgguucagggcaaagauauuuaucugccugccagagcuaucucugauuuuccaaauucccacaggguaagaccuggaaggcauuaaauuuuauaguuuggaaugcuaccauuugguuacauuaauuaccaacaugauuggguagggaggaguccccugccaguuuccauuuugacuuuugcuuuucguauaguagcccauccuagccauauuaacuuucagaaauggggccagcccauguuuucuuuguagauuuuucucaaaguuaacuuuagggguuccucaggugacccgugcacuuuccaccagucuuuuucccucccuccuggggucucuuuucucagucccuugacucaaguauggggaguccaccugcauucaacuguuugcauagcuuucauaguggccaggagcacuuaauagggaccuucccugcuuggguggagcuugucuucuuuccaaguuuuaauuaacaccaagucaccaggcuggaaguggugaacuacaaacuuaaaaggugggguuugagucagaagucauuuuaacuuaaggggugacaggguggaggauaugggccaguauauaauuucuuaaaauugauucuugguuuccauaguagggagauuuguagcucugcccaacugugggagcccauauaauaacuugugggggagacaauuccaagucuucuuuagcggggaagguggcuguccuaauccuaaggagugcuauugggaaauauuugauccaaggcauuuuagcuucuaagauuaguuuggugaaaugcuuuuugagaguuugauucauucuuuuuaccuuuccagaagaagggggaugccaaggggugugauaauuccaucuaauuuguaaaccuuuuauaauuccccuuaacacccuugagguaaaguggcucgcauuuuccaaauuaauauuuuucaccaggccaaaucuagguacagucuguucuaauauuauuuugaccacauucccagcaguggcuguuggaagggggaaguaaguacuuuaauuuuccuacuuugggcauuucugugaaauuuacuugaaugcuuugaaauagucuuaguuugggaggucuuccucccauggccuguuuuuuaauuaccuuuuuguuuauccuuugacaaguuacauaacuuuugcauacuuguuuagugaggguauaaaucccaauacacccauaauucccgaguauugcauuacacagagccuggggucccuaaugacucccuuugugugauauagacauuaguuuuuuaauuagagguuuauuuauuauuucuuuuccauuaggaaguacccauuucccaucuuuaguuugaccccuauccugucuaauucuuccuucacaucucugguaaacugcaccuuaauacuacuuuagggaugucugggaucaggcuaaauagucuaauuuuugccuucaggaggcuugcuuagcagcuuuauuugcaagcuucuuuccuacagcuuuuacaguguucucuuuuugaugaccauuuacaugaacuauggcuaccucugcuggaagcaggagacuuuuuaagaccuguuugaccaguucuccauguaugaauucuuuuccccuccuauuuauuagacccugcuuuguccagauuuuuuuaaguguguaccacuccauaggcacauuuagaaucaguauauauaguaucaucuugaccuucaaggagcuuuagggccugguuaagaacacauaacuuacagguuugggcugacuagccauuagguaauuuaccuuucccacguaaacaguguuuauuuucaucaaugacagcauaaccauuaugguuuuuuuuguuuuuguuuuuguuuuuguuuuuuauccaucacuuuggaugacccauucacaaacagccuuaucccaucauguaguggagcuucccuaaggucuggucuaacuuugguuuuguauuuuaucauaucuaagcaguuauggucugaugucuuucguuccccucuccuuuccauaggaaacuggcaggauucaggcaaguauucauuguuaugaccaaaugauuuuuuuucuauuauuauggcuuuguauuuuagaaucugagaauauguuaaccacuuccuggcuuuuugguuuaauauauuccugaccuggcaugggguacuuagcauuagggccccaccaaagguucgcuuccaacucuccucuaccagcaggguuguggcagcuacugcuugcacacauuucggccaccuccaagagacaggauggagaagcuuggagacaaaaguaacagguugccucuucccuccccaaguuugagugagcgccccaagggccaagcccuggucuacuguuacgaacagauggaauguuuuuucuaaagaugagagggccaggaccagggcugcaaugagggccugcuuuagcuccuucauugccugaauuuucucuggggaccauugcgagggauuggguuccuuuuuuaguaauuugagauacagauuuuuugucuuuuaaggauaugaaucaauccauaaccugcaguagccagucaaaccuaaaaauuuuuggaguucucuccuuguuuuaggcaaaggcagacccacuauucccgauauuuucucuggguuuauucucugcuucccuucacuaaucaggcauccuaaauauuuaacuuuuuuuucucuaaaaauugcaauuuguucuuagagacuugcaauccccuuucuccuaggaaauuaaguaagcucacagugguuucugauaccuuggcccuccucuaccuagaaauuaggagaucauuuacauauuguaacaacuggguuccccuggaagguuggaauucauccaggacuuuuucuaaggucugaccaaaugaguuuggggcuuccaugaaaccuuguggcagcacaguccagcgguacuguuguuuuucucccaguuauaggauuuuucccauuuaaaggcaaagaggucccuaguccuaaaguagaagggacugcccaaaaugcaucguuuagauccaccacacugaaccacuucuguuuauaggacuaucuuacuaaagaggguguagggggccgggcgcgguggcucacgccuguaaucccagcacuuugggaggcugaggcugguggaucacgaggucaggagauugagaccauucuggcuaacacggugaaaccccgucucuacuaaaaaugcaaaaaauuagucuggcgcaguggcggacaccuguagucccagcuacucgggaggcugaggcaggagaauggcgugaacccggcagguggagcuugcagugagccaagauagcgccacugcacuccggcgaaagagcgagacuccaucucaaaaaaaagaaaaaaaaagaaaaagaaacaggguguaggggcuaggcaccacaggguggcgagucugaacaauuugaucuauagcccuuagaucuugcaccaauuuauaacacauuaggcuuuuugugagaaucggaguuaucguaugguuuguauggugacaugcaggguucuaauaguccuucuucaaugaaucccuuuauuaacgguuggagaccuuuuuucccuuuaauagaaaugcaauaucguuuuuugcaaacuacuuguccugguuguuuuaguuuaaucuguaagggugugauuuuuaacccuccucuguugccuuuccuaacccacacaagaggauuaauuuuuuuuccuccuccucuguuaggaggcccgucauuacuuuuacuuguccuuccucuauuccugauccuaaacccaaucucaugaucagguuuugacccaggagguuaguucccgcuucaggaacauauaagaaugacccuucagugugcucuggucucaaucuaauuaacauuuucuucaauaucagaaccuaaaaucccuccccuuuuaccucggauacuguccauuuuuccuuagagacuuuuguaccccuugguuggugaauuagagaggagcaagccacuccaguauuaaucaaaaacguuacguuuucuuccucgggucccaccuucaaauuuauuaaaaguccuggugggaccuacucagaaggaaccccugaagccccuagucuucaacgguugugagggggauugccuuuuuuuucuuauuuccauucaggauauuuucuuuuaaaccguccuggcuuucuacacuuguaacauuuacucauagucuuaggaguuuuuccuugcauuucucuucuuucucuguguugaaaucugucauuccuuugucuccugugagggggaucuugaucuagucuuuuuuuggacuaccuuuuccccaguagaaacuaugauuuuugcuuuuuguuucugcuuuucuuccucucuccuugcaaagaccgacugagcuuccuucaguaauuccuccaucaguuucucauuuuauccaucaaucuuuuuuuguaauuuuuuuguaauguuaggucagcucuuaguuacaaaguuaaccuuuaagaggucuugcccuucuggguccucuggaucuaauuuggagguuuauuuuuuuauuuuauuuuauuuuuuuaucuaauuucugagccucugcaggaaugcagaggguguuuccucuuuuucuuguugaaucucgaaugccucugagacauuuuguguccuaugagugagcucuuuguucccuuuaauuauuaguuccucaagaucccacauuugggccugaucccugggaucacuauuaucccauucaggaucaauauuuggaaauuuuuguucagcuggcgagacuucuugcccggaggguguugccuuucccagaugguuauggccgcuuuccuaaucauuucguuuucuucuccugugaacaggauauuuaugacagacaucauuucagcccauguguaaaagcuggguccuaggaauugguccagauggucugcuaaacugaggggaucuucuaggagugguuuuauuuacuuuaugaaauuccuuauuccaguacuuguaagaggagcacuuacaaagccaaucucucccugucuaugggaacuucccuaaggggcaacaugcuagaugccugcuguguggaagggauagggaaguucucaacaucccucuuacacuguucuaauucuuuucuuaaauuuggacgagaauuuaaagaagcaguugguucagcucccccauggucuccagguauuucuuccucuaacccucuuguugccccuugaucuuccuguccccuauuuugugagauguauggagggggcaagcauuguagggggucucagggcuuuucgcugggugagggcuuuuuacuaggcucuucuucuucuucuuugauagguaacaugggggugcuaauuccuugauccagcagagaacguaaccuaucuccuccuaugaggaugggauuuuauuauucacauacagaauuaaagcuuggcacacccaaaccucauuugagccaaacuuaggccaaaagaccgaaggguuacaaguagggucuuuaggccagauaaaacagcaauacuuuauuaucuuuaacuuuuccuugucccugguuugagaguagucccugcaaaccugcagcauucuccccaacagacuauccaggggaaugucagagagagucucuuugacucccucuuucuauuguucccuaggccuagaauuucugguuccuuuuuccugucagucucuguaucugagcuuuuccucauguacucaacccucccuacuagagguuucuugcacaccccaagaaucgcugccucugucucuggccauuucccuugcgggagaacugaaccauggauugggacucugcacuuguuucauaucuaggauacaucucagucaugcacacacucgaccuaugaacaugcccaaccaccaagguugaauuuauaguccaauuuucuuacuucagcucaugcacgagguugccugguugccauggugccugcuuuucuccuucuguugccucugcugccuccugaauaacaguuucagguuugucuauagccucuacagggagccaguaagcccagacagagugggccacuuaaaucaggugggacgcaucuccccucucugcgagagucccacuccaugaaggcacagagauccuggacaaaaccccagauuugugagaaacacauauucacccauccaaauccaaagaauggacugagagacaugaaaaacagcggaagugagacuuuuaauggcgaucuugcaagaucaggugucuaguaggcaggcacaccuggggcaguuacaccagguaauuuaucuccuagcaugcaagucccuuccccaguuccucauuggucgaguacuaugggguugcaaucuuccuggacguugccuaaguuucauuaucccccuuauaagguuauacccagguccccuuucuugcuuauguuucaauuuccugauagugaaacuuucuucccuuuuaugggcugaccccuccucuacauucuguucccuuuucgugaccuucugggugcaugagcaaugcaguuuguuacguuugccggguggcugccgguacuuagauuuaucaugcuuugaaaauggaccauuuaaaauguuuucuuacaugaccaaauaaccauagggcacaucuaguuauauauucauguuuaugauaaucugaaguuuaaguagaaucacuuuuauuuccuccuuguuuauuucaacguauuuugccuucagaaaguuggacaaaaaagucaauagaguuccauacacauagcaagauguuuaucaauguuuaacuuuugaauauauaaguaauuaauaugcuuuauuucaacaaauaauuuugugcaauuuauaauaauuguaauaaacucuaucaagggcaaacauauaaaagagcuuuacauauuuuuuauucuucuuaucuguaguuaugcuaugugaaauuucuuguuuauaauuuuaugaacauuauuuuuucacucucacauuguuguagauuuuggcauucuuugacaugucaccagugaguggacauacuuguaucgacauagaaucauugauaucuuuaauuucacagggcccauagaaauaugcuauucuuuauuuuacagauagguaaacuaaaauuugccaccucucaaugacuuuucuagagucaugcagcucuugguaguaguuagguuauagaacauagauuuaacauuucccaauucaggacaaaucaauuuuacacugaaaaugauauuugggucuaucaucaauauuucaaacugugagaucuuucagaccccaaauuguauuuagaaauuaucuuaaaaauauugcuucauacgauuaaaguucauuucauucauugaaucacaauuaaugcauaacaaauaaugcauuaauuuuaaaggaaauaucucaucauuuagaaauauaaaucauuugcguauauaugccaaguuauuaaaaagcuaugucuuuaucagauaucaacuuauuguuagaucucuaacagaaauguauaugugcacacaugccugcacauguguguauacaguaaauagauacauugacaaucugauauucauucuuuggucuuauuugcauauuaaugucaaucuuauuguggaauaagacaaaaucugugacaauuuuaaaggccacacaagaaaguuacaauacaauguuucaaauuagcauguuuaaacauacaguuggcucucugacuuuguggguucugcauucguggagucaauaaaccccagauaaaaaauauucaaaaaauaaaaaauaacaaaacauaaauuauaauaauacaaauaaaacauauaguauaacaacuauuuaaagaacaugcacauuuuauuagauauuauaaauaaucuagagaugauuaaaaguauaugguaggcuaugcauugguuauaugcauauacuacaacauuuuauauaagggacuugagcauucacagauuuuguuauugccaaggguccucaauccaauccuccauggaugccaagggacaacuguacuauuaucauuacaaacauuaagugcugacauuuaauguaaugauaacuuuuuaauguaaugauaacuguacuauuaucaguacaaacauuaagugauguugaggauaaaguggcacuucaucugauguuuagaaguucaaaaagguuuacacaggcaaagaagaucggaccuuuuaauguaaugugacgaaauugauuaauuccaaaaaucaagauauuacacuuauccaaaacugaauuuucacuuuuuaaaucuuauuaaauaauaaaaacuagaguccugguggaaaguucagacuaagauaaaauaaagaaagugauuauugucauuuuuucauuuagaugauucuauaggucauuaauuuggccguacauagcuuuauucauucugaugcugaccccacccucauagcuggaaaaaaaaacuuauuuaaaccaagcagucauugacaauaauauauccaacauaauuguaaccuuauuaacuuaugacauggugaguuaaacaaaacuuaacuauagauaauuuucuugagguauauuuauauagagaggagagagaucauaaagaaacuguacaaacuaaugcuuuugguauuacauuugauuuuuuaaauucauaaaauauccuccauuaaauaagccuuuuaauuuguguuucuaaaauugaauuuuaauucaauaaagagaagcacaucacacaucauuaugauagcugugauuggcaguuggaaaagacucaguguugagguaagaugcagguuaaacaguuauuggccuauacauugauuacauuuauuauggugaaauauuuaaauuuagggguuucaauaaaaugugguacagauuuuauuuugugggugaauuauuuuucuaucacaauagauugcacuagaucaggaaugacagauuucauucuaccugccuagucuuauugauugguagugaacaucuacugcaaagguuaagaaggaucauguggcugugucagggcucaggaagaaaugauacugggauaaguuuauaauauuucuauccucaugggauuauaagcaaucgugaggucaggaacuuuguguucuuugucacauuuugagugccuauaauaauucccagcauaugguaaacacuaauauauauauaauaauaauauauauaacauauacaauuauauauacauauuauauacaauauauacauuuuauauauaauuauauauguuauauauaauuaugugccauauauauauaacuaugugcaaggaaaagaggaaggagaauagcagaacacaugguacaucuuugccuucucugcacuaggugauuguaaacugccaagaucuauaagucacaauccucaagcauguauugaaauauaaucugguccauuuuuaaaaagaaauuucagaauguaagaaauaaaaacuggcuuauacauauggaaagauaucaugagcccaauaaaucccaacaagaggccugauuuuuagaagaccauucuguuagacaccuaaugacaguucauuuugucacauggaaaagaauaaaaucuugcugaaaacuaacauuacuuaaauuuuuuaaaaagagagaaaaugaagaaagcugaauucugaauuuuugucaagguauuuguaugugucuugcugccucagaaguccguagucagcagaggauuucucacugguaggaaauggauuugccuuugaagcgacuuuggauaaaacuggcugcauccaagagaugaaaaugauggaagccaagagaccuggcaggcagcuggguagugggcaccccuacaacuaucucuacugaauauauucccuauagugaaguagugaccuccaggucuccuaugauuaaggcaaaugaucuuaugaguggucaugaguaugcacauugauugggcuuggcagauugcauaaucaacugcaaauuagcucuuggaaaugacuggcuauacccagugagcagaaaaaaauggaagcaaggggaucuggcagacagcagguagucacagcagcuguaugaguuacauucccauaauuuuaugaugaggaaagccaagccuggaccuuucauagcugugcuuuucauuucugauauuuggaggaauugcaggauggagcugcacacccgagcaauuuacccucaggguagcaguaaagcagagugaaaaagccuuacuuauauugcuacaccucuugaagcauaauauguacaucccuuuucuuuauauccagaagaaaagcacaacaucugcucuacugauaauuggaaacccggcuuuucuguuaaaaggauauuaauuuucacuucauagaauaauaggccuugggaagucaacuaguccaccacacuaucuuacugcagaauccuuacuacaccagaaggaaguaugugaaagagauauaggcauguuuuacaauauuaucacuuuaaugcuauaaaauuaaucugaauacaugcagcaaugaauugcuaaaccauuccaagagaagagccuacuagaugaccauuaccuuucaacuauuagaugaguucauauuuucuuguuuguauauuuuauuagacaggacaggcucagacuuaaaaaaaaguuccaauucaacaaguauuaaugaacucauguugaguuuuuggugauaugcaacagccuguggaagcuaucagcuccuaaguuuuaauucaguguacauuuguuucugcaauggaaaaagcuaaaugaugucuuuuaaaaauauaauuuagcauccuacccugacuaaaacauagaagauauauaguuucgcauucugucuugaaugaaacagauaucaauaaauggaaagggaaguucuaaucagaaaacacaaguguuagguuuuauuuuaccugaaauaauuguuuguucuauaucucaucaucuuuuccuaugcugcauauauuuacaccugcagcauauuaaauaagccuuuuaaguuguguuucuaaaauugaauuuugcaacugugcauuuuuucaucauucuuuccauuuagcuucucaaaaacuauagauuauaugcugaaaaugaacaagaugaguucuuaaaccaccacaauuuagagaaacaacauaccaauucuauccugggaaucaguuuucuuggaaauacuuuauucaucugaucuuauaaaaaagaucaauaacccuguuucaaaaagcuccuuaaauugucuuagaaaaaagcauauuugaaaaaaaaacuauggaauuauaguaaauguuucuguuuaaaagagaaauacacauuuuaagcaauuuagaaugaacgcugauauuuuuaucuauauuuaugauauacacacauaugugguauaauuucagaagacuauuugaacacagaaaauuguaaagauugugugcauugcuuacugaaugacugcauuucuuuuaaucagaaaagguaguuucucuuuucuuaaaacaucaggaauagaaaaaacgucuaucaauugaucagcacuuaccaguauguaaaauacuagcugguaucacuucaacuagaaaugcauuuuguacuggaaauuucaauauuaauaaacucguggcccaauuauuucuaguauacugaagagggauagaguuauggaaaucggacacaccacgcuuugcauaucugauucauaaaugcuaauguuucaaacagaaaccagauuaagcacaucaaaaccuaacgcauuauuuugauuuaucaauuuuccaguagugaaaauggauguuaggaaaguugcaaguggcuuaacuagcuacaaagggguuuugugaaauaugaagacugcuuaaaaaguagagauuuacacacuuauuccauugauagguuaucauagaacucuagcagguggauaaugaauucuugccuuguuacugaucuauugcacaucccccagcucagccaggcucuguagugugauuuuagcagaacaagagauaaucaaacauccuguuuuuauagaauugucccaauuuaggguccuucagggcccuccaggaugccuauuugagauguuuuucuuucugaaaagcauuaucuagggauaaaaaaaaaaagaauguaaucugucauaauccuagcccaaggaaauaugaauccuggucuccuuacagcucucagagaaguaaaaauaaaaccaaaaggcaagauguuuuccacaaggaaaggauaucaaacuucuggccaacgaauaccuuccuucuuucuauccccuuuuuuuaccaccugcugcuauacucaagccaagaaucaacccaucaccauuucugauuucagaacuuuucugaguuucuaugaauaucuuccuccaauuccuucuaguucuggaagccagugugagcccauuucugcccuuuuaauuccucuauuccuucugguuucuuauuuccuguucccauauugcuguacuuaugugcuguucaugacuacucuuucuguuuucucucuauuuagaguaucucacaucacucagaauuauccauucauguuaaacuugacagggucaccacacugacuauuggcaucuuucaugaaaaaagaaauaggaaaaaauauaauuaaaaagaaaacuaccagucacaggcagagcauguagauggucuugcucauauaaaauuguaagaugugggaaaggcagagaccuauucccaaaguaugaagccucugaaauaaacugcuaucaaaaaaaaauguugcaagaauuaucaaauaccaucaucaacuauucaucccuggagaguugaugacacauuuucagugccuaguaagugcuuuaaaacauguugauagaacuguugaacuauuuuguuaauacagugguuccuuaggaaaaugauugaugccuucuugccaguaucacuaccauccucucuuucuuauacuuuuucacagcauuauaauagucuucucucuccuucuuuuauugucuucugaucucagaaguuacaagauugcuaaauauccaugguacccaaauccaaaccuuugcugguacuuaucguaaugucagcuuaauauguuaccuccagugaucuaugucugugacaaauuuugugauauucaguauacaguugacccuucaaugauguagggggguaggagcagcaauuccuuguguagucaaaaaucuguguauaacuuauuuuucuuguuuucuuuuuuuuuuuuuuuccgagauggagucucacucuauugcccaggcuggagugcaguggugcgaucucagcucacugcaaccucugccucccagguucaagugauuccccucccucagccucccaaguagcugagaugacaggccugugccaccaugccuggcuaauucuguauuucaguagagaugggguuucaccauguugcccaagcuggucucaaacuccugaccucaagugauccacccaccuuggccucccaaagugcuaggauuauaggcgugagccaccacuucuggccuguacaugacuuuugacuccuccaaaaccuaauuacuaagagcuuacuguugaccagaagccuuaccaauaauauaaacagccaauuaaaacauauuuuguauuuuauguguguuagauacuguauuuugauuacaaaguaaguuagagaaaagaaaauauuaguacaaaucauaaggaaaagaaaauauauuuucuaguuauuaaguggaagugaaccauccuaaaggucugcaucuuugucaucuucauguugaguaggcugaagaggaagagaaagagaaagguuugcucuugcugucucaggggugacagaggcagauauaaguggaccugugcagcucaaacccacacuguucaagggugaacagucaauauauagauauuuagaaggaagcaacaucagugagggaaguaguacuuagaggaugcuucaggaaggaagugggucuguguggugaguuugaccaacaaugcaauuucagggaauucuccccacaagacgguccucacuucagacacaagucacaaaguuccuggguccccaggaccacucucaguucagaccagcuggcuacaauuuaaaggacucuaaugacuaaacuuggauuugauaauucacuauaaggacucacagaacucauugaaaacuauuauagucauggguuauuacaggggaauacaaaaacucagccaauggaauagauacauagggcagagucugagagaggaccaaauacacagcuucuggcugucuucuuccuguggagucauggaugguauuaucuccuccuugccacaauguguggcaauacacacagaguuugccaaucagggaagcugacucaagccuucaguguccagaguuuuuacuggggcuuaaucacauagugcuggcauuggcugcccuuuagucuccuaccacucacaaaagucaggcaaccuuuacucaucaguucuucaugagauuagaggugauauagcauggccucaaaguccccaucauaaaucaccuuguuaaguggucuaguagucaaacacacuagcaaaugaaaggauuccuaucaggcaggacacugcaggaaccuagaggucaccucccaguagcugaaggcaaaagccagaccucucuuugaugaggugaaauuccuuauuacacugucuaaaacugaguguucaaggaaagagaagauaaaaucagguaaagauaagucacuucaggcaaaaggauaagcauaaggaaagaauuggaaaugugaauaagugaaugaaaggagaugcuaaagaaaggaucccaucccagcaaaugugggauaugcuuuagguagcugagauaaauaaguuggacuagagcaaaacacauaaauucuggauggcuuuuaaagucagguagaacucagggagagaaguuuuguuuugacacaacaaaaacuggaaauauuuaagauacuugaauuugguugaugagcagaauaaugaaaaaucuguguaaggaaauugugaaguauucucuuuauauuugaacaccguauuuuaaauaaugcuaaaaaguguaaaauaccaauaggagggcaaucaagauauuguggucuaaaauuuauaucagauucaauuauggaaacaguauauguuuaaccaguuuuuaaaacauaagacuuaaaaagagaaaauaguuuucuucaaaggcuugaugagauuuuacauuucagggaauccaaacaaggauucaagggggaaaaauagagcaagaaagauguagacuuaccaaaacaaggggaauuuuucuaucaauuaaaauaaucuacaaauuaaguaagaagguuuuuugaaaaauugggcuucccaucaauaaguauuuggauaguagauggguauucaucuacauuuugggguugauuuguagagauuguugcauuagaggucaacgucucccuauuuuagaauucggugggucuuugaaguacacagaaugauuuagaugagggagagccuggauucauagacaucugcuaggaaauugcaggaauauaaguauaaagugauccaauuuuggaguagggcgaugguaaugacuguagaacagaaggauaaaacagauauuucaaaagaaaaaugaacagaacuuaguauauggcuagauggggaguaugaaucuaagaaaaaugcaaagaauacccaucuuucaagccugagugacuaagcuaacugugcaacagcuaggagaaauagaaucaucacaauggagaacaauuuugggaggaaagauggugaauucuaucuugaacauagcaaauuugaaauaaaaggagaagcccaauaggggaugccuuacagacuauggugagaggcaagcuacuuucguuuucauuuuuuacauauuuuuguuacggcacuuaucacaguaugucugucguugaauuguuuaaauaucagacucccaguggauucugagauucuugaaaacaaagucaaaguuuuaugugucauuuuauuuaaccuaaccagcuuugugucuugcacauauucaguaaauauuuucauacaguuauuuagagauaaaaaucugagucaaauccguguguauaaaacucaauauaaaacugagaaaaaaauaacaagaagcugcuuacuguuuagagaagggagguaaaaagagcugaaccaggagccguaagaggugaagaaaugagagaaauugagauugugaauuaauaaacacuugaagauacaggcuucaagaucaaguaccuagcuaacuaugagaucuugauaaugagaauggggaaaaggucuuuauguuuuuuugauaaacguuuaauugauggcuuucaagagguacugacacuauuauaaaugguucagaaguuuccauuacaaagaaaauuuaucccgugcccaagggauacuuaacagaggcagacaggcucacucccguaagucucuacuucuuucuuauaccugaaacucuuacuugcauuuuagauuguauuucacccuugcccaaucucuuaguccauuccuacugcucuaauaugauauaaacuaggugauuuauaaauaauaaaaaugcauuucucauagcucuccaagaucaaagugccaguagguucaguuucugguaggggcuucauugcugcuuccaagauggcacuguguccuuguaccuuagaagggcaaaaagugggagacaggucugugaugccucuuuuauaagugaauuaaucucauucaugaaaugugaacccugaugaccuaaucaccuccuaaagguucuaccuucuaauaccaucaccuuggugauuagguuucagcauauaaauuuuggagggacacguacauucaaaaaccauagcacucuauuaaaugauagaagaaaaagccaauaagcacauucuucugucuuauuuucuguuuuauacauuugguguguguccuguuucuccauuuugaagacauagcccuuugggaaugaaagaacauuugcuacugugguacacacaggcuggaaauguggagaggccgggcuggccacgguaagguuggaugacauucacaguagcaugaagagugagaacaaacacucugcugugaggucauauuuucauuuaaaaaaaaaaaaagucaagcccugagguggucauuggagguaccaaaaugugucuuuucuugccucccccuccaucauaacacuuucauuuuauccauuacuugcuuguagucacuuccauuauuuucaucuuuagcccaaauaaauacauauuccuucacguuuucugaaguccaugauaaugucagauaauauuaaccuccuugcauucaguacaauugucccuugguauccucaggggaaugguucucagaccucccuuggauaucaaaacccaaagaugcucaagucccugauguaaagugguauaguauuuccauauaaccugugcgcauccucuuguacacuuuaaauuaucucuugacuacuuauaaugccuaauacuauguaaaugccauauaaauaguuguuguauuguuuagggaauaaugacaauaaaaaugucuacauguuuaguacaggugcaauuuuuuaaauauuuuugaucuguaggugguuaauucuauagacucagaacccaagaauaugaagggccaauugaauuuuuuuaauaaacauuacgugagcacuugucaugguaauugugcuaagaacuccugugaaauacuugcuauguguaucauuaagaugcuuuggacugcacaucauggaaaaccccuacucaaaguugcuuaagcaaaaaggaaacauuauuauuucauauaacaagaaauuaguuccagaguggguuaauucagcaacucaaggagccaguucuguccaguguuucagcuguguucugugaacagccguuaaaaucccaguugauuucugcaguuacgggcuuuccaugcagauacaucaauggccaaaggaagauaagcaauuuuuucuucuguguuucguuucaucagugaagacacauuccccagaauccucagcagucuucccuuucaugucauugccaaggugugacucaaucauugccaagacugagucacaugcucuuuuguaaagcaaucacagggaggagguauggcaucgcauagaaugguuuagacuguuggggauuuacguuugaaacagugaauucugccagcaaggaagaauauaucugcuacauuauaugucuaucaauguuguguuagaagaugaaacaaaucaaugaacaaucugaggaauaauacucauuuaugucagccuuuauauccuuuauguuguuuuuuugaagaauguguuuggccaugcacacuguagcauguugucauaagcacucgauguaaagagucaugagauuucauauucagugagguggguaccaaaugcauauuaguucuaaauuuguauuucaaaauugaaacaaauauauaauuguuauugcuaccuuuggguggauuucacaugauauuaauauaagcaaaaagaauacaaucccgcaaaagaauguaaaaauaauacuucuguauuucagaacaagaaauuaaugucuucuauagacaucauauugauaaugucaagaugauguuauaauguaaagaacaaugcauagcaugcaucuauucaaacuaugacauacaauuaaauuuuaaguagguuauauagauuagcacuaaguaauaaugcaauucaauuuaauucauggauuaacauaaaguuaaugcuuuauuuggggugagcgggggaaggacuuuuuuucucuccagcaaguguaaucacucaguuucauccucuucugugaugaauugagaacaauguagcaaauccuccuccuuuacaaagguuugggcuuuuguuuucugccuuuccuaauuuaaaguaacuuaaauuggcuugaauggaaacuuccaggauauacuccagggaaauaaggccaguuagacaaauuugggcuuagugagacaacucuguuuaagaaggaaaaaaaagaaaaaagaaaaaagaaaaaagcucuguuuaagcagaagaacagauuuuguggucugaaagacuugacauuaaaucaugacucuacuaguuacuaucuauguggauuauuauuaacacagccauguauuaguaacacaaccuuuccauggcuucauuuucucuuuuuuagaguaggaaaaaauacucuaucaaucaguguuuuugugugggaaacaacagaaaccaucacgaauaacuuacacaaaacgggauuuauuagaaaacuauccuaggaguuacaacaucaauaagagccuggugaagcagccuaagaaugggcagggaacaaggaaacacuggagggccacgaauuagaaaacuggaaucucagccugaaacuguuugggccacugcuauuaccuugguuguuuuaauaaauaaccuccaaucuaccugggagauuuaaaaccucaugaaagagcucccaauucgcugaauauaugccauuauuccugcucccuaaguugccugagacagagaaagggaauauuugccucauuuggcuuacaugguagaaucuguuuaucuuuaauccguccaccaagacuacauacaaugaggaagaaguaauucuccaacaggaaaaacaggcuauguuuaugagcauaugucauuugaucuucacaagaacucuguaagguauuugaaucucagagaacagacuuaaaaggucaaauaacuguccaaagucacacagauaguaaguaaaauaguggagccaguuuucaagucuaggucgauuuguuuccaaacuguguaguauuuucaauuauaccacaccaucaucuuugugagaagaaaaaccucuaguuuuauuacaucuugaauuguauaauacuucugcuugcauuaguaguugcaggaaacagacaguccaagauaaggaucucagaugggcuaucugaacaguguuugaagucagggaagucagggugcaucuguucauaauauaauagaagaagggauauagguaguucaugcuacauggugacaaggauauuuggauaauauagcuaaaaauuggaugaagaaucugauucugugaguuacugaaugacaauguggguagaaaguuauugcacuguuuggaaaagaacucugggaaauggaaugauaacuuugaagaccauucaaaaauauucaguaccucaaacccugauuucagaaucucaaacuugaaacaguucagcugggagucaaauugcagaaacugcucuggucucauaagcagaaagugacuuuuuacaaggcauuagaguugacaaaauuguuuuggaaagggcugugauaacaggcucuaucuaggcuaaccagaauuagcucccagaacacuguauccuuucucaucaaggaaacuacuacuuuggccaauauaaagaagcuggauaauuuaggaaguccaucacaaaacuguugccucuggaaaaaaaaacugcuuuagacuguugagaucagcaagcaguaaccagcacugugaacuugagagccauacccauaccuguaagauucacaugagcaaaagggacccacacaccacugccuccuucccuguuaaacaaaucuugagcauauacaucugauguguggaacauaaaucaccucuggaaaucuaauuucaauggagucugggaaugucauuuuucagcuuuccagccucuacagcacaagaaaaaacaucagaagguuguuggaaaagcuaucaaguaagcuacuuuauucuaucuaccucaugaucaacauguuuuuagaaaauguguauuucaaagaggaagaauauaggauuaauuguugcaaauauauuauauuguaaagaaaauuaaaaagccaauaaacuucauaaauuuaaaggaaaagugcauuuugcauacaaaagaaaagauuuacuccuuuuuacuaaaaaaaaaaucuaaugaaugcuaggguuuguaugcuucauaacaaacuacucauaagcaaaauuucugagcaaaucuucaucauucauagcucaguaauauuuacucuucagcuagcacauuauuuucauuuugaaccauccugagcagacuucauauuagucaauuuggcuaaugauacaaaaauggagacaaauaguguggaaccgagugugcaaacucaaagaggcuugaaagaccuggauuaugagcaaguaaaugacucguggaauuuagaauaacaauguguaaaaggcaugaaacucugggaccaaaauaaucagaggggcuacaacuuuaaaggguucagagaacaaaguacacaucaggaaagagcucuggagugauuacagauauuauacuaaaaucaucugccugggagacagcugugagggaaagaggaaagaaaguagccgcucaauaguuggagaaaaaggugcaucuucagauguuauuaugacauuagacaaaguguuaguguguaggauuauuucagcaagaacuccugauucugcucugcugggcugucauguugauuacuagggauuacaucuuaaaaaugugauguggucuuuuaaaaaaaagaagacuggauauaucuuuuucucauuuuuaagcgacuuaaguggugcaaaaaaucuucuauguauugugucucuuucucucgguuucuuaugucucuauauggaauagaauugcucaagaugcuugcaacugcuauaucggccugcuguuucagacaaucaaguaaacacaguucucugcuugaucagugucuccaggguguaguauggaacacugugagaggaacaaguaacugaagauuuuagagacuguaugaauuuuaaaaauaauaagaaaaauagccuuguuagguauuauuuacaguauuaguauuauuauuaauaucauuuauugacuuguuauucuugccaggaaccaugcuaaguacuuuacauaaauuaacaucuuugcuuuuaucucuagcucuuuccuggcuugcauuuaggagcauaaaauggcugauguaucuguuuaggacuccuauaacagacccuuagacaaauauuacauuaagaaucaacuuucuaacaguagaagcuaaacuagcaauaagaggauaaaaaggguaagaucuacuuuguguuucaaagacgauauuugaaccuaauugucaccuuguuugagaaugugcuuacaauaagugaaccaucagcuagguuauuaggaaaggugucccuccugguccuuucauauucuucccaagucuaaagagacggguugaguuuugcccucuucuuucaccaugaaagcucuguggugaaaaaaaaaaagaaaauauuugcaaaagacaucagaggaaggaauguuacccaaaacauguaaagaacucuuaaaacccaacaauaaaaacacaaucugauuuuuuuaaaugggccuaagaauuuaacaaacaucucaccagaaaaaauauaccaugucaaauaaucaugugaaaagauguuccacaucauauggcaucagggaaauucaacuuaaagcaacagugagauaccacuacacacuuacuagaauggccgaaaucuagaacacugacaacaccaaaugcugaagagaaugugaagcaacaggaacucuuauucauuccuggaacucuuauucauuccugguagacaugcaaaauuguacagccacuuuggaagacaguuuggcaauuucuuguaaaacuaaacauaugauccagaaauuugcacuccuugguauuuaccuuaaggaguugaaaaauuaugucugcacaaaauucuucacacauauguuuauaguagcuuuauucauaauugcaaaaacuuggaagcaaccaagaugucuuucaguaggugaaugaauaaauaaacuaaggcauauaaagacgguggaauauuauucagcacuaaaaagaaauaugcuauaaagccauggaaagacauacaggaugguuaauugcacauuauuaagugaaagaagacagucugaaaaggcuaccuacuauguaauuccuacuauaugucauucuagaaaaggcaaaacuauggagacaguaaaaaggucaguguuugccaaggguuggggaaagggagagaugaauaggcagagcacagagaauuuggggacaaugaaaauacuguggaugagacuauaaugcuagaaacuuaucauuaagcacuuguccaaacccagauagugugcaauaccaagagcgaacccuaauauaaacuggagacucugggagauaauaaugugucagugcagauucaucaauuguaacaaauguaccacucugguggggauguugauaaucggggauucuaugcauaggggauaaggggguauaugggaaguucuaugucuuucauucaauuuuuguugcaaaucuaaagcuuuucuaaaaaguaaagucuauuuuugaaaaguuaaaacaauccaauaaaguuuuaugauaaaaaaaaauaaggccaaaggagaggagcauaagaaauagggugaauuugccuuuccuccuuucuuuaccuccucacacacacaauuaucuaaacuaaacaaagacuaaaauuaugaaggucaaucaucucaugggaauacccucaagcuuggggacaauuauuuauuuaguaacuuuugugucugcuguuagaaaacacucuguagauguuuuuauuagccaaaaaaaccucaaauuaucaucuucaaauauuagagguuuauuauauucuauucaguuucucauggaaguuguagacagaguuuuguauaaggaaaaauuugaaccaaaucaguguaguaucacaaagagcucuuagugaguuggaaguacuuucuuguauuugcauuuuacucacugugauuuugcagguaucacccaccuucugugggccucaguuucuucaucccugcaaagaaggaguuagacuggaacacuuagauuuauaugaucuuauaugcauuugcucagccacaaaagcauggaagauuauuaauacuauuggauagaggcugauaauacauuuuuaaaaggaaaaccuacauugcgaauucagcaauaaauuauugucuuagaacuuuucaguugcacacacuuucugguaauauucguuaaauuaaaggcuauuuguaaguuucccauaucuugauuuauucuagucugagauuguuuucuaaggggauaaucucauuuaugauauuggcuuuuuaaagauguagaagcauuauacagaaagauaaauuuguacugccaacuaaaugcaaaugaucacuauuuugaaggaacacuuucaaggcuuuguuuuauauagaugcauauggagauucuuauauauuuaaggguuacaggcaauaacaauaaauaaaauuaguugacccuggagaugaaaaaaaaaagucuugcaugaaggugaauaauauuccaaucauaccagagguuaacauccagcugguauuuuauucaugugccugaauguagucacuuuuagaguguucgaaaucaccaugaaaauugguguagagaaagccuauuugaaaagcuguaauagaaugaaaagcugauauuugcaaacuaguuuucaaucaaggccuaaaauccauaguagauuaaguaaaauaaguagaauaugguaauauugaugaguuuaccuagaaaacccauaugguuuucaaauuuauacuccucaagggcauaccaguuauuuuccagagaauacagaaaauaaucuauacauuuuucacucuuugcuucuaaggaauaggaaucuaggugaaaaaaaauccucagugaaaaugacauuuuaaaaaccuuuuuagauacugcuauuauagaaauuacuguuaaaugcuaggcauuuucauuuauuuuauguguuuugaagccaaaagccagaaagucuuagcuacuuaaaaucaacuacugacaguugccuuuuaacagagauggaacacaccugacaucacugcugcaaugcugccuuucauaauuauggggcucuuucuuucucucugagccugaacaugacauuagacucucauuagggcacaccuggcagccacuaccaguggauaagaguuggcauugaagauaaaaccuaugagccacauaugacuuaaaaguuugauaccuuuguauggauagaucuacauacacauacaugcacauguacauacacacacaaaugccucauuggagugcaguucagucauuguagcuuaaccuguaauacucacaccaucaucucuauuaugaauuauuccauuauuuccuaaaugggccccauguuacugugcuugcccucauacacucuauuccuaacuuuuaaaauauaacuuauauuaugucauuccuuuccucagagcucuccagauguucccccuuucacuuagaguaaaacagucuacaaaacccuacauggucucauaccgucauauuucugccuucauuuucuauuuuuuuuuucuguuugccacucuucuucaaucaaacugggcuuugugcuauuccuagaaaaugcaaugccugguggacucugucuuguugccuuaaauauacuggcuguuucccugucugcaacauaacuucccccaaauauccacauggccucucacugacuucuccaagucuuugcaaagauguccccaaugggugugcccuauccugacuauccgcuuuccagcugcaucccaccuaccacucuuaauuucccaucccugauuaaugauuaauucauuucuuuaucucacuuauauagaauaauuauuguauuuuaauugucuuugcccuccucaacuaaaauguaaauuucaucguuagugcuucauccaugacuuuguccccagcaccuaauacaggcaguauauaguuagcugucaauuauuugcugaauuaaugcacauuugaugcuaaugaauuaauaacacuuaggcccacaggaacuaagggaaguacauaugugacucaggcauugagauaaaccuaauaaaaauaacuucuauuugccuuacgcgguuugaagacuugcuauuuugcggcuuuuaaaaguaauaaauaucaaaacauuguuauuccauaauaaacaaugucaaaauccucuaaugacaugaauucuuauggaagauuaaauaaaugagaauuaaaaauggaaaagagcauaaaaauuaucuuagucauaucauuugaugcugggguuuguuuaaaauggugauugcuuucuugacaaguguauguauauuuuuuaaucaaaaaagauuuugugagccggguaaacauauuucuucacuauuuuccaccaccuaacaguuuguucuacuuuguuuagaaagauuaucuguggcaggugcuuuuuuugccugcuauguuaaaaaaaauucuauacaugcuagauguuucucaucaacucagcccaaaauaccuuuuugucacuauuuccaaagcuaguucuuuaauauuaauauaguucugcuuuggcaacaacaaagaugaauagcuauuggugguguggguuuuguuucugucuuugacuauuuaguguagagagguaucaguaugaggaguuaacagugcuuuaaaaaauaagcagggguuuaaucuucauugcucuuguuucaguguuucaucaauaucaaaagaccuagugcugguaaugagaugguacauuacucccaaagcucagugguuugugauuugcuguagaaauugggcuccuggucuuuagaauuaggcuaguuuccaaaaacuaaaguacagagaaagugagaaaaauaaagcucagagaauaaaaaagggagaaacaaaggaaaauuaauacauuuuaaaccaaaggcaugaauguaacuuuagccuaaaaagugacuaaaaagcauuucugcaccaggcaaacaauagaaauaaaggaaguaaauaacuaaacuaaaaguucauauuuuaaaaauagcaccucaaaaaaugcuuaaauaaaaugaaagacuaagaaaaucagugccaaagauucuauaucaucuguuaacaaaaauauuuacaaagugguuguguuuugaaagaacauacaaugaauaugcaauacuuacuaaaaucuuaauugguggaaaaaucuagacuauucguauaaaaaucaugcuccaaagaacaccaauuggcucaagaauuuuguuuuauuuuaauauucaauagguaugguucaguguuaccauuguugccguuuuaaaggggaaaauaugaggaagcaaagagauucacacguauauauacucaauauauguggacaaagccaacagaaggguggcaguacucuaaacaauuuaggucuugaaaaaucauuguguaaagagaaugguuaugguagagagaaaagaucacaguuuuuaaaaguguuugucuauagaagcuaaaccuaucaguuuuuuuuuucaguuccuucaaauaggugagcaccaauugagcacccacuaugccaaguuguggggagcuucuggaggaaggcaggaaaagauagcauggaaaggccugggccuaagcuuuccaaaaugcuuuucccacugaccagcuaugugaccucaagcaagagauacauccauuuccuugccugguaaaggcuuaauaauggaguuaugaaaugaaaucauuauaugaaauaagcaugcaaaacauuuauaaaaaugcuuaucuuuuaauaagcauuagcuauuauauaaaauaaaggaacuaacauuuaauagaaucagacuacaauuuggaugugaaaagugcagaucagacucaguacccaaucuuuacuaguuauauaauuuuuaggugaguuauuucaccucucugagccccuguuuuauuaauuauauacuaggaauaaguauuccuauuuuucaggguucuuugacagaauuaaagauuagguauguaagguauuaagcauaauucuuaguguggccaagauuuguaaaauaaguuauuauuguaaauaucucuuguuucucaaagggcacaauuccacuuuucugucaguggauucugagucagcauagugguauagauagaaguaaggucucugacaacagacaucauguguuuuaauauuaauacuacaacuucauucauuaacucaguaaauaugaauugcuuaucuacuguaugccaucacuguuccaaauuuggaguacaaagauccaugcccucauggagcucccuuucuagcagaaggggacaaacaauaaacacaauuaauaaacaaaucauagagaaucuuggaagauuauaaaugcuaucuaaggaagagagauagagaaaaggagaaagaggaaaggaggaaggguaguggacagaacaaaguaagaggguugggacuugcaauuuuccuuauuaguuacuuauuacccuaaaaccuuaagcaagcuccuuaacguccauggccuuaguuucuuugucuccaaaauugggaaaauaauauugccagauucacaggauuguuuugaggcuuuaaugaauuucuccaaguaaagaacauacaacaaugucuggcacauaguaaacauucaguagauauuggcuauuauuauuacuauuguuaucaggaguuagagaaauauggccacuguaauuacauggguugguugaaauguaauuuaucaacuucauuguuuucaggcuauacuaauuauccaauuuccacugcuucaaaagccuuaaaauauuuacaagugagcccucccaugaaaauuucauaaccaaguaaaauuuauaugaaucacauaaaagaagugcaaguacuuaaagcaugcuaaacaauuguguaguugugauuuauuuacaggcaagcaaucacggaacuacuaagaaacuuuaauaagcaacaacaccacaguagauaacaaaaucgauaacaauauuaauugcauauuggcagggaaaaaagauucccuacaaaccagaagcucugauuuucucaugaaugagagaauacaaauaguuuaaaguagaucuaauaccuauaaauaaagauuuuaugcaagagauguuuaagccauaacucaauuagacugggauuggugcgaaaacaguuucccagaagcaaaguuuucucccuuaagcguauauuuaccuuaauugcccaucacaauguaggauugggugucagaaggaccuaauagaaaugaauaaauaacaccuagauuccuauuaaauauuuagccuguccggaagagaaaacaagcaagugggacauacuuuuauaaugacuuuuuucuacugauugauucuacuggauagugaauuuauuuggauuauauccaaccagcuaaaaugggaugcugguuuucugauuuguuuuuucaguccccugucaggguauugcuguagugcauaagugaguaagagagaugcagcaggugaagcaaggaauagacaagaauaagucaguaggaaacgaauccaggccgccaaaaaagcacaaugaaaaacauuagugcugcgucgacugaugagcacagcuaaucagcccuugggauaaguuaagauuuguaaauucauaaagacuggugagguucuuuaugcuauuucuguaaugguaaagugaaauguucauuucugccuauuucauauggaaaaaaacauuuuauuaauaaaguaacuuauguugcacauuguauaaauuuuaagcagugguuugugagacuguaauaacuauacacuuaagugucagaugaaaucuuaaaauggccuaagaaaaggaauauauugucuguguaacugcauagaccagaggcacuggauucaggugagguuugaucuaacugcucauacagugucacucuaugugucacugaaagauuuuuuuuucccuaucuaucauccaugguaucagcuucaucucaggcaccacuacuaacacaccaaaacucuaauucugucuccauaguagcaaaauaauaacccaguuacaggccucccauucuggcacaguaccauugggggaaagcaagaggggaagaguauugcuucuagauucuccuacagauauugugggacuugcuuucauucugugaccuaaauuuaguucauuaacuauuuacuauguccagaggaauaggauaugcugauguguuaagucaggcaggggaccauuccuacccaaacuaagaacagaagagugcaggguccaaauaaaaauaucaagauguugugggcaauggagaaagagacggccacuaagaaggccaaaggaaagaaaaauccuuuucaaggucuuaaccuaucaacuacaaaaaauguuguuuuguaugauaguggagagugucaguguauucacaaauaauuauugugacugugaacugcuucucaugaggcuggaaaagcgggucugugccagaccauaaaaugccuuaaauuucaugccaaggaucugaaguuuugcacuugcuauuggggauuuugaaggauuuuaaucaagagaauacuauguuuagcauuuaccuauuuuagaacaguccuaguauuuuuauucgauacacauguguacacagacacaccaguaacugugucuuuuaauagcaaaaucaaugguaugagggagugucauuuccuacagagcaaaguaaaaugggacaaaagagaaagacauauauucaucuugggaaaaagauauacauucaucuaugaaaaaacaauuaaacagagacaaucuuuggcuuauugggaaagaaaacacugauaaaguaauacaagaaaaguacaagaucacagcauuuuuuuauuccucauucccucaggcuuccuacagguuuuaagcuuuauguauuuuuuuuuuuaaaaauccaagagugaagcauuguugucugacuauuaagauaucugcucagucucuuuguaaguaauuugaucuuuguaagaucaaaggccaaaauguacacagaaaacaacuauaaugaagcagcaauaaucuacuaagugaacauaaggccucaaacaaaagggccacggaguuucaagcaagagauuuaccuucuacaaacccacucuuucuuuaaagcaccccacugcccaucuaacaucaaccacagcuaacuaaacuaaagcaacuggacacuuauucucaucaauucaguacacaugacuaaguaaaaggugaaagaggaagucccagcaaagcagagaagguagcaggcagccaugcugcaggcauaaacaguacuaauggagggcaagaaucauggacucaggaggaggugagagucaagaaauguuaacuugccuucagcacccuagcagucucaugggagacaauuaaugcaaugucaccaaaagcaaacgucagccuuugaccagucccugugaaaggugaaaaaauagcuuuucauacauaguuaucaaaaaaaacccugcugaacaaaagcaucugccagaguuucugccauaaagguggauuuccagugaaagucaacaaaauuacugguaaaacacauauaaaaguagucuuugaaauaucugccaguuaccuuguauuaccaauauuaagcaagguugccuuuuuaaaaacacuuuaaacugcacugguuaagcaauuuuuaaauauguggaauauucaucaaaauacuugauuagaauuaaaauugauuuguugacaauauucuucuccauguacauauuaaguguauaaucaacaauacuuuuccuuuguagacaagcuaugguaagaaauauaaacuuauaauugcaugccuuaauauuuuuauuuuaccugguauaacuuuggauguucccaaagccaucuucaguuuuggcaauuugcuagaaggacucacagaaauugaaaucuguuguacuccugguuaugcuuuauugcagcuaaacaguacacauuaaaaucagccaaaagaagaugggcagaguccaggaaaguugcaaacauggagcuuccauugucuacauaguggucccaguauuaauauauaacauguagucccaguauuaauauguaacaacauucuuggaguauugccagaugagggaagcucucccgaaccucaguguccacagccuuuauugaggcuccaucauguagacacaguuggucaccuaaauggcugaucuguuuucagacccucaggagguccagcugauacccugugacuugaagcccacagccuaaaucacaugguuguuguggcuuaaagcuccuaccccacacguuacuaucuggcuggccuaaggcccccaggcaaacaaagauuaucuuauuaagcaucacacuccaggacuucaagauuaccucccagaagccaaggucaaaggccagaccucucuuuggaaaagguuacauuauuuacacaccagauaaaaugugaauagucauauauugcuuauuuuauugauuuuaauuuuuguugucaaaaaugacaguugaagguagaaaggaaagaugcaagucaagaaauaauucuacaaucuuuuaaagcuucaguggggucuucaaauucuuucuuuccugcuguuuaguuauaauaugaucagauaacucauauuuucuuuagauaaaccagguugauaucaggaaagauugaugagauuaauuuuauuuuuaaaaaaugacacauauuaagaguauuuaaguguucuuuaaagaaaaauguagaaggaagaaaaaacccacaucagaaaaccaucuuaccacaaucucuaggcagaauucucaaaagauaaaucaaguuuauaaacuccaaacacauguuacuaugauaggagucuaaguuaaguuuuguguaucaaggcuaaaugcuuuauacaagugaacaucaaugaaauaaauaauuauugaagauauuauagucucuagaaaaaaaugagaauaaaauuuagcauuaaauuauuagaauauaaauuaaguaaguuagauaauaaauuuuugccagagagaaagaaggaauauaagcuguuaauugaccuaaauuuuaagcugagauuaguuccuuaauccaauaaagaauaauguuuuuuccuaacgaccuucuuaggaauguuuuauucuggcuuaagcaaauaugugugaaaucucucauccuacuucuaaaucuuuuaaaugaacacuguacucagauaugcuaaaauuguggcuauggcuuuuguuguuguuuuaacuucuauaauuuugaccaaauuuuaaaugggaaaauauuauuaauaacauuuauugcacacaugaaaaaaauuacaguuacauauuguuagcguacaaauauaucaaguauguuuuauuaucacaaaaaucucagauuaacauaacuaauucuuuauauuuccuucuuauuuggaagagauaucuuuugugacauaaacuuugaauauuuugcaaauauccuuuuaacuuauuugaagaagugccuauuauucaaugggguuuaaaucacauuuuucaaauacucaauagccauauauggaaaauaauauacuuucauuuuuuaaaaagcauauuauucaauuauucagagaagcccaugaauaauauaguaaaaugcauaucugcaccaaucaggcuuaaugaauguuaauguuugcuauuauuugcuuccagucucuuuuucuaguagaguuuaaguccccauuauccuagucuccuacacccucccauccugaauuuagguuguauuuuuucuaaccauguuuauauguacccauaaagaauauguauuuuaagauagaugcuguguuuuuaaauuuuacauguucuuuucuguuuauuucuuaccugacccuuguugaauuccuaacuuuuaauuucaaauauuuucucuguuaauguggaagcuauagauuucauauuucuguucuuuuagugguuuaucuuacguuugagcaugcaauguuaacuacaaauauuucuaacaaaguuuaaauaaguauauucaguaaccucuucccaagcaagauggaaaaccuaguaugguuuauuuauucugguuuuguuuuuuuguuuuuuuuuuuuuuuuuuuuugagauagagucucgcuccaccacccaggcuugagugcaaugguacaaugguacaauuuggcucacugcaaccucugccuaccauauucaagcaauuuuccugccucagccucccaaguagcugggauuauaggcaccugccaccacgccuggcuaauuguguguguguguguguguguguguguguguguguguguguguauuguuaguagagaugggguuuugccauguuggccaggcucaucucgaacuccugaccucaaaugauccacccaccucgaccucccaaaagugcugguauuacaggcgugagccaccccuccuggcccugaacaauuucuucucucauugucacacauagacacagucuuccucaugcuguuuuaaauuuauauuuugccguuuuaaucacacacacacacacacacacacacacauuuuccuguuuucuuuauuuauuccaugguuaauuaacuuuaugaaaauaaaccacuuucuguguucuccauuguuucuuucaccuucccucuggguucacuuuucuuucuguuaauaaauauuuuuaguuucuuucagugcaagucugugggugacaaacuuucuuacccuagguaugccuggaaauuuguccaggauuuuugaaugauaguuguguuaacccaauggguugaacagucaaagagcacuucugcacauuauagaucuuacccagugccaaacuuuauuaaugauucaaaagguacaggcaagcagcaggcucaggcaagacaucuauuuccagcaggaacuaaagaccaaaugcagcuuccaaaauuuuuuuuucuuacuuucggauguguuuucauuucugacacacagaauaguauuaagcaauauaugcacacuagucacaaaggaagccauuaggaauuuggagcucuuuuguuuuauacucuuauaauuacagggauaagggaauauuuugaugacuaccacccacugcuccccauucuccaaaaagccaugccccguacauccauaagguccagguucauugaaaauaagaaaucuaguuacaacaaauauauccuacaaaauauauguucucaauaaaaacucccuaucuguaguaaauacuauuuuuauacugcauagaggucuguugaaggucuuuggcaugguuauaaggaaguacaccgagggucauucauuuucccuggauggccuccauaaaaaagaucaaguugcagguauaguguuaacucuuuuacucccaguuguuuuaugauauguagaauucuggguugacagguucacugguugauuuuucccucaguacuuugaagcuauaauuucauuaucuucugacauccacuaguugcuaaugagaaauuugcugucauucuaauuguuguucccuuuuagguaauccaugcccuauuucuguuagcuuuuaagaucuucuucuuauacuucuuugcaaguucauuacaauguuauaaaauauguaaguauuuaauuucauuuauucugacugguauugaaugugcacuuucaaucuuaguacuuauauguuuaauucugggaaagucucaacuguuaucuuaucagguauuacuuuccuguuauuccauuuucuucuggugaaauuucuuuuagacaagugcuaaagccuuuaaaacuacccucuguuuuucuuaacuacacauauauucagauacauacauuuuuaaaauuauuuuaucacuuucgcucugaauuucucucaugguucacuuuuuucugucccauuguuucauaguuaacuuuaucccaucuuuaaucuuuuaauuuuucaguguuagaacauccaauuauuguauauuuacguuuuauauaauauuuuauauguauacuuuuaauuuuauuucugccuauuuauguuuuauaauuucuuuuuacuuuauugaauggaagucuaagugauaccugggucugaauucucacugagagaauauaaacauacucucuucucauguaucagaauggagcaaaaguagauuuuguuucccaccacccaucuaucauacaguguaaggaaagguuucugaugcaucaccuuuucuaaacaaauggagaccaagggaacuuccauagaucagucagcugguuccagugccuggaaagauaauggagcuguagauaaaucaaguugcuuccaauuuucaagucccuaaaauaucuuggaguacuaagaaaaaaucaauaugucuuuaugagacacaagucccaguagcccaauugaauuucaucuuuuacaccaaaaucaugauccuggaggguggagaaucaaaaaguucauauaucgagauuucaguaaggcuguauuuaggcaggccuaucaauaaauaguggaagaaagguacaagugaaaauucaaguuuguaaauaucuccaaauuaggaaaaaaugauagccagucagacaauuuuguaguagacauauuucuauuucaaucaauaccguuccauuauguuagccaauaucccuuccaucucuuacuauuucuaucacugccuguacagacucaaugauagaucuuaaaguaaaaagacucaaagagaucguagagaucauccaaucucaaauguuuaguuguauauuucccauaaauguugguucuagugaaaacuaaacugaaaggggauuucaguaugagagaacaacaugugaucagaagacuuuugaugacugcagagauuagaaguuugcccagaaagucuggaacacaggggagguaaaagggaagaauagagaauaagauaagaaagacagcuggguucagccucuggaaggucaggaaugccagacugagaaggaauaccgggacguuguucuguugugaagaagggacuguggaauacuggcuccucaaacgucacugacacaaucuguugaucaagacagugcugagucuguggcuuuucuggguaacauaggagacugccuuaacugauuugguauuguuuugggcagggaaguuaaggucagauuuuauugagcaccuaacauuugauuaaaaguacgucuuuuuuuuuguuguuguuguuuuguuuuguuuuguuuuagacagagucucacucugucgcccaggcuggaguccuguggcuuacugcaucuucugcuuccuggguucaaaugauucucuggccucagccuccugaguaacugggacuacaggcagguguuaccacaccuggcugauuuuuguauuuuuaguagagaugggguuucaccaugucggccaggcuaguuuugaacucccaaccucaggugaucuggccgccaaggccucucaaagugcugggauuacaggcgugagccaaggugcaucuuuaaaugugggacuugguuagaauuaguuaagaaucacaauauaauaauuuaagauuggugaacauagcaagagaauauuuugaggauuucgagaugaggaguucaaaaagucuuaggacauaaaccauugauguuuuacugaagagcugauguguuccuguaaugaacaauauauuuaauuuauuuauugugcaagagucuucuuacguuaauaaagacaauggaauaguaauaucacauuaauauagcuaguaagcuguguaggaauugauucuugagcaggaauauaacuugaugagaauuguguuuuauaaagauuuuuccagcauuuaugaauggaauaaaaagauaccugauagacagaaaacagcauuagcugggaaguuguuagcaauagcaauuaguaaaugugccugaauauguuaaacaaaaugaggagagaagcaaaagggaaaucaaagaaaaauaaacagcuggguggguugguagugguagcgugagggaaaguuaaaguauaucaguuagaaagaaauucaggauguugaauuuuaaaucugaaugacuauagcugguucuucuaacagaagcagauccuucucgcaacuuguaugacauuugcaccuuuuguuacacauuguuugaacacugccuguguuaguucaaugcuucuuaacccuggcugcaaaauagaaugcaaaaauaccaaggccuggcccuacuacacaacaguugaaccugcacauaaaauugacaaggaucaggcaguaaaagcacucaucucucaaaaacucucucuguagcaguagucauaugaagucugaacauacauugaagagauauauccuuaaguuacauucucucuaaaaacagguauauaauucauaaauaucauuaaagaaggaggaugcuaaauuuucuuuguuuauauuaguguuuuaugaaaacucuuuuaggaauguccuagccuaauagcguuucaugucauucacauaaaacaucaacaucgagaggcauauuaucaaugaccacuccuuaagcuacaaaguaccuaaaacacauacaaaggguugcauuuugugaagucaguaucuguaauaaacaugcaaaaaauaaauaacuucgauaguaggaaaaaaaaagauagggucugggccucagaaugcuucgaaagcugcccaggugaugcugaugcauucugaguauauagacccuacagaagaacacuaacaucuaauguuuggcccuugacuucaagaaacuuagaccuugguuggaaaaaagauaugaccaauaaggaccacagucccuuuauuucacacaaacauuugauauggccaagccuuucaggacuaucugagaguaggaagacuaaaaagacuuuacuuuucaguuuaaaaauaaaauuacauguguccauauuuuguaauuuugguuaacauaucugcucuuuguuggguuauauuaacaaaggauagucaccacuauuucaguguggaaaaagaucaacucuacuuuuguauacagugauuacugaauuaacuuagcaugcuugacuuaagccucucagagacauacuaccuuuuuaauaauuuggggacacaaaaauuaauguauuuuaauaucuacauuuucaccagauauacccuucuuuagagaaagaucuaugaucucugcuauuuccucaguaauucauaaguugucccuuucacucugucccaagcuaucucugaugguauuaaccaggcugcagacaaggucucagcugggucugagaugauauaagugcuucugaugaaagggcuuuuuccccaagauaauccuaauucagcuuauugcuuuucauuugcagcccccuauuuuccuguagauacuaaauucagcuggaagauuuucuuuucucaaaaaguuaaacaucuguuaaugaaaaaugaccagaaguaaaguccuuauuagaauuuaauuacagagcaaauuauguuuuuuuaauaguuuacaaugugauccugcuuacuaaaaguggugcgcucuauuuuacaaauuucaauuuuaucccuaugcaacaaccaaauuaucuuaauggguguccaagugacaaauuagauaaaugccuucccucugaguaauuuucugauaaagacacaucguuuaguugcaagaugacaaacuauguguucaaagugacaaaucauuuaauuaaaauuuacaagcgguuaaauacuguuugacccaaauggaggcuguuaucaugaaucaauuucaaaggaggaacaagcuuuucagaaaaaucaaucccaaauaacuauagcacuuugaacauauuguacaaccucuuuacgauguuuuugaacaccucuucagguuagcggcaguuuuuaccugguucaaacagauuuucaaucuaguugaaaagaauuugagaguuuuacuuaguacuuaaacucuauucaguuucuugaauauuuaauaucacguucaauguucaagcaaaaugcucuucuaucuuaagagaaaauagcugaaauuuugaugaguuauggcuuuuuauugcauauacaggccaauggaaauugcaaacaucuuucaugaaaaggcuggguaguuuuuauuugagaauaagaguggccauugcauuuacuuacuaauacaguaaauguaaaauugcuucaguaacaugcuuuauuauuuaugcugccaaccacauaaugugaggguaguuucauaaaaaauauaaauuagagaaauuucacaugccagcaggcuguagaucuguuuuauggcucugacuuagcaggugcccuucuauuuuaguugugcccuguaaugaaguacauauuuaagcaguauugaaauucagauaaaaauauaauguguaugaggaaagucaguugcuuuccccagugaugcuguacuuuacaagcuccaucauuaguaauuaaugacuugggauucuuuucaucaauucaacucagcuuuuugcucaucuaauuccaugccaagguugauaaggucuaaaaaaauauauuugcgugauuucagcagugguacuuuuacugguggauucaucagauaugcaagacucaccuaugaauaagaaaauucauuaauaguuagaguuagacacagcucacagcacuacugacuaaacuaacaaacuaaaucaaaaggaccaaugaaacaucaaaauaaucaucuaaauauauauaccauuucuuuccccaaagacauuaaauuugguuuaaggaaaaggcaaacgguacuguuggaucauuuuaaguuguuaauauuauauuuguauaauauuauuuugaauaauuugaaucuacuuuuaucugccucuauuuuauugucuugucuuuggagaauaaaguaaguuuuccaccuuuagcuaugguaaaagauguaauaauuaagcaugcugaaaagcacaggauuuuucacuagaauguaauaacaauuuauuauuuacaaugugcucuaugacuccauuuaaaauauacaaagccaaugaaguuugauuuaugaggaugauuuucaaugguuaccaccaaauacuuagaauuuaaaugugcuauauauaagucaagagcucauuugcgaugccagauaccaauugggcaaauagcuaugauuuugacaagcaauuugcuucaaauagaagaauauuuuauaaaaggucaaaaguauaaaauguuucauccucaguugaaauuaaugauucagcuaaugucuaugcugcuguuuacaguauucugaaagacauacaaccucuaauuaucaauagucauaaauaauugucaaaaaugcaaaugagaaaaauuauaucaaauuaaaauaauuaguucacuaguuaaaauuuccucucauauuaaaaaccucuuuuuaaaaaaguaugacacugaaaaaugaaggaauccuuuaguauauuguuacuaaagcauuauugaaauuugacuuugaaauacaagcacaaaugauagauaacauguauaacgcagauuacauaauuucuggggauucauuuuuucuuuguuuuucauuuccuugcaaugacaucuacuuuagcaaaugaauagacuucaggcacauuucucucacaucuucaagacuuccaacacagccuugggauucauucacaaaauucuaguucuaaauuuaacuuacugacuaaccucacaaaauaauccaaccuucagcuuugagccaaaaugcaugacuucugagaaaacauaggccaauuuuguuuuauuuuucauucauuuaacuuuauaauguaugugaauauguuuuuaacauugcuacauaaauguugacaauggacagaggcuaaaucuucuggccaugacauaaacaaaaauccauuaaaauuaugagaaagcuuuccagaucuguguaagaaccggcuuaagguuagcccacaauuuauacuacagaguugacaaucuucugugaaaugcucucugaaucuuuagaccacucugcagagcuggauuuaagcucugcucucauccaguuuuauuaaacaagaucaacaguugaaauuaugguccguggaccccuguggguuucuacccaugcugcaucuccaagacuuaucugcaacccuuuuucaaaacccuugcuuacucuccuccauguacaccagccuccuuacugccuugguuauaagccaaacaugcuccaccucagugcuucacacucucucugcuugcagcauucuuuauccaaauaccacaugacucuuuuccucauuuuugucaaucaugacuucucaacgaggccuacucugaccaggcauguauauaggcugcacuucccaguacucucgaucaccauuccccagcucuauuguuuucauagugcauaucauauucuaacaugccacauauuuuaauuauuuauuauacccgugguuuauaaacuaucugcucccacuagcacauacauuucaagaggucagggauuugggaguguuuuguuaaguaaaugccuguccagggccuccagcaaggaggacauacagaaaguaaauauuuaccgaaugaaugaaugaaauauacuaaacacauucuucaaguccuggauauugauuauaccuaggaauauagcauuuuagaauauugcuacaacacuauuacuucuuuuacuaagggcuaucauuuagugccuacauaaugugugccaggcaccauaaacucucucacacaaauuaucauauuucuguucagugccuguguuacuugcguauuauuaucaccauuuugcaggugagggggcugcuauucaaauaauuuaaguggucacacaucuaggaaauggaggaaucagaaauagagcaugggucugucaaucuccaaagaguuuacuauuaaccauuagagaauacauaaaaugcucaucucuaacauuaauuugguaaaaacuggccauaaucauuuuuccuaauauccuuuauauauauacucuaauccaaggacuuauuauuugucauaugaaccaagauaauaauuuucuaacugguauuucuccuuuuuucuacucuaauccauucaucuuccuaaaguacagcuacaaucaugccauuaguaugaucagaguccuucaaugcauccccauuuugugcauauucuauuuauuauauaauuucaguuuacucaccaagugaugcagcuuucucucuccaaacaucacuccaguaagaaagcuagacuuuaagguacuaguaauaacaggagugaaaaaggucuauuauacuaaguugagucuuguauccaacuuaauggguucauggagacccaaguuuuuaaaaggucguagcccuaggaucaccauuuuuucaaaagauuguuauucuuuuucuccaaaucaacaugugugcacauuguuaaaaugaauuacagaagacuagggguagauacaguauccgauuauaacuauuuccauagugacaaggacaaagaacaaguugucugcagauugcaacaccacucagauacugaaauaauuaaggagauaacuuagaaucaaguuagcagccacucagaaaaaacugcaagcuccaucaaggcagagacugucauauucacugcuauaucuucagcaucuagcguaguggcuggcacagaguaaaacucaauaaauaccugacucugcuguuuuuaucucuguuguucucacugaaacucuaauuuuuaauuguuguuuuccauucuguauacuauaauucuauuaacacugcagaaggugcaggaauuugaaauaucuaaugaaauaaaugguauaaauucugaaaagucugaaauggcauccaagcauccucagaaugauccuagacuuccagaagaaauccagugaaggauuucaaugcuauucucuaccuggaaucuuuaauacguuucugaagauaacugauguagauucucuuaagaagaaaugaacagccaaacucuacgcuugcauaacuguguaccacugccuuuguuacuucaacuaauuaagguuucaguuuguuauuauauucgacuccacuguguagacuuccuucaacaccaagacgcugcaguucaccgugugaauugcucugucuagucaagaacauacacaggggugaggcagcauguuauauuuaauuauggaaagcauauuuucccagaugaguuggcucacagguccuccucauuuuccgugcuuuaugguggggaaaccucuuuaauugauauacaucuagguuuuguauggccaaauuuugcgacagaacugcauucuugggaggauaggauaaucuguaauaaaaacucaaucuuucauuuuccauuuuuuaacagguauuuuuaaauuauuacuuuagcuuuuuuggcaaaauuaaaacaaaauggaacgguauucauguggauaaagcuauaauuagauuagauauuguuuguugcuucucuuuaucuuucucauaacugucauuugauggauguucucuaguuaucuuuacuuucaguucacuuuacuuucucuuuuaaacuuaccaugguacuaaugacaacuaaaagccauugcagucuuuccucauccaacagauuugccguauucucuuauucauugugaggaauauuuaaaaucaguuuacucaugccuagcaacauguggcacuuuugcaucccugacuugaugauacaacacugagucaacuuugacuucagauacuuuuuucccccuuuccuuaaugaagaggcuagauagcaagcuguugacagaagacuaaaacuugauuuuaaucuuauuaacuacauggagccuuugcagaugucacuaaauccaacugggauauuaaaguaacagcagcaucccaggaaagagaugagucuaacuccaaccuuuuccaugaagaaaugccccaguucugagaaaucaauuugucucuggauuccugacgauacaauucaucuggcauaagcuccauuuauuuauuuauuuuaguaucauuugggguccuuucucucuaauuagauuguaaauuccuagaaguuuaagacaagagucuagcacagagcuuuguacaaaauauguagcugcaucauuuuguccccauguagacuugcuuuguuuuugaacuaugaauuugcuuucaauaucucacaauaagaaaugcauaagacaguguccuaggaaacuuguucacuacagccuaagaaacaaauuggcagcacaauuuuagcaacuauuuaaaauugacuaugaccuucuauacuuaucaggaugggcacuaauaguacaguaacagaauuuucagguuugcauuucuugcucacauuacaucaggguugcacagggcacugcuucuuguuuccuuaccccuagacucaggaaccucuacacauuuaucuugucaguaggugccacaguaggagaaagagaacuuggagaaucauaaacuucucaaagguaucuguucaaacgugacacaaaaaaauuguucguucccguuccauuagacaaagugagucauuugaccuugcaaaacuucaacagagcaauucugucaugugccuggaagacgaacaagaauguaguuaucucccuaaugaacaaaacaguacccuauuuaaaaauguuccaccccuucccugcauuucccagucuccuuuuuacugaauaauuuugcccaauagcuuuugucacccuuuuacauaaaauguauauaauuuacuuaaguauuauguuuacugcucucucgcauccaaccugugcuguaauuuacaugaaaacagacauuugucucuucuuuguucaaccaacccaaacuaccccagugccuagaggagugccauguaccuaaguagcauucuauaaauauuugcugaguaaaugcaugauccaguaaaagaacaaaagaaauacccagguucuuacagcauacccacagcuagcuucauccgauuuucuuacuauuccuuuccccucugauuuucuuguacaguuacguauuaucaaauguaacuauaaacacaaaacuaugcacacuuacauccauaacauaucuuucuaagucuucuuaauuuugccaauacuaauuaauuauuccuuuugagaaacacaauaauaaaugaaauuugguaccaaaacauguuuaucacuugauugacugauuguuuuuaagaagcugcaucuaaaagauuauuuuucaguggccuuuauauucucuuauaaagaaauuguugggguuauuguuuucaacacaucuuaauggcuccucuaacugcucucccaguguaaucacuggcuuuuaguacaaaagcuucucucccuccacucccaagguaaaaucauuugaaguaucuucuucuaugauuggccugaugcucacagucaccaggcugguagggggucauccugcugggcaagguccugcuuucuaaggccugcuuugcacuacaaaagggaacuaccuugagaacaccuauuagugcuugauuuuccucuuugcaucuccauugcccucuaccuggcaugcuaucaugaaagggcucuucuucuaaaagggucuguugaauuucccaaauaccagcuuuaaaaucuuuacuugaucuuaaaagaguugcucuauccugacagagaagaauaaaaggcaucucuaacaaauuuaggccauucccacuucaggaacaauuagagguuucacacuauuucccccucagugcauuagauuccaucauugauuuuacuuauaagaggauuuuauuuaaaauuuuagaugcaauuaucuacuacucuaacagugcuaauaguuuuauaacaccuaguuuaaaagaauaaugguuaauaaauuaauuuaucuaaauacauguaugauuuaguaauuagaaucaaaauuucagggauaacagagcaggguucgaaucccacucugccaguuguucugccacuguggcaacuugagcuguugacugaccacuuuaagaucccauuuccucauggacuaaggggccugugaagauuacauaagaguuaugcaaagccuuuauaacaaugccuacuucacagcauuuaaagagaaaaugaccuuggcuguauucucucaaccucuucauagcucucuccauucauuuauacuuccucuccccaguaauaaguuucuuucaagcuaaaaauccaucuucucaucagccauaaauguagauugccucuuuccagggccaucguauggauauuugauauugggcacaugucugagauucauuugugacauuuauauaagucagaugggaagauuagacauaagcaaacaguguguuccucugucaacauuuguucagccuucugugggaaauaccaagagaacuuauuagaguaauuugcaaaauuuugucggccaguuugcuuauucaaauuggaaacugauuaugcauucaggcuuuauaaagagaauaaaugaguucaaacuucuucaaugaaaaugaaaguaagaccuucaaauuuggcaaucaugaccaaauucaggguguuaauuuagcuaauuaugcaaaucuuaaagacaaucauuuagaagugaucuguauuauuauaaaaaguaugcauuaggauaauguaugauguuuuaaaaagaaaacuucugugacaucauagauuggcaaaaaauuuucaugauauuuuuguuaauuuggccaaagacuuggaacagcuucccuuuauugagaauaacaagacaaucauguuuauuagccauuaaagaguuuuauaauugauauuguaaauaggugacacuggaugaacacccauugauugaaaauaaaacaacaguuuuucaauaauaaagaagacaaguaagcccugaguagaaaguucaccauacaugacaaacacaagacagauauauuuuauuuucagagaccagcaagcuuaaaaauaaauuauuuggcaaugaugugggauaaguuuuuuuuuugaaguauauaacuggagcuaaaagaaaaacaaaaacccuuccacuuuauuuuuaucguuaauauauuuuguucaggcccaggcaaauugcaaaguaggcaaaagcauuaauuuguuucuggcauuuucuccucuuugucuuguaccugguguccauauauauuucuuccaacuauggagugccuucugacaucuuucuccagauaacuucaaaauuuucccugcuuuaucacaccaucuaaaccuaccugagaguucauuaccucaggacccuaucauaggcucgaugacagugaguaaaauaucuaauacuuauugagaagcccuuuacacaagauacacuaaguaucauauuaucugauauaauauucaaaacaaucuuacaagauagaugcaguuuuuaagauccuuguuuuauaauugagaagagcaaggcuuacagagauuaagaaaauugcccaucagggcuugaagaccaaggugaagaaacguagcugccuaggguacaaaauguaagaugggagucacuugcagagcugugaguaagaaccuacuuaaauuuugugcccuggcccuaggugacuuguuugccuuaccuuaacucaggcccugucguccauaucacagaaacaaugucugaaacaacugaagcagucuagucugacugcagagcuuguacuuggaccgaugucaacaacacuaucccaccacagaaaugcuauugguauugaucaauucacaguucacgauauguaauuuuuugagaaaaaaauuuccaaccugaaauauguguuguucauucauuuauucaacuaacauuaguuaucuacuauaauaccaauucugugcuuacuuaguaauauguacuuugaagggacagaaaauauauggugcugacuuuuauagcacuaaaagauauggaaguagaagcagacauuaaugaaguaaucauacaaaugaacauaaauugcaacugugacaaguaccaugaauaaauacaugguacugugauugucaauaguacugauauuugacccauuuggguauucuuagaaggauucugaggaaguuaugauugagcuaauauucaaaggauaaggaaaucacuaugggaaggaacuaaaggaauucuaggcacggaggcagguaggcauggccucaugcauaaguauacaaugcagaaaguaauaaauugugcaaagaaaucauuuggauguucagauugaguguucugacaggacacaguuacggccuuuagcauggauguuaguggaugggcaggauuugaacuuacugacaugggacaaggaggccauuguaggcagagggauuaguaagagcaaagagauaaagguaaaaaaaagcuuaaauggguacaaaggaaaguuugcauggauaacggcauggcagguaagacauaaagaauaaguuaggacuagaucaucaggggauuuaaaugccagcccaaguugaugggcagcagaaagucuucaaagucuauuaaguguggaagugacauacuuagaacuauaaacuuuaaucaggaagccucauauuaguggagaaaacaaaaauuaaaguaugagaucacucucaucucagauuagugaaccauuugagacauuaucuuggaaucuauagggagacuuuguuuuuuucuuuuuccuuagaagaguauuagagaagacuuuauggaagagaaaaucuuaaagcuguucuuuuaaaguuaaguuagcuguuauuggaagaaaagucguccccaaguuggaauaguauuuuccaaaauaucgacuaaaagaugguaggggagaacuuaauuuuuacuuaaagaaagauguuuaaagcaauggaaagcaauaaaugagacaagaauuuuauuuuauuuuauuauuuuauuuauuuauuuaauggccagaacugauaaagaacuugaagcucaaacucuggaacuugguuugauuuguguaucagggaagguuuugaggaauggggugacaugaucaaagaggcagaggggagauaacuuugucagagacacauggaacugauggaaacuaagaaauacugaggcaugaaagcugauaaagaaaaaguuaaagucauuuagcuaacaaaugaccaagugcuguguucaauauaaauauaugucaaagauguauuugauuaacauucagagaaggaucuagaaauauauguccuguguuaccaugaagaagucagauuccuuaauucagucauucauccacuuaauggauauguauuaugugccauauaugccagacacugugaaaggaacuggacucacaaaguuaauagagauggaaucccaaccuccaagaugcuuauggauuacugguaugaucaaagccauaucaaaauugaccagcaaagagacaaucuaaaugaaauuauacagaaauagaaugcaacuugacauucaaaaauaaauauuuaauuaggaccugcuaugugaaaaguauaacuauagugggcacuacauagguuacuguuaaaucugcagccuucugcuaguuaucaaagagccuacaagugaugugaguuugcaaagcacaaacacacaguagguuaaaacaggacaauguuuaaucuaaugacaaaggaaugguauguauaauaagaguuuaugguaauuuagaacauuuagagaauauaauggcaguaagcaauaacuuacugagagucaggucuuaggcuacaccuugauggagcaauggaauuugcauucagccuagcuaagagauucacauuaucuuggaaugaauaaaugagcucuucagaguagcaaugugguacaaggaaaaggacucaaacuuugcaguuaaauagaucuaggauaaaagacuuguauaucugugugauuuuuuuagagacauaacuucuuugagccuuaccuuucuuauaaaauaggaaaacuggccaggcgugguggcucacgccuguaaucccagcacuuugggaggccaaggugggcggaucacgaggucacgagaucaagaccauccuggcuaacacagugaaaccccgucucuacuaaaaauacaaaaaaauuagcugggcgugguggcgggugccuguaaucccagcuacucaggaggcugaggcaggagaauggcaugaacccaggaggcggagcuugcagugagccgagauccacugcacuccagccugggcgacagagcaagacuccgucucaaaaaaaagaaaagaaaaagaaaaaggaaaacuaauaauaggucuuauuucacauuguugcuguaagaacuaaaagaaauuauuuauaaaaagucagguccaaguauuuacauauaaaaauguuaauguccucgcugaauucgcaauaaaaaacuugcuaaacaguaaucuguauaagaacagagaugcugucucucuuguuuccucuuuuuccuaggaccuugcauaaucccugaaucauacaaggauaacaaacaugcgaugaaugacugaaagaauuaaaaguggguuugggugucaugggcagaucuaucuuugugacagaguucauguaggacagagcugagggaaaauauugaaaauugaaguagaagcuugauaauuuucuuuggaucuuagcuuuaccuuuuaggcaguaaagcaucauugaaagcccuuaagcaggggauugacaagaugaagugguacauuaugaauauuauucuggcagccagguaguggggagaacggaggaggauuuagaccacaugagaguggaaucacugguggggugggguggagaaugugguagacaaaggguagaagugagaugccuugugaaugaagaaucccaggacccaguggcugauugaugaagagagaaaaaggaaggaagagaugugaggacucucagaagccagaggaagauaauaauauuuccacagacaccaaucccggaagcaacaaagaguaaacaacaaccaccuucccagaacaggauacauucaagacuaaagcuaguaaagucccaggcaaacugagacaaguuaguucuucaucccauuucacccaacuggacucaaauuaccagcaugccagaauaaaaacauuuuuaaaacuguggaaaagcaggcauagaaaugugcagaaaauaucaaaaaaagaaauugacuuagcuguauagcgauacauggcaaaauuguaaaaacauguccauuggugcuaauuguacugauuuaugucugucuuaugagaaauuaguggaauuuuuugaauuuucuuugcgucugaacuuuccauagaaguugguguaauuacaacauaagaacucuccuacaaguaugucaugaugacuggccaugagccagccauugcggggaagaaaaaaaugauuaaaguacauuuaccugccuuucaaaauagucaggacccuuacagucugagcagaccugggaaugcguuguuaucuggauaaugugcuuucuaccagugcuaugaauaaagagggacacagcaguaggauaaauccuucauucuagugaaaguacccuuacugaggccaggugugaugguucauuguugcaauccuagcaguuugagagguugaggcaagagaauugcuugagaccaggaguuugagaccagccuggucaauacagugauaccccaucacuacagaaauaaacaaauaaauaaauacauaaaaaaauuuuuuaaagugcccuuacuguaacuuagcaauuauucccuucuguggaccagguuuuucagagugcuucuuugcuuaaagucucaacauacauaucucuuuguuguaccuaagcaaguacuuaacuauauuuuuaaaccuuaaagaaaucuuggaagucaucuaauuuaacuauaguuugaaauuuugguuauauagcucuauaucauuuuuauucccauauauuuagaaauaauuacaguugcaugacuuuguugaaaaagugcauguuacgauuaucuguauauuuuggaaauucugaaccaacuggcauaucuaaggagcaacacaugauauugcagugaaacauacacuguaaacugaagucuuaugucuuugggcuuaugagucacagaagauggaaaggagacaggaaaacaaguauauaauuagacagugauaaaucauaaauuaagaauuuuaacuuggagacauaaaaauguaauaaagugcagauaaaaguaacagccugauacucaaaagauuuuuuuuugagacagagucuugcucgauggccaggcuggagugcaguggugugaucucagcucacugcaaccuccgccuccuggguucaagcgauuccccugccucagucuccugaguagcugggacuaaaggugcgugccaccacgcccagcugauuuuuuguauuuuaguagagacgguguuuuaucauguuggccaggauggucucgaucuccugaccuugugaucugccugccucauccucccaaagugccgagauuacaggcgugagccacugugccuggccagucaaaagaucuuaauucaagugccaccuuugcuuaaagcuuacaggaugaacuugaacaagcugcuuaaugauauuagacuuucaucugaucaccuacauucauucauucagucauucagucauucaauuaauacuuauucagagacuuaggaguaagggaggguagguauuauguaccgaauaauauauuaggcucaagggcaggguuuuuuaaucucagcacuauugguauuuugaguuaaauacugaguuucuccuggaauuguagaaaauauugacauauuuguacaagaacugguucuuggagacuaaguagaggaaaauaauggauggcaucuucagaaugcuguaauuggacucaaugaaucauuuccaauuaguauucaaaauguaaguccuuuguagauacuccuacugcucacuuacaucugugcccaucccuaaagugaucgccgugggaucugccuggccaagccuguggaguaugccaacccccagguuagggcuggagaaggauagggccaucccacaaguuaugagugggaaaaaaugguguccuaaggaaagauccuaggcaagauaaaaccuucaguguccacuauaguaguuuauaaagacuuuuugcauuuguuauuacauuuuaucccccaaucugugguauagguaggcacaucuugugagucauuuucuaagcaaggcaagagaaaggagugaucuguucaagcuuacauaauuaguaagugauggagccaaaaccugaagcuggaccuucugguccaaaauguuauacucuuuccauuucucaugcuuccacuugaguguuuucuacccaacucaggauauggggauccacauuguaagaguggaagguaaauuuuuuuaaaaccacaaggaaaccuggauauuuggauaaauuguaaauuauccuugucucagaagcaaauuaagaagcauuucaaagaaaugucaugauuggaugucagaagaugaaaaaaaaaugucacaguagagguaauugcuuugauaaguaucuaugugggagauauuauugacauccaagaaucuuuccaucaaguaaugggacaaagaauuaaauuaaauagaaaaaaaaaaguuggauccagaacuaaugacaauagacaaagucaccauaagcucuaaaaaggagaaaagcagaaaauccacucuaguaaaaauuucuugaaaacaaaaauucacaggaaaugcuucaaguuagcaaaaacuaagaguaauuuaaauugucacuugaugccaaugaacagagaguugcuguuaagguggguggagaauaaauuaauacugggaauauucuugagaaaugaagacauuaagucuaggaaaaagauuuaaguucaaaaauaagaaagugagcucaugaauuauggcugaagagaagaaaaauguaaaaccacugggacaguuagacaccaguguuuguggguaaaaaacuaacauuugcagcauaauuguggcucaguuuagaguaaaggaaaagggcagagguuauuucuuuuguauagaauucugauuucuaaucuuuugacuacugaguguagggcuuucuccauuuaguacuguuccccaucagugaacaaucugcucagaaccauuccagaguucaugcugauccuuauuagcuuuucauuucccugggaguuucucucugacacaaacaauauuuuccaguuacaaacaauucugcaguauaaaauaucaucgagggcaauagcacuugcuuguauuucuuuucccuacaucuuauugaaaaagcugcuggcauuauuucaggucuuucuccagacugguaaaaauuguaauucuaucaaugauaagcugauuuguuucugguuuuucuauuucucgcccgucuuggcauaaaaaauuggacuaaucguuguuguuuuccuaugaaacuaaaugcaagauuauuuauaucuugggcauugaaugacauuuuacacuaaacaugcuauguugaguauuauggcuuacuuaucacaggacaagguauuugagaguuucaaaugcuauauccaaagcuuaccuaauauugcaacccugucccugcaagccagggacaguuuauuauauaauuaaaagagcuauuucacuaagaccccacugcaugcccuugguugcaacucagguagaacauaaagaugacacagaacuuguagaagauuaguugaagaauauccugcucccugaauccauaaaacacgucucugaauucaaaccuacaucaucugcccuuaaaaguauaauagcuucuucaguuuucaacugucacugcauuucuguacuuucaaaaagcuauugagacgcuuggagcaugaaagaugcuauauaaaaccaaauuuaauuccauagucuuccaguaauuugccucauaaauacuucuuggaguagugaaauacuuuuggucauagaaauaaaacuuauguauucaugaccuauguauuauuucaucuucuuggaagucaaaggacuauuucuguguuuaugcuacugaaauaaaucuguuauauguauuuuuauaaaaguuguuaggacauguuacauuguuguuggagguggcacuguuaucuguuguguuuuuuuuuugguuuuuuuuuguuucuuuguuugcaauuacuguacuuuuaaugcacuuucuuagucauuuuaagugaauuggcugaaauuuuucuucauuaauaacuacuuuuauuucugugaaaucucacaauuucauagguauuuggaaauguuagcaaaaccuuaugguaaggaaaaaugaauaagggaaaugucaacccaaacaggcuuccaaaucacuaucaaggagacaguaggaaccuuauuuggcuuugagaaaaggacauggauuuaaugauuacucaaguccauauuuuuuccagugaauucuuucuucacauaaucuuuucucacucuaagcaugucuagaaacaauccuuuuaucuugacccguugaagccccugcuguaucuagaacauuaaaugagaaauuucaacacuuuaguuguaaaagucagaaaucauuuucaaaucuuguagcaauguagauuacuacuuuaacaagaaaacuuguuaaaagugaaagcaaaagaaaaccccuaagauauucugucaaauguaauguguagugauaucauugaggaugaccuuugcaucucugcacuaggaaaaucuaaggauaugagauuaaacccuccaauucgaugcucaaaaauaaaauaaaaggagauuaauggcaaucaugaauggauaugugugaguguguguauguguguugggggguuuacaaauggcacaauuuaucaaguaucaggaacuacucuuugucucauaguaaaauuacaacuauuugcaaugaaagacugucucaugauguuauaguggaauuuuguucaucuaauuuagcuauuaauuuugaaucccuacuggugcuugaggaaaaggcgugggugcaaaaguauguaacauauggaccuguccuaaaagaauuuaagcucuagugaagauuacaugugcaaaaauaaaauuccacuugggauucauuguuuucaggaauauguacuugaauauacaauaggauuaucuaauauuuuuaaugagccuagucagauuuaaaauauccuauuucagaggaaauuuaaauacuugcuuuuauaaaacugguagcauaaucuucacacagucuccucaaggaaaagaacagagcucuguccauugcuguaugcauaguauuggccucaauuucaacagcuagucccuguggaguaaguagugauaccaccuacaugccuguaaucauagcacuuugggaggcugagguggggggaucaccugagguuaggaguuugagaccagccuggccaacguggugaaacccugucucuacuaaaaauacaaaaaaauuaucugggcgugguggcgggcaccuguaaucccagcuacucgggaggcugaggcaggagaaucacuugaacccaggaggcggagguugcagugagccgagauugugccacuacacuccaguccgggcaacaagagcaaaacuuugacucaaaaaaaaaaaaaaaaaucuguagcacuacugugugccucucaguugcacugguucuuuccugggaucauuuuuucacuguagaauuagcuaaaguaaaaaaaccucagaacuuuguuagaauaugcuaaagcaguuuaagaacuucugacaugaugauauuaaagcuucuguuuugaacaagccugucugcccuacuuaagggagcacccaaguacucugggacggggaggggcaucuuccaaaugucccacugguguaauugauugacaaaugaaaagugauuacuagucuggaggagaggagguuagaauaugaccuuucucugaauuccaguacucuagagauuacaccugucaaauauuuuaaaaacauggaagacaaugaggaggcuacacuauugcuaccacuuuuuuuaaaaauguguauuuuuuucacacuguaaguaauauuuaaucauuaaugauuaucugggaaguauagaaacaaaagaaaaaguuacccuuauuuucuuguuuuccuuuuuuuuuucuuuuuuucccugagaccgagucucgcucugcacccaggcuggagugcaguggugccaucucagcucacugcaaccucuacguuuuggguucaagcgauucuccugccucagccucccaaguaccugggauuacaggcaugcgccaccaugcccagcuaauuuuuuucguauuucuaguagugacaggauuucacccuguuggccagguuagucucaaacuccugaccucaagagaucugcccgccucagccucccaaagugcugggauuacaggcaugagccaccaugcccagccaaaguuacccuuauuuucaacauccaaagauaaccacuauuaacauuaaaucucuuucaauauuauguauuagaagucccucuaaaaaaugugucuuauauuuuaguuauauauaguauuuacgauuuaaaugauagaguuacaauuacuuuguaauacugcacauugcugugccacagauuuugcugugcauugaauuaauaacagauaguuugcuuguaaauaauaacauucuaggccaggugugguggcucacaccuguaaucccagcacuuugggaggcuguggcggguggaucaagaggucaggaguuugagacaaaccuaaccaacauggugaaaccccgucucuacuaaaaauacaaaaauuagccaggcgugguggcacgcccauguaaucccagcuacucagguggcugaggcaggauaaucgcuugaacccaggagguggagguugcagugagcuaagaguggaccgcugcacucuagccugggcaacagagcaagacuccgucucaaaaaaaaaaaaaaaaucuauauaaaauuccaaaaaugucuuaaaauuggugaaaauaaaagacaaauauaaaaauaaauuuauucauuaaaaaauuccuggcuuauaucacucaaugagaauaccaagaaaaauuauaaaaauccagccuuacaagaacauacuaaacaauguggucuaagauuugaaguucuaagacaugagauugagcccugaguccauuuaaugaucauguaaccucgagcauaucaauaaaucuucccaaaccuuaguuccaccauguauaaaaugaagauaauaaagauuucuuugaaaacuuguugagaauuaagugauauaauguacauggaauucuguuauaaacuuuuaaagugcuacucaaaugacacuagcacauaauuuaauaauuugaacuuaaaauuuacuucuuaaauucaauugucaaaacgaaauuauaguuaucuuuaucugccauuauguaauuguucacagaauguaacuuaaaguuaguacuaccaacaaggacuguuuuccaaaucaaaaaacuuagagguagcuucagugcucagauuugaacaucaauaagcugaccccucuauccaaauaauagcucuaaaugcaguuuuguuuuaucuuuuccauaaaagugauugugaaaaauuugcaaaacuuuaaauauaggcaccacugaauauaguuuuagucaguguaaacagugucaaaucaagugagguuagccauuuuaauugggcuagcuuauauugugaaacaauaaaauuuucauaugaaugauugaacuuuugcacuaacucuuauaccucucuuaaccuagauauuacaauagugaaaaugaauucugauaugaucagcuuaggguucacagaguugagggagccacugacuguaggaaguaucuauuacuuccuauggguagugcagauuaugucaucacgccucaaaguaaauuguacacaaaguaugaaagcaaugugcucucauaccaucucaaugacagccucggguuccucuuugacaaccgaaguaaauuuaacaaagacguggcaucaaaccauauuacaagccucuugaaagaggcggaaaugagaaguaaugagauuuuauccuaugccccuuuaucgugcaguugucacugaaaucaaagauuccagaaagcucuuuuugacaugaccuacaauguuuacuaugguacaguuugaccuaauuguauaaauuacaucuaaguugaggagcaccuugaccuucuuuguguuuuugucagacuguguuuguggucagccuucccugagucuauugggagacuuuguccuacugcucguucucagagcuuucugccucuaaaauguugcguaauuuucucuaaucucucucagcgacauuuuuuuuuucuuugagauggagucucccucucucgcccaggcuggagugcaguggugcaaucucugcucauugcaaccuccaccuccugggcucaagcgauucuccugccgcagccuccugaguugcugggacuacaggcguaugccaccaugcacggcuaauuuuuguauuuuuaguagagaugcgguuuugccaucuuggccaggcuggucuugaacuccugaccucaauugauccacccaccucagucucccaaagugcugggauuagaggcgugagccaccacacccagccucagccacuucuuaccaauaacuucucuuaucugucaggacacaagcaaugaugcucucucucucugugucuuuuuuuuuuuucucucagagaagguacuucaaguagucucuucuucuaagcuccguucagccucauuucuauccuuuccuuuuaacacugaccaaaggugccaaacgcuaaaauuuccaaauaaccuuucaaugaucagaaaaccguguuucccuuggucaagcaguaaaagaaaaguuuauacagucuuucucuuaagucaguuuguucuuucccauuucauucaacccugugaaaggauuaaaaaugcaaguauauugaagaguuuccucuuccaguccccagaacaaauguauguuuuaauucuuuuucuuuuaguuuuuucuuauuguaggagaaauaauuuccaugauaaaauuuugguuguuuaaacuacuuugaaaagaaagaggacuuacagaaaaaaauauuucauucauucauucacucaauaaaauuaugcuaggcaauugguuaagcucauucuagucauugugaacacgacgaugaagaaagcauagcgagugcuucauagucccuuagggagaaaauguauaaacagggagauaaauucaaguuacguucaaacacugggcaguacagaugaugaaauuaacuguacuuaggaaggucaggaaaggcuuuucaaagaugguaaaguaugaauagagauuuaaaggaagaguagaauccagcagauagaaaagaucaggguaaagucacucuaggugcagaagauuuuuacucccuugcuguucacagaacugcaaauaaagcgaaguaauugcauggaaagcagcaaccauauucuucauagcaucauaugggacuaagaggcuugaauuauauccuaagacacuggaauauuuugaucuggaaaaugauuuauaucaaugggcauuuguaaagaucucucugguagcaguucuuugaccucuuuggguggauuacaugaaggguccccaauuuuuuuuggcaccaggaaccgguuucuuggaagacaauuuuuacaauuuuuccaaggacuuggcgaagguuguucagaggcauuagaggcucaugacgagugcucacccuagaucccuagguuccacgcuccuaugagaaucuaaugcagccacugaucugacaggaggcagaguucagacaguaaggcccgcugccucuccugcugcucaccuccugcuguguggccuggguccuaacaggaccugucagcaguagaauagauaaagaaguugugguauauuuauacaguggaaacuuauacuguaauaagaaugaaugaacuccaguuacagacaacaucaugaaugaauuucacaaacauaauauuguaugaaaguuggccagacacaaaauaauguuacaauauuguuugagucuauuuauuuaaaguuaaaacauuggcaccaauagaagucaacauaaugguuacucuuaucgaugaggcuaguuacuagaagggggacguagugacuucaaggguuugggucagguuuccuuugugaacauuuaucaagcuguagaguuccaauuuaugcacuuuuccaauguauuucaauuuaaaauguacaucggaaagaagaaugaaguaaaagaauaugaguaaccagauuccauuaugaacauacacagcauacacagucuaauauugucaacuuuaauuaaaaucuaacuaaacaugcuaacuaaauuuccacuuaaauuggucauagggauauaaucuauguaaaacauugugaguuuugaauuauuucccuuucucaauaguauugugcacaauucuuaaaagucaaucuugucaaaaauaauucaucuuaccuacucaaaauaauuguagaggcuuguuucauaauucuaugaaacaauucacuauuucaugacauuuaagaaaguguagcuuuuuucucucuucuaaaacaacaugaaaccuccuagcuuuguuuucugagacgguuaucucagaacaaaguaaacaggaaucuauuugguacacaacugauuugaaaugccuauuaccucuucuucaugguuuucuguuaagugacuuccaaugaguucgucucaaaugaggcaacauggcuacuagaaaagggaaacauauuugcuaauauggucauagauguucuaaaggccacauuaaguccuccaugcucauaacucucuacagcaaugugauuuaaauuuuauauucugagaugucuucacuauuuuaaaaacaauaguaguuuucauuuguguccuuuugacaauuucuuaaaaaagggugauuuaauauguaaaaaauauggugaagaauuugaacauaaagacauguuauagucucuucaucuuucuuuuuguaauuccuauaauagaaagcuaggaaauucugugacagagcuuuagcaccggaauaucacacucaagagagcauuuacuaaauguccuugggaauguccaguaggucacauaacugagauugcagaauuguacuugaccgcuggccuucucccaugcagguucccaucaggaagccaauugcuugcugguacguaagaagacgcauauuggggcuuucuauuuuuauuuaaagucauaugcauuuucuaggucuuauuuucccagcuucauaaauugauuuccucucaggugucugcaguuuagauugaaguuuuuuuguuuugagaauuuuauuagaguuaggagacucaggugucaguugugucagacucuaagcaggucacuuacuguaucuucaggcaucauuucuaagucagccuuuuauaguuccucagccuauuucucuaacgccuuaaauccucaacuaacuucaaguguaacaauauuuggaguuuuuuuuuuuuaaucucuagggcuccauagaaaauuccaaauuuuucuaacuauauugucccacuaucuacaaucuuugcuuuaagacaauuuugacaguguaagcuauuuuuuuuuuaaaaaaaaaagcauugagcuuguguucugaccuugaauuuuuauuuucuccuugauguauugcaguuucugagaagacaagauuuaagauuuuccucaugauaagucuuaaccccaacuagagguucaaugagcaggcugcuagaacccuuguuggguaacccuaaaaguguauuaguguuacugcuuugucauuuccaguuuagcucagaagccaggaauauuuguagaaguuauuuugucuguaaauuacauuuauuuauuguguguaugcauguuuguguguuauuauugggcucccauucaagaauguaaacuccaugagaacagagauuauguccauuuauaugccugagcugugguaucuccaaugucuagaauagugcuuggcacauaguaguugcucaaaauauauauucaugauuucaagaauauuauuguguuagaauguuaguuuguugccuuuuggacaaaaacuguguuauauuguacuuuauauaucaugucaugugacuacuuacugcuuguugauggaaauauauuguugucuacaccagggauugacaguuuuucuugaagagccaaauaguaaauaguuuuggcuuugcaagcauuaaagucucucugacaaauacucaacuuugcugcaaagauuuaacuuugcagcaguagcagaaaaguagccacagaaaauauguaaauaaauaaacaaguauccagcccacccacuucuuguuuuuguauggcccuugagcuaaaaacaauuuuuagauuuuuaaauggauuucuuauaucaaaagaagaaugauaucccacgugucaugggauauugacaugacauagaaacggaaaucugaauauuauucccaucacacuugggauauuauucuccuggaaauuauaauuuccauguuuauaauaaauaaaauuuuauugcaauauagccaugcccauucauuuaaguauuaucuaaaagugcauuugcauucuaaugugggguugaguacuugcaaauaguaagcaaacuacagagcagaaccuuuuaaaauaggcugaaaugauaaggcuuuuuuaaaaauauuuucuggucauaacaaucuccauaucuucaaaacauguaaaaguucaaagcuuuacuuuuggggagcuuauggcuccuacaauuaaaacaugggaauuauaauaaagauagaaaaagauguuacucuaugcauauuagugagaucuguaaauguagaacacaaugcuuaguuaccuauaauaauugauucaagaaucaaaugcauaaaugaugcacacaugugaugcuaaagaaucauauaaaucaauuaggcuagguuucucaacucucuaucaacuuucaacaauucuuuacaauguaaauggaaauuaacuucucacuuuuauccucugaugcaguugaaagugcuaaugaaaaaucuagaaaaucuggaccucaguuaaucacgacuuggcuguagauuauuguguuccauaaacuguaaaaaucaaaugagcauuacuuauguuuauuagaaaaaacuaaaguauguuucucacaaauuauaaaaaagcuguuaacauuaggcaaagcauauucaacugauuaaaauacaaggaugugagcuuucuccaauuagaauaugagcuuuaggaggacagguauguuuguauccucaguaccugauaacuuaaugaaagaauuaaugaauagugcuuacaaagccauucauucauucaugcaucugaucaagaaauaaucauuugauggcuauucugcacuuguacugugaaaacacaaagauauauaagaaacugucucugccccucagcaacccuuucacugagaagauaacauauaacuaaaaaaaguggauauaacaaaaaguuuaaauauuaauuuaaaguaaaaggcauuagauagcaacguauuuuuaggugccaaauaaguaauacaggaaauaauggcuacgacaguuaugaggcggaaggaucacugggaucuagcgaggucaacaaaggcuuccugauagaggaaagacuuauaaaggcacuuaaagagugaaugaacacccauuguauccccaaaauaugcccauguauuauguagcaauaaaaaaauuuacaaaaucauccuguauuugauaaauacauaaauaaguauaauguuuagauagcuaaagcgaaugaagaacacaaaucgguaaaauuaccaucuuucuggaugcuacuccuagauugaccagaagguucaaggugaacaaauauuacucaaaggcagaauaaucaguucugcccauucuccacuuauccuccaccacuggcugagccugaguguacagauccacaaaguaaccuaaacacacuagagucuagaacagagggggcaaagugagcacaggauaucccugaaaauucagacccuuaaacauuugggaagaugauugucucaauaaccuucaauuuguuucugucaaacgaucaaagucagcagcaaccuucucucaaaacaagguccagcagagggauuacuacuguugucucagaauuacacucaccuguuugucuuaagcuuuuucaacaggaccaauucuuguuucccugcacuuuaaaaaaguuguuaggauuuugccaugugaugugaaaauguucaauuuuauuaauuaauucauuaauuuauuuauuuauuuauuuuuugagacggagucucacucugucucccaagcuggagugcaguugcacaaucuuggcucacugcaauuuccgccauccagguucaggugauucuccugccucagccuccugagaagcugggauuacaggcgcaugccgccacgcccagcuaauuuuuguauuuuuaguagagucuggauuucaccauguuuccaggcuggucucgaacuccugaccucaagugaucugcccacuucagccucccaaagugcugguauuacaggcuugagccaccgcacccggcugaaaauguccaauuauuuaacgauggaaaaguuuuccuauguuguucauugaugauaaagaagaaacauuugaaauccaguaaaaaaaaaaaaaaaaaaaaaaaaaggaaugcuaccuugccauuguguuuuuaaauguuucauauuuaaauuuucaaguaacauguggaguuaguauuugcaaaugcauuuauagagagguuuuuuuucaaggugaguaauagaaagguguuuccuaacauguauacuuuuuaugauucagguucuuauaggauguaaucacuagcaauauuuuuuaaauaucauuuuacaaaguacauucaccuauuucagcuaccaauugauauauuuacaaaagucaacauugugcuaagcauggagaguacuaaauguuggauaauguagauuaauaucuucaaggaauaaaaaaguacaaaauauggugagaauaaaauaaucuucuauaauuuugcaggguuuccucuccuaauuggacuaucuuuguuuguaaaugcuuguccauguaguguucuugauaaccuaacaaugcaugaaaccacugcaguuaccccuugaaguaucuaccaaacaaccaaguugggcuuagcaggaaacauuccaugauaacauaaauucccauuuucuaauagcugaaaaucuaguauacgugauaacauuuacucagauagcuauaauacagagcagaaagggauuuuaaaaacccuugaugaugccuucucaugucacuaaaaguaaaauuuuacuucauuacuguugucuauaagacugaaugauccaaucacucaucauccagccucauuagauacauucuugaucaucauaauucaccaaguucuuuuguggucuagguucaaaaaugacagauugccauuucuaugucauggcauuuggcaaagcaagucucauggcuaauucaaagucaugaggcagggaaauacauacugcccccagugggagggcccuuaaaaaguacauggcgaaggguauggaagaaggaaagcuaaaagauuggggccgauaacaaccuaccacaccagauuaugugcaaauuauuuucuguuccagccacacuaauuucacaucaguugauaacuucacuuuggagcgauuguugaccacucacacauuguuuaugugauucaccacauggccacacauuaugccuggaagaagugcauuuuggccucauuuguacugauaauuguuuuggacauaugucucccuauucagcuggacgugccuugaaauucaucugucauuuaucacuaccaaaagccucaccuacauuucugcacagugugagcacccuauaaauucugucuuuuaauugauugcuuuauccuguuuugaucuaugaguguccaauaaauuuucaugggucugaucauuuggaagcauuaauauucaaaaucuuucuaaaauacucaccugcauuaguuaagaugauugagauuauaggacugaucuaaacccagacacacaagacuuuguucuuucauuucuauaaauaugacaauuuuaauuucaaugacagaaauaaagaccuaagguagugucucucaaacuuuaaugugcauuuggaucacuugggacaucuugguaaaaugcaaauuuugauucagcagccuggagugagaccugaugguaggccuuucuaacaagcucccagcugagguugaugcuguugaugccuguaccaaauugaauggcagaugucuaaaggaaucaguaguauccuuuccugaauagaauccuuauccauaagugauauaauaacugcauuuaagaaaaguaacaagaaaucaccucaacaugucgauuauuacaacauuuuguuuauauaucacaggccaguuuuaugucuugaaaauuaguagaauuuauguuuuggaaauagaucucuaauccaaauaaaaccauauucaucaaauagcaauuacuuuauugcucuauugcaggcuaugguuguuggcaaugaaugcagauuauaccuggacaaguaaauugaaucaaugcucaugagaauuuauagaauuuacugguaauucaguauuucucacaucauaguaaaucaucaguuuuaguguucaucacuaacaaaauguacugauuuacuuagagaauaaaauacaauauauuuugggugaagauacuuauucuuuuauucauuuggaaacauuuaauacauacuaggacaucaaauugugguagucaaagauaaaacaaugaugaucauaugugacaccuauucucaauggauucguaagccauagaauacaaauggguaaugaaauaauaaaauaaaacaauaaaauuaugcaggaaguacuauguuccuuaagaaaugaacacaagugcuaaggaagucuguaaaaggaaaaauuacaugaggcugaagaaaaacaagaacagaccaaaauuuauuuauauauauauaugagagaaauaaaagccuauauguauauaucuacagauauaggcauauacagaaaaagagagaagaaagaccaguagaaugauuaaaauaagaaaacaagaaucccucagccagagucccauccagaaucuuuaauaaagcaugguaagguaagcauauggaaucaguuuugacgagaaguauugucuaucuucuauguauuuuaaaauuuaugccaggcacagugccucaugccuguaaucucagcauuuugggaggccaaggcagguagauuccuggaggccaggaguucaagaccagccuaggcaacauggucaaacucugucucuacagaaaauacaaaaauuagcugaguuuaguggcaugugccuguagucccagcuacuccggaggcuaagguaggaggacugcuugaucccagaaggcagagguugcagugagccaaaaucacaccacuguacugcagccugagugagagagucagauccugucucaaaaacaaaaacgaacaaacaaaaacauuauugaaggaaaggacauacggugaaauuucauuugaguucuaguaacaccuuccacuuuugcucguucuugaauauuuacuuuucccacaaccuuucucaguuuugggauuuguaaaugaguugaucuuuaauauacagagcucuauucagaaucuauuacaccccucccuauacacugcuuggaaaacacaauuauuuggaguagucuggagaaggauaaaaauagugauagaaaguggaaucagaagggaagauuagagaaaaaaggauuggggaauuugcucaccaagaaaagaucaugggggagcuuugauuuuauuuugaauuuuggacugggaauagugaacaguuauuuacugaucagaauagggcaaaaagaauaugcuucagucagacaccuaaguaagcaccuguccacaugugccucuggccaguauagcuugcuccuccugugaguguaccaagagcagggcagguuuccaccacgccaucacuggccagugagacuugccagccuucuagaucagcauauucagguucuggccauaauagcaucaaauggggccaggugcucucucucaagaaugucuggccccaucucacuuucgauagucuguguaagauuacuaggcuucuuugauaaccaaaauugugagcuuggauaaagaccaguucaucacagcauaacuaagguuaguaaggccauuuucucuguuuggugcacuaaacaaauacaaaaugcuauuaugccuaagugcuuuuucgaccuaaaaaaugcccuucaaacaaacaaacaaacaaaaaauccuaaaacaccuaaaaccucucuuuauugcccugaaagugguucuucauuccucuuuucagugggaugagaaggcaauuauguuuguuuagagagcuuauuauuaugcagaguagcuuucagcacgacauacaaaaaaaaugaagauucugggauucaucacauuugaagugucauuauaauuugauagacuugcauuacaauaaggaaagauucuagaaauauguauguaaguaccaauguacuuuuucacaagaaacauaagauccauuaauuauuggugccaaauuuaagcauagccagccccagauaucagaacgcccauuauuuuuucauuuguacaccaccaacuucagcaaucuuugacuaagggcuuauaaagaauacauaaacauccucaaagccauccaaacaguuuacaugaauugaucuguuacuguugaaacucucaacaagcguuguaauuuggcagguaacugguuuaaaccauagaucagcagcuguagcuaauagaaauagaugcaagaacaauaucuagcaaaccaugcagccccugugagaaaaucucucuagaagauacugcuaauaauaagaguucuugagaggccacuaaaaggcaguguugcuucaugaagugcauauuuaauauagcucuccuucgacuugaaaauaaucauacuucuuuuucucaaugucugaccuggagggcucuccuugccugaaauauagcaugagcacugcugacacuucaaacaaaucuuuuaaauguaucuuagacaaacacaaauuaaggcauuuaauuuucauggugaagucaauuaaugauacccuucccucuuuccaaagaucucaugcuuaaccugaccucuuccgcacucacauuuuuccaaguaaagaauauaaauacauagaugaacauaacauuucuaaaugcaaaguagaauguuuguaaauauuuucauaagaaauuuagcauacaagcaccugaauuucuugacuugcugauauguuagcuuuuuuuuuagcaccauuaauuuacaaaguggccauuauuuacgauagguaagacuucauccauuaguuuuauaaucauuuuuugaauaauagcuguauugaguuaucauuuacaugugauacaauucacccauugaaaauauacaagucaaugguuucuaguaaauucauagaguugugcaaccaucaccacaucaauuuuagaacauauuaccuauaaaagaaacauuuuacccuuuaguuaucacucccuaaaaaccucucaucccaccuauuccuaagcaacuacuaaucuuucugucucuauauuguugccuauucuggauauuucauauaaaugaaaucauuagauuuuauaauuauuuuuacuaauuaauuauauucaaguaaauauaauucauacucuuaaaaauuauucuuuuuuucugagccagguaccuauaguguuaugugccuauaguguuuuuaggguuaugauuauagcuuacauuuaaagcucuaugaacgcauagguaagaauauacauuggcacuugaacaacaugaagaggcccuaagccccuaugcaggugaaaaucucccaaaaaacuuaacuacuaauagccuacuauuggcuagaagccuuacugaugacauaagcaguugauuaacacauacuuuauauauguauuguauacacuauucauccaauaaacuagagaaaauaaaauguuauuuuaaaaucaugagaaugauaaaguauaguuacuauuaguggaaguggaucaucauaaaggucuucauucucaucaucuuuacauugaauaggcuuaggaggggaaaauaaguuauucuugaugccucagggguggcagaggcaaaacagguggaggagguaaaacagaaggcaggagagguagacacacuugauguaacuuacagaaauacaacauaauuucugccugauuuuucugcuuucauuucucuaaaaauauuuccauaugguacaaaugcuuucuuuugcauuugcuuuaguuucagugauugugucauggaaggguuaauauuauaaaaacaaacaaacaagcaaaaaucaaaacagucuuaaauaaucagaauccuccuggcagauugucuagugucaauuuguuuucuggcacugauucaucugcaucuucuuccucauugucuggcacugguucagaagcacccaucuccaucaagucaucuucugcuaauucuucugguaugauaucuauuaguucuuaaauuucuccaagaucuuuguauugaaacccuucauaccccaccuuuuuuuuuuuuugccauauucacaaucucuuucauuauuuccuugauugccucuguuguaaguccugugaauucauguacaacaucuggacacuguuuccuccagcaggaauuuauuguuucucacuugaugacuuuuacagcuuuuucuacaacaaugauagcaucuucaguggugaaauccuucuagauuuucaugauguucuuucuauuggaguucucuuccauaacauugacaauccuuuacauagaguacuguguguagugagcuuuaaagguccucaugacccaccacacauguagggacugaguuagaaauguauugaggaggaagcagaccacucugaugccuuccauguugaacucauggaguucuggguauuggccaauaucaaaagaauuuuaaaaaguaguuccuuaugggcaagguacuuccugacuucagggacaaagcauugaugcaccucuuccaagaaaaguguucucauuguccaggccuucuuuuugugcagucaaaagaugggcagcagcugguauuuaucuuugcccuucaaggcucagggguuggcagcuuuauacauaagagcaguccuaaucaugagcccaacugcauucauucaaaauagggaguuagccuauccuuuccugcuuuaaaucuugcugcucaauucucuuucuuacuaauaaaugucucugugacuuuuuuuuuuucagaauacagcacuuuugugcuuauuaaaaaccuguacagacagauauccuuucuccuuagugauuuccuuaacagcaccugagaauuugucugcuaccucuugguuggcagaaccuguuucucucguuaucuuggcauuuuuuuaugccaacucucuuucuaaaauuaucaaaccacccuuugcuggcauuaaguccucuagguuuagauccuucaccuuccuuuugccaauugucacguaauaacuucaauucuucucuaaucauauuagagacuaaagguaugacucucuuauagaaggccugcacccacauaaaaacugcauuuucaauaugacauaaaaagguauuuugcaaaaaguacaacguuuuugccccugcugauguagauacaauaauucccucuuuuuuuuuuuuuuuuguuuguuuguuuguuuguuugagauggagucuggcucugucgcccaggcuggagugcauuggcgcaaucucggcucacugcaagcucugccucccagguucacgccauucuccugccucagccucccgaguagcugggacuacaggcgcccgccacuaugccgggcuaauuuuuuguauuuuuaguagagacgggguuucaccguuuuagccaggauggucuugaucuccugaccucgugauccgcccgccuuggccucccaaagugcugggauuacaggcgugagccaccgcgcccggccucccccuuguuuuuuuaacuauaguaacaauaaauccuuacacuggauuauuugucuugaaguggcagccaaccacaguugcaguacaaucugcaguauauauaucaagcaauucgacuuuuucuuauaaugucaugacuuuuguuuacuucuuggacgcacuuccagcaucacuauggcacuucuugugacuccaaugguguuauucaagacuaugauauugcacuaaacaugguuuaaaauaaacacaagaaccucgagaaaucacuuuuuacugcaauacacaauuuauuggagagaugaauuucucacacaaagaugauuacuaucacacaguguauuaagcagauacucaucacucaagcucaccacaauagcaacaggaaguggcuacaaaauuguuacaguacuacaauauguaccacuguuaauuuuauguaguuaucauuuaauaccacaucuuuacauuuauuuauuuucccuggacugaguagcacuaugcacagucugcaucaguuuaaguuuuuauaauagauuugucuauauuuuauaguaguaaaugacaaaauagacuaguaucuucauauauuauaugcauucaugacauaauuuuuucuuaauuuguuugauauuucuaggcuacacaguuugucugccaguuuuuucaaacuguugcaaaucuccaaaaacuuucucaauauauuuauugaaaaaaaaaucuauguauaaguggacccacauaauucuaaccaguauuguucaaagguuaacugcauauaaacacaauuugaccagccauugaaacaaggcuuauuucuaacuuauuagcuuauuacugacuuaacaaccucaacgugacuucaauuauugguauuuaaaaguauauuuugguaaaacauauucccaauuguuucuguuuguuuacaaaauuauuuugaaacauagagaaauaccaguuuacuaccaguaacaauaaacuuugaagcuuauagagaaagauaaucucucucacacacacacacuguaugauaugguuugguucuguguccccacccaaaucucaucuugaauuguacucccauaauucccauguguugugggagauaauuugaaucaugaggacuguuuuccucauacuguucucgugguagugauuaagucucaggagaucuguuggucuuaucaggguuucugcuuuugcaucuuccucauuuucucuugccgcugccauguaagcagugccuuucaccuccugccaugauuccgaagccuucacagccacauggaacuguaaguccaauuaaaccucuuuuucuucccagucucggguauaucuuuaucagcagugugaaaaugaacuaauacacugugcuucaggaaucauacuucuuuauuggccagggacauuuuggggcagugugaagcacaguaacugguguccaguuugaagauuccuuaaaaacaaugcccuaauggguaacuaugugagaugauagauacguuaauuuguuuggcuacaguaaccauuucacuauuaucucaguucauucauguugcucuaauaaaauacuugagacugaacaauuuauaaauaagagaaauuuauuucuuccaguucucaaggcugggaaguccaagaucaagguauuaucauuuuguuucuugccguauccucacauggcagaaggcagaagggcaaaagggaacacaccugccacucaagcacuuuuauaacucguuaaucucuuugcuagaauuccuuccucauaauugcagauucuaaaagguuccacuucuuaauauuguugcauuggagacaaaguuuuaugggaggcaaggcccuuggccgcccaagguuucaaugauaaaucaacucacaauaagacagauuaauaagaaaaaagacauacaaaucuauuaagccauguucauggggagaaucacagaggauucuuccaacaccauccaggagcuuauauaucugcucaagaaugggggcuuggauccugguaaaacagguuauaaggugggggagaauaauaauuccauugaguggcaauaauugauugccuggaugaauuguuggaucaaggaacagaaauuaauuuguaaauaguuaucuuuggaauugaaaugauccuuggagucagucuuuaucuuuaaaaaggguguguucagaugcaguuacauuuuuagccuucguuccuuuaguggauaaugaaauaacagggaggggaagagaaacaauuguucucuuuggugcuucagucucaucuuuacauagauaagcgaaaagucccuucuagagccuacugaccucucaguuuuuaaaucaaaauacucaugauuccagugagccauauuuugguguaaaauuuccugcacuccuucaguuguuacaugaguuuuggagggaacacaaacauccaaaccauagcaaaaacuauguauaaguauaccaaaacauuacauuuuaugccuuaaauauauacaauaaaauaauuucuuuaaaaaagagcaauugcuaauauacaugcucuauuaucucuguuagaacuauugcuauggauucuugucucuuuugcuucccaucuuccuuuaacuuaaucuguucucuaccacaaagagccugaaugauauauuuagaacaugucacuccucugcucaaaaccacucaauagcauccuaucucauuaaaaauaaaauccaaaguucccucugggaccuauaugaucuugucccuugaucuacgacaucaucucuuacaaucauuuucucaguggacucuccuacucugcucagccauucugguuucauuguugcuuuugaacacaccaagcaugcuccuaccucagggccuuagcacuaaccaggucucugccuaccacaauuucaguuuccccuaaucauuuucauagcucaucucauuacuuuauuuaaaucucuaugcaaagaauuacuuuauuuaaaucucuaggcaaaagucucuaaauuuauuuucauacauaaaagaauacccuacccucccauucacuuucuagucccuuauucugucuuuuuagaauguaucacuacuugauguuuuauuuguuuauuuguuugcccaaaauguaaauuccaugauagcaagaaauuuguuuguucauugcuauaucccuagugccuaggaaguaccuggguuauuacccaguauacauuauauuuaauaaacaucuguugaaugaaugaaugaaugaaugaauggauaaacagauggauggauggauggauggaugauuggauaaauaaauaaauaaauaaauauugauccucuuuccuucagauaaauaaauccaaauuagaaguguggaauuucuauagacuuuuacuuuuucugaguucaauucgaaauacucacucuguuuuuagggcuuacagaugagcuuuagucugcauagacaucuuucagcucuuuucuucuuccauuauuguacacuuugcuagaaaaauugggagcuauagccauguuuuacuuuauucaaacuguccuuuuuuguguauuuuaguguuaaauaaacugaauuuaugauuuauaucuucaugguauuuccagauacauuuuuacuugcuuuucaaucaguauuugugggauuugaauacaucuaaacaaugccagggaauacauauuuauugccugaucauaaaaaaggucuuuuuuugaccuuuuuuaugaucauaaaaaaaaggucauaaaaaaaagaucauaaaaaaaaaagucuuuuuuggccgggcgcgguggcucacgccuguaaucccagcacuuugggaggccgaggugggcggaucacgaggucaggagaucgagaccacggugaaacccugucucuacuaaaaauacaaaaaauuagucgggcccgguggugggcgccuguagucccagcuacucgggaggcugaggcaggagaauggcgugaacccgggagacggagcuugcagugagccaggcugaggcaggagaauggcgugaacucgggaggcggagcuugcagugagccgagaucgcgccacugcacuccagccugggugacagagcgagacuccgucucaaaaaaaaaaaaaaaaaaaaaggccuuuuuuuaauucuuauauggagagucacaacuuuuuuuuuuuaaaaaaaagcuauaagacauaccacuucagaaaauguaguaaaaugugaauuauacacuuucuguacugcccagcuaaaauguggauguuuuauagccaacucuaugcuguaagaauguuggaaagucuggauaaucuaaggguuuugaguggaaauacaguaugacugcuuuaacuaauucaauaccauuaaaaaaucaaaaccaugaauuuuaauuuuacauaaaagcaagagagaaaaaggcacauuacauauugcagucaccuaguugagccccaagcaaaagagcagagaauugcagaggaaggauauguuagggcaauacccagcagaggccaggucaaacugagguuuauagaggcaauacagagaaaggaucugagaucuaaaugagaccauagagccaagagcagaaaggaaacgugucuuugagccaggauccaggagcuauaauggccauaguuugccagaaggugccaaacagaaacaaaaguucaaagaugaguugcccaauuguucuaagaagauacucuccucuuccauacugcaguaccaggccaugagcagggacucugcagugggagggaaggcuggcacuuuucaauuauauaacauuuauuucugccucugcuuaucuguccuaggagauaauuaccuuucugagaagagaggcaggggcuggcaaaaggccuugaacauaguaggcagucaacacauuuguugaauaauaaguguaaauuauccuccucccucucacccugcagugaauccuucauaaguaaguauggguaauccauaaaguauauuuuuacuuuaaaacaaaauacaucucuuaaauauuucucauacagaggcacuuugaacugaaagcaaacacaaaguuuccaucugaauacuauuuugagaaaauguuaaguaucacaaaacagcgauuuuuaaaaguggaagggccuucuuaaccguaaccauaguaugucaucccuacccaauguuuuaauugccacuguuugucuggcugcagaacaaugagguauggauggaucuaggacuggcuggagaggucccagagugagaacaaaauggaaugcacugugcacuggaccuaacagauggagaaagccucugauggaugacucucuagaagcaucagagaccacuggcucugggugacuuggcucaggcuauuagcaaaaaagaaguuugauucaagccagucuuuuaucaauaaggauuuuacugugcaacccccaccgagcauuugaauuugaaaugaaauguaauuuagacuucacuuaaccuuucggacuuuuuuuguuuuaauuuuaccuuuuguaaaaauaacaaaaacugcugaugguacauagagauuuguguuccugauauguaaaauaauccauuuaaauacuacaugcuaguuuguuccuucuuuagaaauaacuuuuucaggaauuuaaguucauugaaaguaaauauagguauguguaccaguaccaccagcaguucuagucaaugcgguuuaugaaaaaaaaauuaaaaaaaacucuaaaguuaucaagauguaaccuuuuaaucaaagaacuaaaaaauuauguauuuaucauaccaggguuucuucuaacuucauacuggcuuguuugugaaagaaaagucuuugaaaaggcuaccugcaggugauaaagauuuuuaaaguauucuuuucuuccuuuuuauuagagaaaauccaaagggaguuuuaaaauuuguuucuuuauguauuguuuuaaucguggaucuuauucaaacauuuuuuaagccuuuacauuuguugcuuaucucugaggggcagcauugcaaagugcuuaagaacaaagauuuuaaaacuucauagacuggguuaaaucuaggcuccaacauuuauguaucucaguuuuccccauuuauacaauggagaaaauaauauaggcuguugugaggaguaaauaaauuuauauaauaaaauaaauuuauuuauuauaauaaaaaauaaauuuauauaaauaaauuuauauaugcaaaguuuuuaaaacauacuuaaacaugauaggucuaagaauauaagaaucaacuauucugauuauuuuguucuagauuccagagguccugaaauaugaaauuauucauuaucuuucagcuacgcauuuugcugacagcacauugauauaaugugccuagcauuugaauuuauuagggcuuauacucagugccuuaacauuauagcaguuuuauagauaaaugaaugugaguuuuuauuugugugaaacauugauuugaacacuacuauuacacagguacuauuuagaaugagacuuaacacagacugccuuuauagcaggugugaaaucuucagcccacaggccacauaugcaccucagcuuaaugucaucuagccagaaggcaagcacccagagcuggcacugccguugguaccuucugcugugaaaauacaagagggcauuugcagucuuuauuauccuauaaacacauaaacuggggcuguuucccauucaccucacuuucugccauaauuagaauucucagucuuccucugcccuuucaguaagugucuuugugugccucuaaauguugcuaugcauaaggacaguguguguguuugugugcaugcaugugugugugugugugaguguguuaucagccucucagugugucuuaugugcaggugcauagcucccuuugagcacaucucucauuauucuuuguccuacuguauuugcuggucauucucuuuguauggcucauagcauauguaaguucagcauucacugccuuucuuuacucucaugugauugucucgaucuaucacuuaaaauucuagaaugcuagaauuaaaauggaauauuguguuauuuuacaguuggcaaaauuccuuaauaaagaaccaaaauguauauuuuauugcuuacugaauguauugaauagcauucucacuuaacaaauauuuaacuacuuacuauaggccaggaacuagaacaagagaguuuguuuuucuuacucucauuuuuuaaaggugcaggaaauacuauacauuuaucuuaacuaaaacauaacuaguaauuuaaauaucuuuuaacuugauuuauuacuugguuaacucuucauagaaagaguaaaggauuuccugccuugcuguaauauauaaaguaagaaauuaguugugaaaagauauauauuaagauuagauguauauuuccaaauagauuggaguguacugaugcagguaaaugcaaacccacaauaacagugaauuuaacuuugacaucaaaguauuacuucugcagaacacaggaaggaugaggacaguccaugcuauuggcacggcuauugacuuuaacaugcugugcaaucuggaucacagguuugucuucuagcacacaggcagagcacauuacagucugggucauguaggagauuucuguguuugaaaagaagaaaguuucuaaauuuuggcucggagaaauauccagcuacauauaugugccuuuaugcuuaugacaucuccaacgugagcaugcauacagguacagacauuuuuaggugagcuaacaaagcaaacaccaguuauucaggcaaugagccuaaagagaccuaaaguacagaggguaagaaacagugaaagcuaaaauauagaugaagaggaacuucaacauggcugccgugugagcuuccugcucccuuacuggcauuucuuugauaugggauuuucaaagcaggugcuguucuuauugcaaucacauugucacacuccauuaugaggaagcaauuaagcccauaauaaguuaaaaggugauguuuuguauuuuuuuuuaaaucucacauaauuguugauuuguuagcuuuugaaaacagauaggaauuuuucaauuacacccugcaaaauaccuuuucucauucugaguguuuaaaggcaaauauaucuuggauccagugcuuuuguguuuacaaaucuggauaugauuuaguaagcuuuaaagagauaguaagcacacaguaaggaaaucagauuuacauaauuuucugcuugcuuacagaacacagcaguugagauuaucuuuuacauuugggaagacuguuuuaauaugauaagaugaaauaccaccuacaguacgcuugaucuugcuaguuugacuuuuuaaaauaaauuacaggcugauuugucaucgugacuuuuaacauaaauugcuauuauaaucuaaaggagcaauucuaaaggagacugccuuuuuaccucaucuacauaaaaagauuuagguuauuucuacauuuauucuuuucucugugcaauuuauuugcuguaacuuuacauggcaggaacaacaaaaaucuauguuuugcucauuucauccauucuucuauucaugcugauaaguagcaaauagcagcuuaaauggagaaauggcacaaguaaaagaaauacguccacuuuacuuuuuguauauaaaaaaguguucuuuaaggggaggugugugccuuuuucucccauuggaaacauaauuaaauuacaaguuuggggaaauaagaugagcuaaggcauuacucauuaucuucugcacuguguauguaugcauauauguauguagguacucuugcagcuucacuaacugcuguaaauaaugagugucguaguccagacaucuuuuagcuguaggagugugauugcugggaaaagaagagguugugcuaaaccaaaggaccugaaggacccucuuauguaaucaugagccucaggggaauguuugguguuuuuuguccugauuuuugcuuuauggauugugagcauuaagcuugacuaagcuuucugucacugucucuaaauuacguuuguccaaauuugccaugguuccuauuuucuguaucaucuguauuuauuauuugaccacaaaagaguuagaaaaugaacaugauuauaugcuucccaggauuaguuauucauugagaaguguuccgacucagauauuuuacauuaaaaaaaguguguggaggggugcacacaggucuucuggucaagcuuucuuacuguacucuauauggagauuacauauauguauguauuaucucauucagggcucagcaugaaauuggaguaaucccggauuuauaaguggaugaugauuauuuccuuccaacucaguggaauaauagcacugacuccuuggagucucuggagcauuuguuuuuguuguuuuuauaguuggggaaagguuuguagaaaacaugaauaacagauauagcuuaggauuauauaaugucaucuauacagugucaucucuguugcugcuuucaguuuaaacaaaaacucaaauuaaagauagacaaguuuaaugggagguuuauuuggaaucauaagagagauucggccuugccuacuaccucuuccaugcuuuaagccuuccugcuccaggaagaacuucucagaauauuccagcccacugugaaauacucuucuugaagcuaagagcacguauuaugugugcugcucagucauuucaucuugacaugucuuuuuuuuuuaauuucuaacuuuugucccuuuaacccuuccugccuuuccacaguuuauguggcaugccccaauaugaaacagauuguuaacuugcauuugcuuucuauugcuaugaaacaauuaccagaaaucaaguggcuuaaagaacauaaauuuacuuucaggucuauaagucugaagugcaauaugacuuaacuagguuuucugcauauggucucacaaagcugaaaccaaggugucagcucagcuggguucuuaucuguaggcucuagggaauacuuacuuuugagcucauuuguguuuucaggauccaguuccuugugguggaaggacugagguccucauuuucuuguuggcugucagcagaaggcugcuuucugcuucugaaagucaccugcauuucuuaacacaugggggccccucaguuuugaagccagcaacagcaaggccaacuccucucuggguuuuuaaucucuggguuuuugccaccaguggagaaaacugccugcuuuuacaagacuucauguaacugggguaggcccacccagaucaucuccagauuuuaaggucaacuaacuuggaauuuuaauuacaucugcaaaaucuuucacaaaguacuuagauuagugcuugacugaguaaccaggggaugggaaugucuggggaggaaagacaucuuuagaauuuuucuaccacauugaccauggugcauuaucuccugugacacugagguaauucugugcacagguacauacuaaauccauuuauuaaaugaauccacaaauguaugaacaaaugaauaauaaagauaauuuuguaagucagauauauuaucauacaaauuacaaauagauaaaacugagccuguaggugaagauaauuuuauuuuacccaaauacauuaguuuugggucauuacacuuaaccuuaugucuaugauugaauugauugaauugauuaaucauggaaagauuuacuauucaauggugagaauuuguuuaucaaaugacaacaaauuuuaaagguuuuuuuuuuucuuuaaaguccuaacuauuagcgucugacaguuaugccuuagucucaaauugcuuuuacaaacugauguguacauuacaaagcacaggcacauacauuaucuccuccaacauucacaauagucuaaggauauuaauaaccccuccuauagcgccuauagaaauuugcggcucacagugcugcaguauuuuguugaaggucuuaauucuuuauacucaaaauguucugaaugcaacuaauuuugaaaaaaaaaaaagggggggugggugaggaggaguuggucauaaugauauaaucaaagaauuaaaugaagagauuaacaaaaaaaaauucuggccaauucuuuauaugcccugcccaaaaguuugauaauuauaaugugauugcuaucccacccuguauuuaacaguggaauuacguauccucaggaauugcaauaguaaguuaucuauggcaaguagaagagacuaguuuuucccacauuuuuugaaaugcuggaaaaggaccucuaaucucuaccagugaagugaugaaaagguaauaucuucaaaugaacaacaugcaacuacauuugucucuaauuaguaucuaugcaauaaugacaaucauuuuucuugauuuuguaaguuuuuuuuccauguuuuaaaaauagcuuuuuaaaaaauuucauuuuauuuucuugagauaagaaauuguuucaagaaaugcucuguugcccaggcuggagugcaaggugcaauuagagcucacagcagucuugaccuccugggcucaagcaauccucucaccacagccucuuaaguagcuacuaugauaggcauaugccaacacauaucacuuuuuaauuuuuuuuauuuuuuguagagaugggauuuuucgcuuuguugcccaggcugaucucgaacuccuggccucuagggauccuccugcgucagccucccaaagugcuugggauuacaggugugagucaucuggcccagccaaaaauugcuuuuugaaucuguacuuuuuguagcucagugaucaggaaauaaacuguauuuacagacucaggauaccuguuucauaacuuaaaaaacaaacucaaaugcaauucaguugugcaauacguauuuuaagaauuaagaagggcauuuauaggauaauugguauuagcagacuuguauaauuuaguaaacacaccuaggaauagaaaaagacucaaaauguucaauauaaagagauguauuugcagggcuccaagaucaguauguuugugucucugaugcugcuuucagucauaggauucccuugaccucuucuuccagccuucuucaaguuucaauauccuuuccaacacucacuuugccucuucucaaccacucccuuucacuuacaaaauccuuucuauaauauuccacguuuuauuucauuuuacugucagaaaacauaaaacaaggccuuucuucaguucuuuuccuguagcugcuaagccuagauuaaauccgaggugauuuucacguccuguaagugacuuugagcuugaccuaggccccugucuuuagcuuucgacuaugagauuucagaagaauuguugcuucuuccuuaaagaauauaaaugacauuacgacagccuuaaauaagaaaaacacucacacaaaaacgauuaugacaaauugaggaauauuaaaguagucaauuugugcauuucuuugaacauucugaaccauacaaauuugaaugcagcuuucaauauacaaauaagccaguucuguaacaauagacagugccauuguguaucagacauuaugcauagugcagccagcugcaucaaagagaugggggaauugggauuuguuuuuaacguuaaauugaaauccugaaaauuuauuacugucacucuguaauaaacaagaauguggcuuaaugaaaaccuucauuuguauucgugaguuuuuuguuccuaauucagaaguggauaaagcugcucuuuauaaguggguagcugccacaaugcuuaaacuuugcaaaauaucaucucguucacaugugaagaauaucagaagaauaguuuaaauaguauagauaagauauaguuuaauauaggaggaaauuccaggaagauuagcaggaacauucacagugcuuauuauauccuucuuauaucccuuugucuuaaaaaaaaaaaaaaguguaacaaggagauauuaauauuuaacaucuuuucucucuuuggugaaggcagaaaauaaucaucugucuuuucuaauuuaaagauuaaaaaauuacacccaagugcaauuauguauuauguagcccaaaccuuuuuauaaugauauguuucuaagaauacaucagaauguaugguugcuuuucuuaugcuugcuuucuuuaagucuuacauguaaacaaacacagaauuuuagaauuuuuuuuuggcaauuagaaugaugccaaauguuccuauuaauugugaauauaagugaaguuagugugaaauggaaaauguauguuagaacacauguauuuaaauguggcuuauuuuauuagcaguuacucuuagauacuagugugcuaggaaguagagaaguuacugugaaaaccaauugacacacuuauuguuuuuaaacuauaccuuugcuauucaggaauauaagguucucuuaauccuuuuuccauuuuucaaguuuucaagcccugaccucgagcuugaauaguaagccaaagcugcuccuucacuggaaaaaaaauuaaaacaaacaccaacaacuaaauuuuaugcagagaugucugaaugcuaauuuucugauuucauguguaccuuuuagcaacugaugaaucaagacacagucuagacauauagcuaaauguuguagaugccuacucuuuugauucuaggccaaguucuucuuacaaaaauaaauuagccauucauaagagauuucuaauauaaugauuauucaaauaucacuaauauuugaucaauacguauuuauuaugagcuccauaugcuugagguacuaaaaaaguucaaauugaacacauuaugaaagaugugaagaaagcauguauuaacuauagaucuuggaaauuauuuccaacauuugauauuucaaaaauuaauuauauuacuuucagcaaguauguagaacaaacucauuuuguauuuuauugguugaaaugucuaauuaaagaugugucuagacuuuggauaauuuacuagacuauggaauuauuuugaucauauuauauuuagaaacauuuuaagauuccuauuggcuacuuuaauauuaauaagcaaugagcguuauaaaagcaugaagcaaaauacuaaacaaauucaugugagcagugcaauauucuggaaaaggcauuaaacuuaaaaucuagacacuuacauuaauucucugucuagcucuuuccucuccagacuugagugucuucuggcuauaaaacgacauaagccuagaaugucuuucucuaacuagauucugauuuaguuaugcuuugacaaaggugaauagauacccucaaaauuucuuuuaacccuggaauuauaauaacauaugauuuuguaaaaaucauuuccuuuuuucuuguguagaauguuuuuuuucuacuugacuacauaguccuaaaagcuaagaauuagguauuguucaucuuuguguauguaugagugcaaugccuaacacauagcaggcacuccauagcacuuguugaauaaauaaugugauuacugguguaaaaaucaguuacuucuaaauuauaauuuccugacuuauguaagucucaaagaucaauuuuccaauuauauguuuaaauguauauauuaagguuaaguauaauugaaaguacugcuaaaguggaggcaucucuuaauaaaauaaagguguuaugaaaugacaaaaauuuccuaauguuuugugccugaaggaaccauggauguaaacuuaaugcuaauaaacugaaacauuuauuaaugcagggaaugcuauuuuuauuauagucaaaaaugauuucaaacaguaauauaaauggccaaauuugcaauaucuacaaaaaugagccagagguaagguguuuugauguaaugguuuuaaaaaugcacaccucucucuguuuuuuaccaucuugacuagugucugaguucaguacuggcaucacugugcauguuuucuuuuuuuuuuuuucuuuucauccuuuucuggacucuucuuuggaccagaauucccuaauaucugauuuuuuugugccugcccccaaaguccuuccacagcaguucuauuucucauuuucccguuuuacaaguuggauaaucuuaggcagcaauagagucuugaggaaagaacauuucaagguugcagaggagaggaguauuuuauaguugaaaucauaauaaaaaauaagaaccgugagugccuuuaaauauuuaagaaauacaagaggagacaaaacuuucauuaagcagugcugcugguauagcagaaaccaaaaugaugauaguguaaaacaguggguaauauuccugggauaaaaucuaugaggaaaaaaaacagauuuaauuaagauuuuaagaccuggguuuuuuguuguuguuguuauuaagaguaugugccugcuaauaguauaauuaaugcaaaacucauaaaagugacacuaacugagagaauuaucaagacccaggaagaauaguggcaaagagaguagauaacuguuuacuuucaacagauauauuuauccaaauuaauuuucugugcaccuacuaugugcaaagcaccauggagcauagggagauaagaaguugcaguagacacaguauuuacaauguauuauuuuccuuuucuuuguacaagcuuauugucuuucucuggaugccccuaaaaugagcaaauugcuuguaggugauuauuuugggaaggaauuuuggaacacuggugggugacuggaacaaauaaaauagggaagaagggaaagccaguccaauaauacacuauugaacugguacuagcugugcauaacuggacuccauccuacuagggacccucugaggagcccuguagaauauacuuuagaauuguuugcccugcacacaaccaguugucauagcaauagcuaaaguagaaauguaaugagaagauguaaggcaaaauacaaaaagugugugaaacaaguguauuuugcaaauuuaucucauauggaaauaaaaagaguaauuauuuauuaagcccuuauuauauguagucacuguguuagacucugucgggaagaagaaacaagaggaaaagaaagaugaaaaaauaugaugccggcucuuuagaaaugcgaaaucuaggugaggaagcaaguaccuaagcaaggccuugagagaaugugaguuacaaugaggcuccaaggaaggaggaaguaaggaagggaucauguaaguuauuacauuucuucuuaaguuauuacauuucuucuuaaggagaaauauaugucagauagaggagggagaauugggaggaaguagaagaagguaauuccaaguaaaagaggcacggauuguaaacccaaggagcuaaaaggcuaugguuuguucagagcauugugaucuuagaggagcuacauauuaaaacuacaaaaaauuagacggccgugguggcgggcaccuguagucccagcuacucgagaggcugaggcaggagaauggcgugaacccgagaggcagaggaugcagugagccgagauugccccacugcacuccagccugggcgacagaguaagacuccaucucaaaaaauauauauauaauaaauaaauaauaauaauaaaaaguaggcacaggugguuuaccauuuuucuuucuuucuguuuuugaaaguugcauucucuaccacauuuuuuccccauugaacuauaacuaauuaagcugugaaacacuacuugcuucuuuucuccaguuugcuaggagaaaggucuaucucaacacaagagucaacauuacuauccaguaaaacaucacagugguaugccucaaaaaaaaaaaaaaaguguacccuggaacacagaauaguacguggggaauagcaggugaucacugagcauguauagauacuuaagcauuauuuguuuaguggaugaguuuucugaccugaauuuuaaaagcucuguuuuagaagggacauauauuguuggugucauuguuacuguuucagauuucuagaacucugagauacacaugaucuccugccaacaacugaacauuucuuugugggccaagguagggcuuacauugguacuucuuguguaaacacuaacacauuuuuuaaagcuacaauuuuaagaaaauuuaaucagcacuucaauaaacacuucacuuaguugucuaauuugcuuaucauaacacuagaagggauaauuuuauccccuuuguucaacugagaaaacugaggugccagggugcuaagcuaauaccucguaugcuugauuguuaagaaauauggccuccauccauaacaaacacauucaaauagaacucacagacaagagcaguuauuuaacaguucucuuggguguguguuuauauguuuguaaagguauaacucuauauuuaugguaugaugucuugagagacauccaagaagacaagauucgucuuuucaguagauggaaccaacguuacuuuacagugguagucaauauuuccaaguccugaauucuugauugauaauauuaucuuuccuaucucuuuuuucuucagcucuauaguaaaaccucaucccaaugcagaaauuuaaacaauguaucuauacuuccauucucuguaauaaauaguuugaugguaccaaacacuugaucaaaugcuaugagucauauaaaaguaaauuaaauaugauccuacagagucaagaaacuuagacucuguagaagaagaugcacaugagagugauaaaguauagguaaaauauagaugaaguauaggcaaaagcuguaggagaaaagaggacuuggcagauuaauucaaccagaguuagguaauaauucagggaagcuacauagagauggaagcacagagaaucagaauaccugaguccuugucuuauuuuugcaucuaauuuaagcacaucauuugaucccugucagccucaccuccucaucuguaaaacuaaaggauggcaacagcugauccccaguacucagacuuuuuucagauucuaacuuugugagcagguggcaucugagaugggcacugauauacgaguacuguuucaacacauacagacauagaagcccaucucagaugaaggcaaacugcaaauacaaaagugcagcaaaggcuuggauguguccugggaauggagaguuuucugccuagggugacacaugugcaaaguauggcagaguaucagguauaagacugaaaaaguagcuugcagaaaguuuacagaaggucuuacauuccauacaaaguccuuuggauuuuauuaaggauuuaaaaauagccaaaauauaaugguaaugauuagagaaucauugagaagaacucaaaaucaaucuagaguguaacaaguggaacaauuuaaguaaaucagaacuacaaggccagauaaucacuggccuucauuucacuggaaaaaucgaagaacaaacaagcagacaaaauuuaaagguaaauggaauauucaaaaaaauggaaaugaucaaagcuuaugaaauucuugaucauuaauuaaugccaaaagaacgauguugcagacuccagaaaauaagcuaguuuagguaaccuuccuaacacaaaagauacaaagaauaaaauguaguaaacaagaaaaccugaucaugaaacuccaaguuuagacacccuacauaaaagcuuaaauaauuucacacccacauacccacauguauaagaucauaaaaacgcauucaacuugcaaaaauguuuucgguuugcaauuucucccauguuuuuaccacacuaacagugucacagugaagacacagcugauggcagugacuauuacugaccuuaagaacacagcuggauuucuauuuuuauuucuguaaaaccuucuuuucuucaacuaaaugaugcccuagaggcccaagcuaaagucuguauaguaagggcaauguguaucguauuuugugcaaauguauuucacacgacaaagccagaguuuaaaacacacauacacacacccacacacauccacauacacacuccaaaauaugucaagacgcuuacauagaaacccauuugcaaaccagccugguaggaguugccauaccaaguucaaagaaccauucagggucauacaaaauaaccuguauugacaacacacuacaaagcaacuauauauucauguaaauuacuucugaguuucuaaaauagaguaaacaaaaaaauccaaaacauuuggaaaacauugaugaacaauucaagcuuugagacuucuuuauuucagcaacuaggaaggauaauaaaagauagcgguauuuguuuauauuuggaugauugcuuccuuauucuccuuaccucaaauuagagguaauagucuuggagaguuucaucuggcuauaugaagauaaaagcauuuaucuacaaauaggcagauuucugaauguggguaauaaccaaggcaaacauauguuuaaaauuccuaauguaauugaugcugaguagauaggaggguauauugugaacuuuggcaaaaugguuauucagcaagcagaaugggacuuaaggaugcuggucggccagagaaauagcucuguagucgcuaagaauaaguuggcagaaaaaugccacuagucaaaaagagcaagaaaggaauggugugauuucucuacccauucaccucaucauuuauaacacaaaaauagagagauuuucuguaaaaaugauuauuuuuauguuuaucaaguuucagucugucaaaaaugauggaacuaccugaagauagacauuguuuuuuuaucaaaugaaaaaaaaaacccaaaauguuagaauaaguauauaaauacaaauuuuucuaugaccuuuggccucuaauucaagaaaagaacaccagugugcacuuguuugccugacuucuucuaaagaagacaaacgggaaagcugacugacaggaaucugaagccauuuauccaauuuuuacauucuuucccuaaaugcaagaggaguugacugcaguagggaaucauaaauuguuagucgaccacacugagagcuaauugaaaagaggaccaugguauguuuaccucucugcacuccaggagacaugcacaaugaagguguguuuaguaaacaaacagacagaaaaucucuacauuggucccuaccacaugacaaguaugcuacucgggcauucuucaacccuaaagucgagggggagaaaaagacuacagagggucuacaguacaggagcaugcaauauucacacagacaaagcucucuuccuagaaaucgcugugcaacagaugugaggugguacaugagaugauagagcaugucugugcuguaucuauaacucagcacaucucaucuuaggaucuggaccauuugauuucaccagaaauaauggaaaggaguauaauuaugucaccugugugagaccugcuugauucuuccagauacuauaauccaaauuuauauaccaguggaaaagcauaucccaucugcuucucuuuuucucuccuaaucucuacccaguguuuaaguaaaauuaagugauacaaaaaagggaaguguaaucugagccuccggauaucuccugcagcugcucauggggaaagggguggauauugcuucagagaggauuuaauuaucuuuugagcaaacuccucccacaguauguaaugaaacaggaucacacugucaauuggaucuaaucaaugguguauaauuucucaguaaacguauguguucucuauuuugaguacacauuaaucacccucuugugcuugaaacguuauuuggguguaaaucauuugcuucccacuagguauaugcuuccucaggaaaauguaaguugaggccaguuuugucuuacagaagcagaauuaauauagcuuuaguaacucuaagauugcaacagaaaucuuaaaaacaugacucaaagcuaguuuaaagcuugaguaauuuaaggaaauuucuagggaaguaauugguauuguaccaaaacuaaauauuucacaguuacauuugcuguugccucaaaauacaaacuggagcaauacaagggaaaacugccaaaacagaaaauaauaugcagcagaugugguaauugguagugauaaucauaauuagaaaagauauaagauauauguuaaaacccagaguggaucuuccuguugacaacgggaaaaagucucaaaggcuuacacuccacucagcuuggacacuuuugcuucauaccugagacagauccucuaaaaacaaacucgucauuaggucagccaugaagccauucucuaaauuucacucaccaugcuguucucuuuggcaaaagagaagaaaaggaagaggucauauccucugacucugaagaaauugcaaaucagaggagacuggccaauuaucuagcuauaaauugcauuaaauaaaaauccucccaaagucaagaaaauauagagaauuaauauuuuuguaagcaaaaaugaaagacaucuuugcaagaccagagaaagauugauuuaaccaaguguagauuaagugaaguaaaauaugcuuguuccaugcaaagcaucucaaguuaaacagaaagcucugugggaacaggaaccauuucuguuuugcucauugccucagagugccuagcacauagcacacacugaauuugcuaaaggaauaagugaaugaggaguguuuagaucauccuugagggaguguuuaugcuuuguuaagugcuguacugggugguuuauagauaacaacacauuugaucuuuguaauaacuuuugagauacuaccaauccucauuugcaaaugaagauacugaacucagcaaaguuaagaaacuugccuagguuaguccaguuagaaagggauggaauuggaacuugaaccaaugucauccagcucuacaguccauauauuauauacaaugucauauuuaaagacuagaaugucuuagcuuuacuaagaacuagaaagaaugacagccuguucuguuguuuguuuuaaauucugaucugcaaacaggaucagucucccuuacauacucuauuuuauuuucucuuuuuuuucaauaaaaugguaaauauaauacaaucuaauacauuguuaaagggcugcguauucucucuguuaguuuuaaaucuucaaccuuuuguuuccuuuauccuccuccuuucuuucuuguucucaauuuaaacuuuucuucucuuuucuucauucuucuccucaaaaaaaauuaagcagguaguaagaaagaaauagaacaauuucauuacacacuuugccuugagggugagaaaucacaggaacaacuauuaaaauaggauagucuaucaaaauggucuugaauuugacacaugcauauuuaggaauauuauuucacauccaauccaguaaacaucaauugaacacauuugauauaagauucagaugcacauauaaggaggaauguuccauaacuucaagauguuuauaguuauauaucacauauauauaacuaauuauaaguuaagaagaaagaaaacauuucugaagucagguauaagcagaagacuaauaauuuuucuuagauuggggauggccucauggaaaaacugguauuuuugauguuuaaggaugagcaggacuuuaauaagugcaaaggggaauaggaagaaggccaucuaggcuuaaggagguugcaugcacaaaggacaugagguaaugaaacacucuaugugcucagaaaauggcuuguaugacuagagugaagaagcggugugagucuggauaaguugacuagaaccagauggcagaggucccugaaugccaggcuguaaaguuuuggcuucacucaauagacaauggggaauacuugaaucccaggcuguaaaguuuuggcuuuacucaauaaacaauggggaauacuugaaggugagcuaggauaggcuuuacuuuuuuuuuuuagacagagucucacucuuucacccaggcuggagugcaguggcgcgaucucggcucacugcaaccuccaccuccuggguucaagugauucuagugccucagcuuccugaguagcugggacuacaagcgugugacaccaugcccagcuauuuuuuuguauuuuuaguagaggcgggguuucgccauguuggccaagcuauucucgaacuccuggccucaggugauccaccugcuucggccucccaaagugcugggaguacaggcaugaaccacugcacccgagcaacauaggcuuuacucuugccuuuccuaguacaaucuauugucuacugaguagccaagugauccuuuaaaaauaaucauacucuccuauggcuucucaugucacucagaaugaaacuaaagcccuugccauagcccagauacaucucugaucacaugaccuauacugccuaauuuuacuuaagguaaauagcagcaugauauugaaaggcaacuaaaaacuugacagagauccuucaacaggucuggccaucccagaggcucaacuagauaucuucuaaguaauucaggcuucuagcuuggaccuauggguucaucuaugcugacugucuuuuguggcaagaguaugauguuauaaaguucaguacaugcugucuuccuauauuauccacuuaaugaucugucuucuugcucaaaauacuuaagggagguagucugaccuguacaggucaaaguauaaugagccugauacuaaaaugagaagaaagauucagcaaaauacaaaaggaaaagaugauacucucugaaaaaagaagucaagguauuuugucuccuuauagguuuguaguaacugggggaaauggaugugaagcacugacguuuacugaacaccuauuaaguaccaaacucuauguucaguaucaaagauaaaagauauuuauaauauaucuuggcuucuagacauucuugaccuaaucagguuaagauguauaaguauauuaccaguuacuaaguaauacaggggaaaggcgguaaugcuuaauuugucauaugggauuuucugaagguuuuuuccuaaguaauauuucagcccagucuugaagcuaauuucuaauagcuaacagcuauuuucuuaagaucaaguaguugauuggaauuugaccugcuaagaagauccauugacccaaauaauacugagacccuuaacuugaguaucauuagcccuguucuucaaauaauucaguucaacagucauauacacacacacaaaccacacauaauaaaugccagucagugggaauaagguugcauaacaauggcaucccccaacaauggaauguuauaacaccauuuuaaaaaugagauauguguguacuaaaguauguauaucauuguauuuuguaaaaaauaauuguauuuguaacuguugccuagauuacuuaucugccauagggaauccucccaaguuuguauauuauuuuuaaaguuccauauacccuaauguucuguauuuaccuauuuauuuauauccccaacuagaauaagcucuuccugaaagaaaggauugguuuuauucaucuuugccuaugugaggcuuaauucaaccccacgaacauaauagauauucaguagauauuuaaagaguacgacuggugacauguaacuugacauuagguaucugaucucacauuauggugacuaacuuugcucuuuguguuuugguguacugauuauucacgauuacuccacagucuacugccuguaacaauugcaagcuaacgauucaucccccaguuucuaguuuauuucaggacuaauauaaauauuauauucacaagcaacaaaaaaguauauaaauuuguggcaucagugaaaagacguaugcuauuuuaauuguaaaguaauaaauuuaaaauacgcuauugguaauaucuuuguuaaguuuaagacaauaggaggcugaguggaagaagauacagcuacacuggggaaggcagaauuaaguaauaaaaggaucauacauaucuuauuaagugcugcauucccagcacuuaggagagugcuugguaccuaguucaauuaaaacuugcugaaugaaugaauguacuauacuacuauaguacauuuucuagccuauaaucacguggcuuccuucagaaaagauuccauuuuguaggacagaaauacucauuuugauuaugacccauucauuugauugaaucauuuacuuagacauuucuugagcaucuacuauauaccacacuuugccagauuuuaugucuggaaacacaaagaugaauaagaaaugaccuagaagaguuuaaaucuguuggaagaaaugaauauguaaacaaauauuugcaaugcagugugauaguuacauaacauauaauauauauuucaugguaucaugacacaaaagagguggucagcucaguuuguuggagaaugagaggagguccaggaaagauugcccaaaaacgcauuuucaaggauggauaaggaguuuugaggggacuugauaaucuacccauuuaauguuacuacuuaauuucucauaacaaaaauaauuuaccuuugcuuuuuaugcuuagcuuuuaaauuuuauuucuuauuuaugaaaccauuuauaugcuuuacauauuuuugguccuuuaccauuauacaaguuuuauuacacuugacauucuugaaaaacaacucuagcauaacuacuauugagaaggucauauauuaaauaaagauuaauuuguauuuuuaaaauauuuuucuaggucuagaaaaggggacaaugaggaguuccauagcuuuaaauuagacuucauauacaucagaaauugaaaagcucucuguucaacaauagacuuacuuucuuugucuuuuuauuuuuuaaaaaacucauuuguaauuauacacaugcauuaaauaguuaauuuugcucuuuguuuauuaaaaaauaguagucucaguguucaaaucccacucaccuggaaucaauaauugcauugucaaggaaacuucccacugcagggaccaauguaucuuucauccccuuuaauuucuuggaaguguaaacagcagaauuuauuauucuuguuacguagcaauauagucauuugugaacauuucauuaaaacuaucugcuggcaauucagacucagugugacuaaaccugcuccuggauuugaguuauaaauuuagaaaugaaguagucgauuucuuuacuacauuauucaauuucuacuaggaaauagugcuugaaauccagguuucauuaagaaaaggugguuaaaauauauuggcagguuuuuuguuauuacaauuauuauuauuauuaugguaaaugagaaucagucucaaacaaguccaagcacggcuguaacauuuaauuucuggaacacaauauaauucacuacaacuaggcaacugucuguucauaaacaaagugaaacccauuccaaacacuccaauaauaucccaaacuuggugaauuuucagguauucagugaaaauucaacaugacuguuagccaaguaccaugugaacuuccccauauauaagacuguaauauuucugauguauaaauguagucauacauucaacucuccaaauucuucaaaaugucuuucaauauaaaaaccuagucccuuuuucauuacaguagaggucauucuaccugucuagaggucuaguuucaauucccuccacuucgggccucaaacuucaugguccagcaagacuaaaucuaccuuuauauucuauacgacacaccuugcucuguccuuuuauuaugccuucgaauauguuauuucuucuacccacaugauagucuccuuuaguaaaacuguauuugaaaucucccuuacccaggcaauuuaaaagcacaauuugucuguguuacuggguaugcacaugcaacucuaauauucuguauuauaauuguuugaagaucuuuucucaccaaaaaaaggccuuggaagggacaauauucuuguuuuccuagcauuuaguacaguauuuagcuaauaaaacacagcuauauauacacaugaaugacuauuuguccauuaauacaaauauuuacaguacauauaagaggaauaauaauguuaguagcuguugaguacuuagcauguguuuaguugauguaauaugcuguaugugcuucaucuccaauucucaccacagcccugugagguggauucuauuauuucuauuauuuucauuuugcccuugagaaaacugaagcucugagaaguuagccacauagcccacacguugucauauagcagaaucagauaugaacuucagucugucugacuccaaugucagugcuuuccccgaugcaccuggcuaccuuuugauuauugucaagauccuggaagacacaaauuagauuuugauuuaaucuuuuccauuucuuuccagcuccaaguacagcccaguauggaauuaccgggagcgcugauguucuuuucuccugcugguaccuuguguugacacuguccucuuucaccagcauauucuaccugaagaaugccauucuacaauaaauucaaagacccauaaaaggcuuuuaaggauucucugaaagugcugauggcuggauccaaucugguacaguuuguuaaaagcagcgugggauauaaucagcagugcuuacauggggaugaucgccuucuguagaauugcucauuauguaaauacuuuaauucuacucuuuuuugauuagcuacauuaccuugugaagcaguacacauuguccuuuuuuuaagacgugaaagcucugaaauuacuuuuagaggauauuaauugugauuucauguuuguaaucuacaacuuuucaaaagcauucagucauggucugcuagguugcaggcuguaguuuacaaaaacgaauauugcagugaauaugugauucuuuaaggcugcaauacaagcauucaguucccuguuucaauaagagucaauccacauuuacaaagaugcauuuuuuucuuuuuugauaaaaaagcaaauaauauugccuucagauuauuucuucaaaauauaacacauaucuagauuuuucugcucgcaugauauucagguuucaggaaugagccuuguaauauaacuggcugugcagcucugcuucucuuuccuguaaguucagcaugggugugccuucauacaauaauauuuuucucuuugucuccaacuaauauaaaauguuuugcuaaaucuuacaauuugaaaguaaaaauaaaccagagugaucaaguuaaaccauacacuaucucuaaguaacgaaggagcuauuggacuguaaaaaucucuuccugcacugacaaugggguuugagaauuuugccccacacuaacucaguucuugugaugagagacaauuuaauaacaguauaguaaauauaccauaugauuucuuuaguuguagcuaaauguuagauccaccgugggaaaucauucccuuuaaaaugacagcacaguccacucaaaggauugccuagcaauacagcaucuuuuccuuucacuaguccaagccaaaaauuuuaagaugauuugucagaaagggcacaaaguccuaucaccuaauauuacaagaguugguaagcgcucaucauuaauuuuauuuuguggcagcuaaguuaguaugacagaggcagugcuccuguggacaggagcauuuugcauauuuuccaucugaaaguaucacucaguugauagucuggaaugcauguuauauauuuuaaaacuuccaaaauauauuauaacaaacauucuauaucgguauguagcagaccaaucucuaaaauagcuaauucuucaauaaaaucuuucuauauagccauuucagugcaaacaaguaaaaucaaaaaagaccauccuuuauuuuuccuuacaugauauauguaagaugcgaucaaauaaagacaaaacaccagugaugagaauaucuuaagauaaguaauuaucaaauuauugugaauguuaaauuauuucuacuauaaagaagcaaaacuacauuuuugaaggaaaaugcuguuacucuaacauuaauuuacaggaauaguuugaugguuucacucuuuacuaaagaaaggccaucaccuugaaagccauuuuacagguuugaugaaguuaccaauuucaguacaccuaaauuucuacaaauaguccccuuuuacaaguuguaacaacaaagacccuauaauaaaauuagauacaagaaauuuugcagugguuauacauauuugagauaucuaguauguugcccuagcagggauggcuuaaaaacugugauuuuuuuucuucaaguaaaacuuagucccaaaguacaucauaaaucaauuuuaauuagaaaaaugaaucuuaaaugaggggacauaaguauacucuuuccacaaaauggcaauaauaaggcauaaagcuaguaaaucuacuaacuguaauaaauguaugacauuauuuugauugauacauuaaaaaagaguuuuuagaacaaauauggcauuuaacuuuauuauuuauuugcuuuuaagaaauauucuuuguggaauuguugaauaaacuauaaaauauuauuuuguauugcagcuuuaaaguggcacacuccauaauaaucuacuuacuagaaauaguggugcuaccacaaaaaauguuaaccaucaguaccauuguuugggagaaagaaacagaucaagaaugcauauuauucagugaccgcuuuccuagaguuaaaauaccuccucuuuguaagguuuguagguaaauugagguauaaacuauggaugaaccaaauaauuaguucaaaguguugucaugauuccaaauuuguggagucugguguuuuuaccauagaaugugacagaaguacagucauagcucaguagcuauauguauuugccuuuauguuagaagagacuuucuugagugacauuuuuaaauagaggagguauucacuauguuuuucuguaucacagcagcauuccuaguccuuaggcccucggacagagugaaaucaugaguauuuaugaguucaauauugucaaauaaggcuacaguauuugcuuuuuugugugaauguauugcauauaauguucaaguagaugauuuuacauuuauggacauauaaaaugucugauuaccccauuuuaucaguccugacuguacaagauuguugcaauuucagaauagcaguuuuauaaauugauuuaucuuuuaaucuauaacaauuuguguuagcuguucauuucaggauuauauuuucuacaaguuccacuugugggacuccuuuuguugccccuauuuuuuuuuaaagaaggaagaaagaaaaauaaguagcaguuuaaaaaugagaauggagagaaaagaaaaagaaugaaaaggaaaggcaguaaagagggaaaaaaaggaaggauggaaggaaugaaggaaggaagggaggaaggggagaagguaggaagaaagaaaggaugagagggaaggaagaaucagaguauuaggguaguuaacuuacacauuugcauucuuaguuuaacugcaagugguguaacuacguuuuucaaugaucgcauuugaaacauaaguccuauuauaccauuaaguuccuauuaugcagcaauuauauaauaaaaaguacugcccaaguuauaguaauguggguguuuuugagacacuaaaagauuugagagggagaauuucaaacuuaaagccacuuuugggggguuuauaacuuaacugaaaaauuaaugcuucaucauaacauuuaagcuauaucuagaaaguagacuggagaacugagaaaauuacccagguaauucagggaaaaaaaaaaauauauauauauauaaauaccccuacauuugaagucagaaaacucugaaaaacugaauuaucaaagucaaucaucuauaaugaucaaauuuacugaacaauuguuaauuuauccauugugcuuagcuuugugacacagccaaaaguuaccuauuuaaucuuuucaauaaaaauuguuuuuugaaauccagaaaugauuuaaaaagaggucagguuuuuaacuauuuauugaaguauguggauguacaguauuucaauagauaugaauaugaauaaaugguaugccuuaagauucuuugaauauguauuuacuuuaaagacuggaaaaagcucuuccugucuuuuaguaaaacauccauauuucauaaccugauguaaaauauguuguacuguuuccaauaggugaauauaaacucaguuuaucaauuaaaauauguauuugacucauuuuaaaacucuauuagcuuaagagaaagaaggaagaaauaauaauuugaagauauuucugcuauucucuuuauuuccuguauuacacucaucuuucugcuuacucuaaagcaguacaggguaaaaauucuagaugcuacaguuucaaaugacuccacacuauauucuuucuugcuguugcugauuccuaaaagguuugaugagcugaacuacaucuaaacuaaaaauaaauuuucuggaaacauuuuauuauuaauuauuuagaaccuuuaccugguaaaauacagcagaguuagcaacagagacuaaauauccuguugauaaaauccugaugaucuuacaggcuaaacaacugaaaacucaaacgcuuguaagagccaggcagaguguaauuucuuaacagcuggguauaaaacaacgggcaccugaagguauucagauacaauuuccuuaaaaauaccuugguuuccaagcaaaacacguuauuuggcugagaaccuuuaguuuguaaauaccaaaccauaauauacaaaugagaucucaagccaaaugaauuuuuuaagcccucuuucccauaucuguucaucuaugauagucaacugaauaaaugagaacaaugugauagauaaaacaacaaagcauaaaaaagauucaugcuugguuuuauaagcuauuuugaaauauaaguaucauugcuauucugagaaaucuauauacaccaaagcccucccuccacaaaaaaacuggaaauguucuaauaaaugucugauuuccccca

SEQ ID NO: 191347 - RNA, 43170 nt, Homo sapiens
ugccaaccaaccaguaaauuuuaauaucucaaaagaaaauaauuagaaaauuauaucuaaaaaguuuuuccauaauagagauuaacaacauuuuucaagaacguguauucuguuucaggauauucccaaauuaaaguaauuuggccaaaaucaaaauuaucaaauugcaagauugaaaaaaaaacuuagagacuguuauauucagguagaucaugccguaagcgaauugcuuucagcuucuccacuucaauuuuugcucuuaguagcucuuccucuagcugcugccuucuuuucaauccaucccucuucuccugaacauacaauccaaaauuuuuuugauuuucuaaaauuaucugaugcuccucuuucaacauuugcaggaucugaggaucauacccuaauagugaccuaaaguguucaccacucucaugccgaaaaaaaucaucucuccuuggaauagaagauggagacgaugucauucucauaucaacagaggaaagugaaggcgacaaggaucuuuccauaacauguacuaauucauguucuucucuuugcucuaaaguaucacucuguugagaauuuaaaaccaguggaggaggugguuuaaugucuucuucuugcuucaccuccacuguaauagcaacaggauggugauccaacauuaccuguagugaacugguaccagccugugccuccucauccaaguuugcacuauagcacacaaaaaagcauuauaauauguaaaucaaaugaagaaaaaguguauauuuauagcauaauuuuaauuuaauguacauuaaaugauaaagcuuuaaaacuauaaaguuacaaaauaaaaaaaaaucuuaaacacuugaaauacauuaaagugacuaagauugggauuucaauaauacauacucacagaucucccccauccuuaacuuuaaaauugugcuuuaaaggagcaggaaauuacaaauauuauagaaggccaaugaagaaaauaaaaagaaaagccaguuuucauguugucaaacagacaccaaucuuucccacaacccuaagguuuucaaaugguguacagagccauuuaaugcauucucagucuuguuauccccauaccuuagcccuagaccucaggcuucugcucuccuggacugaucuuaaaaccaugaaggcccauaacuuauaaaaggacagugaaaggccaucuaugggagguacugauuucugcauuugcccaaaaaauaaaacauaaagauuguauauggcuuugggauaugcucaacuacuggagguuauccuaacuuucuuauuucagaugcuuuuaucugauaggaaaaacuuccguuuuaccuauucugaaccauaugacucagaugcuguuuaagucuuucaaucacuggucagguaaaguucacaagagcaaugguuuuaauccacaacuguauacucaguaccuagcagguacuguacuuagaaccuaguaggugcucauuauguguugaaugacugaaaaaaaacaaacuaaaugauuuuuuaaugaaacauuuuuaauggccuauacagauauauuaaagguuuauuaaauuuacacauaauuuccaccaaauaugcauucccaauggagacaacuacagcuuuagcauaauuuaagcuucagcauaacaaguuaugauauuauaaaugcaauaaaccuuaaaauucuguuuuauaaacauaauuuuauguauaacgugaagcugugaauuaagaauaucugcuccuugagguuguuuuuuuuaauuuaugcuucugccuaacuuaaaaauaaaaguuauaaagggaaauuagaucauugaacaugaauggaaauacuuuauuuaauauuauuuagagaagauuuuacauauaauaagaaacauaauuaaaagaauacauucuacauggaugauuaaaaugcuggaacaaguucaagcagaaugcauagaaaaagauuaaaacuacccauacguuacuuacuaaugccauuaaauugccagaaauaucagauauuuaucuaagagacaaaaugaaacauauauaguauauaauaaaaaaucuauuuguagguuauauaaauucauuuuuguucuugucucuguuugugucauuuuauuauuuccaaaaacaaaacaauuaauuauaaauguaauucaaaguagcaagcucugcuucuauuaauagcucugcuaaaaccuggaaugggaaaaggcuaaaauugcauaugaaaauuaaguuuuuaaaaccacauaauuacuauuucaaauuaguauguaaaauagagaguauaaacauagacauaauacuaccaaguaaauuaaaaauaugccucauaucuggaacauuccuuuccauuuuagcuaaaacauuacaacuaaggcauaacaauauaaaaagggagaaaaaaagcuuuagagcaggucacaaaaaugacagagaaggacuugagaaucagaacuuugaagaucaguuuacaaaaacacaaaauauaaacugauauuaggaagagguaaaaauaaagacauaagucaaugugaguuacagaaaauaaauagccuuacaaaacagguauauauuuuuaaguauguuaacgcaaacacuaguauuuuccuuauuaaaaaggaagaguuugguaagauuaacaggcauauuuauguagaaguauaguuaagauuauagaauaauuauaaacuucugagauuauuaagauucaaggaugauaucaaucaaauaaauauaagcacauuaaauauauauauuaaagaaauaagcuaauacagagaaaaugucaauguagacacaguaacauaagaauuuaaaaggcauguuucuuauauucuucccuuuaaaaccuaacaaauugguauuauuuaagccauagguauagaaauguacaaaucaacucauuuuuaucagagaaauguucauaucccaaaagauuuuuugugugugaauauuguaaauauucacacacacaaauagucaaaauguaaccagauacuuguauauuuauauauuauuuuucuucuacucacuguuauuuuuaaaauaugcaacuaacuaaaauuacaguuucuacaugucguuuucaaauuauaaaaaccuauaccuacuaaccaaaggguacaguuuuauaccugcgaugcaaaaaacacuuuucuccaugguucaagggagagaaaauucugcauaaguagcacaguauaaaacaauuuuacugcguaguuuucuggauaucuagcuauugggauuucaucauuugucaucacagugaacauuuuaaccaguggccccaagaauuaauccacuguguauucauguccuggauucccacuggugauauuuuuuuuacugugcuaucaaguagaaauaagcaguaucugguaagaagcuaggcucaaaaauacuuuccuaguaaauuaccaaaauaacauaugcacuuggcuacaaagugguuuuuuucugcuucucuccuaauuucaaagggauuucauaguaaucaauaauuugcuuauauaaugccucuuccaccaauagaaaagcacauuguguaaagcuuuguuugaaaggcuccucaaacuaacaaggaguuuacaauuuguuuaaauuacccuaaaugguucagaauaagaauguagcugccauuuuuauauuuugccagagguuacaaucugaauuaguggcaagauaauacuuuugaaaauuccaaggcaaauaguuacauagaagacaaguuuaaccaaaaaauugcuucuaacucuaaaaaaacccaguugcucuuagggguauuuuaaaauucauaauuugauauccuugcaaagcaguaagagaaagcuuacucuuuccuauacgacccaagaucaaagugaaacuagacuauuaaggaauaaaaacaacaacaacaaaaaacuuuuaauuuuauuaaguaaacugaaucccuaauuaggcauuaacucccuuuaguuguguucaucuuuauuuuaaacguguuagaaaaauaauuuaaacugucuucauauacacaaucaugccauuaacaaguuuacuuauugauuuuguuuauauuuguuaguuaacauauauucaauaaguguagacaaugacaauucauaaaaaagcaagguuccauuucucuagaaacugcuaacuuuauauaaauuuuauauaaaauugaaaauuccagugaaauguaaucuuaaaugagaaaaaaaguaucucucagaagcaaacuaaauaauuuaauuuuaaagcuuaagaaguuuaugaagugaugucacaaauuucaacccacuuauuccucccuaaccuuuacuuuuagaaacuacaggagggaagggggaggggaagacaguaaaaaguagcuuaaaugcaacagaaaaauuccucauagccucacuuuucucuuuuuaaaaaaugcaaaacaaagacacuauucauugcucccguuguggggaugcuuacuaugcauaucucuaucacgacuaagccaaagcccaauagauaggaggcgccauaauuuuccauaacaaaacaaaauaaagcuuaccuuuguaugugguuccugucucuuaccaggcaaaaacuggaaaucuggggaaucaucuccauaacuuucuugguuggcucagaaauauugcuuuuaaaaucugauugggucucuuuuugcugcaauagcuccuguuuggcauauucuuugagccuuuuauaaagggugcguaggcccugugcuguucgaggagggcggucuacuccaauugcauuauaguuaacugcuaugauaucccaacaucuauucuuuucuacuauuacugaauguuuauuaguguguucuucgagaauuuucacauauggcuucacaagcuuuagcaaaucaagcuuuucggauaagguaaaauuggaagaucuagccuuuccuaccauuguucuuuucaaauuaaguaggcaguuucugaaaccaccaugcagccuucagcucugcucagcucuuuucacaaacagaaaaagaucaggcuuaacuaggcuagccucauuuaggcccacgccuacaggggaggguuuauuaaaauuccuccagcuuaagcugacgcagguucaggaaaucugcuuaagccaagccugaccuacauaaagcuucucacugaagaagacaggaaggcacaagcaaaacacacuuguguauaaagggaacagcucgagacaggauuuaauacacaaaggucuagagauaagcauggaacacagcuaaaaauuagcuaauuuagugagaauaucaaauuucacacauguaugccuagcugacagacugaacugcauugcaguaucacuuuaauaaaaacaaaagaggaacuguuuugugcuauuuauuuacaaauccaguagacagaaaacuaaaagauaugaguagugaauguaguaauuccuaacagagccucucaucacuguuucugagcugaguguucucccuuacaaaaucugcauaaugcuggaucugcugucaaucaggaauugcauauccucuagcuaguuagguuacacccagacccagacuccacaguaaagcuaagcuucuccuucauuuuacagucuacauuagccucugcauauuuuuuucacuuaagaaaaaauuuuuauagaacacucaaucuaaaaagcagguaaaaaucauguuuuuaaagcaauggauuauucuagccguaauguaugugaauuugcuagccugccuuaucauguguaaaaaaucacuguucauggugagaaacaguauaaucacgccuuaagacuccacauacaaaaucacauuugcuauuauaauagagccagauuuuuuauuuagcuauauucacacaguuuggacuaugaaaggaaacagcuagucuagccauuuucaaggccaccaguuucggugcuuagaauauauuuguuaaccccaguaugaaaauauaugauacauaauaauguaagcaagacaaaccuauuuucucacaauauacauauuuuuccagauaggggaauaaauuagaacauacuugaacauaguucuauccaauaaaacuauuacugaacaacugugauaguuauuaagagguaggaaaaauaaauuguuuuuaauuacugaccacguauauaaaugcucccaggcacugugcaagacccaaugaaaucaaaaaugaaucuagauacagcaccuauccagggaacuguaguuccacagaaaugcuauaaauucucaauuaucuuguuuuucauucuuuuaacaauggagaagcaaauuacauuuacugagcucucacugugagccaauguguuaaaagcuuuaaguguauuaucuuucagaaaacagugaaagauugcuggauguucuacggaaugcuagauguugucugguauacgcuacugaguaauuugauuccauaauaguucuacccuuucauugucuuugagcaguuucacagcucuguaaauuguagaaaucaguaaugcaaaugauucuuguccauagagaugcaaaaagaaaaucgaccugccccaacaacaacuggaccacagguacucaaaaucauucuagcauuuucugagcuuuuggaacauuaaaagagaaccaaagaaagaacauaggguauauacuuuauuuagauaauuauuuuguuauuuucagaagaaauacagguauuacagaacacaggguauauacuuuagauaauuauuuuguuauuuucagaagaaauacagguauuauguuaagaaugaaacacuacuaaaauaugaaaaaauguucaaucucacuaguuaucagggaaauguauacuaaaaaugauuuucauuccuagauuagcaaaauuuuuuaagacuuaaaaugccaagagugaggccaggcucaguggcacaugggccuguaauccaacaguuuugagaggccaaggauuacuugagcacaugaguucaagaccagaccgggcaacauggagaaaccccaugucuacaaaaaauacaaaaauuagccaggugugguggcauaugccuguaguuccagcuauucgggaaccugagguggaaggaucacuugagcucaagagguugaggcugcacuaagccauaaucaugccacugcacuccagccucggugacagagcgagacccugccucaaaaaaagaaaaaaaagaagacuccaagaguggaaaaggauagaagggaaagaguacucuucuguaccacugaagggaguguaaaaugacauuuuggauggugaucuggaaguaucuacuaauauuuuacaugaguaggaaaucuucuaaaauugugguaauuuuaugucucagaauauaccuuagaaaaauaaaaugcacacgggagcaacgaagcauucuuugcaguugcauacaguggaagcaaucuaaaagcacaucaguuggaguuaaaagcauacaauacauccauaucauggucuacuccaggcagcauuaaaaugaaagacgcagaucauaguguguuugaauauaucacgcuguuaacgaaaagagucaaacucuguauaaaauauuuuuagagauugauucugagccaaauaugagugaccauggccaaagacacagcccucagguggcccuaagaacaugugccaagguggguggcguauggcuuacuuuuauauauuuuagggaggcaugagacaucaaccaaauauauuuaagaaauacauugguuuaguucagaaaagcgggacaacucaaggcgggggcgggguggcggcgggggcgguguuccaggcuauaaacguuuucugguuuacaauugguugaguuuaucugaagaccugggaucaauagaaaggaaauguauguucagguaaagauaaaggauuguaggcaccaaguuuuauugugcagaggaagcucucagauagcagacuucagagagaacagguuguauauuguuuauuaucagaccuaaaagagugccuggcucuuacuugauuaucuccuggaucuagaaaggaaggaaggaaaacaaggggaaaguggauucucuauagaauguggauuuuucccacaagggauggcuuugcacgaccauuucaagauauggcagagaaacauguuuugggguaaaauauuuuuauuuucuuccauguuaugccagagucagaucggaaaguaagucaugauauacaggguuaaauaaaaccaucugaugagaauguaugguuuacagagcaugauuccccagaccccuuagauaggaauuuaggcaagauuaaaaaaaaaaaaaucagagcuuaguccucaaugcagacagcacaaauuagugauaaccuauguaaauuguaauugaugauuaaucugaaauauuuauuacuguuugauuauauuacaauaaaauuaucuuucuaguuuaaaaauagaauggacaaguuuuuaaauuaaaagaagcuauacuacugaugcagaauuaaguggaaaauacuaugcaggacuuucuaaagcagacuaugaaaagguaucauggauauacuuguuaagaauauuacgaauauauguguaaaugcuaugaaucacugccaguuuauggaacugguaaaagacaucgaauaauuuuuuguucuuugccaaugcucguugguguagucauagaguuuuaugaagaaucacugugcugucugagagugaaaaacucaaacuguuuuuccucugcucucacaccacaacaaucaacaugaagacuugugugaccaaaugugugggaguuucuccccacacaccaagcaagaaguuaaguucugcaguggagaggagccggguauccucuaauucaacuuuccaacacuaucaggagauaguguuagaucucaaagguuaagagcucaguaccacaaaccccauggccccaccugagggaagagagagacccucucauauuguuuuauauuguuuuauacucaguaccuguuuuaagaaaaaaacaaggaagugaaaucaaagacaggcagcccggcgccagguccaaaaccaggccugggccugccuggccuaaaccuaguaguuaaaaauuaacucaugacuuagaacccgauguuacccauagauuccaggcauuguauggaagaacacugugaaacucccugcucuuuucuguuucacucugaccaccggugcaugcagccccugucacguacucccugcuugcucaaaucaaucacgacccuuucaugugaaaucuuuaguguugugagcccuuaaaaggaacagaaauugugcacucagggagcucagauuuuaagacaguagcuugccgaugcucccagcugaauaaagcccuuccuucuacaacucggugucugagagguuuugucuguggcucguccugcuacacaaccagucacaagucugggccuccagaacaucuaaccaaaaagcuucaaguugggguucccacaauccccucuggguucuauuaguuugcuagaguggucacagaacuccagaaacacgcuuaccaguuuauuauaaaggauauuacaaaggauacaaaugaacagccagauguaagagaugcauagggcaaguuaugguggaagggacacaaaguuuccaugcccaccccaggcacaacccccagaaaccuccacuuauucagcuaucucgaagcucuacaacacagggcuuugggcuuuuuaagaaagcuucauuacauaggcaugacugauuaaaucacuggccacugguaaucaauuuaacccucagccucucuccucuccccagagauaggggugaggcugaacguuccaacucucuaauggugccuuggucuuucacguaaccaacucacauccugaaacuaccuaggggcugucagccaucaaucaaucacuagcacacaaacagacauuacuuuggaggucguaaggauuuuaggaguuguauaccagggaaacggggucaaaggccaaacauauauuccacaauaucaccuauuauuaacuucaguuggagauuuuugugaaacaaaauguuuacgaaacagucaauaaacaaaggcaaaaaaaucaaccuaaguguccaucaacagaugaauaaagaaaaugaacugcauauacacaauggaauauuauuugguuauaaaaaaugaaauccugacauuugcagcaacauggauggaacuggaagucauuauauuaagugaaauaacccaagcacggaaagacaaauaccguauguucucucucacaugugggagcuaaaagggugaaucucauggaaguagagacuugauuagugguugccagaggcugggaaggagagguggggauuaagagagguugguuaauggguacaaaaguacaguuaaaagcugggcacgguggcucacgccuguaaucccagcacuuugggaggccaaggugggcggaucacaaggucaggaaucaagaccauccuggcuaacauggugaaaccccgucucuacuacuaaaaauacaaaacauuagccaggcgugguggcaggcgccuguagucccagcuacucgggaggcugaagcaggagaauggcgugaacccgggaggcggagcuugcagugagccgagaucgcgccaccgcacuccagccugggugacagagcgagacucugucucagaaaaaaaaaaaaaaaaaaaaguacaguuaaauagaaagaauaagaucuaguguucaguaauauaauacggugacuauagucaacaacaauuuauuguauaguucaaaacagaagaauugggauguucccaacauaaaaaauguuugaggugauggcuguccuaauuacucuuguaaaagaaaauaaaaucuuaggaccccaaacucauuauaccaaaaggaaaguuaaaccuagaaaauuagucaugcaacacugccuuuccuuccuccucuuuccccccagagcuauaauuucacaacccugugucauagcauuacacguuaagucagcauugucccgcaauggcaaaaggacauauaccucccucacaaauuucucauaagaaaaucccuuccuagucacuaaaccuuucaggauacauauccccuaaaaccagcacaugccaauuguaaccuugggugugcaaccuaaguuuaacucucaaaacugaguucuguuaaaucucaugcugacaaugucaauuacaagcuuaccuucuuagguacacaacagggacaagacaaaaaaucacuccuucgaucaugucuuuugcagggacaugaauggagguggaagccauuauccucagccaacuaauacagcaacagaagaccaaauaucgcauguucucacuuauaagugggagcugaaugaugagaacgcauggacacauuguggggaacaacacacacuggggccuauagggauggucaggagagcaucaggaagaauaacuaaugaauguuggcuuaauaucuaggugaugggaugaccugugcagcaaaccaccagaguacacaucuaccuauguaacaaaccugcauauccugcauauguaccccugaacuugaaauaaaaguuuaagaaaaauaauaauaguaauaacccaagggaauaaaaugaaauuaucaaaaaaaaaaaaaucacuccuucggcuaacccgagauggaugcauaacugacucuuuccucuacuccaucuuuucaaauguuuaccuuaccuuauguaaaacacagauuuacugagcacuaauuagagccucacaaaaauguaaccauuugucucacugccucucuuaccuuccuuugucccuucugcuugcucuuuauucuucaauacugaguuccagaaacccucuuuuggaaagcacagguaacagaugcuccugugacuuguguuuuucccagguguauccuuaaacuuuggcuuaauaaaccucugauugagucacauuuuugguuaauauacugauuugaucauuacacauuguaugcauauaugaaaauaucacaugcacccccaaaauauguacaacuauuauguaucaauaaauaaaaauaaacuguaaaaauaaaaaauauacaaguuuaccaauuuuuugagucuucauuuacuuaugaaggcuccuguaucauauaaaauuuauauuaaauuuuaugcuuaugaaauacaauagaaaaaugguuguagaauacagauaacuuaaugaauaaaacacaaauguccaacauauaaagaacucaacuucacaaguaaacagggagacacaaaagauaacaguagguuuuccucauucaauuggcaaaaguuaaaaaguuuaguaacauguguugaagaaguugggaaaauaaauucucucauacacuaaugauggcagucauuuuggaaggcaauuuggcagaccauauuaaaguguaaugcaaacacauuaugaucugacaacuccugagaaauacaugcauauguucacaagaccacaugcauaaggauguucacugcagagguuuuaauaguuaaaaaaaaaaaaaaacuaaaacuaaaaacaacuaugauguauucauaccaugguauacuuugcagcaauuaaaaagaauaagguggaucuacguguucuaaaaugaaaacaaaaaacauccaaggcaaacuaaugagaacuguaaauaauucuuggcaaacaacuccauccaaauucuugcucuaagagccuugaccaacucuagcaaagcuucuaguagccuagcccaccuccacucagcccuggaauacccagccuccuuuugagcuccagucugucuggagaaguucagggcuaucaaaagaagcuuacuguuuauucuagccaacaccugacuauaggccccugaccuuccuuucuuagagcacuaagaagaguuuacaauuguaaauucuuccucugucccuuugagauguguauguaucuccuacaacucagcagugucuuucucaagaaccagaaagccacuccuuugaaauguaaucaucaggaagguuuggaucucugugucccagucucuguggaaggacagaauccuaauuuugauaacugucagcgagcaggcacaccugacccacucacauuuacaaugaccaacuaucuuagccuggagcugcuauaacaaaguaucauaaacuggguggcuuauaaacaacacagguuuauuucucgugguucuggaagcuaggaaguccaagauaaaaacaccagcagauuuggugucugguaagggcccauuuccugguucuuagaugacgccaucucaguaugucgucacaugguagaaggaacaaaugagaucucuugggccuauuuuaaaggguacuaaucgcauucaugagggcuccacucucauaccuaauuaccucccaaaaggcccuaccuccuaauaucaccaccuuggggguuaggauuucaacauauaaaugugggggaaaaacaaacauucaaaccacagcaccagcccuuuguaauuuucacuuuccugacgcuacuugagcccucaguugcuccccuuccguacucccucauucucccuuuaaaaggcccagucaugacugcacaaaucauggagcucagcucuuuccccuauugccagugguuacugaauaaaauuuguuuuuaccacuuuaauugucuugauuuuuuuauucacaagugucaaaguuguaagcagauaaauacugaauaacaccauuuauuugaagcacagcacccacaauaacagcugaguuguaucugcaguauuuuagauaguuuuaugaaaagaauguauuuagguacauuaauuuuuuuuuuuuuaagagacagggccucacuauguugcccaggcuggucuugaacuccuggccucaagugauccucccaccucagccucccaaagcucugggaucacaggcaugaaccaccacacuuaggcuuaaguacauuaaucuuaaugaauugcaugaauuauuuugaggaaaacguacucauauuugaaacuuuagaacucuuuuuuaaaauuaauguagauugauggauaaauauauaauaaaacacauauagcaaaauuuuaauuguagacuugagaugguagguuuauggguguucaacacaaaauucuuucaacauuuauguaagauuuuuuaaaguaucauaauaaaauguucaaaaauuaucauuaaaaagaaaacauagcaaguaguguauuuuaaagucuuuagccauuaaaaaugugcaaaguuugaacaaaguugaauuacuaaaacuuagauaaauuagauauaauaguaaagaauaauugugggguaggggugauuuuuuccacaaacucuuuuuaaggcacaaaaaguacagugauuacagaaauuuuuucuguauuuuaggagguaguccaaaagagucaagauaagaauuauaugccuuauuaaucuuugucuuggcccaguucucuggcaaacagagccugauuaaaaugcugauguuucacuugagaggugcauacacagggcaucaaaggugaagagaagguaaacugaggcaagaaaauauauaaagcaagggaaagugcuggcuaccauuuuacaacaagcuauaaaaaaaauaguaggucacuuaacaaaugcauccacuugguguacucuuuguggaaugucuccugauagacuacaaaaagaaaccauaccucagaguaguccaugugggaaaagaaauuuaucuggcagguucccuccugucuccuauuucccacuggucaaaguccacccugaaguacacugcacuucauuuugugucaucuggccuucacagaugcuuagggugcuaccuacaaggauguuguguggcguuauacccaagauuggaaguggcaggaggagccagacccucccagaguaugguucauaaacuuagcuagaugguggccaccaaggcauagggcccucauuccucagaugaagcaacugguuagccuccaguggcagcagaaaauucuacgaggcagauggugccaagggacucugaaggggcacauaagauuauguuugauauaaucacaaugcaacaugagaggaagauaagacuuaaaaaaaaaaaaaucugucacauaaaaauagggcaaaaacuaggguaaauccaaucucuaagaguuauucucaguuacagcauuuaaauaucucacacuucaucacugugcuuugguggugauauucugugauguuaagcaguuaagacaaucaaaaccuaggauuuaaggaccuugaaaacccucacaaaaccaaaggagucaaauuauaaaauuuacuccacccaugcuacaugaaucacagaccuacucuauauaaucuaaauuuacauauaucuucacaaaauagcucccagcugucuauuaaggaucucuguuuggccaagucuuguccuugguguaaaaauauguugagcuaaaggagccucucugccucagaagcuggccugcccuuuagaugaauuuuguauacugcaaacauugcuaagcuacucuuauuuauuuuagccauucuuucacuuaaucauuuuaucaguauagucaacauuauguuugcugguggcgucucacaauauucacuacaccacucacucauuguguugcagccagaaaaucugggugaaauaacucucacuucuaaggaaggagaugaaaaguaugugccugcuucguacacugaggauucucagaaacugguaaggauuccucuucacgauggcaaacuaagacugggauuagaaaaaccccuggucacaggaaaguggucagcaauagcacaaaguuaggaaaucuuauuuagugauucugaguaggaaccaucugccugucaugagauagaugagaaaaagcguguggccacaguaguugcugggauccaucauuuaacaugaguggagccagucuaagaaugcaacccauccugcagaugacagauggaauaaauagaaagaaacugggcucaugacaauauccuuuaaacugcuagaccagucagcccugaagccuggaauuuccaguuauacaugccaauaaaaaccuucaguuauauaagcuaguauuuuuaucgauacuugaaccaaaagcauauuagcugauauaaaaauauauucuuuuugguuauuuuuuucuuucccuuguguuuucuucuuugccuauguuaccuugcucaaauuaccacuucucugacauuuuguuuuuaaaugaggauucaaaugaaagacaagauaggaagacaguucauucuccaaaaaguagaggcugaaugucauuauuauuucaacuauucuauaguuuuggguuuuuuuugucuuuccauugagcuaugauuguaccacugcacuccacccugggugaccaagcaagauccugucuccuccgccccacucccccaccaaaaagaaacaggagauaacaaauguuggcaaggguguggagaacagggaacccuguacacuguuagugggaaugaagauuggugcagccauuauggagguucuucaggaaauuaaaaauagaacuaccauaugacccagcaaucccucuucuuggcacacacccaaaggagaugaaaucaccaucucaaaaaucugcacucccauguucgcugcaucaugggagcacacacacauacacaaaauagaauaucauucagccuuaaaaaaggagacucugucauuugccacaacauggaaggauguggaugacauuaugcuaaaugaauuaagccagacacagaaagaaaaauacugcaucucacguuauauguggaauguuacuuuaaaaaaaaaaaaaaggccaaacauacagagauuaaaaauaaaacagugguuacuagaacagaaagguggguuggugggggaggagggagaggaaaucgggagauacgcgucagaggauacaaguaguggauauguacgaugaacaagucuagggaucuaauauacaacaugaaggcuauaguuaauaaaauuguauuagguacuuuguuaaauaaguagauuuuaggugcucuggucacacacaaaaaacaguauaugugaugaguaauauguuaacuugcuucacuauauuaccauuuuacugucucuauauauguacgugugugcacaugcauauacauacacacaugcaugcacacacacacacacacacauacacacauauauaucucccauaacaucauguuguaaaccucagguaugcacaauaaaauuuauuuuuaaaauguuuuaaauugagcuuuaauauuaggucuuauaccacacccuucccccccgccccccaccacacacacacacagacaacccucuagaacccauguuaauuaacuacugcccaauauccauaucaucagguuguugccucuucccuugagugacccaucuaaaaaauaaugcucuauacucugguggccaggugcaguggcucacgccuguaaucccagcacuuugggaggcagagacggacggaccacaugaggucgggaguucaagaccagcuggccaacauggugaaacccuguuuccacuaaaaaaauacaaaaauuagucaggugugguggugggcaccuguaaucccagcuacucaggagccugagacaggagaaucacuugaacccaggagguagauguuacagugagccaagaucgcaucacugcacuccagccugggugacagagugagacucugucuccaaaaaaaaaaaaaaaaagaaggaaauggucuauacucuggagagaauuugauaacccaaccuccuagaaauagcccuggauaacaccucaguaguuucaaacauccuuuaggaugauuuggaaggaugcauaugagagagucaauauucaaaugaccaggaccuuuuuuaguaccuuuaggaccuuuuuuauucacuuccauccaaggcaggaauucaaaagaacagucccaguguauagguuuccucaaaagcccuucuuaauccugacaacuaggacaagaacuagaaggcaaauuaguuaggggagaauuaucuucaaugguguauuuuugaaaggagaaaggauacaccuaucauguuuccccuucuucagcagacuggacuacugacuguguggaucagaaacaaugcucauacgcccaaaaaucauaaaaccuaauuuauucccugacccaaaucuucauaaaagagcccuaaaggacaaaggaugaucuccucaaaacucaauugucuguggagaauuuucuauggggaaaaagauauaguggcucugaauauucaauaucugauuccuugcaguuaugucuagguuguuauauaaggaaguaagagccacuagaaaagaaaacagauucaccaaucaacuggucacaaauuuuuaaaaaucaguuuccauucaaaugucccuuaaaccucaaccauaauaucaaagucucuuugagacugcaugacaaucaacuacaaaaugaaacagcaaaucuugcaaaagguugacaugauagguacuuggaaagagacugaccugaauaucaaagaauuuuaggccccuaggaaaaguuaagcaauccacaaauacuaugcaaaaacccuuuuuaugauggggcuaaaagagucauacacaaacaaaagaaguuuuaucaugucauaguuucugugagaaaaaguauaacuaacuucuauucaaauaagcacuuuuaauaaggauauaaaaucucagccaggcucgugccuguaaucccacaauuugggaggccaaggugggcaaaucacuuggagccaggaguucgagacgaaccuggccaacauggcaaaaccccaucucuacuaaaaauacaaaaauuagcugaguguggugguggacgcuuguagucccagcuacgugggaggcugaggaacaagaauugcuugaauccagaaugagacugucucaaaaaaaaaaaaaauuuacuauuaaauuuggucccuuuuugauagacugguuaaacagaaauuaauagguaaauauauuuaagauaacaauaaccaaauuuuucacuaugaaagaaagggcugcaaacuaaaaugaacccugggguacuauauuagaauuggagguauugguaugagcugaugguuuuuaauauuuauagauaaauauagauguaaucauauauagauuuucgaguuuugacugcuagaagagcuaaaagcaauaacacugcaguaucaaugaguacaccuaguggucaguuccugguuuuuaaauacacuucuccaccaaaaaagaacuagggcucuugaaugauuucuacagcuggggcaggaaagaucuuauugugccggaagcacaaaaacgcucaaaaacugauggggauugucaaaaggacacaggaacccugguaaaaggauucccauuggccaaaucugagacaaucugagcaucauaauaaaugauaacagauuauaacccacugaauaaaacagacauuuaugaauccauaaaaauuaauuaacaaauaaaugggggagaagggaaagcucuuccuugcaacagaaugccaacuaauaaauauagauggaaugagaaaacuaacauuuggcaacaauuauaguaauaaauuucaaaguaacucuccauagauacuaauuucaaagguaaaaauaauuuuauggugaagaaacccugcugacaccaauuuauccaaauaaucaaacuuauuaucaccaguaaugggauaaauugacaucaugugccuucugauugauauacuaagaacuauuuccgugauauuucugccaaaaauguguaaacuaaaacuaauuauaaggaaauaucaaacaaacccaaacugauaagcauucaacaaaugauuggccuguacuccuuaaguuaaaaagucacaaaauagaagcaaagacuaagaaaacguuccagauugaaggcaacuaaaagacacgaugacuaaauacaacacauauccugguccagcaggaaaaaaaaaaaguuuauucauuuuuaaauuuguuucugccauaaaggacguugucuuaguccauucaggccgcuauaacaaaauaccauaaacuggguagcuuauaaacaauagaaauguauuucccacagaucuaaaggcugggaaguccaagauuaagaaacuggcagauucaguguuugguaagggccuccuuucugguucauagauggcacugucuccuguguccucacauggugaaagagaaauggcaacucucuggggccuguuucacagaggaaauaaucucauucaugagggcuucacccuccuggcccagucaccucccaaagcccucaccuccuaauauuaauaccaucacauuagugcuuagguuucuacauaugaauuuuggagaaacagaaacauucagaccauagcauuguaucaguguuaauauccugauuuugacuguuguacuucuguacuuuaucauauagcagccuguccuuguuuaggaaauacauacugaagaauuucaggugauggagcaccaugucaguaucuuauucucaacuaguacugaaacauuacacauauacauacaauacacacaaaaauguuaaauuuguggaaguuuuuuauacuauccuuaauuuuuucuuuuuucuuuuuuugagauagagucugcacucacccaggcuggagugcaauggugcuaucucagcucacugcaagcuccgcuccuggguucacaccauuauccugccucagccuccagaguagcugggaauacaggcacccaccaccacgcccagcuaauuuuuugcauuuuuaguagauaugggguuucacuguguuagccaggauggucucgaucuccugaccucaugauccacccaucucggccucccaaagugcugggauuacaggccugagccaccacacccagccuacuauccuuaauuuuuucuguaauuuuuaaauaaucuuuaacaucaaaaaguuuaaauugaaagcacaacaaaauaacacuguuuaacuuagauugucaaauaucaaaaauaugaauauauacuuacauauagauugagcaucacaauacaugauaaaugcacuccucacgcauugcugaugagaguauaaaccuguacuaaccucuguagaaggcaauuuaucauuauccaucaaaaugcuaaaggcauauaccuugugaugaguauccuacuccaagguauuuaugaacauagucuccuauauguauauauuauauagauauuuauuguagcucuauuuguaauaacgaaagaucccaaacaaacuaaauauccauuauuaagacauugguuaaguacauuuggcacauccacacaguggaauuaguuuuaaaaauaagauaguucuggccgggcacagcggcucacgucuguaauccuagcauuuugggaggcugaggugggcggaucacuugaggucaggaguucaaaaccagccuggccaauauggugaaccccugucucuacuaaaaauacaaaaaaauuagccaggugugauggcaggugccguaaucccagcuacucaggaggcugaggcagaagaaucacuugaacccagaggcagagguugcagugagccgagaucacgccacugcacuccggccugggugacagagcaagacuccgucucaaaaaaauaaauaaauaaauaagguaguucuaaaugcauugacaaaaagauuucagugauauacuguugcaguaaaaaugcaauguauagaacaaggaagcuagugaacaauuauuuagauggagaaaaaaauauauauguauacaaauauguuucuagaauacuucaaaaaagacauacaaaaaacuaguaacugguuaccucuggggaagggaaguagacagcuauguaacagggaagggagacuuuuuacuauauucccuuuuuguuuguuuguuugagauggaguuuugcucuuuuuuguccaggcuggagugcaacggcgcaaucucggcucacugcaaccucugccucccggguucaagcaauucucuggccucagccucccaaguagcugggauuacaggugugcaccaccacacucagcuaauuuuguauuuuuaguagagacagggcuucaccauguuggccaggcuggucuugaacuccugaccucaggucauccacccgccucagccucccaaagugcugggauuacagacgugagccaccaugcccggccaacuuuuuacuauacucuuaacaucuucugaguuuuuuaccaugugcgugcauuaccuuuuaaaaaaaaaaaaaagucacaagggauuacauauugcaugauucucauuacaucgcauauccagaauagguaaacccauagagacagaaagcaaauuagugguugccaggggcuggaaagagaggagagaaagagagugacuauuuaauugaucugggguuucuuuuuagagaaaaaugcucuggaacuagauagaagugacaguuguacaacauuguaaauaugcuaaaugccacuuaauuguauacuuuaaaaugauuaaaauggugaauuguauguuauguauauuuuaucacaauuaaaaaacaaacauuuaugaauacaaauaaaaccaauaaaauauuuuaaaauauauuaguuucaugauaguaauauuuugcuaaguuuaaacugcuaauuacaauauaaauaugauaccaacagauuugacacacaucuuuuguguuuaacaagccuuuuauccaauaggggaugagauggcuuaauucauucaccaucccuauuugaauaugggaaaccuucauuuggcaagaguauaccacuuauacaguuguuuacuuguucucaucugcaggcauaaaaucuuguaauggcacucaauuauaaggcagcuauccaaaagaucuagcacgagcguauacacuuuuauucauaucauuuaaaagaaaacacaaaagucuaacuuaucugagaauuuauaaacccuugagaauaugcccaaccaucuccaaggaccuaagacccacuuaagaaacauuuagcuaacuucuccaauggggaaagauuuuuaucacuccccuguuauaccuuuaaucuuccacucuucacuaccuuuuuccucucagccuacaacauacuaccuuaaaacaaaaacacaacaaaacucucuagcccccuaccauuccucgagauacuacuuccuucacuaccgaauuuauuuauuuacuuacaaacuuuauuuacauacuuacucgcauucacuuccuccacuggccuauuuccauucaucacauauccauuacagcaugacuuuuguuccaaaacacuugugaaauuauucucucaaauauuaccagagccugcaaacuauaauguuccaauagccucuuuguggcuacuugacuucccugaagcacucugaagccaaagacagccaagagacucaacuagagaaaacuguaaguuucucaggaucucuuuguucagucacaaaacauuuuuaaaucuauauaguuugauuuaaaaccuuaacaagagaacauuccugccuuugcaugucacaguuuugugaaggagauucagguaaacagauaacagaagauggcauagucuccucucacaguucuucagaaugagaaagaaucagaaagaauaaaaaaacuuucucuuuuucuaaagaaacuauauagcucugaauacccaagagaucuggggcuuccuguauuuauuucugagacuccuguaacaaacuggguggcuuuaaacaacagaauuuauucucccacagucuggaaaccagaaguccaaaaucaagguggcagcagggcuaugcucucucugaagguucuaagggagaaucuuucuuugcuucuuucuagccccuggugguuuccagcaaucaugggugguuauuccaaucucugcuuccaccaucacauggucuuuuucccucuguguuucuaucucuuucuucauaaggacaccagucauuaaauuuagggucuaucuuaauccaguaugacuuuaucuugauuacaucugcaaagacccuauuuccaaauaaguucacauucauagguaccaaggcuuaggacuuuaacauauaucuuuaggagacacaauugaagccacuacauuuccccucucccagaauuugguuuuugaaagcccagggucaaaaguacugaacuggauuguucaugaaaagaaacaccuguggagcuuggaucaaaaaagauagaaguggguccuauggccauucuaccacaacccccaaagaaaucacauucccuaagcuuugggggaagucauuagugguagaccuacaucuucauucucacacaaaggauauuaucuguaaacacgcaguguuaugaagagacucaaagugucccgugaauucaagaaagugaaaauguacuuaucagggcucuuucaguugaaagagaaaccaaacugaaacuagcuuaagcaaaaaugacauuaacaaugaacuaaauauuaugaauuacuauuaauccuguuugguauaauaacaaugugugguuaugcaggagaaaacauuuauuucaagaaauacacacuuaaguggcuagagguaaaguggcaugauauaugcaacuuauuuucaaaagguugaggggagugcaucuacauagagaaaaagagagaaagcacacaaaugaggcaaaauguuaguaacuggugaguuuaggauguuaauugcgucauucuuucaacucgagaguuuguaggcauauuucaaaauaaaaaggugauggggaaaaugacauauguuauuuaacugggacauacagauuuguaguucauuucaagguggauuagaucaagaaugaaaaagaugugaaagggugaguggauacuaaacaggucucucaucucuaugcuuuucuauaugcuacaucccucuccaacaauccaccauagagaacaaaacauuucucacaaagcuuuuuuccccaauuuaaccucuuucugaacaagaaacaggaggguaucaggagguuggcacagguucuccaguccacugaauguacuaaucagagaaaggauuacgggauuaggaguugaguaaguuaacucccucuuuauuuuaucuuaacucuuaacucccuucucaaauuuagcagggaagagaaugagaaacuaugguagaauacaaauaaagcccaagauuaguaacauaaaagguauuauauuccagagucuaaaugucauuuucugaugaagaaauuagaaaagaacugggcauacauggaucauuuucuaccucgggcuuaaaguagaaaagaaaaucugggaaaacagaauagucaccuaacaaggauggaagcaaggaaggaggaaguggggaaaauagggaggaaagaagggagagcaagucaguaagauagagcagagcuaaacugccaugcccagagcuguuccuagggaucuuccuauacugaaucagcucaaaaagucuuucuccaccuuguucugacaccagucacagcuuuugaaaaguuaugaggagcacauaaauggcaccaagauaauggccaguuagguaaauacagaauuccuuucuguccggacaagauacaaacccauucacagguaaaauucauuaaucaucaggaaguccaagaacuuccuucaaaauggugcuuagggcacuuuguugauuugcacugguaucauaaggauggcaguuacuauucuguagcccaacagauggggccggcuggcugaaucuguucauucaaccaaaacaugaauaaaauguaauuuggaaaaauacagucuaaugauggcuuucacaagaccaaauaaacaucuaugaaccaucuuaauuauuuuuuuaguuaccuaacaaauaguguucucuuacauauacaaaaagaaccauaaucauuauuuuaacucaguucaacaauagagggauggagcauuuguuaaaugcuugguuuucaugcaaguauguaucauaauaauucaacucugauuugaaguacuccagacucuaaugaauuaacaaguaacuacuuucaaguucaacucuccaauuuuaguccuauuaacaugcuuuuuagaaaaaaaauguauaaauccuaucuuuaaacacaaucuugguucuugaggaaaagaucacauuugaccaaguuuauaaucaacagucuuaagcauacaucuacuauaaagcacuuuaaucacacaguuauuaauccaaucacuaaagauaaauuaugacaacaaaaaaccugaacuaccaacaauguagugguauuacaucaacaauuuucuaauauaacauauucauucuuaaaacaucauuuaaagaauacuguaauacuauuggucaagcauaaaccuuaucaauaaaaagcagucuuaccuguaugagguggaucuaauguugccaguguaggugcuucaaaacaauauuuuccacugcaauuaucucuguuauugauuucucuaguacuuucuucacuaggcagauuuaaacugcauauucuaagaucauuuugugacgggagaaagguguuauuaauugcaacacccuaaaagaaacaaauauauauuuaaaucagaacucaaaccuaauuuucuguauuuucuguauuuuuacauaaaagauucuaauuuaaaacaggacauacugguuauauauauaaacuagaacuagauauuuaaaaauaaauuaauaucugcugggcaugguggcucaugccuguaaucccaacacuuugggaggccgaggcgggugaauuacuugaggucaggaguuugagaccagccuggccaacauggugaaacacugucucuacuaaaaauauaaaaauuagccuggcgugguagcaagugccuguuaucccagcuacuugggagauugaggcaggagaaucgcuugaacucaggaggcggagguugcagugagccaagauuguaccacugcauuccagccugggcaacagagugagacuccaucuaaaaaaaaaaaauuaacuaauuaauuaaaaucuaauuuuuauugcuuguuuuuagaacuauuuuaaauuaugcuacuaaaacugaaugauaugacagaaugaaaaauuaugcuuauaauuauaguguauuuuaaacauaucagaaguuuuuaaacaaaucauaacaugccauucucauaauaaaaugcucuuuuucuuguuaaauuucucaauacuaaaaucaauacuuaaauauuuuuaggugagauaaugguaaucucacuauguuggguuuuuuuaacaagcccccaccucuuuuuuuaagagauggggucucggucugguacccaggcugaagagugcagugucacgaccauagcucauugcagccuucaacuccugggcccaagggauccucccaccucagccucccuaguagcuggaacuacaagcaugugccaccauacccagcuaauguuuuuuuuucuguagagauggggucucacuauguugcccaggcuggucugaacuccuggccucaagcaaucuuccugccuaggccucccaaagugcuaagauuacaggggugagccaccauacccggccuuaaaaagcucuuauauuuuagggacauauucuaaaaauuuacaaaugaaagcauauuccuggaauuugcaucaaaauaagaagggagggacuugagcuggaguggaaaacuaaagaugaaacaagaggccgggcgcaguggcucacgccuguaaucccagcacuuugggaggccaaggcagguggaucacuugaggucaggaguucaagaccagccuggccaacauggugaaaccccgucucuacugaaaaaacaaaaauuagccagacacgguggugcacgccuguaaucccagcugcucaggaggcugaggcaggagaaucgcuugaacucaggaggcagagguugcagugagccaagaaugcaccaguguacuccagccugggcgacagaacaagacccugucucaaaaaaauaaaaaauuaggccgggcgcaguggcucacaccuguaaucccagcacuuugggaggccaaggcaggcagaucacgaggucaggagaucgagaccaaccuggcuaacauggugaaacccggucucuacuaaaaauacaaaaaauaagcugggcgugguggcgggugccuguagucccugcuacucuagaggcugaggcaggagaacggcgugaacccaggaggcagagauugcagugagccaagauugcgccacugcacugcagccugggcaacagagcgagacuccgucucaaaaaaaaaaagaugaaacgagaucagucauggccaggcaugguggcucacaccuguaaucccagcacuuugggaggccaaggcaagcagaguccuugagcucaggaguuugagaccagccugggcaacauagugaaacucagucucuacaaaaaauacaaaaauuagccaggcacagugguguguuccaauagucccagauacuuugaacacugaggugggaggauggcuugaggccaggaggccaagguugcagcaagcugagaucacaccacuguacuccagccugggcaacagagccagacccugccucaaaaaauaaaaauaaaaaaaagaucagucauacauuuucaauuguugaaguuagguaauauggacaaggaaguucauuaugugcuauuuucucuuuuuuuuguauauguauggguuuucuauugcugcucucucaaauuaccagaaauuugguggcauugaacaacacaaauuuaucauuuuauaguuucgcaaguuagaacucagacuuaggucuuacugcauuaaaaucaaaguuaucaccagggcugaguuccuuucuggaugcuccaggagagaauauauuuccuugucuuuucaaaauucuagaagccaaacaaauucuuuggcuuagcccucuuccuccauauucaaagucaacuauguuacaucucucugacccugcuucccuaaucaccaucucuuucucugauccucuucccucucucucuuccacuucuaaggacacuuauaauuauaaugggcccacucagaucauccaggguaaccuccccaucucaagguccuuaacauuaaucacgucagcaaagucucuuuugccauguaaaguaacacagauuccagugauuaggacaugaacauguuuaaagggccauuuuuucugucuaccacaguaguaaaugguugaauuuuuuuuaaauagaaacucacaauaauaggcaaaguugucauguuauuauaaauacucaucuuuuuuuuuuuuuuuuuuuuuuuuuuuuugagacggaguuuugcucuuguggcccaggcuggagugcaauggcgcaaucucggcucacugcaaccuccgccucccagguucaagcaauucuccugccucagccucccgaguagcugagauuacaggcaugcaccaccacacccggcuaauuuuguauuuuuaguagagacgggguuucuccauguugaggcuggucucaaacuccugaccucaggugauccgccugccucagccucccaaagugcugggauuacaggcgugagccaccacacccggccauaaauacucaucuuaauaaauuucaugguuaguaaauaaauuuuccaaaaaaaaaccugauaaauuuuuuuuauauuuuuuauaucugaucagauauuaaaguaagucaacuaaugaaggucacaaauuuucuuuuuugcaacauuuuauuuucauauaauuucaaauucaugguaacauuccaaaaauaguauuccuauauaccuuuacccauauuaaccauugguuuacauuuucuuccauuucccucuccuccuuugcucuguguauguguguacacacacacgugagaguaaacugcagacgcuaugcuccuucgccucuaaauacuucaagguguguuuccaaagacucucuuccauaaucacaguaaaauuaucaaaauugauuauuuaacacugguauaauaccaguaucuaauccacagucuauauucaaauuuggucacuuaucgcaauaacgucuguuauagauuuuuccccaaaucaggauccaauccuagaucacacauuacaucuagucaguauguuccuuuaguuuccuucaaucucuaacuucauucaucguuucuggucuugaaauuucaaaauuucaaaauaaggccaguuauuuugcugaauaucccucaaucuggauuugucugauguuucccuaugauuaguuucagauugugaauuuggggcaagaauacaacaguucaucauauuaggaggcacauaauaucgguuuguuccauuaccagagguauuaacuuugaucacugauuaagguggugucugccaaaguauuuuucccuuuguaauuuuuuuaaguauguugugaggagauacuugaauauauucaaauauccuauuuccucauugaacauuuacccacuaguuuuggcauccauugagacucucuaacaccaucauuacuucuacuucuaugcuuuagcauuccacuguaaggaagaguuuaaucuucauuuauuuauuuauucauuuauuuacauauauuaguauagauucugacuccuguauuauucaaugggcuauaauccauuaguauauuucuuuugauguucaauuugucccagauuuuguauuuaucagaccaaucaaguaaacaccacugaagucacuaaagcaauacuuucucacuauagguuaauucaaucuaagauaagaaauaguuuaaaaacaagaaguuaagaauguaacagacaaaguaaaaagacggcagaguugacugcuaagccuaauacuuuuaggcuucucauguuaccuugcuuaaaauugcuguauaauuucaaaaaugccccacuucaguuuuaaaaaguaaaauaacuauuuaauuuauuuauagaauuaaaagaaaaaaauaguaaaucuguguuuuugccuagaauuaguccuuagacauuacaucaaaaaacaaaucuuggccaggcaugguggcucacaccuguaaucccaacauuuugggacaccaaggcaggcggauaaccugagaucaggaauucaugaccagccuggccaacaugguaaaaccccaacucuacugaaaauacaaaaauuagcuaggcguggcggcaggcaccuuuagucccagcuacuccagaggauaagacaggagaauugcuugaacccaggaggcagagguugcagugagccaggauugugccacuguacuccagcaugggugacagagcaagacuccaucucaaaaacaaauaaauaaauaaauaaauaaauaauaaauauugguuggacacaguggcucacucuagccugggcaacagagcgagacuucaccuuaaaaaaaaaaaaaaaagacaguucuccaaagagauacacaaauggguaauaagcacacauaaaagugcuccauaucagcuaucagagaaaugcaaagcaaaaccacaaugagguacuacuuuacccacuaguauggccacaaucaaaaagauaauaaguguugguagggauauggaaaaauuaaaaccuucauacauugaugguaagaaugaaaauggagcagucagcuuggaaaagagucugucaguucauuaagagguuaaacauagaauuaucauaugauccagcaauucuacuccuaggaauacacucaagagaaaugaaaacauggccaaguaugguggcucacaucuguaauuccaacacuuugggaggcugaggagaggacugcuugagcucaggacuuagagaccagccugggcaacauaggcagaccccaucucuauaaaaaauuuaaaaauuagccuauaaaauuuaaaauuuaaaaaucucuaaaaaaauuuaaaaaugauggcacaugccuguggucccagcuacuuaggagauggaggugggaggaucacuugagccuaguagguggaggcugcagugagccaugauggugccaucaucaagacccuaucucaaaaaaaaaaaaaaaaaaaagaaagaaagaaaaaagagagaaacgaaaacacauauccacacaaaaauuuguacacaaacguucaugaguauuacucauaauugcuaaaaaguggaaacaacccaaaugaccauuaacuaaugaauagauauauaaauugugguauauuaaaacaacagauuauucagugugguaggcagaauaacggcucccaaagauuuccacacccuaauccccagaaucugugaauguauuguuaugugguaaaaaggacuuugcagaugugauuaaggaccaggaccuugaaacggagagaugauccuggauuacccaggugggccuaaccuaaucaaaugaguucuagcugcagaaaaccaaagagaaggaaacaugagaacucaaacgugcuucccuggcuaugaagacggaagaaggggaccaugagccaaggaauguggugaccuguagaagcuggagaaagccagggaacagauuuccccuaaaaucuccagaaaugaauauagccuuaccaacaccuugaucuuagaucuguguugaacuuuugaccuacagaacuauaagauaauucauuuguguuguuuuaagccauuagauuugugguaauuuguuucagcagcaagagaaaacugauauuucagcaauaagaaauaaauuccugauaaaaaguuucuuuuuggugucaugaaaauguucuaaaauugauuguggagauggcugcacaauucugugaauauaauaaaaaccacugaguuguaguaaguagacuguaugguauuuaaauuauaucuguauuaguuugcauugcuauaaaggaauaccugagacagguaauuuauaaagaaaagagguuuauuuuggcucacaguucugcagccuguauaggaagcauggugccagcuucuguuucugaugagagccuccagaagcuuauaauuagggcagaagguaaagggggaaacugcaucucaaucacaagagggagagcaaaagagggaggggggagaugccgcacucuuuuuaaacaaccagauaucauguggacucagagcgaaaacucacucauuaccaugaaaacagcaccaagccauucaugaaggauccgccccucaugacccaaauaucucccauuaggccaaccucaaacacuggaggucacacuucaacaugagauucugaagggacaaauauccaaacucuaucaaaccuaaauaaagcuguauuuuaaaaaggaaagaaagaaagaaaccuuauuaagaaaacaaaagccuauguuuucuccuuacagugugccagaauuuuuacauugguaagugcuaaacaaucuacuugggaaagaaauauaggauaaaacaaacacauacagaccaaaaaaagcagucaaaaauuagaagguuuuuucagcaaaaaaagacaccauuaaaaaccaggcaaagaccuuaaauagacauuuuuccaaagauauacaaauggccaauaagcacaugaaaagaugcucagcauugcuagucauuaaggaaauacaaaucagaaccacagugaaauaccacuucacaacuacugagaugccaauaauaaaaaaauuuuuuaaauggaaaauaacaaguguuccugaggauguagauacuacaaccaucacacauuccugaugaagauguaaaaugguacagcuaugaaaaacaguuugacgguuccucagaaagcuaaacacagaauuaccauaauacccagcaaauccauuucuaguuauaauccaaaagaauuaaaacaggaacacaaacagaaacuuggaugccaauguucacagcagcauuauucgccauagcaaaaagguggaaacugcccaagcaugcaucaaauagaugaauggauggauaaacauaaugugguaaaaccauauaaugauuauucaaccauacaaaaaaauuaaguucugauacacacuacaacauggaugaaccuugaaaacauuaugcuaagggaaauaagccagacacaaaaggacaaauauuguaugauuccacuuccaugagguaccuagggcagucagauuuauagagacaaaaaguagaaucgugguuaucaggagcugaguggagagaauggggaguuaauguuuaauggguacagaguuucuguuugggguaaugaaaaaguuuuggaaacagauuguggugaugguugcacaacagugugaaagucauuaaugccacuuaauuguacacuuaaaaaugguaauguggcaaauuuuauguuacauacgcuuaaccacaauaaaaaagaagagggaaaaaauuaauagacuuuaaucccuauaacauaaaaggaucagggaauugcagaguaguagguagugugaauucuccauuuuauaugccuucuuuauacuuuauaugccuuucauauauacuaacgccuuugaucuuagaccuaagaccaaaacaauccuuuuucuuaacaguaaaugagacacauuaagacugcuuccaguauucacuuuuuuuuuuuuugggggggacggagucuugcucugucacccaggcuggagugcaguggcaugaucucagcucacuauaaccuccaccucccagguuccagcaauucuccugccucagucuccggaguagcugggauuauaggcgcgugccaccaugcccggcuaguuuuuguauuuuuaguagagacggaguuucaccauguuaaccaggcuggucucaacuccugaccccaggugaucugcccgucucggccucccaacgugcugggauuacaggcgugagccacugcacccagccaguauucacuuuuuacagauaaaagugagaaaaaauguuuggaauagugauacaaaucauuauguauuuuuuccucuuuaaaugaccuuaaagaaguuuucacuuauuuaugugguaacuuuaaaaagaacacugauuagaaucuccaccccuucccucaaagagguacuuacuuaucauuaccaaaaguuuauuuuauagacucaaguacauguuauuccauugauugauugaaugagacagggucuugcuguguugcccaggcuggauggagugcaguggcacaaucacagcucacugcagcuuugaccucccaggcucaagucauccucccaccucagccucccgaguagcugauacuccaggugcacaccaccacaccccacuaaauuuuuauuuuuuguagagacagggucucacuauguuacccaggcaggucuugacguccuuagcucaagugauccucccgccucugccucccaaggugcugggauuauaggcaugagccacugugcccagccuguuauuccuuuuaaaaaaaaauuauguaaucuucauuuccaagguuuuuagaagauguuuucagagauacugaaaauuccuacaggcagaaaauacuguuaacucuuuaaauggcauuuucuuaaacauacaugcuucucuauauuaucuauaucaugagucuuuuuuugccuuaccucaaauaauuuuauaucuggauucaguuuuguaaucucuucauucagaccuggauuacuucuuccuggagguauaaauuuugguuuuuugaaggaauuccccugcaacugacuuggugcugcagaucgucucauauucagcagucgugaccugaaaaauacccaaaacaguuaacuauccacgaaucuaauuacaaucacccccaaauauaaaaauagcucaaaacuacaacuaagauggaacagaaaccccucuuaugggccugccuggccccccaagcauagaaacaaaaggaaaaucuucaguuccuucaaaggaaauuccaggcacuuagcuagcccugaaaaguacaugagcaauaugauuagcaagaagguaauagcuuaaaauaauggugagggaaguuagauugacaaaauguuugguucccucuagaaacuaaagguaacaucuuaacauauguccuugaguuguuuuucagaaauccagaccaccaccaaauggaaaauacugucuacuggcacacagaccucagauuaggggaaacaggacugaacucuaacugcuauuauucuuuguucugaauuucuucuucagaggccuggaggaagucauacccacaagccagagcucaacauuccuuucugcugaccccaaguuuuuagacagagcuucacuuccuuaaccaaucccaaaucagagaaucuuuuaauacaucuaugacucgcaagcccccacuucaagaugucucaccuuuuuaggccaaaucaaugaugcauugauuuaugacuuugccuguaaccucugccuccccaucuuuaaaaauaguuacaugaaagccaucacagaguuugggucuuaaccauuagcuacccauuuuuccucgcuuggcacccugcaauaaacgccucacuuucucuugcugcaaaucccaaugucuguggagagcuuugcugugccaggcaggccgucucaaguuugguuugguaauacaaccaugacauauguaaaaagguaaaaggggccggcguggugguucaugccuguaaucccuguacuuugaaaggaugaggccggaggaucccuugaaccuaggagcuucgucucuauuaaaaauuaaaauuaagaaaaaaaaaaaggccgagcacgguggcucaugccuguaaucccagcacuucaggaggccgaggcgggcggaucacgaggucaggagaucgagaccauccuggcuaacccagugaaaccacaucucuacuaaaaaaaaauaccaaaaauuagccaggagugguggcgggcgccuguggucccagcuacucuggaagcugaggcaggagaauggcgugaacccgggaggcggagcuugcagugagcucagaucacgccacugcacuccagcuugggcgacagcgagacucugucucaaaaaaaaaaagauaagaggagcuugguggugcaugccuguagucucagcuacucaggaggcugaggugagggggaucccuugaggucaggaguucaaaaccagucugggcaacauagcagcaagacuucaacugaaaaaacaaaaacaaaacauaugagaauaagccugagaaaacagguucaggcugggcaaaguggcccacaucuguaaucccagcacuuugggaggccaaagugggaggaucacuugagcccaagagagcccaucucuuguuuuuuuuuuuuuaauaaaaaaaaagaaaaagaaaauaaguucaauagcuaguaagauuuuauuuuucaucaagggcuauugaaaagaauuuaagauuuaaacugaacggugauacaguuuggcugugaccccacccaaucucaccuugaauuguaauaauccccaugucaagggcagggccuauucucgugguagugacuaagucucacgagauccgaugguuuuauacaugggaguuccccugcacaaacucucuugccugcucccauguaagacguggcuugcuucuccuuugccuuccggcauaaaugugaggccuccccagccauguggaacugugaguccaauaaaccucuuuccuaauaaauuacccagucuugaguaucucuuuauuagcagugugagaacagacuaauacaaaugguguaaauuuaaguauaugucaauuuugauaauacuauaagcaugauaucuucuuuaaagcaauuuaaauaaaaauuucaaaaugcaaggaaauacaauucacauacaaauaucaaacauguugccuuuuuccuauuccacuaauccauaaaccacaugaaggcagcaaucucaugcuuguuuucuccaccacuaaugacuauaaugugucuggcaacagugacagauacauuaccaucacuaacaaauauuuugaaugaaugaaaucuggcaauuuaaaagguauuuuuauaauucuacuuguuuuuacuauccuacuucauuugaaaacaguggaauuuuuuaaaauauaaaucaagagacuagaaccagguuucccaacuuucacucaaucuuauuuccacuaggacuggauaggggaacagauggaaaacaaggacauuacauacauacaucauguuucugcaauggauaguagcaagcauuccaauucaaagcaacaccacaaaacacuauuuaacauaagccaucagcaaggaugaacaugacuaccaacauuaucuguuucacccagaaauuccaauucuggcaauuuaaccuaaggaacuaucagagauaauacuaaguaacuacguauaagaauaaucagcugggcaggacacaguggcucgcacgcauguaaucccagcacuucaggaggccgaggcagguggaucaccugaggucgggaguuugagaccagccaggcuaacauggugaaaccccgucucuacuaaaaauauaagaauuugaggccaggugcaguggcucacaccuguaaucccagcacuuugggaggccaaggugaguggaucaccugaggucaguucaagaccagccucaucaacauggagaaacccugugucuauuaaaaauacaaaauuagccaggcgugguggcgcaugccuguaaucccagcuauucaggaggcugaggcaggagaaucacuugaacccgggaggcagagguuguggugagccgagauagcgccacugcacuccagccugggaaacaagagcgaaacuucgucuaaaaaaaaaaaaaauuagccaaguguggugguacacgccuguaaucccagcuacucaggaggcugaggcaugagaaucgcuugaacccaggaggcagagguugcaguaagcugagaucgcaccacugcacuccagccugggugacagagcaacacucugucucaaagaaaacaaagaaaaaaaaaaagaauaaugaugcuaguaucaauuacaguagggggaaaaagggaaacaaaugucuauaaugaaguacaagauaaauuaugguacacccacacaacagaacacucucuucauauaccaccaaaaucgagucaguacuauuccccaagcuagccauguucucuuuuucucuaggcuuugaacaaacuuucccuuauauaauguugggaaugcuuuuucccacuuuucuuugccuaauuaauucuaccuuaucaucuaggagucuuaaccaugagcccucuucaucuccucccaaagacuggacuggagaccuuccuguauaugcacuacccaagcacuuuucacacugcaaugaaauuugcccuaucauucccucugagcuauuaacucaggcaugaaaucuuacguacaauucaucaguauaucgccaguaccaaauacacagaagagguucaguauuuguuaugugaaugauaccauuaauggguggcgggggggggcaguacuuuaaaaaaauguuuaaugacaagagaaauauguuuuaauaaaucaaaggaaaaauggccacaaaacauguccagccucauucuaauuuuuacaaaagaaaagaaaaauaaaaacaauaauggguguauguacauuuaaaagacuagaaagcaaaggagcaugagagaacuuguuggaggugauagaaauaaucuauauaagauuguaguaugguuacaggaguauauauacaucuguauaugaaaacaucaaaauguacacaucuaacugcacacuguaaauuauacugcuauaaaguagauauaauauacauguuauauauuaaaauacacaaucguuuuuuaaaaacuagaaaaauacaugccacaacauuaacccuaauuauuucuaggucugguuagaauaccaguaauuuuuauucuauucugaguuauuuucuguauauuucaaauuuuuuacaaugaaaauguuaccuuuguaauagggaaaaguaucauuaauuagauuuuuuuaaauuaccauauuucaucaaaucuaaaaugccaucaauuguaagauauacucuugauuguuaguccauauaaaagaaauuuuuaaaaguaaauaaaaauuuuaaaaauaaaaauuuuuuaaauuguaagauguaccauuauuuuauguauccaagaaaaaaaguguagccaauuaaaccaugauacacuaucauugaugguuagacauuucccaauuucaucaauguuaaaauaaugaaacauguaaauauuuuauauauaaccagccuuuauauaguuugaggaaugaguaggagagaucacucucuucuguuucuuauucaaggacaaaauagaucucuauuaguauaaucuuuaaucuuaaagcaaauuaugaaacagaugguuuuugacugcuuuagaagcaguauuuaccaauaccagaagucaguacaaauucugaccaaacaagucaugccaaaauaacuucauuaaacuaauuuccuuuuuauaauggguaagcagaauacuacaggccucuaaauauauaacugacacaaguuugaaauugauuaacgguaacugucacaggacgacauggauguuaggccuugcacuuagacucaguuacuuaauggucaaaugaaauagaacaauagaagcugaaauuuaaaacuaaagauuuuagugacuauagcucaacugaaauaagauaaugagccuucuuaaacuaauaaauucuagauagcauuaauaaaaauaugauguccacaucaugaaauguaaucaguucuguucucuacauuagucagacuccccucuaauacugugaaaauucugacacuuuuuaaaaaggaacacuuaaaaaauacaguaguuagaaacaucaacaguagaaaugaaggaaaccagaguguaguucagauucugcuauuucagggaugcuuaacuuuggggaagcuauuuaacucucuagacaccaauuuucucauuuauaaaauaaagaaugaacuagaugcuaaaauuucuuucaacacuaaaugcgaagaauuacuacccuaaauccuucuacaucuaauacaugauuucugauuuuucaauccuccuauuuuguaaacuaauaaaaaugauaaugcaagcauacaaccaucagcacagagcagugguuaagaaaacagacugacucuggagccagccaggcugccuggcuagaaucccaacucugcuacuuacauaugaccuugggcauccaucaagccauuuaauuuguugauacaaaguaaaaugcagaaaucaguacauuuccccccaaaagaccauugcacccuuauagcuuuuuaaacugguucuguauguucauauuguccuguccauaauaaauuaauuaauuaauuagugcugucugagcccuuuccccagguccuagaaauaaagccauuugguagcccugaugugaugcuacaacuucuauaacaccuauuaguuucaguccuuccaaguaaaaugguaaggccaagcugacaacuguaauacaccagauagccacaaguacuuggcacuacacugugguaaauaagaacacaacuuugaaagcaaaugccugaauauaaauguggacugacacuuucuaauggucuugcacaguuuacuuuggcuccaugugucucaguuuccucaucuuuaagaggggguaccauaaucaugcuuacacaccggacuguugggaggauuaaaugaaauauguaaagcacuuagaacaaaacuugacacauaguaagcacucaauguuaucuguuauaauuaguauuaucggagaguagaaaugaugaagguccugugaaggagauagagaagggguaguucaacauacaggacaaugaccagaaucuuuggguucgucugggcuuuaaagagagguaugugcaaccaucaaacgucgaggaugcaagaauguaaguacaccaacucuaccaagaaccagcaacggucucucccugcuguugcugcuugucgacuuccaacuacauuagguaguaauuauuucacuucaugccuuaaauugcuccuuugagacuccggcuauauagaugguuccuaauuuaggacggugucacuuagaauucuucgacuuuuaagaaagccaugagcauucaguagaaacuguacaaguaaccacacaaccgucuguguucaugauuuugcccaacuguagauuaagguaaguguucugagcauguuuaagguaggcuagcgcagccauaaaaaggaaugaaaucauguccuuugcagcaacaugggugcagcuggaggcuauuauccaaagcgaauuaaagcagaaacagaaaaucaaauauugcauguucucacuuauaaaugggagcuaaacauugggcauucaugaacauaaagauggcaacaauagacaguggagacaacuagaagggagaggaaaggaggagcaaggguucaaaaacuauuggguaacaugcucacuaccugggugacaggaucaaucguauccaaaccucagcaccacguaauauaccgaugcaacaaaccugcacauguacccccaaaucuaaaauaaacagcugaaaauaauuuuuuugauaacaaaaguaggcuaggccaagcuuuaauacucaguagguuagcuguguuuuaaauccauuuuccauuugggauauuuucaaccccguaguaagucgagaagcaucuguuccuaccuagaaaaucuuccauaagguaaucgauuaaaagguuuuaaggaaauacaagaaaaaccugaccagugaagagguaaaagccccuaaagaaggcguaccgacacucuccaggacgcucgcagagccuucacccccuggcccuggggaaggaaauucccagugcaggagugagggagagacccaaaagccaagaggagccugcgcaaagcgaccgcaguggcggccccaggggccacugcccagaaccaucccucccacacaaacgcacaacccuaaacccccaccgcccgcccuucgcuccaaggcccccggggccagcaaccagggcgucccuggcacuucagaccaaagcugcaggcccgcagaaggccacuucggucgcuccugccgccuucccucccuccucccucguuggccugcuccggcgccacucccugcuuugucccgcacgagccuacaggcugucgcagccucccgagcuucccccugcaggacgcaccggcgaaaaucugacagaaaccacuggcccugcaaagaaguccuucugguaaccagcuauccccucgccgccggagaagcucaaggaucccgccucggcgaagccaaucgcggac

SEQ ID NO: 191348 - RNA, 25334 nt, Homo sapiens
uuaauaguugaauuuauuuagaaauuuuccaccacuuccuauugacuaauacaaucaacuaaaauuugaugccacagaaauauauuacauagaacuagauuuucaaaaaaguaguuggauaugguucacauagucaaaacacuggaagcuguaauuaaaucuuuuuguuguaucauugcacuuuaaauccccaaauucugcuuuguaaacggucuuucaacaucugcuaauuauggacuguuugccagacaccaagccaggcaucgagggauaaggaggagaugcucacaucaugcuauaacuagacaaguauuuagugauucuucccuuccaugaauagcuauagcugauagcaaagaaaaaauguaaaguguuagaauuacgggacagaaauuuauagaacaugagaguauaguauaucagagaaaaugcccaaauguuauauacuacacaggacagcuuggauugaggaagaacucaggaaaugggagauuaccaaagaugaaauuauucaccagauuuauuugcagcuccacugaacuuuuauuuuucuugaagucuuuuuuuuuuuuuaacaaauacucucaucacaaaaaaagccauuguuugaauaacuguggacuuuugagacacaaggggaugucaaagguuuuauccuucccuuuuuuauaacacugucauuuucuauuuagaagugacaguaagaaaaacaucuaauccaacucaugcagaggucaaaaacaggcaggcaagagaguacugaagcaagugcagucagagaauguuauuucauuaagaugugaaacugguuugaaaaaaguuauuaucacaauagaaaacuaaaacuggauuguacagcuuguaaaaucaaguuaaauuaggugugauauuaucaagagucuaagaauucaucugaagcaauuauuugaucgacgcaaauauauucuauacaauuauauuuaaagugaauuaugguccuaauaagcuuaagcauuuaauacugcaauaaaaugaacagaaaaacccacauuaauccacuuuuaauucuaagaaaaauagaauaacgaguucaaugaagacauuccagaugaaguaauuguaccaaaaaaagaaaagaaaaugacugaaaaauucaauuugccauggagaacuucagauguuuucgucuuaacauuaaaaauucuagcaguuugugugaaaacacagacaguaaacacacuuauauaauuagaacagauaaauccaauaaacaaccaugauaugagcugcuaugucaucucgaaugaauacuaauagagaucucuaaguacaccuuuggaauggaaaagaaaaauucugacuuuauuuucuauuuuaaccuuuaauaauuuagacaaugcccaaacaguauuacaauuuucgaaguacuuaccacacccaaauaccucaguuucagugacagaaaguaauucaauguucacacagggauaaguaguucaacccacaauuuauugaacuacaaaucagauucauuaaaugcuaugauaguuaaaucgagaauaaaucucugaaaaacaucuuggugaguucuuggaugucaaaguguauaccacauuauuggacuguuuaaauuauuagaagaauaugaaguaccugucaagguuucaacgauaaaaauauuuuuuaaaagacccuauuugguaauaaauuagauuuauacaauugauaauuucaaaauaaauaaaaucugaguuguaaaugccuccuacccucaccccacccccaguuauacauaccuuauauccauuuucauuuaaaccagugucucaaauuuuuaugagcauacauaucccuuggggaucuuguuaaaaugcaggaaguaaguuguggggccugagaguuuacauuucuaacaagcuacagauguaagaugcugcaggaccuugcaccacccuuugaacagcaaggugacccauuauauauuuaagauaauuucuggcauaaugacugcacaguuuuauagauucaaggcuguacuauuuuggaaucaaguauaauaaauaaccaaaaaugaucaugaaaaauaaguuuugcaagaaaagaauguuuuaguuaaaugaaagcuuaaguuacaccaaguuggcaguguuucuauuugucugacagugacaccuuugaaacacugcaauauaaaucaggauaccaaauucuaguaacuuuuaaaaaugaaguuacuauaguuugaggcucuccuucaguuaacucaaguccagaaaauucaagccaguacacugcaaaaccacuauuaaaaaucuuuaauggcaaacuguccauuuuaauuacuuguaaacuugcuuuaagcuaucccaucuccuccuccucuuucaacaaacaaaugcuuuuucuucugucuuguagcuaaacagcguguaacacccagcgccccucccuuuaaaaaucgaacaaaauugucuccaaccaaaggacccaaugcaaaaagguuggcuucuuuaauacacucauagguauauguaucuauuuccacaggauuacccuuacaugugauuggcuggcuugacuuauggccuagguaacacccuugauccuucagaaaagacagauuaggaugagaaccuaucaauacuacugcugcagacagcuuaaauauuuucuucaauccagaaacgcuuuggagaacacauuucauguccgacuuaaaggaaagcacacggugcucgggaaagcugguauaaucagauaaaagauuugagucuacagaauaugacugaguacacaucauaugauagacuuuaugauauucaggauacagcuuuuugggaagcuguuugaaaauuaagcuuggaucaguuacucgucugcgaaacacaugaaucacagggauauuacuguuguaagcacacaguacugcgucagcggcaguaagcccagaaccuacaauuaacacuggauccacuuugccacgcaacuuuccuuuguuuauagcagcuccaaauucaggcauugaaugaaacacaaaaggaaaaucuuccccuucaauuuccagaugggcaggagaauccagcguuccaguugccagcgcuacauucucagcaaagaggcagaagggaacaugagaaccaucagcuauucgcugauaaccccuaauuucccaguuucucuugauaaaguuugacuucucuaucuguaaaugcuuuguugaaauaucucugucuugaauaucaucaucaucuugaucucuguagagucuugauacggaaguuauguaaguauucucucugaaauucuucugaagacccaugacuuuuacauaauguuuauaguagcgagcuauuuccucuggcauaacucgauccccuuuuaggcuccuaaaaaaggaaaaggaaaaauauccuauaaggauacuacuuucaguuuccaugauuauuacuuaucuaccuaguaagcuuuuauagcuuuuuaauucugcuggacugucuuagcuauacauuauccuaacacuuaaaaaaaaaacuauuuuuaguuaaaaaucuucaugaguuacuuuuuagcaaaaaauuggaagaagucccaugagagcagagacuauauuuaaugcacuucuguuuccccagugccaugcauagugucugcucaaauacacugcuugauaaacuuucauuaaaugaagguauuaaaauguggauauuugaaaauuggacuacuuuaucucacaauuauaaucuauaacuaucaacugaauuauuuucauggcaaucauugagauauuacaggccuaacuaauaucuaugcuucuuaaaauuauacaugccaucuugacaugaauuuuaguacacugcuauuuuccuaacagcugaaaauaauucagaucugucuuuugcuaaacaaagucaucuuacaucuagguuaaguaacagaugacauuucacucuauguguuuuccuacucacaagcagagcuaaaacauaacuguuaugaaaaacuugcauuagucuguaugucauuuuccaaaguucaaagcaacaagcaaaauccccugccccaaucagagauaagaagcaaauuauuugacauaauucaugauguggaugcucuucaauuuacaguaggguuuguccugauagaccaauuguaaguugaaaauauuuuaagucaaaaaugcauuuaauaacaacuagcuuacugaacaucaaagcuuagccuagcuugccuuaaaugugcucagagcacuuacacuagccuacaguugggcaaaaucaucuaacaaaaugccuauuuuauaauaaaguguugaauaccucaugugacuuauugaauucuauacugaaagugaaaaacagaacaguugcauugguacccaaaguauaguuuguaugaaaugcacaucacuuugguaccaccuuaaaaccuaaaaaccuuaagugaaaccaugauuaaucagggacuguuuguaacuuguaaugggaaguucacaaaaauuuuucuuuugaaguuuaauaauuauuauuaagauuuagaauuaacuuuagauuuuuacuucuucagucaugugucacauaauucaaucaacaaaggauagcauauacaacaauggucccauaaaggauuauaaaggagcugaaaaauuccuacagcuuagugacaucacagccaucuuaaaguugugguaaaauuacuuuuuuaaaaagaaauucaguguacccuaagugugcaguguuuauaaaguguaccuuaguguacaguaaugugcuaggccuucacauucacucaccacucacugacucauccaaagcagcuuccagcccuccaagcuccauucaugguaagcgcccuuauacagguauaccauuuuugguaugguaccucccacagguauaccauuuuaaaucuuuuauaucguauuuuuacuguacuuuuuguauauuuagauacaaaaauacuuacaauuguguuacaacugccuauaguauucaguacagcaacaugcuguacuggguuguagccuaggagcaacaggcuauacccuauagccuaaggguauaguaggcuauaccacggagguuuguguuaaguacacuuuaugauguuugcccaacgaaaucaccuaacgacacaauucucagaacauaucaccaucauuaagcaauacacggcuguauuaucaucuccauuuuacagaauggaaaauugacaacuaguuuauuuguucaggaucacaacacuagaagucauaagucggaacucaaacuccaccaaucucuagagaccuaagagucuucucuuuauacaaaggcagcaacuaaaccuaaauuuaucacaaaauucauuugcacauauuacuucaacacaauaugcauaauuuagaaaaguaaaugcuucugguacauaaaucauaaagcuuucucuuucuuacccuuuuacaaagugaagaauguguuaagcaauuucacuugccaaguuacgaagaucaagaacuguacaacuugccuaauuuuacuucaaguuucaaacccauauauaauucuuuuuaaaaaucuaaaaugaauuuuuggaaagguuuaaucucaauuacccaugaugauguaaauuugcucucccugaauuuccucauauuaaggaaaauuucuaugaauuaacaugguuguuauguagcaggaagugaaguacucaaauguuacaucccuguucuaacaaagguuacguaacuucuuauuuugugaguagucaaauuagaguagauucucuguauuaguaauucuuaucuaauauuuacuauccuugaaaaugauugacaggauuuucauauuucucuuuuuaaauuuugggauuuccccuuaaaauaaauaaauuuauaguuuuccaaggugagauuucuuccguccuuuuuuuuuugagacagagucuugcucuguugcccaggcuggaguccaguggcgcgauuucggcucacugcaaccucugccucccggguucaagcaauucuccugccuuagccucccgaguagcugggauuacaggcaugcgccaccaugccuggcuaauuuuguguuuuuaguaaacaggguuucaccauguuggucaagcuggccucaaacgccugaccucaggugauccucccaccucagcuucccaaaaugcugggauuacaggcgugagccacugcgccaggcccucaguucuacucuuauuuuuuuuuauuaaauauguuccuucauacccaauuagccaaccauaagccagauucuagcuuauccaucauuuuaaauuaucaaucauaaaauauacaaucuuuauacugaaagucaaacacuuuagguaugcagaguuuagguauucauauaagagauaugcauagauaaaguuauauaucaaugcauaaaaauaaaguaugaaaaauaauauauggauggaugagaaaguaacuaaacagagagugauguaacaagacaguagauaaacccaugauuaacaaaagucacaggaaaccaaucugcaauaaucccuuagcucugugcuuaguuuuauaacaucucuaaaugaaaacuagcauauuauaaucacugcuucaaggacacauuuuuauuugaaagacguacauuuauauucuucagccaugacaaaaucacaaauauuuugaaauuuuuccacauucucuuuuucaacguacaccaaagaauuuuaauacaguucaaucuuuaccuucguuuacuugauacccaguccuuaaauuuaaguccagguaguuccauccaacuuccaaagcugauugucaacauggagccuuccauauucuauuagaguuuaaaaaaaaaaauguaccgucaaaaaacaagaaguaacaugguuuuuuuuggucuguuuuuuaaccauauccaucucauuuacaauaauuaugacucuggacaaggugcgcuccugcaguccuaaaugguuggcuaacuuaccucaaaaacauuacuccaauaaacuuucauauaccuucaucacuugauauuaucccgacaaccuucuuucauauaguuauaaauuuauaaaacaaauuuacaauauuauccaaugccuacacaauguugauaacuuuggucuaugaucaacauaauucagauguacaauauuaugucagggaaacaaaaauucaguauauucauuuuuugaacaaaaggaaaaauguucauuaaguuccaaaauuuuagauggcuuuccauuuuaauauuauuaacuuucuuuuaauuagcaacaaagaagcuuuucccuccuccaucaauuauaauucuaaaaucuaggcugauguggauacagcagcaucucuucuuaaggauacagaaauaggcaguggaugccugagaaacaaacgagcugaggcuacugcuugccaucaagcucccuugaccuacuuauuucugcuuuguucaauacaaagcaagaaaagcccaaaggccaaguaccuguuauaccuaugaccucuaugaucucuuucaaucaacucuuuuaggcaguggcuccuuuucucauaauuucuugcccugcuucuauaacacccaguuugaaaauggggcauauuauuauuauuauuauaacugacuuucacagaguacuuacuauguacuaggcccugugaaaccucauuugugacuauauacaaaucacccaagaaagagaauguagcaagcugccaccugcuuugagggaggcuagcccugauaccagguucagaaccuggaaucaucauaaaaggagcuguuaagaauguauuaucuaucagagauuauuuggaaccugagaguuucaccuguaacucuaaaaccuuaagacacuacuauuucacuuucugacaacaauuuuuuaacauuauucccacugcaccaguucuuccaguugguugagagcccuaaugccuugaucucuucauuuuucuccuaucuuucuuuuuuccccauguaaccuauaugccaugaauacaagcugccauggacacuguaguauuaaaggaugcaaacuaaauagaaguaugcaggagcauauagaaaguaucugguucuucaaggacacaaaugggcagaggaguguaccauuagaaagggaaaauauuccaagccaaauaaaaauccauguggcagcuuaauaaagagagcaaauaugaguguccuucaaggagucaaaagaaauucagccuugugccugaaaggauuaacucagcaggccugcguuguuccaaccuuuuacauuaccaacaaaagccugucuucagaaccaggcuuggcugccaccuucuuagaaauaacuucugagccccugaauacucuaccugaugagcaugaguuuugcaugccuaaggccuuggcaaugcuauaccaguguaaccaugagaguuuauccuaacaaugugauuuaugugaauaccaguuuuugcucugggaggcagaggugagucacaugggagcugcuggccuauaugacugaccccacagaaaacaucccucgacaccacgcaccagugacuuuacuaggaguggauaucuagaagcuuacacuugguuucuccuggacuuugcccugugaaccuuuucccauugcugauucuaaucuguauccuuucacuauaguaaaauuuaaccacaaguacaccaucuuuacugaguccugugaauccuauugaaucuucgagacugagaaugaacuuggacuccccaacaaaagcaugcuagagcacagaaugucagagauaaaaagaggaauaugacaagaaaccuaauaagggcuagauuggaguauggugagauacauuacgaagucuacauacuauauguuagauggagagcaacugaagaguuuuaugcauugguguaacaucucagacauguaauuuagaaagaugagucuggcuuugguauggauaauggauuggagaagagacaaugaguaagaaaaccauuuagaaaggguuugcaguaauucuggugaaagacagcggugaccaauauuagcaacaaaauagaguagauggacccaaaauaucauaaaugaaaaagauuuggugauuaauuugaaaugggaguugaagaaagagaaaucaaggaagacucucagguuccuggcuugaguaacuacaugagaaugccauuuaaugacaaggaaauugaagggacuugaugauaaagauaguuaguuuuagguacguugagucugaggacaccugcagaauaaucaagggaauguauuuacuuggguauaugagaaacagcaaucugggcugguuuugauuuugggaauucugauuugggaaucaauuaauaucaauaugcaagccauugaaguagguaagauaacccagggagaaugaagaguaugaagaaaagaccugggcuugggauaaggucuacagaagcaauuuuuaaagaacaagagucagcugggugugguggcacacaccugcaaucccagcacugggaggcuaaggcaggaggaucauuugagcucagggguccgaggcugcagugagcuaugacuguaccacugcacuccacccugcaugacagagugagacccucucucaaaaacaacaacaacaaaaaagacaagaauccacaaagguaucagaaaaggagugaccaaacaggaagaaaaacaaggagacugaagauucagagaaccuaagaaagauaugaacacugucaaaagcugcagagaucagaaaagauaaauucugagacucgucaucaaauuaagcaaaaaagaaaguuaccgacuuucagaaaaaacaguuccaauggaaaaccgguggcagaagguagagugaguaagcuaaggagcagaaagcaaaggcagggagaaguauguauagguaacucuuucaggaaguuagcuauaaaccaaaggauaaagaucagcuggcaccuaaaauuuuuuuaaagauggaaauaauuucagcauguuuacauaccgaccaauagaagcuggcagagaaauugaagauauaaaagaaauggggaaaaucaaauaaauaauguucuugggaagacagggauccagaauguggcuggaaggugagccuuaguaguaauaucucuuccauuauaacaggggauuaaaaaaaaagaauuugcaucaauguguaaguuuucgguuugagugugaaauuguggaaguucaauccuaauggauuacauuuuaucuguaaaauaagaaccaagaccacuucuaagcaugaaagaaaaaaaagagauaaagguuugaaaagaaguuaauaaggaaauaucaaagguuauaguaguguuuuggccccaacugagaguggagaauauuuucacaguuguauaauuuuuuuucugggggucugacugcucaaguguaagaaaagauaaaguggauaguuagaugaauugccuguaugacaaaccuaugugacagaaggacaauggguuaagggaauuaaagagaauaguuaacuccauggacuacagaagcugggcuggguaaguaaggauaugaagaucacagccuggagcacgcucuguguucaaagauuaucuauagugugaauuaacugggugauaagcuugaagaacaggaaacugugaucagaaaggaagacauuugagaauuuagguuuuuacaaguugaguaguuaugacagauaagaucuacaguggagccacuggagugaguagcuaaugaagaauacaucaucaucaagaaugaggagaccaaggaacaaaaagguuaagaucuugguucugugucauguuuguagagguaaaauuauucaaggugguaacaaaacuugggauauaauggaagacccaugaauuaggugccacagauucaguaacuggagacagucuggaaugguaaaaaagccagaaauggagacagucuggagacagucuggaaugguagaaaagcuagaaaauggcaucaucuguucaauggaacagggcuuuuuacacaagugcauaggggugugaagagaagaccaaccuuacuagccaaccugaugggacauagggcuaugggagaaugaauaggcuccacuucagagggcuacagugggaaugguaucuuuaggaaagaguaagcuuucaagaaagggagcagaagcagcaucugacagaaugguuaaagaugugggaaagcaaacaaguuguuuaucacaaaauugguucaaggggccacagaaaguuuggaagagagaagagugaugagaaacuagaucacaagagaaacagagaacuauaugaagcuaaguaggagagaggggugaugacucaaggaguuuacgucuuaagucacaacucagguuaauuaggauguacauaaaccauagcaggggagauggucgcauaaacagauaaauaguaccacaggcaagcacaguaagauuaagauauggaaugcagguaggaucaaguaauuaugucugggaacauuaggaaccuucacagaggugaugacuggcaacugguacacagcugaaauauuacuuacagcccuauuuuagugaauacaugccugaaaaaaaucagcaacuuuuagguauauuuuaaccuuuaucacuggcucaaaauguguuuuuaguaaucaggguuuauccauacuuucuaacuuuuuuauacauaagugaaagaaaugaaacagaucaauuaucgccugcacaacucaucauucuucuaagcggaaaaaauguaaguaaaauaaaaccucaggaauucagagaaggcagucuaaaugcccuccccacuuccaaauacauuauggcuuuuuuuaaaauuaagaaugcuacuaauuaacagagaaaauauaaacacuuaaguuuugggcaugauagaauucuuucuuaucuuguauuggugguuucacaguuacaggcauuugucaaauuauacacucuaaauggaugcagcuuauuguaaauaaagcuuaaaguugauaugaaaaaguaaaaaucauaaaacuuaagcuaaaagcaacaaauaauuugguaguugcuacucauuauuaaaaagagaauaaagauuuuaaaagaaacccaugacguauuuaaucuaggaaugucccgauacccugaaacagucauuuuauaaacguaaacaacuuuucagaugugcaaaacugcacuaauacacgaacagccaaccgaaguuuguacuaaaaauuugguauguaauauguuaaaguucccaugaagucuguaauucauaacacagcaaacuaaauuacuuaacaucaauuuguauaacaaaugaacacucacuacacacuagacacaguguuaacugcuaagaacacaggaaggaugaacaauuauuacuuacuggcccccuaaugaaaugcacugagugaauccuuaauucacugguucucugguuuaaccucugcuaugaaccgaauuguaucuacccucaaaauucuuacguugagguccugacccccaaugugaugcuuuuggagauggggccuuugggagguaaguagagcuagaugaggucaugaggguaggucccucagaaugggauuacuggcuucauaagaagagaauauuucucucucucugcuaugugaggacacauugagaaggcagcuaucugaaagcuaggaagagggccuuuaccaggaacugaacuggcuggaaccuucaucuugggacuuccagccuccagaacugugagaaauaaauauguuguuuaagccaucaauucuauggcauuuuguuaucgcagacaagcagacuaacacaaccucuuuuacauuuuucauuuaagauucugaaaauguaagaaaauaauggauacugcuuugaaauacuaugugagauuauguaaagucuaaaaugaauugaguuuuaaauuuuuauuauacaaaacauucuugaaauguuuucuacauaauucuuguaagauaguauagagacaugcuuauucuaagacuguaccaguaauaaaauuuggcuugauuuacugcuacuuguaauaaacccauauuuaacuaacugaacagcauuaaaguucuucucaaauaaaaaugugauaaacaucacauauaacauuaucauaaugcuuaagaauaaaguuggucuuaucaagacaaauaauucacauacacuaaaaugcuaagaaaaauauacucacaugccaagccccaccagguggaccuuuaccaagaacuacgugagggauauaaugauguugcucuaauuuccaaugcaaaacggauggauaaucauacccaaagucagcaucuggaugaagaaguguaucgaaaaguacugcaacuggauuggaugaucggcccucaaggcccucagacaaguauucuaaguccugaaugaacaaaagggagacagaguuugaaaaaagccagcauuucccagauaguauauucuaaugcuuaccaugaugcuccaaugauaaaaagcaguacccccaacuugaccacagagcaccuacuaaaucuccauuagaaaauaauucagaaaacucugcucuaauaaauucaagaaaauaaacagaaguaacucagaauacauuuacgaaucuaaaauaaaaaugauauaagguguuauuuagaauaagggguuucaacuaagaaaguucauauaaauaaaaacuaaucuuguuucagcauaaaaaaauuuuuuaaauugacauguaagaaauaauaccugaucaacaauggaaagaugucuugcuucuucuaauuuacuauuuaagauuguauuuggguguauugcuucugaugauaaauacggucuguagccugauaacauauaagaaaggcauauuccugaggguccauuuccuauuaaaaauaaaagguggaaagggguaggucaugcaucuuaauacucuuguuccuuggcuuuuguccuacuuugaagauggcucuuuucucugaccaguucuuccuuuucuaaucucuuaaaaccagauguuucaugagauuuuaaccucugccuucucuccuauuuucuuuugggaaucucaucuacucaaggcuucaacucucuaggcuacugacauccaaaauuaguucucuaaauugaccuauuucccaaggauauaucccacauuuccauuccacuucuugauucuaccugauagaauggcccacuaauaacuuuaauguaaugugcucaaaagcaagcucaugagucccuucauugaggugcccucuccuucaaacccuauccuaucucaaaguaugguacuagcaaacuucuaaguuaaucaguuucugguucuaaaccuaguuugcccccuauaucuugucaguugucuuugcuauucucauuccuguacuucaccuaaaagacaagucuccuacuguuucucugcccugagauucacccacucccaaucauuucacauacuacauucacauaaguuuugguaacauaauccucaucauguuagccuucuguucuaaaggucuucauuguuuguuucugacuauccaguguucuccauuugaaacaacuuuugcaaagauuaugacagugagagaaaucuaacauggcugacuccaucuugcuucuagcuucaaaggccggcugucuucccucacuccuggguauaggcaaagcuaaucauggaaggaauuuauaguuuaaccuuaaagcaaggaugguaacaguccuucccaaaauuaaaccgccuuucuaaaacuaaugaaaggccacaagguucggauuaugagaggugccggaauucugcuaagauguaggcagaguuucuauaauccuuuacugcugaagagucacgcagccagaggucacaugaugugugacuucccuaauugcucuuacagauaacaucgcuacuguggauccugagguuggccuuuugaaaugucuuuucagacuuuugcauuucugaugacugucugacucuauuggucccaagauucaagacucagacccaagacucaacugaaccaguccugcggccccccacccagaguuggacucagugcuagagaaccauuuuugauacccccagcauggcauccccaaccaaucagcagcaccuauucccuaguccccuguucacccaacuauccuugaaaaacccuaaccuccaagccaucaggagggaucaggaguuuuguuuuuuucguuguguuuuuuuuuuucagacagagucucgcugugucaccaggcuggagugcaguggcaugaucucggcucacugcaaccucugccuccuggguucaagcgauucuccugccucagccucccaaguagcuaggacuagagguacacgacaccacacccagcuuauuuuuguauuuuuaguagagacgggguuucagcguguuggccaggacagucuugaucucuugauccacccaccacagccuccccaagugcugggauuacaaguaugagccaucacgcccaaccaaucaggaguuuuaucaggagacuaauuugaacaacugcaguucucucacaugggcuggccuugugucaacuucuuuacugcaacgccauggucucagugaaaugguuuugucugugcagcaggcaagaaacugccaggugauuauacaucucaaccaucuuuccaguccuaaauccugauauugcuuuccuauauguuuauaugcuuuaacuaaaaccaaacuggauuuccugaacuacuuccauuuaugaauuaauaauuccuuuauucuggauuaccacuuauuauaucugccuuucaaaaauuuaauccaaccuagagaauugcuagcugcaaagaaaaaauccuguuccuuaccuaauauguuaccccaaauaaaauauacucaaagauauaagaaaaguaaaaccauaagaauacuagaaacagagaaagcagagaaagauuucaacuuauaauucuagaauaggaagccuuaaagacugaaagaaaaauaaaaaauauuuagaacuaauuuuauaucuuuuuuuuuuuugagacggagucucgcucugucgcccaagcuggaguacaguggugcgaucucggcucauugcaaccucugccucacggguucacaccauucuccugccucagccucccgagaagcugggacugacuacaggcacucgccaccaugccuggcuaauuuuuuguauuuuuaguagagacaagguuucacccuguuagccaggauggucucgaucuccugaccuuguuauaugcccgccucagccucucaaagugcugggauuacaggugugagcuaccaggccuggcccucuuuucuuuuuuuuuuuuuuuuuagacagaguuucacuugucgcccaagcuggaguacaauggcgcaaucgcggcucacugcaaccuccaccuccuggguucaggcgauccuccugccucagccucccaaguagcuaggauuacaguugcccgccaccaugcccggcuaauuuuuguauuuuuaguagagacgggguuucaccauguuggccaggcuggucucgaacuccugugcucagaugauccagcccaccucagccucccaaaguucugggauaacaggcgugauccacugugcccagagaugucccaguccuauccccuagaaccuguaaauguuacuacagagcaaaaggacucuguagauaugauuaaggauccugagauggagaguagucuagauuacccagguagacccaaucuaaucacaagaguccuuaaaaauagagaacuuuucccaguuguggugaaagggagacaugacaaugaaagaagguuaagaaacaacauugcugauuuugaagcuacagaagggagccaggaaaaggaaacauucuucccuagagccuccagaaagcaacacagcccugccaacaccuugauuuuggcccaggaagacccauguugaauuucugacccacagaacaguagaauaauacauucacauuguuuaaagccacuaguuuugugguaauuuguuacagcggcaacagaaaacauauauuuaagaaauuagcucuuuaugcucaggcugguggugccauugucaacaguaaugacacuauauaaauauacaugaggcuaagcuacucacagcuagcugaggcaaaacagggauaggcugcuuugugggaaguggagugggcaggugcaaaugaagguuaaguuuuucuuuucugaccuucccacagccuagccacacaagaagacaggauuccuccauucauucaggauagaaaaccaagguuagagguaagggggaaaaugaaacaugacguauggucccugauaucucuugguugagaacuauuacaaaaacugucaccucuaucauauccuguagaggagaaucuaguauagaaccuaguauagaacaaucuugcucuccucuuuuccucccacaagccagaggacaugaauuuucuccccuuccuacuaacuuugaaacaagcugucaaagaaacaaaggaagucauaugcuaccaaggcaccuauauuccuuaacucucuccucuggcuuaguuagcuucacacuauauuccuugucugaauuccucgacuuuguauauuagaugaaaaauauacauaacagguaauuaaaugcaugcaauaaaacuaaauuauaaaagcuuauaaaucugaauguuuuauuaauaguuuaauuuuuaauaucuuaaaugccuaucugcugaggugauacaaaggauauaaaauaguaguguugugguuaagguaacuguaaacauuaccuuagaguacuauaaugucauugcuaauacagcaccgguuacuaacuugcacguuacucaacaucugugucaguuucucugucuguauccgcccuaccaacaucagaagucugcagaguuguaagguauuauccaauaauauacauagaauacucuucagagcucuaauaauauuaucacauuaccaugacacugucauauaauuaacacaaauguaggagauauuuuaaaauaauguaguaauaucaguucuucacuaaaaagauacugcauuuuaacacagaugcuaaaaucagauaaaccaauuacucuccaaagauuugguuauuaguuuuuuagcauaucaaaccaccuaagaauacuuuucaauaaaaucuuaagaacuuguacuaacuguagauuuauaaaaguauuaagggucauuaacuauaauuuuaaaagauaaaauacaauaacuuaccuauuauuaccacaggaaaagucacugacgaaucuuccaguaaagaaguuucuucaacuaauggcaucgcuuuaacuuuucgccccaaguugucaccaaaguauugcacuaaggaauuaaaaaucucuccuucaguuucagugucacuauaguuucuuuaaaaaaaaaaaagggggaauaaaaagagauauagucaauauagccuuuauaaaaaucaaucucuacuccgaguuuauuuagacauaaaauauuuuaaucauuccauaaaagaagcaaagaaaauccuucugauuaaugcuuucaaauuaguagcuucgcuacaugucaaccuauaccaacuugaaggccaaauauccccaauauuaauaguugcuuuucucucacaaguaucuucuaggcaagucucuaauaagcaguucucucaugaucaaagacagcaugguguugaggaguucauaauucucugaaacuagccuagaaauggcuagugucuccuccauaccuuucuuuuuaaaaggugagugcacuaaaauacaauauauagucauacacauuuuaagaaaaaguuacgguauuuauauauuauaaauugugcauuuuuguauaagaaauuagguuuauacauuuuuauucaaaaaauauacuacauauacauuauauauauauauauguauauauauauauuuuuuuuuuuuuuuuuuuuuuuuuuuggaaacaaggucuugcucugucacccaggcuggaguauaauggcgcaagcauggcucacugcagccuccaccucccgggcucaugucauccucuugcuucagccuccagaguagccagggcuacaggugugccaccacacuuggcuaauuuaaaaaauauuuuuugguagagauaggaucucgcuauguuacccagacuucaaaaauauauuaaaauaauuucuuaauguuauuuuccaauuuuucuuucucaauuggcucucuagaaauuaguuuuagcauucucacauuuucaugcaauacauggaguaucuccugcacacagguaauguucugcauuauacaacagauuacuuuagaauagaaucccuuaauuaauuuuaucuucauacagucaguaacagccacaaugucuggaaguauuaaauuaaguaucuacuaguggguaaguguguuuauuacuacucucagaugauaaauaagcaugggauagaucaguuauuucacaagauugaacucacugaucccagaggagguugauaaacagaaaagaaucaggcagagacaggcauuucuacuucccuauaaccuucagaguucccagucuacccuaggauaggcgagacuuccucaggacauacugagagcuuucuugaagcaaagaaaguaaccuguaccccaaauauuugguuuccccuuacauagccucuuuugaccaaaacagacaccaaucagacauggcuacuaagggaaaccccuccucacagugcaagccuacccuugggaggaaguuuuauaugcucaauccaucuauuucugacucauuccaacuacugccucugaucagauccagaugccucagcugucuugcccaugcccgcuucuaccucuuggcaacugcauuuaacauguuuuauauucugcucugucccugguauuucuccaaaguaugugcaaagguuagguucuccuguaccuuuggaggcuucugaucaaagucauuuugaucagaaaccuccaaaccacugcucaaagaaaucagagaugacacacacaaaccacugcucaaugaaaucagaggcgacgggaaugggaaaacauuccauauucauguguaggaagaaucaguaucauuaaaauggcuaugcaaauucauacaaacugcccaaagcaauuuauagauacaaugcuauucccauuaaacucccgaugacauucuucaaagaacuagaaaaaacuauuuuaaaauucauaugaaaccaaaaaagagccuaaauagccaaggcaauccuaagugaaaagaacaaagcgggaagcaucaccucaccugacuucagacuauucuacagggcuacaguaaccaaaacagcaugguacugguacaaaaacagacacauagaccaauggaagagaaaacccacaaauaagaccacacaccugcaacuaucugaucuuugacaaaccugacaaaaauaagcaauggggaaaggauucccuauucaauaaauagugcugggauaacuaguuagccauaugcagaagaucuaaacuggauaccuuccuuauaccacauacaaaaaguaacucuagauggauuaaagacucaaauauaaaaccccaaacuauauaaacccuggaagacaaccuaggcaauaccauucaggacacaggcacaagcagaguuugaugaggaagacgccaaaggcaauugcaacaaaagcaaaaaaaaauugacaaaugguaucuaauuaaacuaacgagcuucugcacagcaaaagaaacuaucaacagaguaaacagacaaccaacagaaugggagaaaauuuuugcaaacuaugcauccaacaaaggucuaauauccagcaucuaugaggaacuuaaauuuacaagaaaaaacaaccccacagaaaagugggcaaaggacaugaacagacacuucucaaaagaagacauacaggcagccaacaaucauaugaaaaaaaguucaacaucacucauuagagaaacgcaaaucaaaaccacaaugaggcaccaucuaacaccagucaaaauggcuauuaaaaagucaaaaaauaacaaaugcugacaagguuauggagaaaagggaaugcuuauauguuggggggaguguauuaguucagccauuguggaauaguguggugauuccucaaagaccuaaagauagaaauaccauuccacccagcaaucccauuacuggguauauacccaaaggaauaaaaauaauucuauuauacagacaaaugcacguguacauucacugcagcacuauucacaauggcaaaggcauggaaucaaccuaaacacccaucaaugauagacuggauaaagaaaacaugguacauaugcaccauagaauacuauacagccacaaaaaagaaugagaucagguccuuugcagggacauagauggagcuggaggcccuuauccuuagcaaacuaacacaggaacagaaaaccaaagaccacauguugucacuuauaagggggagcuaaaugaggagaacacauggacacacagaggggaacaacacacacuggggcccacccgaggaugaagggugggaggagggagaggaucaagaaaaacaacuaaugcaaguuuguucaacccacaugcggcccaggauggcuuugaauguggcucaacacaaauucguagacuuucuuaaaacauuaugagauuuucuugccauuuuuuuaagcucaucagcuaucaucaaugugaguguauuuuauguguggcccaagacaauucuuccaaugugguccagggaagcaaaaagaguggacaccccugaacuaauggguacuaggcuuaauaccugcgugaugaaacaaacucccaugacacauguuuaccuauguaagaaaccugaacuugcaucccuguacuuaaaagaaaaaacagaauauuaaguuuuucaauccaugaauauagaauuccuuuccauuuauuuagaccuuuaauuucucucaacauuuuguaguuuucagugcauaaguauugcauuuauuaaauuuauucuuauguauuucauuuuuugaugcuauuauauaaaugaaauaccuuuguuaauuucauuuuaaauuauucaguguuaauguacagaaauacaauucacuuuuguauguugauuuugcauccugcaacaccguugaauuuauauauuaggucuaguaguuuuuugcaugugcagcccucaagcaaugaagaaccaaaguuuaguuuauccaaauucucuacacauuagcuuaucuaaauuuacauaguauagguaaucugcucugauuuuucaggagccacugguauaaacucugugauaaacuauuuguaguaaaccugccuccuauuugauagugguuuaacacaaagaaaaacaaggaaacaaaaacggaaagugugauucacugguuuuacauaaaacauuaaugaaacaagacuuuuaguaauuauucuuucuaaaaaauucagagcuuaaguuauaaauuuaguauugcuguacauguuuuauaguacaugcacaguauaucacaggucuaugaacaguguuaaucucuagauuuccaauuugauauuuguucuauuuaaaacaagagcuuauuuugaguaauaaaaaucuacuuuuucuucgaggcacaaauuaaaauuggaaaauauguacaauuacauuuagcaacuaguaaagaacagcacuuuacaugcaaaauuaguuacucuauuguuaggaagcaaguuaaaagccuauuugacauuuaagaugcuuuuagaggccuuccauuuuuuguuuuugaaacauuacagcacaaaguuucagagaacauuucaaaggauaguguggacauaguaucaggauaacaaaaagacuuuuuccauaccauagcaguacuuguuuaaaugaucauucaaacuaaaaugaaaugcuuuacuaacugaauuuuuauagucuuuggaaccaugaaccuaaaauuuaccaaauuuauacuaccacauggaaagaagguucuaaagccacaaaugaagucagucacacucuucaucuuccagaacacgaaggaagagguuuuuuccuuuggaaaguuaguggacaguucucucacuacuuauccauucagauguuagacaauagaugucacaaccuguuuuauaaucuguguuuuuuuguguguuuuuuguuuuuuugagacagucucacucugucgcccagcuggaaugcaguggugcgaucucaggucacugcaacgugucuccuggguucaagcuauucuccugccucaaccucccgaguagcugggauuacaggugcacaccacccugcccggcuaauuuuugaguuuuuaguagagacgggguuucaccauguuggccaggaugaccugaacugaccugaaacugcucgagaaauagcacugguaaaucagaaacauauuccugaaggagcugguaaacaacuaaaaaaaaaaauacuuuagacacaacagaacuguuuuugcaauaaaaagugugguuuauuaaucauaauguuuaucuuuggcagcuagcuuguuuuucuuucugucccuccagaccaaaacauagcaaauacuuuguuuucacucccuacuccaaauuucugugcacggcaggaagcaaaugguauucaacacccaguauuagucaaaagaauaugaauccuacacugugcaucaaaaggugucaaauagcuuucacacaauauuuucugaaaggcauguuagauucucaugggcuuuauuuaguuuaacaaguuucacuaggggaaccuauuuccuaaaaguuuccauagugaaucugauaccuucaaaccgcugucucaguagucaacaaauuugccuaaaaguuaaaaucaagcaguuuauuauaugaaacaauuuuuccuuaauauccacaaccuagagacucauucuaaacucacugagagguuagacaagcuuggauuaucgcuguuacaaaagaaguuccaaacuuucucuaugccuuacaucucuuuuacuauaggaugacgcuucuuaaccucuucucugaauacuguucuuaaauauacacaggauuuacaagaaaacuaauucuauuaaaacagucauaaaaaguaaacgcgauauauauaugugcuucucuguugcauucaauaaauucagugauguguuacuauaauuuugaauaaguauaaacaguauuucuauauuaacugcaaugugauauaaacauauuuuaugaucucuacugaugacagucacagauacuacugugauuuguugcuuauauuuuaacugaauauuaguuuuuaaaauuuagugaaaugauauaccuuucuuuccauccaaguucauggguuaccuaaauuguaugaaacccacuauuuaggaaggcuugaucaaaauuucauauuuuaccagggaagaagucuuacauagaauuauucuggaacaucaguauauguaaagcaagguacuaaaguauucccuaugcuuaaccauucuucaccccaggguuaaaaucaguuucuagugucuggucuuuccaccaaugacugagguguugaccaaaugugcuagaucuagaaaacauacuuuuauuuuagaaauguauuauauuuuaucaccccuaaaaccuuuccccauaaggugauuguaaaaccgccucauucuuuaaauuucuacaacacacacgucuuaccauggcuaacaucuuaacaaggcagaaucuauuugugauuagaugacacugaaauguaguucccuaccuuccuuccacucauuacauuauuuagaagacuuuuuaagaaauaauuuuuuuuuagggaggcaggcacuucguagaacccccuucacuaaaacuuugcacuacugggaagucucagcucgccguaaccgacucaguccggccuagccgaucccgcagucccgugacccgcgcgguccagagcgagaaaagggaacagcgcagggcuccccggagcaaggaccccaccacaccgcaccccaccccacccccacgccaggcaggacggccgaggcgggaggacgcugcgguccaggcgcucgcccuccaccccggucccggcccgggccaggccaaaaagcucgagagcgcggcauccccgccugcuccccucccauccccggcgaggaagucaccugaaaugaccggccagggagcagcggcagcaccacacgggcauggagcgcugcgcgaggggcgcccgagcgcggccgccguggccgccuccgccucccccggcgaggcugcccgcucggggcgcccgcuggcucggggucgcggggucugccgggcgccccugccucgcgccucgccguugccgcggcugccccggcucuguggcgccggaguccgccuccagauagcggcuuccgcuccucgccugcagggagccaggcgccggaggcgggugaucucggggcgccgcgauaggggcggagc

SEQ ID NO: 191349 - RNA, 25334 nt, Homo sapiens
gcuccgccccuaucgcggcgccccgagaucacccgccuccggcgccuggcucccugcaggcgaggagcggaagccgcuaucuggaggcggacuccggcgccacagagccggggcagccgcggcaacggcgaggcgcgaggcaggggcgcccggcagaccccgcgaccccgagccagcgggcgccccgagcgggcagccucgccgggggaggcggaggcggccacggcggccgcgcucgggcgccccucgcgcagcgcuccaugcccguguggugcugccgcugcucccuggccggucauuucaggugacuuccucgccggggaugggaggggagcaggcggggaugccgcgcucucgagcuuuuuggccuggcccgggccgggaccgggguggagggcgagcgccuggaccgcagcguccucccgccucggccguccugccuggcgugggggugggguggggugcgguguggugggguccuugcuccggggagcccugcgcuguucccuuuucucgcucuggaccgcgcgggucacgggacugcgggaucggcuaggccggacugagucgguuacggcgagcugagacuucccaguagugcaaaguuuuagugaaggggguucuacgaagugccugccucccuaaaaaaaaauuauuucuuaaaaagucuucuaaauaauguaaugaguggaaggaagguagggaacuacauuucagugucaucuaaucacaaauagauucugccuuguuaagauguuagccaugguaagacguguguguuguagaaauuuaaagaaugaggcgguuuuacaaucaccuuauggggaaagguuuuaggggugauaaaauauaauacauuucuaaaauaaaaguauguuuucuagaucuagcacauuuggucaacaccucagucauugguggaaagaccagacacuagaaacugauuuuaacccuggggugaagaaugguuaagcauagggaauacuuuaguaccuugcuuuacauauacugauguuccagaauaauucuauguaagacuucuucccugguaaaauaugaaauuuugaucaagccuuccuaaauaguggguuucauacaauuuagguaacccaugaacuuggauggaaagaaagguauaucauuucacuaaauuuuaaaaacuaauauucaguuaaaauauaagcaacaaaucacaguaguaucugugacugucaucaguagagaucauaaaauauguuuauaucacauugcaguuaauauagaaauacuguuuauacuuauucaaaauuauaguaacacaucacugaauuuauugaaugcaacagagaagcacauauauauaucgcguuuacuuuuuaugacuguuuuaauagaauuaguuuucuuguaaauccuguguauauuuaagaacaguauucagagaagagguuaagaagcgucauccuauaguaaaagagauguaaggcauagagaaaguuuggaacuucuuuuguaacagcgauaauccaagcuugucuaaccucucagugaguuuagaaugagucucuagguuguggauauuaaggaaaaauuguuucauauaauaaacugcuugauuuuaacuuuuaggcaaauuuguugacuacugagacagcgguuugaagguaucagauucacuauggaaacuuuuaggaaauagguuccccuagugaaacuuguuaaacuaaauaaagcccaugagaaucuaacaugccuuucagaaaauauugugugaaagcuauuugacaccuuuugaugcacaguguaggauucauauucuuuugacuaauacuggguguugaauaccauuugcuuccugccgugcacagaaauuuggaguagggagugaaaacaaaguauuugcuauguuuuggucuggagggacagaaagaaaaacaagcuagcugccaaagauaaacauuaugauuaauaaaccacacuuuuuauugcaaaaacaguucuguugugucuaaaguauuuuuuuuuuuaguuguuuaccagcuccuucaggaauauguuucugauuuaccagugcuauuucucgagcaguuucaggucaguucaggucauccuggccaacauggugaaaccccgucucuacuaaaaacucaaaaauuagccgggcaggguggugugcaccuguaaucccagcuacucgggagguugaggcaggagaauagcuugaacccaggagacacguugcagugaccugagaucgcaccacugcauuccagcugggcgacagagugagacugucucaaaaaaacaaaaaacacacaaaaaaacacagauuauaaaacagguugugacaucuauugucuaacaucugaauggauaaguagugagagaacuguccacuaacuuuccaaaggaaaaaaccucuuccuucguguucuggaagaugaagagugugacugacuucauuuguggcuuuagaaccuucuuuccaugugguaguauaaauuugguaaauuuuagguucaugguuccaaagacuauaaaaauucaguuaguaaagcauuucauuuuaguuugaaugaucauuuaaacaaguacugcuaugguauggaaaaagucuuuuuguuauccugauacuauguccacacuauccuuugaaauguucucugaaacuuugugcuguaauguuucaaaaacaaaaaauggaaggccucuaaaagcaucuuaaaugucaaauaggcuuuuaacuugcuuccuaacaauagaguaacuaauuuugcauguaaagugcuguucuuuacuaguugcuaaauguaauuguacauauuuuccaauuuuaauuugugccucgaagaaaaaguagauuuuuauuacucaaaauaagcucuuguuuuaaauagaacaaauaucaaauuggaaaucuagagauuaacacuguucauagaccugugauauacugugcauguacuauaaaacauguacagcaauacuaaauuuauaacuuaagcucugaauuuuuuagaaagaauaauuacuaaaagucuuguuucauuaauguuuuauguaaaaccagugaaucacacuuuccguuuuuguuuccuuguuuuucuuuguguuaaaccacuaucaaauaggaggcagguuuacuacaaauaguuuaucacagaguuuauaccaguggcuccugaaaaaucagagcagauuaccuauacuauguaaauuuagauaagcuaauguguagagaauuuggauaaacuaaacuuugguucuucauugcuugagggcugcacaugcaaaaaacuacuagaccuaauauauaaauucaacgguguugcaggaugcaaaaucaacauacaaaagugaauuguauuucuguacauuaacacugaauaauuuaaaaugaaauuaacaaagguauuucauuuauauaauagcaucaaaaaaugaaauacauaagaauaaauuuaauaaaugcaauacuuaugcacugaaaacuacaaaauguugagagaaauuaaaggucuaaauaaauggaaaggaauucuauauucauggauugaaaaacuuaauauucuguuuuuucuuuuaaguacagggaugcaaguucagguuucuuacauagguaaacaugugucaugggaguuuguuucaucacgcagguauuaagccuaguacccauuaguucagggguguccacucuuuuugcuucccuggaccacauuggaagaauugucuugggccacacauaaaauacacucacauugaugauagcugaugagcuuaaaaaaauggcaagaaaaucucauaauguuuuaagaaagucuacgaauuuguguugagccacauucaaagccauccugggccgcauguggguugaacaaacuugcauuaguuguuuuucuugauccucucccuccucccacccuucauccucgggugggccccaguguguguuguuccccucuguguguccauguguucuccucauuuagcucccccuuauaagugacaacauguggucuuugguuuucuguuccuguguuaguuugcuaaggauaagggccuccagcuccaucuaugucccugcaaaggaccugaucucauucuuuuuuguggcuguauaguauucuauggugcauauguaccauguuuucuuuauccagucuaucauugauggguguuuagguugauuccaugccuuugccauugugaauagugcugcagugaauguacacgugcauuugucuguauaauagaauuauuuuuauuccuuuggguauauacccaguaaugggauugcuggguggaaugguauuucuaucuuuaggucuuugaggaaucaccacacuauuccacaauggcugaacuaauacacuccccccaacauauaagcauucccuuuucuccauaaccuugucagcauuuguuauuuuuugacuuuuuaauagccauuuugacugguguuagauggugccucauugugguuuugauuugcguuucucuaaugagugauguugaacuuuuuuucauaugauuguuggcugccuguaugucuucuuuugagaagugucuguucauguccuuugcccacuuuucugugggguuguuuuuucuuguaaauuuaaguuccucauagaugcuggauauuagaccuuuguuggaugcauaguuugcaaaaauuuucucccauucuguugguugucuguuuacucuguugauaguuucuuuugcugugcagaagcucguuaguuuaauuagauaccauuugucaauuuuuuuuugcuuuuguugcaauugccuuuggcgucuuccucaucaaacucugcuugugccuguguccugaaugguauugccuagguugucuuccaggguuuauauaguuugggguuuuauauuugagucuuuaauccaucuagaguuacuuuuuguaugugguauaaggaagguauccaguuuagaucuucugcauauggcuaacuaguuaucccagcacuauuuauugaauagggaauccuuuccccauugcuuauuuuugucagguuugucaaagaucagauaguugcagguguguggucuuauuuguggguuuucucuuccauuggucuaugugucuguuuuuguaccaguaccaugcuguuuugguuacuguagcccuguagaauagucugaagucaggugaggugaugcuucccgcuuuguucuuuucacuuaggauugccuuggcuauuuaggcucuuuuuugguuucauaugaauuuuaaaauaguuuuuucuaguucuuugaagaaugucaucgggaguuuaaugggaauagcauuguaucuauaaauugcuuugggcaguuuguaugaauuugcauagccauuuuaaugauacugauucuuccuacacaugaauauggaauguuuucccauucccgucgccucugauuucauugagcagugguuugugugugucaucucugauuucuuugagcagugguuuggagguuucugaucaaaaugacuuugaucagaagccuccaaagguacaggagaaccuaaccuuugcacauacuuuggagaaauaccagggacagagcagaauauaaaacauguuaaaugcaguugccaagagguagaagcgggcaugggcaagacagcugaggcaucuggaucugaucagaggcaguaguuggaaugagucagaaauagauggauugagcauauaaaacuuccucccaaggguaggcuugcacugugaggagggguuucccuuaguagccaugucugauuggugucuguuuuggucaaaagaggcuauguaaggggaaaccaaauauuugggguacagguuacuuucuuugcuucaagaaagcucucaguauguccugaggaagucucgccuauccuaggguagacugggaacucugaagguuauagggaaguagaaaugccugucucugccugauucuuuucuguuuaucaaccuccucugggaucagugaguucaaucuugugaaauaacugaucuaucccaugcuuauuuaucaucugagaguaguaauaaacacacuuacccacuaguagauacuuaauuuaauacuuccagacauuguggcuguuacugacuguaugaagauaaaauuaauuaagggauucuauucuaaaguaaucuguuguauaaugcagaacauuaccugugugcaggagauacuccauguauugcaugaaaaugugagaaugcuaaaacuaauuucuagagagccaauugagaaagaaaaauuggaaaauaacauuaagaaauuauuuuaauauauuuuugaagucuggguaacauagcgagauccuaucucuaccaaaaaauauuuuuuaaauuagccaagugugguggcacaccuguagcccuggcuacucuggaggcugaagcaagaggaugacaugagcccgggagguggaggcugcagugagccaugcuugcgccauuauacuccagccugggugacagagcaagaccuuguuuccaaaaaaaaaaaaaaaaaaaaaaaaaaauauauauauauacauauauauauauauaauguauauguaguauauuuuuugaauaaaaauguauaaaccuaauuucuuauacaaaaaugcacaauuuauaauauauaaauaccguaacuuuuucuuaaaauguguaugacuauauauuguauuuuagugcacucaccuuuuaaaaagaaagguauggaggagacacuagccauuucuaggcuaguuucagagaauuaugaacuccucaacaccaugcugucuuugaucaugagagaacugcuuauuagagacuugccuagaagauacuugugagagaaaagcaacuauuaauauuggggauauuuggccuucaaguugguauagguugacauguagcgaagcuacuaauuugaaagcauuaaucagaaggauuuucuuugcuucuuuuauggaaugauuaaaauauuuuaugucuaaauaaacucggaguagagauugauuuuuauaaaggcuauauugacuauaucucuuuuuauucccccuuuuuuuuuuuuaaagaaacuauagugacacugaaacugaaggagagauuuuuaauuccuuagugcaauacuuuggugacaacuuggggcgaaaaguuaaagcgaugccauuaguugaagaaacuucuuuacuggaagauucgucagugacuuuuccugugguaauaauagguaaguuauuguauuuuaucuuuuaaaauuauaguuaaugacccuuaauacuuuuauaaaucuacaguuaguacaaguucuuaagauuuuauugaaaaguauucuuaggugguuugauaugcuaaaaaacuaauaaccaaaucuuuggagaguaauugguuuaucugauuuuagcaucuguguuaaaaugcaguaucuuuuuagugaagaacugauauuacuacauuauuuuaaaauaucuccuacauuuguguuaauuauaugacagugucaugguaaugugauaauauuauuagagcucugaagaguauucuauguauauuauuggauaauaccuuacaacucugcagacuucugauguugguagggcggauacagacagagaaacugacacagauguugaguaacgugcaaguuaguaaccggugcuguauuagcaaugacauuauaguacucuaagguaauguuuacaguuaccuuaaccacaacacuacuauuuuauauccuuuguaucaccucagcagauaggcauuuaagauauuaaaaauuaaacuauuaauaaaacauucagauuuauaagcuuuuauaauuuaguuuuauugcaugcauuuaauuaccuguuauguauauuuuucaucuaauauacaaagucgaggaauucagacaaggaauauagugugaagcuaacuaagccagaggagagaguuaaggaauauaggugccuugguagcauaugacuuccuuuguuucuuugacagcuuguuucaaaguuaguaggaaggggagaaaauucauguccucuggcuugugggaggaaaagaggagagcaagauuguucuauacuagguucuauacuagauucuccucuacaggauaugauagaggugacaguuuuuguaauaguucucaaccaagagauaucagggaccauacgucauguuucauuuucccccuuaccucuaaccuugguuuucuauccugaaugaauggaggaauccugucuucuuguguggcuaggcugugggaaggucagaaaagaaaaacuuaaccuucauuugcaccugcccacuccacuucccacaaagcagccuaucccuguuuugccucagcuagcugugaguagcuuagccucauguauauuuauauagugucauuacuguugacaauggcaccaccagccugagcauaaagagcuaauuucuuaaauauauguuuucuguugccgcuguaacaaauuaccacaaaacuaguggcuuuaaacaaugugaauguauuauucuacuguucugugggucagaaauucaacaugggucuuccugggccaaaaucaagguguuggcagggcuguguugcuuucuggaggcucuagggaagaauguuuccuuuuccuggcucccuucuguagcuucaaaaucagcaauguuguuucuuaaccuucuuucauugucaugucucccuuucaccacaacugggaaaaguucucuauuuuuaaggacucuugugauuagauugggucuaccuggguaaucuagacuacucuccaucucaggauccuuaaucauaucuacagaguccuuuugcucuguaguaacauuuacagguucuaggggauaggacugggacaucucugggcacaguggaucacgccuguuaucccagaacuuugggaggcugaggugggcuggaucaucugagcacaggaguucgagaccagccuggccaacauggugaaaccccgucucuacuaaaaauacaaaaauuagccgggcaugguggcgggcaacuguaauccuagcuacuugggaggcugaggcaggaggaucgccugaacccaggagguggagguugcagugagccgcgauugcgccauuguacuccagcuugggcgacaagugaaacucugucuaaaaaaaaaaaaaaaaagaaaagagggccaggccugguagcucacaccuguaaucccagcacuuugagaggcugaggcgggcauauaacaaggucaggagaucgagaccauccuggcuaacagggugaaaccuugucucuacuaaaaauacaaaaaauuagccaggcaugguggcgagugccuguagucagucccagcuucucgggaggcugaggcaggagaauggugugaacccgugaggcagagguugcaaugagccgagaucgcaccacuguacuccagcuugggcgacagagcgagacuccgucucaaaaaaaaaaaagauauaaaauuaguucuaaauauuuuuuauuuuucuuucagucuuuaaggcuuccuauucuagaauuauaaguugaaaucuuucucugcuuucucuguuucuaguauucuuaugguuuuacuuuucuuauaucuuugaguauauuuuauuugggguaacauauuagguaaggaacaggauuuuuucuuugcagcuagcaauucucuagguuggauuaaauuuuugaaaggcagauauaauaagugguaauccagaauaaaggaauuauuaauucauaaauggaaguaguucaggaaauccaguuugguuuuaguuaaagcauauaaacauauaggaaagcaauaucaggauuuaggacuggaaagaugguugagauguauaaucaccuggcaguuucuugccugcugcacagacaaaaccauuucacugagaccauggcguugcaguaaagaaguugacacaaggccagcccaugugagagaacugcaguuguucaaauuagucuccugauaaaacuccugauugguugggcgugauggcucauacuuguaaucccagcacuuggggaggcugugguggguggaucaagagaucaagacuguccuggccaacacgcugaaaccccgucucuacuaaaaauacaaaaauaagcuggguguggugucguguaccucuaguccuagcuacuugggaggcugaggcaggagaaucgcuugaacccaggaggcagagguugcagugagccgagaucaugccacugcacuccagccuggugacacagcgagacucugucugaaaaaaaaaaacacaacgaaaaaaacaaaacuccugaucccuccugauggcuuggagguuaggguuuuucaaggauaguugggugaacaggggacuagggaauaggugcugcugauugguuggggaugccaugcuggggguaucaaaaaugguucucuagcacugaguccaacucuggguggggggccgcaggacugguucaguugagucuugggucugagucuugaaucuugggaccaauagagucagacagucaucagaaaugcaaaagucugaaaagacauuucaaaaggccaaccucaggauccacaguagcgauguuaucuguaagagcaauuagggaagucacacaucaugugaccucuggcugcgugacucuucagcaguaaaggauuauagaaacucugccuacaucuuagcagaauuccggcaccucucauaauccgaaccuuguggccuuucauuaguuuuagaaaggcgguuuaauuuugggaaggacuguuaccauccuugcuuuaagguuaaacuauaaauuccuuccaugauuagcuuugccuauacccaggagugagggaagacagccggccuuugaagcuagaagcaagauggagucagccauguuagauuucucucacugucauaaucuuugcaaaaguuguuucaaauggagaacacuggauagucagaaacaaacaaugaagaccuuuagaacagaaggcuaacaugaugaggauuauguuaccaaaacuuaugugaauguaguaugugaaaugauugggagugggugaaucucagggcagagaaacaguaggagacuugucuuuuaggugaaguacaggaaugagaauagcaaagacaacugacaagauauagggggcaaacuagguuuagaaccagaaacugauuaacuuagaaguuugcuaguaccauacuuugagauaggauaggguuugaaggagagggcaccucaaugaagggacucaugagcuugcuuuugagcacauuacauuaaaguuauuagugggccauucuaucagguagaaucaagaaguggaauggaaaugugggauauauccuugggaaauaggucaauuuagagaacuaauuuuggaugucaguagccuagagaguugaagccuugaguagaugagauucccaaaagaaaauaggagagaaggcagagguuaaaaucucaugaaacaucugguuuuaagagauuagaaaaggaagaacuggucagagaaaagagccaucuucaaaguaggacaaaagccaaggaacaagaguauuaagaugcaugaccuaccccuuuccaccuuuuauuuuuaauaggaaauggacccucaggaauaugccuuucuuauauguuaucaggcuacagaccguauuuaucaucagaagcaauacacccaaauacaaucuuaaauaguaaauuagaagaagcaagacaucuuuccauuguugaucagguauuauuucuuacaugucaauuuaaaaaauuuuuuuaugcugaaacaagauuaguuuuuauuuauaugaacuuucuuaguugaaaccccuuauucuaaauaacaccuuauaucauuuuuauuuuagauucguaaauguauucugaguuacuucuguuuauuuucuugaauuuauuagagcagaguuuucugaauuauuuucuaauggagauuuaguaggugcucuguggucaaguuggggguacugcuuuuuaucauuggagcaucaugguaagcauuagaauauacuaucugggaaaugcuggcuuuuuucaaacucugucucccuuuuguucauucaggacuuagaauacuugucugagggccuugagggccgaucauccaauccaguugcaguacuuuucgauacacuucuucauccagaugcugacuuuggguaugauuauccauccguuuugcauuggaaauuagagcaacaucauuauaucccucacguaguucuugguaaagguccaccugguggggcuuggcaugugaguauauuuuucuuagcauuuuaguguaugugaauuauuugucuugauaagaccaacuuuauucuuaagcauuaugauaauguuauaugugauguuuaucacauuuuuauuugagaagaacuuuaaugcuguucaguuaguuaaauauggguuuauuacaaguagcaguaaaucaagccaaauuuuauuacugguacagucuuagaauaagcaugucucuauacuaucuuacaagaauuauguagaaaacauuucaagaauguuuuguauaauaaaaauuuaaaacucaauucauuuuagacuuuacauaaucucacauaguauuucaaagcaguauccauuauuuucuuacauuuucagaaucuuaaaugaaaaauguaaaagagguuguguuagucugcuugucugcgauaacaaaaugccauagaauugauggcuuaaacaacauauuuauuucucacaguucuggaggcuggaagucccaagaugaagguuccagccaguucaguuccugguaaaggcccucuuccuagcuuucagauagcugccuucucaauguguccucacauagcagagagagagaaauauucucuucuuaugaagccaguaaucccauucugagggaccuacccucaugaccucaucuagcucuacuuaccucccaaaggccccaucuccaaaagcaucacauugggggucaggaccucaacguaagaauuuugaggguagauacaauucgguucauagcagagguuaaaccagagaaccagugaauuaaggauucacucagugcauuucauuagggggccaguaaguaauaauuguucauccuuccuguguucuuagcaguuaacacugugucuaguguguagugaguguucauuuguuauacaaauugauguuaaguaauuuaguuugcuguguuaugaauuacagacuucaugggaacuuuaacauauuacauaccaaauuuuuaguacaaacuucgguuggcuguucguguauuagugcaguuuugcacaucugaaaaguuguuuacguuuauaaaaugacuguuucaggguaucgggacauuccuagauuaaauacgucauggguuucuuuuaaaaucuuuauucucuuuuuaauaaugaguagcaacuaccaaauuauuuguugcuuuuagcuuaaguuuuaugauuuuuacuuuuucauaucaacuuuaagcuuuauuuacaauaagcugcauccauuuagaguguauaauuugacaaaugccuguaacugugaaaccaccaauacaagauaagaaagaauucuaucaugcccaaaacuuaaguguuuauauuuucucuguuaauuaguagcauucuuaauuuuaaaaaaagccauaauguauuuggaaguggggagggcauuuagacugccuucucugaauuccugagguuuuauuuuacuuacauuuuuuccgcuuagaagaaugaugaguugugcaggcgauaauugaucuguuucauuucuuucacuuauguauaaaaaaguuagaaaguauggauaaacccugauuacuaaaaacacauuuugagccagugauaaagguuaaaauauaccuaaaaguugcugauuuuuuucaggcauguauucacuaaaauagggcuguaaguaauauuucagcuguguaccaguugccagucaucaccucugugaagguuccuaauguucccagacauaauuacuugauccuaccugcauuccauaucuuaaucuuacugugcuugccugugguacuauuuaucuguuuaugcgaccaucuccccugcuaugguuuauguacauccuaauuaaccugaguugugacuuaagacguaaacuccuugagucaucaccccucucuccuacuuagcuucauauaguucucuguuucucuugugaucuaguuucucaucacucuucucucuuccaaacuuucuguggccccuugaaccaauuuugugauaaacaacuuguuugcuuucccacaucuuuaaccauucugucagaugcugcuucugcucccuuucuugaaagcuuacucuuuccuaaagauaccauucccacuguagcccucugaaguggagccuauucauucucccauagcccuaugucccaucagguuggcuaguaagguuggucuucucuucacaccccuaugcacuuguguaaaaagcccuguuccauugaacagaugaugccauuuucuagcuuuucuaccauuccagacugucuccagacugucuccauuucuggcuuuuuuaccauuccagacugucuccaguuacugaaucuguggcaccuaauucaugggucuuccauuauaucccaaguuuuguuaccaccuugaauaauuuuaccucuacaaacaugacacagaaccaagaucuuaaccuuuuuguuccuuggucuccucauucuugaugaugauguauucuucauuagcuacucacuccaguggcuccacuguagaucuuaucugucauaacuacucaacuuguaaaaaccuaaauucucaaaugucuuccuuucugaucacaguuuccuguucuucaagcuuaucacccaguuaauucacacuauagauaaucuuugaacacagagcgugcuccaggcugugaucuucauauccuuacuuacccagcccagcuucuguaguccauggaguuaacuauucucuuuaauucccuuaacccauuguccuucugucacauagguuugucauacaggcaauucaucuaacuauccacuuuaucuuuucuuacacuugagcagucagacccccagaaaaaaaauuauacaacugugaaaauauucuccacucucaguuggggccaaaacacuacuauaaccuuugauauuuccuuauuaacuucuuuucaaaccuuuaucucuuuuuuuucuuucaugcuuagaaguggucuugguucuuauuuuacagauaaaauguaauccauuaggauugaacuuccacaauuucacacucaaaccgaaaacuuacacauugaugcaaauucuuuuuuuuuaauccccuguuauaauggaagagauauuacuacuaaggcucaccuuccagccacauucuggaucccugucuucccaagaacauuauuuauuugauuuuccccauuucuuuuauaucuucaauuucucugccagcuucuauuggucgguauguaaacaugcugaaauuauuuccaucuuuaaaaaaauuuuaggugccagcugaucuuuauccuuugguuuauagcuaacuuccugaaagaguuaccuauacauacuucucccugccuuugcuuucugcuccuuagcuuacucacucuaccuucugccaccgguuuuccauuggaacuguuuuuucugaaagucgguaacuuucuuuuuugcuuaauuugaugacgagucucagaauuuaucuuuucugaucucugcagcuuuugacaguguucauaucuuucuuagguucucugaaucuucagucuccuuguuuuucuuccuguuuggucacuccuuuucugauaccuuuguggauucuugucuuuuuuguuguuguuguuuuugagagagggucucacucugucaugcaggguggagugcagugguacagucauagcucacugcagccucggaccccugagcucaaaugauccuccugccuuagccucccagugcugggauugcaggugugugccaccacacccagcugacucuuguucuuuaaaaauugcuucuguagaccuuaucccaagcccaggucuuuucuucauacucuucauucucccuggguuaucuuaccuacuucaauggcuugcauauugauauuaauugauucccaaaucagaauucccaaaaucaaaaccagcccagauugcuguuucucauauacccaaguaaauacauucccuugauuauucugcagguguccucagacucaacguaccuaaaacuaacuaucuuuaucaucaagucccuucaauuuccuugucauuaaauggcauucucauguaguuacucaagccaggaaccugagagucuuccuugauuucucuuucuucaacucccauuucaaauuaaucaccaaaucuuuuucauuuaugauauuuuggguccaucuacucuauuuuguugcuaauauuggucaccgcugucuuucaccagaauuacugcaaacccuuucuaaaugguuuucuuacucauugucucuucuccaauccauuauccauaccaaagccagacucaucuuucuaaauuacaugucugagauguuacaccaaugcauaaaacucuucaguugcucuccaucuaacauauaguauguagacuucguaauguaucucaccauacuccaaucuagcccuuauuagguuucuugucauauuccucuuuuuaucucugacauucugugcucuagcaugcuuuuguuggggaguccaaguucauucucagucucgaagauucaauaggauucacaggacucaguaaagaugguguacuugugguuaaauuuuacuauagugaaaggauacagauuagaaucagcaaugggaaaagguucacagggcaaaguccaggagaaaccaaguguaagcuucuagauauccacuccuaguaaagucacuggugcguggugucgagggauguuuucuguggggucagucauauaggccagcagcucccaugugacucaccucugccucccagagcaaaaacugguauucacauaaaucacauuguuaggauaaacucucaugguuacacugguauagcauugccaaggccuuaggcaugcaaaacucaugcucaucagguagaguauucaggggcucagaaguuauuucuaagaagguggcagccaagccugguucugaagacaggcuuuuguugguaauguaaaagguuggaacaacgcaggccugcugaguuaauccuuucaggcacaaggcugaauuucuuuugacuccuugaaggacacucauauuugcucucuuuauuaagcugccacauggauuuuuauuuggcuuggaauauuuucccuuucuaaugguacacuccucugcccauuuguguccuugaagaaccagauacuuucuauaugcuccugcauacuucuauuuaguuugcauccuuuaauacuacaguguccauggcagcuuguauucauggcauauagguuacauggggaaaaaagaaagauaggagaaaaaugaagagaucaaggcauuagggcucucaaccaacuggaagaacuggugcagugggaauaauguuaaaaaauuguugucagaaagugaaauaguagugucuuaagguuuuagaguuacaggugaaacucucagguuccaaauaaucucugauagauaauacauucuuaacagcuccuuuuaugaugauuccagguucugaaccugguaucagggcuagccucccucaaagcagguggcagcuugcuacauucucuuucuugggugauuuguauauagucacaaaugagguuucacagggccuaguacauaguaaguacucugugaaagucaguuauaauaauaauaauaauaugccccauuuucaaacuggguguuauagaagcagggcaagaaauuaugagaaaaggagccacugccuaaaagaguugauugaaagagaucauagaggucauagguauaacagguacuuggccuuugggcuuuucuugcuuuguauugaacaaagcagaaauaaguaggucaagggagcuugauggcaagcaguagccucagcucguuuguuucucaggcauccacugccuauuucuguauccuuaagaagagaugcugcuguauccacaucagccuagauuuuagaauuauaauugauggaggagggaaaagcuucuuuguugcuaauuaaaagaaaguuaauaauauuaaaauggaaagccaucuaaaauuuuggaacuuaaugaacauuuuuccuuuuguucaaaaaaugaauauacugaauuuuuguuucccugacauaauauuguacaucugaauuauguugaucauagaccaaaguuaucaacauuguguaggcauuggauaauauuguaaauuuguuuuauaaauuuauaacuauaugaaagaagguugucgggauaauaucaagugaugaagguauaugaaaguuuauuggaguaauguuuuugagguaaguuagccaaccauuuaggacugcaggagcgcaccuuguccagagucauaauuauuguaaaugagauggauaugguuaaaaaacagaccaaaaaaaaccauguuacuucuuguuuuuugacgguacauuuuuuuuuuuaaacucuaauagaauauggaaggcuccauguugacaaucagcuuuggaaguuggauggaacuaccuggacuuaaauuuaaggacuggguaucaaguaaacgaagguaaagauugaacuguauuaaaauucuuugguguacguugaaaaagagaauguggaaaaauuucaaaauauuugugauuuugucauggcugaagaauauaaauguacgucuuucaaauaaaaauguguccuugaagcagugauuauaauaugcuaguuuucauuuagagauguuauaaaacuaagcacagagcuaagggauuauugcagauugguuuccugugacuuuuguuaaucauggguuuaucuacugucuuguuacaucacucucuguuuaguuacuuucucauccauccauauauuauuuuucauacuuuauuuuuaugcauugauauauaacuuuaucuaugcauaucucuuauaugaauaccuaaacucugcauaccuaaaguguuugacuuucaguauaaagauuguauauuuuaugauugauaauuuaaaaugauggauaagcuagaaucuggcuuaugguuggcuaauuggguaugaaggaacauauuuaauaaaaaaaaauaagaguagaacugagggccuggcgcaguggcucacgccuguaaucccagcauuuugggaagcugaggugggaggaucaccugaggucaggcguuugaggccagcuugaccaacauggugaaacccuguuuacuaaaaacacaaaauuagccaggcaugguggcgcaugccuguaaucccagcuacucgggaggcuaaggcaggagaauugcuugaacccgggaggcagagguugcagugagccgaaaucgcgccacuggacuccagccugggcaacagagcaagacucugucucaaaaaaaaaaggacggaagaaaucucaccuuggaaaacuauaaauuuauuuauuuuaaggggaaaucccaaaauuuaaaaagagaaauaugaaaauccugucaaucauuuucaaggauaguaaauauuagauaagaauuacuaauacagagaaucuacucuaauuugacuacucacaaaauaagaaguuacguaaccuuuguuagaacagggauguaacauuugaguacuucacuuccugcuacauaacaaccauguuaauucauagaaauuuuccuuaauaugaggaaauucagggagagcaaauuuacaucaucauggguaauugagauuaaaccuuuccaaaaauucauuuuagauuuuuaaaaagaauuauauauggguuugaaacuugaaguaaaauuaggcaaguuguacaguucuugaucuucguaacuuggcaagugaaauugcuuaacacauucuucacuuuguaaaaggguaagaaagagaaagcuuuaugauuuauguaccagaagcauuuacuuuucuaaauuaugcauauuguguugaaguaauaugugcaaaugaauuuugugauaaauuuagguuuaguugcugccuuuguauaaagagaagacucuuaggucucuagagauugguggaguuugaguuccgacuuaugacuucuaguguugugauccugaacaaauaaacuaguugucaauuuuccauucuguaaaauggagaugauaauacagccguguauugcuuaaugauggugauauguucugagaauugugucguuaggugauuucguugggcaaacaucauaaaguguacuuaacacaaaccuccgugguauagccuacuauacccuuaggcuauaggguauagccuguugcuccuaggcuacaacccaguacagcauguugcuguacugaauacuauaggcaguuguaacacaauuguaaguauuuuuguaucuaaauauacaaaaaguacaguaaaaauacgauauaaaagauuuaaaaugguauaccugugggagguaccauaccaaaaaugguauaccuguauaagggcgcuuaccaugaauggagcuuggagggcuggaagcugcuuuggaugagucagugaguggugagugaaugugaaggccuagcacauuacuguacacuaagguacacuuuauaaacacugcacacuuaggguacacugaauuucuuuuuaaaaaaguaauuuuaccacaacuuuaagauggcugugaugucacuaagcuguaggaauuuuucagcuccuuuauaauccuuuaugggaccauuguuguauaugcuauccuuuguugauugaauuaugugacacaugacugaagaaguaaaaaucuaaaguuaauucuaaaucuuaauaauaauuauuaaacuucaaaagaaaaauuuuugugaacuucccauuacaaguuacaaacagucccugauuaaucaugguuucacuuaagguuuuuagguuuuaaggugguaccaaagugaugugcauuucauacaaacuauacuuuggguaccaaugcaacuguucuguuuuucacuuucaguauagaauucaauaagucacaugagguauucaacacuuuauuauaaaauaggcauuuuguuagaugauuuugcccaacuguaggcuaguguaagugcucugagcacauuuaaggcaagcuaggcuaagcuuugauguucaguaagcuaguuguuauuaaaugcauuuuugacuuaaaauauuuucaacuuacaauuggucuaucaggacaaacccuacuguaaauugaagagcauccacaucaugaauuaugucaaauaauuugcuucuuaucucugauuggggcaggggauuuugcuuguugcuuugaacuuuggaaaaugacauacagacuaaugcaaguuuuucauaacaguuauguuuuagcucugcuugugaguaggaaaacacauagagugaaaugucaucuguuacuuaaccuagauguaagaugacuuuguuuagcaaaagacagaucugaauuauuuucagcuguuaggaaaauagcaguguacuaaaauucaugucaagauggcauguauaauuuuaagaagcauagauauuaguuaggccuguaauaucucaaugauugccaugaaaauaauucaguugauaguuauagauuauaauugugagauaaaguaguccaauuuucaaauauccacauuuuaauaccuucauuuaaugaaaguuuaucaagcaguguauuugagcagacacuaugcauggcacuggggaaacagaagugcauuaaauauagucucugcucucaugggacuucuuccaauuuuuugcuaaaaaguaacucaugaagauuuuuaacuaaaaauaguuuuuuuuuuaaguguuaggauaauguauagcuaagacaguccagcagaauuaaaaagcuauaaaagcuuacuagguagauaaguaauaaucauggaaacugaaaguaguauccuuauaggauauuuuuccuuuuccuuuuuuaggagccuaaaaggggaucgaguuaugccagaggaaauagcucgcuacuauaaacauuauguaaaagucaugggucuucagaagaauuucagagagaauacuuacauaacuuccguaucaagacucuacagagaucaagaugaugaugauauucaagacagagauauuucaacaaagcauuuacagauagagaagucaaacuuuaucaagagaaacugggaaauuagggguuaucagcgaauagcugaugguucucauguucccuucugccucuuugcugagaauguagcgcuggcaacuggaacgcuggauucuccugcccaucuggaaauugaaggggaagauuuuccuuuuguguuucauucaaugccugaauuuggagcugcuauaaacaaaggaaaguugcguggcaaaguggauccaguguuaauuguagguucugggcuuacugccgcugacgcaguacugugugcuuacaacaguaauaucccugugauucauguguuucgcagacgaguaacugauccaagcuuaauuuucaaacagcuucccaaaaagcuguauccugaauaucauaaagucuaucauaugauguguacucagucauauucuguagacucaaaucuuuuaucugauuauaccagcuuucccgagcaccgugugcuuuccuuuaagucggacaugaaauguguucuccaaagcguuucuggauugaagaaaauauuuaagcugucugcagcaguaguauugauagguucucauccuaaucugucuuuucugaaggaucaaggguguuaccuaggccauaagucaagccagccaaucacauguaaggguaauccuguggaaauagauacauauaccuaugaguguauuaaagaagccaaccuuuuugcauuggguccuuugguuggagacaauuuuguucgauuuuuaaagggaggggcgcuggguguuacacgcuguuuagcuacaagacagaagaaaaagcauuuguuuguugaaagaggaggaggagaugggauagcuuaaagcaaguuuacaaguaauuaaaauggacaguuugccauuaaagauuuuuaauagugguuuugcaguguacuggcuugaauuuucuggacuugaguuaacugaaggagagccucaaacuauaguaacuucauuuuuaaaaguuacuagaauuugguauccugauuuauauugcaguguuucaaaggugucacugucagacaaauagaaacacugccaacuugguguaacuuaagcuuucauuuaacuaaaacauucuuuucuugcaaaacuuauuuuucaugaucauuuuugguuauuuauuauacuugauuccaaaauaguacagccuugaaucuauaaaacugugcagucauuaugccagaaauuaucuuaaauauauaaugggucaccuugcuguucaaaggguggugcaagguccugcagcaucuuacaucuguagcuuguuagaaauguaaacucucaggccccacaacuuacuuccugcauuuuaacaagauccccaagggauauguaugcucauaaaaauuugagacacugguuuaaaugaaaauggauauaagguauguauaacuggggguggggugaggguaggaggcauuuacaacucagauuuuauuuauuuugaaauuaucaauuguauaaaucuaauuuauuaccaaauagggucuuuuaaaaaauauuuuuaucguugaaaccuugacagguacuucauauucuucuaauaauuuaaacaguccaauaaugugguauacacuuugacauccaagaacucaccaagauguuuuucagagauuuauucucgauuuaacuaucauagcauuuaaugaaucugauuuguaguucaauaaauuguggguugaacuacuuaucccugugugaacauugaauuacuuucugucacugaaacugagguauuugggugugguaaguacuucgaaaauuguaauacuguuugggcauugucuaaauuauuaaagguuaaaauagaaaauaaagucagaauuuuucuuuuccauuccaaagguguacuuagagaucucuauuaguauucauucgagaugacauagcagcucauaucaugguuguuuauuggauuuaucuguucuaauuauauaaguguguuuacugucuguguuuucacacaaacugcuagaauuuuuaauguuaagacgaaaacaucugaaguucuccauggcaaauugaauuuuucagucauuuucuuuucuuuuuuugguacaauuacuucaucuggaaugucuucauugaacucguuauucuauuuuucuuagaauuaaaaguggauuaauguggguuuuucuguucauuuuauugcaguauuaaaugcuuaagcuuauuaggaccauaauucacuuuaaauauaauuguauagaauauauuugcgucgaucaaauaauugcuucagaugaauucuuagacucuugauaauaucacaccuaauuuaacuugauuuuacaagcuguacaauccaguuuuaguuuucuauugugauaauaacuuuuuucaaaccaguuucacaucuuaaugaaauaacauucucugacugcacuugcuucaguacucucuugccugccuguuuuugaccucugcaugaguuggauuagauguuuuucuuacugucacuucuaaauagaaaaugacaguguuauaaaaaagggaaggauaaaaccuuugacauccccuugugucucaaaaguccacaguuauucaaacaauggcuuuuuuugugaugagaguauuuguuaaaaaaaaaaaaagacuucaagaaaaauaaaaguucaguggagcugcaaauaaaucuggugaauaauuucaucuuugguaaucucccauuuccugaguucuuccucaauccaagcuguccuguguaguauauaacauuugggcauuuucucugauauacuauacucucauguucuauaaauuucugucccguaauucuaacacuuuacauuuuuucuuugcuaucagcuauagcuauucauggaagggaagaaucacuaaauacuugucuaguuauagcaugaugugagcaucuccuccuuaucccucgaugccuggcuuggugucuggcaaacaguccauaauuagcagauguugaaagaccguuuacaaagcagaauuuggggauuuaaagugcaaugauacaacaaaaagauuuaauuacagcuuccaguguuuugacuaugugaaccauauccaacuacuuuuuugaaaaucuaguucuauguaauauauuucuguggcaucaaauuuuaguugauuguauuagucaauaggaagugguggaaaauuucuaaauaaauucaacuauuaa

SEQ ID NO: 191350 - RNA, 33318 nt, Homo sapiens
gagcucgggcggccggagcuggucgcugcgcgcgccggggggagggccggggcugcgagagaggaagcucuuucgcggcgcuacggcguuggcaccagucucuagaaaagaagucagcucugguucggagaagcagcggcuggcgugggccauccggggaaugggcgcccucgugaccuaguguugcggggcaaaaagggucuugccggccucgcucgugcaggggcguaucugggcgccugagcgcggcgugggagccuugggagccgccgcagcagggggcacacccggaaccggccugagcgcccgggaccaugaacggggaggccaucugcagcgcccugcccaccauucccuaccacaaacucgccgaccugcgcuaccugagccgcggcgccucuggcacugugucguccgcccgccacgcagacuggcgcguccagguggccgugaagcaccugcacauccacacuccgcugcucgacagguaggcagucacugggguucccuggaagagcccucaacuccugcauccccucaagcccccugacaagcgggcucuagagcccaaauggcagugaccgcuuggggccggccucaccucgucaccucuagggagcccuucaagcuugggagauagggagcacccacccuucaagcucuggcaccguagggagcacaggcuucucuggagaugcagcaguugcauuccuccacacaucucuccauuacccuuucucuccuucccucuuacuccuaggcguucuggcuccguacuccaaaaaucagcaaucacugccuaacucuaaacgcuggguuuacugaaauugauguguguuuauauauaguggguguggguuuuguuugcuuuguuuuuuccuuauuuuugaaauugggcuguagggcugcacuguccaguagguagcucuuagccacagguggcuauugagcacuugaaaugugcccguccgaauugaagugugaccuaaguguaaaauaccagaguucgaaugcuuaguauuuauuaaaaaaagaacuuauaauauuuuauuauuuguuuauugauuauaugcugaaauaacauuuuugauaucuuggguuaaauauaagauuaaaauucauuuuauguguuucuuuuuacuuuauguggccacgagaaaauuuuaaauuguauguggugguguucacauuauauguuuauuggaccgcacugcuuuagaaucaaggauguuuugcuucuuauuguuuuuauuuugguuuugguuuauuauguguugucaggaacguuuuauaucaaacucaauacuagcaguucaguuucucccagucucaguuucucucacagggaagauuaaguagaggaaaugugugcuauuuuugccacaauaaauugaaccaaaagacuguuaaauggccagaaauuguaaauggcuuucacuuauugguuuguacagguuuuaagggaagguuagcauuaguuucuguuuucagaagaacauuacaaccgcgugccauagaccugugacuguguauuagucaaugggucacuagucuuguguauuuuacuuccuacagggauuuaacuaggcccagcauucaguucuuagugaguuaacauccaugauuacaacauucucuucuccuccuccuauaucuaaugugaaaauacgucauccccgaugccugauuggccagaagcugugaguauccagcaucagauaaauuccucagcuuccgcccugccaaaguuacuggauuuucaccugccuguggcuuuucuucauugucucucacugucaggcuucgauggccuaaauggcacaggagauuugggacacuucuagagcuuguuuccacuucuugucuaucauaauccagauucagugauauacaagguguggugucuguuuacuccaggccuuauauucuguggagcaagugcuggacaaguguguauaugugucuguagucaacuuuuaaggguggugguugguuagagaggguggauauauguuagaaccaguuaugcaaacacuauauggaaauguagcacugauggacccauuagguauugaaaagccaauugauccucccacuuugggugcugcuucucaggauuuugauuuaucuaagcuuugugcaguuuggggaccaagaagugaagagggaguuuccuucccauacucaugaacaauuuucauagucuaaaauucuucacugaauuggguaggaaauuaauucugucuucgaggaagccauaagaccagcgaaacacucuggcauuuacugcaucacauucuuuucuccaauuuguuacuuaagaucuuaucauugcaguauuuauguagucugagcauuagaugaggcuaugcaguugacucacuggugucucuuuccucacuuauaaaauacgaauaauaaauacauguguuucucggacuauggagaacaauguuugcauuguucuuugggaugaccugaaaaaaaauaaguuuaugcaauguuacaugcucuuauuuuaaugacuggugaaucagucuccauaaccugacuucuauccgaugaguggaccuuccccaacaaucuucccaccccuuaugaguaaugaguccaauugguuguucaaauacccuguagaugacauaacuuuucugauuaaauuuuugaguuaauuuuggugaugugacuauggaagcuguacuuuacaccuuuauuuucaaaauguaaaaaucaauuuuuaaaaucuuuuggcuuuaaaaaaaauuucccacucacucaaucuugccaaaaaucuaccuucaagaacuuuccuacuauauucuuugaucaagcaauaggguagaaagaaugcaggcuuuaaugucccaugauugcaauucaaaucugacgccaacccugccacuuauuagugugaccauuagaaaaguauuaauuuuucugagccuuagugcccucauuuauaaaguggagcuaaugaaacuauguuuagagggugaucuuaagaugcuagugcauauaaagugacugacauguaauagggucacaguggaaagaagaaugccucuuaaugggaggaggaaagagugugugaagugucacugagacuucugcagcaugcacucucuauuguucuuaguauccaggaaucuucagggucauccucuauuguuggccuaaaucucuuggggcagauauggaacuauuuccaucuagggaauaaacauuuaauuaaaaugggucucacaaacugauacugguuuccuagcaguuggaguauuaagugauugaaggacagagaaugagagaagcuuuucacuuuaugccuucuuguuacucuugaauuuuaagacauauaaauauaugaccuauucaaaaaauaaaugacgaagauucuuuugcuuuguuuuuuuguuuguuuuuaaaaguaguccucuuagucuggucuagaaugucuguugcuauucauauuucaacagccauucauucagagcuugggagguguaagaacuaacuuaucaucauuacuuaccuaauaggcuucuccuggaaacauuucuauuucugucauugcugcagccaacauccagucacucaggguaaaaaaauaaugacaucuccaauuccuuuucauuuuuuuuuuaacccccuacagucagucacuacaacgcgggcauucuauucacuuaguguuuuucuuuccauuuccacugcuaccuuuguaguuuuagguucauguauuaacugguauuaaaaucuccuaacaccugacuuucaaacucuaccacuuucuacuaauccuacaucuuguugccaaauugaucaucuuaaaauuguauucuacugucauuccccaacucaaaaacuuucagucacaccagguacauuggcacaccccuguagucccagcuacucaagaggcagaguagggagggccagucugggcgacauagcaagaucuggucuguuaaaaaaaaaaaaaguuuccaguguguauucuguauguuaaaaaaagcaaacaaaccgucaaucacuuagugacugcuaagugaaguuucaccacccuaaccaggcuuuaagacugagauaugucccuaaccugucuuauucaccuucacuccuuuuauauuacauaaaaggagugcauuaaacaauucacaauuucccaacuuuagccuucccuuuaauuuccuugaaaucauuugauaccuaccuauuggacgucugauacaauugagcccaggaguuugaggccacccugaauaacauagugagaccuugucucuacaaaaaaaaaauaggcacgguugcaugccuguggagcuagcuggcugcuggggaggcuaaggugggaggauggcuugaauccaggaguuugaggcuauagugagcugugaucacaccacugcacucuagccagggugacaaagaaaaauagaaaaaaaaauaguuaaauauauauuuguuuuacauaugaauaaacaaaugaaccugggagccaguuaccccagcagucuauuaauauuauugagcauuuaccuguucucagugaucuuuuccugaguucugguauauaauuuauaaauauuacugacuuuuaugcagcuauugaaucuauaacauuuaaagguuuuaauauucaggauauuuggaaaauguuuauaugguaugcaaccauaaaauuuaauauaauauucuaauaaaacaugcucauuugaauacaauguaaacuuaaucauguaauuaguucaagcaccaauuguucuaacauagauagacuuuauaaauuuaauacuauguucuuucccauuccugggauaaguacaauaauaauaaaccuguguuuagcacuuuuaccugucaauggcuuauagaaguuaguuuggucucuaaacagaccuguggaauauauaggguagguauuauuucuauuuuaaauaugaugaaacuaaggugcagagaaguugcauaauuuacaugaggucacauagcuaauuaaugaaaaaaaauccaggcuuagucuuauaggcaugauaauuguauauuuuuuuauuacuugaauaauuaugcauuuuuuuuucuuagugaaagaaaggaugucuuaagagaagcugaaauuuuacacaaagcuagauuuaguuacauucuuccaauuuugggaauuugcaaugagccugaauuuuugggaauaguuacugaauacaugccaaauggaucauuaaaugaacuccuacauaggguaaguauuacacaguuuuaguggccauaauugccauuuuuacuauucaaacuauauuuuacuuugauuuuauauuuggucagauuauuuagggguauauagaugaaucaaagaauaaugaaaaacuaucacagggauaaaauuuuaccuuuugugacauuuuuguguugauuaaaacacuguggauucaggcccuguacucuagauuauuuugccuggguuaccauuccuaacauuuauaccaaauuauaguauuuacaugcauauuacauggguagaaauggaagagauaaacucugcauacuguaaaauccacuguuaagugauauuuuauuuuauauuaauagcaauuucaaauucaaauuuaauguuauuaauaccaguucauaaaguucugaauuagcaggccaaauauuaauaaauuaucucugaauaccagauacauuagcuuuucuaauaauagacagugguaucagccauuuacccuuuuucccaagguaccagucacucucucuuugauuaugaaucccuugaguaaacaaauucagggguccucauucucaaaauacauguauucauuauuaauauuaucaugagucuguaguuucaguagaucuuuuuaaacuacuugguccauuuuuugaggguuggcuuaauuaaaacuguauuaaucuacaaaauccaaucaauagauacucauaaaugauaguguaacacaaugcccuguaaguggccaagggaaagugggugccacugucagucagucauagaguaacuuccucucaguuucagaauacaucacauucuauucaugacuugugaccauuugaaacaaggauggaauaaguaacuggugucagucuguaagauuuguauaacuaccacagagccaagauacaaauauuaauaaaucacaauuucucuuuuauuuuuguugagaaaugaguauaaguagaaaucuaacauuuucuucccacaccccagcagauacucuggcacccaaauuugcagcucgcuggaaauucuacagccuccucaagggggauugcuaacuccuggaaaaaaaaucauaaaauauacagugagcacuucucucccuugucuccaugaucacaagcccccauauuauauuaugcugcagagaggccugguaacugcuuuaaacugcauaauuuucagaaaaaguuaccuuuuuuacagauuaaaagauuaaguuucucuaggggacaggccucuguguaugccagagaaaguaauguuccacgucagcuuuuuguguuucuuuugguuuccuguauugcauuauuuagggugggauuuaucuugaagugcccucccccaaccucacaaaauucauugagaaaacucaagauguaucauaaacagucuaaaauauuuugaaccacucccccugccagauugaucacugaacuauaagcugacgcauuugcagaaaaacuucucaagaacaguuuuguacuuucaguagaagcagucuuuuucauagcauuuagaaaaaugugguauggugccuggugauucaucguggaucuucccaaauugccugaucuuccaaaguauguucauucuccugggaagccacauuaacuuuuauguucagaaaacauuuauuuuaagaaaacucagauggauauuauuugaguacuaugaaaaauaaaauguuauguuuuaaaugugucuguucuauacaguuuuagaaacaaaaaugagugucccuuccacaaaaacaaaacaaaaggcuaauuuuauaagcuggaaugcagauaaauuaauuauaugauuaaauguaugauaaauuaaugcuuagucaauaaauacaauaugaucauaauuuguaacugaugcagugauuauaauguaugauuuuauaguaauagaaaaauuaaaauacaaauuuugaaugaaugccuugguauuuacuagaaaaaaacugucuguaauuuuguguguauuuguguguacucaaauuaccugauuaagacauagaaugaggagguggauguggguguaaguauaugacucuggcuauauacagauacaaaguaauugagauuugugucagcugaagaaagacccaaaaccauguaguugcaugaccaauauaaacuaaaaggaaguauuggugccauaaaguuaucauaauuuucucuauaaagugaggaaaguaagacacaaaaauguuaaacccuaucaaauuggugcuauuuuauaaaaaugagcauauguuuuaaccuuaguuuauacuguauuuccucauggaauauuuaacuuucuaagugugaaacauagugaaauuuggacuaauuucauuuucuuucuuuucacauauauaugaagaaaacugaauauccugauguugcuuggccauugagauuucgcauccugcaugaaauugcccuugguguaaauuaccugcacaauaugacuccuccuuuacuucaucaugacuugaagacucagaauaucuuauuggacaaugaauuucauguuaagguaauuacuuuuuuaaaaaguuuauguuuccuuguccuuauaguuuuaaaaauacuuuuuaguuauuucuucgaccuagccaauuucaugucucuccuuagagauagagacuaaugaauaguaauuuccauagccccuaauuucuaucuucuauucuccuucuuccuacugcaguuaggaaguuauuccuagacagagauagaauuaugguacaaaauacaaagccauuauguuucuuaauugaauugucaagaucaccuuuuuuuuuuacuuuuuauuuuaaaauuauuauauauuuauaggaaguugcaaagguaauaaagagguuucauguauccuucaccugguuucccacauuguuauaucacacauaauuauaguauaauuucaagaccaggaauuugacauuaguacaauguguguucauaguaaccgcaacaaucaagguacagcacuacucauaacaucaccacaaagauaacacucauccuaccucacccacuuccucccuaccacaaucuguaccccuaacaaccacuaaucugcuuuccaucucuuuaauuuugucauuuugaaaaugcuauauaaguggaaucauauaguaugugauauuuugagauuggcuuuguucacgucacauaaugcucuugugauccgucuaaguugugcuuguaacaauaguuguuuuuuauugauaaguaguauuccacaguauaaauguaccaaaguuaaccauucaggaacauuuugguucuuuccauuuugggguaauuauuuacaaagcugcugugaacaaagcuguacagguuuaugagugaacauaagucuucauuacucugugauaaaugcccaagaaugcaaaugcugggucauaugguaaggguguguuuaguuuuuaaagaaaguauccaacuauuuuccagaguggcuguaccauuuuacauuccaccagcaaugugugagagauccagcuauuccgcaucauuuucuaaagggauucuuugguuuucuuacuguugaguuuugagaauucuguauauguuacaguaguaguucuucaucagauauguaguuugcaaauauuuccucccaguuauaguuuaucuuuucauccuuuuaacagggacuuucacaaagcaaaaugauaauaccaaaugcccaccagcauuugguauuaucacuguuuucuguuuagcuguucuaauagauguguagugauaucucaucuugguauuaauuugcauuuuccuaacugcuaaugauaucgaacaccuuuuuauaugcuaauuugccacccauacgugguuuucagugaaaugucucucaugucuuaagcucauuuucuaaagggauucuuugguuuucuuacuguugaguuuugagaguucuguauuuguuacaguaguaguucuucaucagauauguaguuugcaaauauuuccucccaguuauaguuugucuuuucauccuuuuaacagggacuuucacaaagcaaaaauuuuaauuuugaugaaguccauauuuuuucuucuauggaucaugcuuuugcugucaucucuaagcacuuuucaccaaguucuacuuacugaagauuuccuuuuuuguuaucuucuguaaguuuuauaguuuuauguuacauauguaaucugugauccaccuugaauucauuuuuuaauaagaugcaggacuuaagugcugaagacacuggcuauugugauuucacagcuauacuauaucuaacugaguguaaauaaaaaguaguuuuugaguaauuaauacuaaauguaacucaccauauuuuuauguaucauuuugcuauacuucuuuuaauaacauguaaucagaaaauuauuauaaauauaaaaaauguucaaagaaaucaguaauagagaaguugaaacaacagggaaauuaaaacaagaaaugugagagaaaauaagugggaaaaauuuuuauugaagacacuccucuccuuagaauaaagugguaggggaaaggagagagaagcaagcugcugccucaguauugcuaagaaaaaaagagacuaaucuauuccaucaauuauagaaccaucaaguagaaauaccuuaauggucaacuaguucucugauacuucacugcaacaaucccugucucccaaagcaguuauccuguaacagggagucuuaacauccuuaauugaauaauugugacauuuucuuaaaugaucaaccaaaauuccuuccugguugcuuccacacauugauccuaguucaacuuuuugugauaaacagaauaaauccaauuuaguuacuucagcaagacagcccuuucaauauuugaagauagcuaugagcugucucccaaacccucacguacaagugcauuuuauccaucucccugauaaauacccuuuaguuccuucaacucguuuucuuauuacauggauuuuaauccuuggugcuauguagaugcaucauuuuguuuaaaucucacuuaaauguugaucgucagaacugaacacaauacuauuuuuggugcgguuugaugaaugcagacuuuagugaaagugucauuuccuuggcccuaaauacuuaauaguuccuuaauaauucaucagcuuuccagggguagucauaucacauaguucaaauugggcuuagugucaacaaaaaacccuuggagguucuuuuugccacguaucguugcuuaagccaccucuucuuaagcaacaaaguacacaaaauaauguacuuugcagaauacuuucuagauaugaucaaauuuuaucuuguuagauuggagcaauugcuucagucucuuaagaccuuuuugaauguuauuucuauaauccaaagguuuuaaguuucucuccaaguuuugugugaugcugaaauuuaauuagcuaauuuuuuguaucuuuaagucaugauuaaauaugaaccaguacagagcuugaaucagagcuguaucacauggccauaagaaccuucaucugggucaauaucaguccuuuuguuaauccgcgcuuuuggagaacacucauucaguuugucuggaauacuccuaaaagugcuauuauacagcccauauuucuucauucuguccuuaaaaauuuuucugaaagucuuugcuuaacugcuuuucucagcuguucucaugacuuagucaucuugguccuuuucugugaauucaauuuuaaaauucuugauuauuuuuauuuuuuuucuuaaauugacucuuuuauuguagcaaaugaaugaaaaauucauuuauucuaccccuccuuuuugggaauggaggccauaauuuuuuuuaucucaaauucaucuaaaugcuaauaaaaauuauguauuuuguuaaaauugguaaaaaauauaggagguaaacaauggaaacaaaugaugugcugcauggagcucauuucacucugcugaauucuaaaguaugcaguaaaauauuuuaaguaauuucagugucuuuuaggauuucccauacucccuugucaauuaaauauuauuucuguucuuacauuuugucuuacauuuuuaaaaaauaaaguaaaaaauaaggaagcuuuuaaauauuuaguuauaagauacuguauaauaugugcauaagauuuacaacugaagcaaaacuguacaggacauaucaaaggcacagaauauugucacugauaauucuuuaggcacccauuguauuggacauaaauauguuuucuuugcaauuauacuguuuccaugaaauacuucuuuuagugaucagcauaaaauuguauaauaauuaccuuuacaauuuugagauuuaguguauuucuuaauuuaaggaugcuaccuuuagggcauuauuaauacaacuguauaaaccagaauuguaaacaaugaccagugacaauugcaugagaugugaguagacuuggcagcucugugagauguaggaagcacaugguaucaagcuauaugucaugaaaaguaaggugugcaagguacacacucauugagaauaucagacaaaaaaugccucugcucaauuuucaaaaauuagucucucuuuugaaauuuguaauguuauauuaaacuuuaacucaguauguauugcuccuagaguuauuuggcucagcaguguggaauuuaauuuuguaagaaguugggggaauauacagaaauaaaauauuaaaauauauuacauuuucucugguuugauaucuaaauacagugaauauacaaaaagauaguugacuuuuggacuuuuuaaagaggaaauuucuuaauuauuugcucuugucccuuacagauugcagauuuugguuuaucaaaguggcgcaugaugucccucucacagucacgaaguagcaaaucugcaccagaaggagggacaauuaucuauaugccaccugaaaacuaugaaccuggacaaaaaucaagggccaguaucaagcacgauauauauagguagaguaaaguugcuucugcucagauuuaaccuugucucagacacaaaauuagucaaccagaauuuugaagcuacauuuuaaacugugauuuuuauucuucucucauaauuguggugaaaauaaacuugaggccccacggugauuaauauuuuucaaauuaaggaaauuuaaugauuugcuuuaagaaacuuuuacauccuuuaagaaauuuuaaagcaucucuucuuauccuaucaauuuauaauauaauaguuaaggauuuuuaucauaugugacuuggaaaugcagagggaaacagugguuccuaacauuuuagcuuuagguuucucaaccuguucaaccuuuuagcuuuugauaucuauauaucuuuuuagauaaauagacaaacucuuaaucacacuggggauauuucuauuuaaagaaucccuaauauuuguauaugugugaauuuuuuauacaacaaaucaauggguuugauaagaucauauuuucauauuucagaugcauauuacuuauaaucucauaaugcaguaauaagcauaacacauuguuauugacacugguuauuuaaccagaauaaaaggaagaugauuauuuacacagguuuaggagauggggacauucaccucauguauaaguuacucuuaucucuuuuaauauacuaaugaaugcaaaagcagacucucuaaguuugcucugaacacauuuuauaguccuuuaaauggcuuuuugccaucuuuaauaaauaauuuguuaaugaaucauuuuaggaaugaaugcuauaucucuaccagaaaacuauauauuuaauuaaauugcauauuccuuuucuucaaaagcauuuuaauuuuuguuauuucucauuaaaaccaaagccagccaauccauuuuaguggcugcacuaaaacaauucauacagugucuuuuacauucacauuguaugaauauaagaaacuguccuuuuauauuuuguuuucugauauuuuuaauucauucugaaugauguacugaggggaggagaaauguauuuauagcuuccuaagguagagaucauguucuacccaacaauucuuaaagcugguuugauucuauaaaaaugggccaauaaaucugccagucauucauuuugugaauuuucccuuuauguucaauuucaauauucucugucagggaaaaaugaggaaauauuauuccuucauuuggguaggaauucccucuguacuccucgcucucccuguaacacaagguguuaguaguaauaaauucuauguguccauuuugaaugcaugguuaauguugggguguggcaaaauucuuauauccuauuuaaccauuuauucuaauuauaaacucuaugcagcuuaacccuguaauugacaucugaaguuaaacuguaggcaagauauuucuacuaccaaagaagauagugcugagagcagaaaaaaggcaguagaauagagcuccaugagacaauuuuuuucuuguucuuuguucuuugugaaaaauaauaucauuuaauuaaagggcauagcuuaucuggguguccaagaauuaaaucauccacaaaaaguuaaucuugcauguaacguuaagcuuguauuacaguaauuuccuaauuuuuuaacuuaaaguugauuuuguuuccaaacuacaugagcauuuaucaucuucauuguauacaguaauucuuugcugccuuaucacuuugaaaaaugguaucuucagucagcuuuuaaaaauagugcuauuuuaguuuauuaugcagaguucauuuaaaauauguaacauguauguucuuauguuaaacagcuaugcaguuaucacaugggaaguguuauccagaaaacagccuuuugaagguaaguaugguuugacuuuuuuaugcucaauaacaucauguuaguaggucacucucagaacuaucuaaaaaucauguuauuuuaaaucugcuuauucauuuuguggaaaacacacuaaaacaaccauuuaucaguugugaaugcaucacauacugcaaaauauaccggguuaaggauccaguugugagucuacuauauacuggaaaauguacuggauuaaggaucagaaaaacccagauuuuaauucuuguucugacaguaauuagcucugugaucaagucacaaaucucuugcguccucauuuuugucgccugcauaauaagaauuuuaaauuacuauuuccaaguucuagucuagcuguaaaauuauuuauaugauaauuuaauuacuacccccucuauaaagacuagcaaauaucgaagacuaaucuguccuuuuuauucccugaaaauauuguuuauuucuuuauuuugagguuuguguaggucagcuuguuguguaacaaaaaacaaccucggaaucuccguagcuuaugaaauaaacauuuauuucucauucacauuaaauauugguugcuguagcccuucuuaguucugcaagguuucgcucagcucugcuuuacaaauacucuguugaccaaauccaaucacauggucaagcccaaaauuaaugaggugaggauauaaacucauuccauaggaaucagacaagucuggcaaugguuugggguauauauauuccuuuuacagaaagggggguaaggcaucauuccuaaaauuucaauauucacuuauuuucuuuuaguuaguuuuagauguaaguaauaugcuuaaucauaauauauuacuaaugaaugcaaucuauuuguuuugacagaugucaccaauccuuugcagauaauguauagugugucacaaggacaucgaccuguuauuaaugaagaaaguuugccauaugauauaccucaccgagcacguaugaucucucuaauagaaaguggaugggcacaaaauccagaugaaagaccaucuuucuuaagugaguauauaguuuuaaccuagacucuuugaauuacagaauuaguuaauauacugugaauaaaauauuccuugaaaaauugugcaaauuagaugacuagcuagaaguuguuuaaauuauuuucugucuuaucauagcauuuauauaugaguaacuccuucuagagcagaauugagaauuccuaacaaaaaagagaaaucgugugauaggaguaacaauuucuuucauauauuuaacaaauaugucuuaaaccccuaccaugugcuauguauauacuggagugagcccugggaacagaguaguaaacaagacaaacuuucuguagcuaguucacauucuaguugagaaggcagagugaaaacaaauaaauaagcaagauacacaaauugugacagucuuauaaggaaauaagcaagguaauagacuaauuaagggagggaaacaaaggccuuuuuuuaggggcaaacauuugagcugacauuugaagcuugaaaaagagccagucauucaaaugcugaagaaagaguauucagccaaacaaaacagcaagcauaaaggcucugagccuagaagaggaaaaaguuuuauauucucaagaaacagugagaaggccuguguggcuggaauacagugagcaaggaaaggaauuagaugauauuggagaguuaagagagaggcuauuggccaucauaaaaagguuagauuuuuauuccaagugcaauggaaagccauuaaaguaucuuuugcagggaagugacaugaucugauagaaguuuaggugaaauucuuacugcuguguggaaaguugauuggagaaagacaaaaguggaagcaaagaggcuagaaaagacacuuucaggaauauucuaauuaagguggaaauucugaagacagaagaguuacagaauuaagauaguauuucagagguagaauggaucagacauccaaauguaaauguaggagaaaaucuucaugaccuaggguuaggcagaaucuuuaaauaugacaucaaaaauaaauaggauucauuaaaaaauuuauaaucagacuuugcaaacauuggaaacuuuuccacuucgaaagguacuauugagaaaagagaaagccaggcauuuaguguccacgacuuuagucccagguacuuaggaggcugaggcaggaggaucacuugagcccaggaguuugaggauguguaauagugcacugugaucgugccuaugaauagcuacugcacuccaaccugggcaacauagcaagaccucauuuccaagaaggaaaaaaaaaagcagagccacagacugggagaaaauauuugcauaacauguaucugcuaaagggcuugauucuagaauauauaaaaaacccugacaagucaauaauaggacauauagcccuauuuuuaaaugaguaaaagauuugaauuucaccaagggagauauacaaauagcuaaaaagcacauaaaaugaugcuuaauauuauuagucauuuggaaaugcaaauuaaaacugcaaugaguuaccacuucauacccacaaaauagcuauaauuaaagacagaaaauaacaaguguugacagugauguggcagaaccaaaauccguauacauuguuggugggaauauaaaaugaugcugccacuuuggaaaacgguuuggcaguuucuuaaaaaugaaagauaaauuuaccauacaaccaagcaauccacuaacagguaaaccaagagaaaugaaaacauauguucacacaguuguaugugauuagugauagcagcauuguuuauaauagccagcaaguagaaacggucauaauuacugcugcuacuacuacaacaauacaugaaucuguuguuccaggaagaguccaggauccuaauauaaaauugaacaucacuaacauauugauagucuggacugguucaucuaagaagggaauauacauagcaaagagaggacccauaguaaagcucugaggcauuccagcacuuagaaauugagaagaggaagaagaaaaaggauuaaggaagagaagacaguagagaguguaguccuugugucuuggaagucaaggagggguauagucggacauguuuaaucugccaggaggccaaaugagauaagcaggauuuuccaacauugucaucaccgguaauccaaacaaauggaguuuuaauagagagauguaaacagaagacugauguacauuuaaaaaaaauagaaagaagugaaggcaaauauggaaaauuccagcaagaugcuuggcucugaacagaagcagaaaaaaaugaggugauagcuaaaggaugauauggggucaaaauuuuuuccuauggccaggcacaguggcccaugccuguaaucccagcacuuugggagaccaaggcagagggauuacuugaguucuggaguuccagaccagccuaggcaacacagcaacaccuugucucaacaaaaauaaaaauaaaaaaaaaauaaaaaauuagccagacaugguucguugccuguaaucccagcuacuugggaggcugaggcaggaggauugcuugagcccaaaauguugaggcugcagugagccuugauugugccacugcacuugcacuccagccuagcugacaaagcaaaaugcuguuucuuaaauaaaaaaaaaaaauccuggagaaagauagauuacuuuaucuggaaaaaauacucuacuggaaaaaaugauccaguagagagucagagauugucagugcaagaacugagagagaguaucagaaacagaaugcuggagagguggaggaaaugguauucagaaugcaagugauacuguuuacauuuguaugaguauauggacacuuuuuucuacuguaagagaaaugagguuggagagauggauacaaguacaagaaguuuguagaucugguuauagaacccugaaggaauucccucucauggcuucuauuuucucaguguaguaugagagcagaugaucagcuagcucaaaggaaacauggaggaugggauguaagaggcugaaaaagggaagauaaaguacaaugccuauuaccccugccuucccuuucuaaguucagaauauauuaagaaaaagccgaggaagaaagauagauguugaucagaauaucaguuucauuacugauaaagcuaauuggagaauguaccuuuagaucugcagccaaaugggcuuaguagcauuuuaccccuacaguugauagcuuuaccagcccaccacaggccucacccugcuucuacauagggaagcagaaaauguaugcauucuuuaggcaagcugacuuuuaaaagaaggagaaaacugcaaagguaccaaauaagcaugcuuaguuuuucuccaaguuuaauaaaugagguaagucugaggggcagaaaggagcuggaagaauuccuccuauacuucucuuuccugaggauugaacuggaaaugucaucuuccuguuggaaacaugaagaaaaggacuuaagugucuccuccaacaguacgagauaauuauguaagacagcaauucucaaacuuagaucucaagacucuucaaaauuauugaggacuucaaagagcuuuuguauguguggguaauaucuauuagcauuuacuguauuagaaauuaaaaccaaggaauuuuaaaauguaggaauauacaagaacacauuccauuaucuguugaagcagugaucuuaucacaccuuauuuaugggccucuggauaaauccacuauauacuuguuuggggaugacagugaacagggaaaauaaugucuuaguacuuguuauuuugaauauaguuuugacuucaugaacccucaggaaccacccccgccaggggucccuggaccacacuuuaagaaccacuuaucuaugagaacagaauaguagauguauuuaggaagcaaaauaggauugcugagaagugguauuuagugucuaguuugggccguuaauuuagagaaaccagcgaccccacuucuggccaagauggaguaacuggggccaauuuacccuccugccugaaacaaccaaaaaaccuagacaaaauaugugaaacugguuuuuaagacacuaaauaucaggaaacaaagagcagcaaucucugauggaugggaaacaaaugaagugagccuuccgauugcccagcuuccugccuugagaguuucuagaugcagcauggggagaggaaacagguggaacccaguggacacucagggucaaggaaacagggaugacaguguggguagaccaaggcagacagacuucauaggacauugcaccagaagggaaaagguacacagagugagaaccccagagauuucagaggguuccucucaaguauucaguggagcacugaucaguacagggugaagucaguaagccaaaagccaaaaucuugagcauaggagaaaggagaaguuugcagagaaguaaguauugccuaauggcaugaacuuuagaggaucuagaauuuucacagaaagaagaaauuacgauuuggaaauggcaaagagaggacaacagagauauauacccuuccucauggcucuggaaagaaagaaacaaaaugugaacccauuaccuuagcaacuuuugauuuguaaauauaaugcugaugaacaauggauauaaguauugaaugaaaaauacaaugcauuauuuuucuaguaauaagaacuuagaguuuauuuuuaaacugucuuaacugaaauggccuauaaacauauccagcuuuguaucuaauaguacagugugaguguguguguguguguguuuaauuuaucacauuucuuacaaaguacuguugucugccuuagacauguuucauuuauagccauugggaugcuacugguuuuguuguuauuguuagguuuugaacuuuguuuuuaaauggaaguacaacuuuuuuuuccuaggaugacuguuuccuauuuucagugggaagguaccaucauugauuuauaaacacacuacugccuauacagccugucaguuuuauuuuaaggcucugguguauauuggaauguugaaaagcagauucugggaaccugaaagggaaaggaagaaaaaaaaaucaauaauaaggaaaguuuaaguguauucaguaaagaaauucugucaauaggaccaaauggaagaacaugaaauuacaaagggaucucuagauaccagaguaagcacaagaugccuacuuuuggacaaaccuacugaaaagaaaugaaaaguucacaaugaaagaaauuuuaauaaaaaaauaaaggaagcuugaaaaacuaaaagcaagcaauauuuuuccuuuuuuuaaaaaaaauauagguuaacugaauuaaggaaaagaggaagaucaguaaaccuuuguugaaaaaguaacuagagaguauauauucugaaaauggauuuaacuguucaauuaauauacauauuaaauggcaaaguaacacaguagcagagaggaaucauauaauaaagauuauuuuuuucaaaagccuaucaaaguauaauuuacuuaccauaaaauuuaucuauacauucauugacuuuuuaguauuaauaauuuuacaguuugcaaccauuacuauaauccaauuuucaaguauuuccaucacccccuacaaaaucccuccuaacuauuugcagucacugccuguucucaccacuaacccuagguaaccaguaaucuauucucugucuuucuagauuugccuuuucuggauauuucauauaaauggaaugauaacaaugugugguccuuuugcaucuggcucuuuucacacuuagcguaauguuucucagguucauccagguuucggcaugaaucauaguucaguaauuuauuguugaauaauacaucaucauauggauguaucccauuuuguugauccauuggccaguugaugaacauuuugauuguuucuacuuguugccucugugaauaaugcugcuaugacuguucacauacaagucugugaacauauguuuucauuucucuugguuaauuaucugugaauagaauugcuggguuauaugauaaauuuaucuuuaauuuuuaagaaacugcaagcuguuuuccaaaguagcugcauuaucuuauucccaccagcaauguaugagguuuucauuuucuccacgucacugucaacacuucuuauuuuccuuuuaauuauauuuuagugaguauggagugauaucucauugcaguuuuaaagugccuuuucuuaugauguuaagcaucuuuucaugugcuucuugaagacauuuguauaucuccuuuagugaaauucaaaucuuuuacuuguuuuuuaauuuugcuauuuuuccuguuauugucaugggucuguauauauuguagauacaaacccuuuagcagauacaugauguggaaauauagugugcaaggcugcagcuuaucuuauuuuuucuuaauacugucuugaagugcaaaaguguucaaauuuuuugaaguccaauuuuuaggcgguuuuuggguuuuuuuuuuuuuuuuuuuuuugagauggagucuugcucuguugcccaggcuggagugcaguggcacaaucuuggcucacugcaagcuucaccuccuggguucacaccauucuucugccucagccucccgaguagcugggacugcaggugcccgccaccacgcccagcuaauuuucuuuuuuuguauuuuuaguagagacgggguuucacuguguuagccaggauggucucaaucuccugaccuggugaucuguccgccucggccucccaaagugcugggauuacaggugugagccaccaugccuggcccaauuuucaaguuuuuuaauggauuucauuuuugaugucauaucuaagaacucugccuaacccaagaucaugaggauuuucuccuauguuuacauuuaggugugugguucauuucaaguuaguuuuuauguguagugugauauaaguaucuaaauuuaucuguuuccagguguauauccaacuguuuuagcaucauuuauugaaaaggcuaugcuaucauuuccccauugaauuggcuuagcacauuuguccaaaaacagguguuuuuagauucucaacacuauuccauuguugcuuaugucuaucuuuaugucaguaauaaaagcucguaaaacagcugaaugucaucacuuuggggaaaaacugacuugaggccuuguacauuaaauguuagcauuucacuuuaauacuuagaagcaaucugaacucaaccuguauuuuuuucucuuauguagaauguuuaauagaacuugaaccaguuuugagaacauuugaagagauaacuuuucuugaagcuguuauucagcuaaagaaaacaaagguaaguugcuaaaugaaaugcuggaaauuagaaauuuaaacaacuauauaauauucauggagauuuuuaguuaaguguaguuuuuaauauauauacuuuacacagauauaagcuacaguuuuggagugagaaaauuuaccagagacuaugaauacuacuuuuccuuugucaccaaaagcuuuucuauuucauucaaauggccaccuucagauuuuaaagacauuuccaggaccaggcguggugacucacaccuguaaucccagcacuuugaaggccaaggcgagugaaucacuugagcccaggaguucgagaccagcugggccacauagcaagaccccaccuuuauuuaaaacguaaaaaaaaaaaaaaagacauuuccagaacccuuauauaucagacauaaauuuaaaaauguauaaucacagccaguuguguacaaugaaugcacugagccauuagagguguuuguuuuuuaauguacauuuauuuucccaaaguuguaaugccuagagaauaauagaugucuggguucucgcacuucucuuuuuauuuaauguacauuuuuuucugagauuccucgccaaguuuagcuguagaauuuuuauuaaauuugagaccaaaguguguuugugguuuguuuuuucauuuuuccucucaaacacuucauguuuuauagaccaagguagcaguaacaguuuauaugaauuaccuaggagaguuguauuaaauacucagucugauucuugugggucggaacaauuuaagggaccuauuacugcagggguuuuuuuuuuuuuaauauuacucaaaauuguuuaaaaagcaaccacaguucauuagggcaagugcuaaacuaugcuuacuuugcccuaaugaacugugguuuguuaggggauauagguuucauuaaauuguacuuaauauaugauauaaaaaccagcaguuagccaaacucuuggggugugaacaagcaacaucuacaauuuuuaucacaaaaugacauugcuugccugccccuugugggaugcuggaucuagugacauaacccuugguuucaaagggaaaugcauaaaggaaggaacuaaagaggaacuguguuuucauucuuuuaauaacuuuucacuggcuccaccacuucugaguagguaguguuuuccagaaaauaccaauuucucucuuccuuaauagauugaauuuuuuuuuuuuuuuuuuuuuuaguuuuuaaagacagggucucccucugucgcccaggcuggagugccaugacaggaucauagcucacugcaaccucgaagugcugggcucaagcaguccucccaccucagcaucuccaauugcuugaaacuacaggcgugggcuaccacacucagcuacuuuuuaaguugccauauuuuuuccacucaggauuguucuuuuuuuuaaaaaaaaucuuguaucaauucugugauacuuauagggcaagaauaucaucugauuuuuguagauaagauaacuaagguacaguagucuucccuuaugcaugggagauacauuccaagacccuggucaaugccugaaaccauggguagcacugaacccuauguauacuguacauacauaccuaucauacauacauacuuacuuuucccaugcauauauaccuaugauaagguuuaauuuauaagauaggcacaguaauauauuaacaauaaccgauaauaaaguagaacaauucuaacaauauucuggcaucacuauucuugcacuuugggccauuaguaguaagaguugacuuaauuaguaauaagaguuauuugaacagccuaggcaauguggcaaaaaaacauaacaaaacaaaacaaaaaauauagcugggugugguggcacaugccuguagucguagcuacugagggcugagauaggaggaucacuugaacccaggagguagaggcuauagugagcuggcacuccagccagggugacagagugagacccugucucaaaaaaaaaaguuacuugaguacaagcacugugauccugacaguuguucugguacuaacagggugguagcuuauacagcauggauaugcuggacaaagggaugauucacauccuggguggaauggagcuguagguucaucauacuacuuagaacugcaugugacuuaaaacuuaugaauuguuuauuucuagaauuuuacauuuaauauuuucaaaccacaguugagcaaggguaauggaaacugcggaaagugaaaccaagauaagagggggacuaccguauagggaaguuagucacuuauguacaucucacacaguaagcuaaugucagggacaacaguagaacacgaauuaaauaagauucuucauaaagaaauuucugagcuaggugugaugguacaugccuauagucccaguuacucugaaagcugaagcaggaggaucucuugagcccaggaguuccaguccaaccugggcaacauaccaagacccugucucuuaagaaaaaaaaaaaaaaaauucugaaagccaaaauuaguagggaaauuuguuuugaguuuccuacauuuuuucaacucuuggaaucagcucccguaauuuauguuuuccuagguaauuggcuucuaaaucuugaauaauaaacacugaauaaacauaguuuuucuucaguuguucauuucuucuuagggacagauucacuaauucacaaguaauuugaauuaucauaacugaucaguuaugaaaaacuguuacuaauucaaggauauugcauuaucagaaauguuuuggcaaauuuuauaagcagaggaaaaccucacauaacagagauaaaaccaaaaacucauuuuaaagggucauauaacaauauguuuauagauguuuauugaacugcuguguauaacgcccugugcuagguacauuauauacacagaugaauaagaguaauuuccuucugaaguuccuuagccauguaaauggaguaugcagucauaaaugugcauaauggauggcugggugugaauucaccauuuuccaaauucugaagaguaguugacauuaugauggucuggggaagaaaaugauugauagguuuguauuuaaaucacugaguagugauggaaacuaauccaagccuagcuuauauagacaggaauaaaccacuuaauuuuaacacaaaagaauaguauuuaaguaaaucaucuacucagcagcuaccauuuauugaaugcuuacaaguaauguuugggccuuuuugcauauauuacuuuucauuuuccucacaguaauccuucaaaauaggaauuuuuaucuccaguguacagauaaguaaacugagauuaaaucuaaugucucacgucaaacagaugugggucucuaaaucacaucugauuggcuccauggcccugccauuccauuauugacacucuaccuccuuuacuuaguccaagccucaaucucuuaacuauaaaaugaaaauaauaauaguacuuacaggcacagugccuaaaaugugguaaauacuuaacuauagauagacauacaaucacacucccaaaaauucccaaaaauuuauuaaguaccuaguuuauaccagauauuucauauuuauaagcucaaucucuagaaccauccugcauguagguaauuguuagauuucgaggaugaagcucugagacacugagagaagguaaccaauuaauaugagccaggauucaaagucuguguuucuaaaguuauuucccguucuacacugucuuuuccuucaguuauauguuauauucucaacucuuuauauuuucuuuccauguauuuuguacaaacauauaaaauguguuagauuguauuuuacuucuauaauuuccuaaucaucuccaguuaaaguguauauauauuuauguauucauuacaguuacagaguguuucaagugccauucaccuaugugacaagaagaaaauggaauuaucucugaacauaccuguaaaucaugguccacaagagguaaaaaaaaaaaaaaaaaaaaaaagguuauauuaaacucaaaaugugagaagaauuugaaaaaaucauuuggucuaagcccuucuuuuauagaaggaaaacuaaagcccagggagcuuuuaggauuuguuugguagcucaugucaaucuccaacuugaaacccagcuguacugauucucaguucauuguucaucccaucaaaucacaauuauugcuucuuuguuugacauugaguucugucccugucauuguuuuauacaauaaaugauaucccaggguauuauguaggcaaaucauugauuacaguuuuaacacuguauuuaugcuaccuuguucuuaccucuuauaauaauuaaugagaggaaaacauugcugccuaggaagaaagaucucuuuaguagcauucaaucagacuuauauuagucugaauuaguaauuucuuuuaagaauguauauguauguucauuuuacagaauuagaaaaguaacauagauugagcaucccuaauccaaaaauccaaagcccuccacaguccaaaacuuugaacaccaacaugaugccacaaguggaaaauuccacaccuguguuagucuguuuaucguugcuauaaugaaauaccuaagaguagguaauuuauaaagaaaagagguuuauuuggcucacaauucugguagccagaaaguccaggauugggcagcugcaucugaugaggaccuuaggccgcuugcacucauguuggaaaguagaaggggagcgagcuaugcagagaaaucacauggugagacaggaugcaggagagugaaaaugaggaagucagguucuuuaacagcuugcucucucaggaauccacucaccacuucuagaauggcaccaagcuauucaugagggaucuucccccaugacccaaacaccucccauuaagccccaccucccaacaccaccacauuggggaucaaauuucaaugugagauuuaguggggacaaacaaaccauaucaaaccauagcaacaucugaccucauaugauaggucgcagucaaaacauuguuucauggguggacacgauggcucaagucugugaucccagaacuuugggaggccaagguggguggaucacuugaggucaggaguucgagaccagccuggccaacaugacaaaaccccaucucuacuaaacauauaaaaauuagcugggcaugguggcgcaugccuguaaucccagcuacucgggggguugaggcaggagaauugcuugaacaagccaagaucgcaccacugcaguccacccugggcgacuccaccucaaaaaaaaaaacuuuguuucagguauaaaauuauuuuaaaauauugaauuaaguuaccuucaggcuguguguauaagguguauaugaaacauaaaugaauuuuauauuuagacuugggucccaaccccaagauaucucguuauauauauacaaauauuccaaaaucugaaaaaaauccaaaauuccaaacacuucugguuccaagcauuucagauaagggauauuaaaccuguaguaucuuuaaaacgaaccuuaaagcauaguauaucacauuuuuaaucacuugauguacaguauuucauuugaucuuugaggccauucaugcauauuuuuagauagacagugcggauaauagagccaaaaaccugagagccagagagguuaaauaccuuauugaaaguuagcuagugauuccaugacagagcuaggaguaaaauucuccauuacuuuuuccauguuuuccugugccuccauguggaaggaaccugaggugcugagaacaggcauuucuaaaucuguaggagaccagacuugcagauaccaaauuucucauucacuauucuagcuacuggcugcagcaucugagaucguguagaaaauacugaaaaaauaauuauuucuaauguuucauuauuccccuauuucgcccauuuguguuaauuaagaaaauaaguuuaucuuuguugguuauuuuauagauguauguguuucuuuaauuuuguaaaguauaauuuuuaguaguuuuguagguugggcacaauggcucacaccuguaauuccagcacuuuguguggccaaggcugguggaucacuugaucgcaggaguuugagaccagccugggcaacguagcgaaaccccauuucuacgaaagauacaaaauuuagcaugguaugguggugugcaccuauaaucccagcuauuaaggaggcugagaugggagguucaccugaguucaggaggguggggcugcagugagccuagguugugccacugcacuccagacugggcaacagagugagacccugucugaaaaaaaaaaauuaguaguuuuuaucuucauuugugauaagccacaaacaagaacuauuuagaaauuaaagcucgauaauuuuuauuaaccuaaacccuuuauuuuuuauuuacuuuaggaaucauguggauccucucagcuccaugaaaauagugguucuccugaaacuucaaggucccugccagcuccucaagacaaugauuuuuuaucuaguauguagauuuuccaaucauuauuuacuugcaaguuuuccauuuucuuucaagaucaaauuuuugcaagcagucaugauuucuauggaacuuuaauuugcauauauaacucauuuuguaaagcgacagagucuaaagauaggaaaauaguagugugauauucaacaaauacauuuaaguuuuaaggcauuauguuuggccaggcgcagugguucacaccuauaaucccagcauguuggguggccaaggugggcagaucaccugaggucaggaguucgagaccagccuggccaacauggugaaaccccaucucuacuaaaaauacaaaaauuagccaggcaugguggugggcaccuguagucucagcuacuucggaggcugaggcggaaagaucgcuugaaccugggagggagguugcagugagccgagauugcaccaccacacuccauccugggcgacagagugagacucugugucaaaaaauaaauuuuaaaaaacaggcauuauguuagacacugccagaaaauguccgcaaaaaaaucucuuacaagaaaaaggagaaauguuucuaaauaacuauuauaugagauagugauauaagagagacguggaucuagagcuaugguaguacaguggaagaguaacacuguacaaaggacuuucacaacaaccuugugagagaaauguccucauuuuacacauuuaaggacucuggaucacauagcuaguagcuggcacaucuaagacuuuugauaaauauuaucaugucacucuacucuaccauguugucaucaugaaauuauuucuggcugaaggcuggaucuguaauuacaaaggauaggcauuccaggcaaaaggaacaacauacagguacagaagcaagaaaauacagagaacagugaguaauuugguuuagcuaguaaagaaggugaaugaaagaaguaagagcuaaguagauuggagucauaucaucaagaauucuaacuuucagcugaacuauuuggacuuuuuuacuugaguaggaagcaacuauugcaauuuuuugagcaagggagugacauaaaauuuuuuacuuuggggagauucauucuggcuggaauguguaggauauuuugaaaggaaaaggaaacuugagauggggagaucaguuaggagacuauuacuguaguacccgugagagauuauuaagaaccgauacagaaugaaagaaaggaggggugguaugugagauguuauagacaacuagaugauaggacuuuguaacuuuucacuuagaggagcgaugagagaaaaaagagguaaagccaaauaaauuguuaagccuggggacugggagaacauuggugccauuaaaagaaauagaaguuaaaacaggcugcaugcgguggcucacaccuguaaucccagcauuuugcaaggccaaggugggcaaaucacuugaggccaggaguucaagaccagccuggccaacaugccaaaaccccaucucuacuaaaaauacaaaaaaauuagcggguaugguggugcacaccuguaaucccagcuccucaggaggcugaggcacaagaaucacuugaaccugggaggcagggguugcagugagcugagauugcgccacugcacuccauccugagugacagagcaagauucuaucucaauuaaaaaaaaaaaaaguuaaaacaaguuuuagaguuaagacggauaauuauacuuuuaauguuuuuguuuuuguuuuuaauuugagguacuaggagcacacaaaggguugauggccagagggcuuuugaaaauauaacacuaagguucauggcugaguguaguggcucacaccuguaauccuagaacuuugggaggcugagacagguggaucaccugaggucacgaguucaagaccagccuggccaacauggugaaauuccaucucuacuaaaaauacagaaauuagccaguugugguagcaugcaacuguaaucccagcuacuuaagaggcugaggcaggagaaucgcuugaaccugagagguggagguugcagugagcugagaucgcaaccauugcacuccagccuggguggcaaaagcaaaacuccaucuaagaaagagagagagacagagagagagagagagggagggagggaggcagggagggaggaaggaaggaaggaaagaaggaaggaaggaaauauaagacgaaaguucaaugaagacagaaaauguaauugcguggauuugggaauagaggggaugauuaagucccugaggcucagugggauugccagaagagaaacuagaaagacagacaucauauauagauuuagagaacauacuuaaacuucagaaggaguaagaagacacacaggaaaaauaugggacuauguaaagaaguaaaauucuaugauuuauaauuuacacagaacagacaauuucugacagaaauuguagugaaagcauuccauauaaacccuuuuuuguuuuaagaaauaucuacuugcagaauuagguuucugaaccagccuuaauauuaguggaaacuaaagacauuggagccuaccuucugucugcucagauguugacauguuagccaauaggaauuucuaaggaguauucuacuucuaaugaagauguuguauuuuguaggaaaagcucaagacuguuauuuuaugaagcugcaucacuguccuggaaaucacaguugggauagcaccauuucuggaucucaaagggcugcauucugugaucacaagaccacuccaugcucuucagcaauaauaaauccacucucaacugcaggaaacucagguaaauauuuacugugaaacaccuuguaagugaugccauugaccuuacauaucuguguucaguggauuuaccauacaaugagguuugucuuuauuuccucaauaugauaaauacauaccuucuuaaguaggaaaacaaaucccaggagaugggaaugaugacauggcccaaaugguauucuaugaacaucuaaauagggaggcagugcuaagaggagguauuaacauauuacuaaugguaaaguuauuuuuguuuauuuaaaaaauuugcagguaucuuuuauauuugaaauaaaauggacaucaaacaaaacugaacaaaucccagaagauggaaaugaugacauaaagugguuuuugccccgugauuuauaccauaggaaaaggcaaugccuuuucuggggagugagggggagauaacccaaaucucugaauguuuccugaaaaaugacaccauuccccaaaguguugguguuccauauuggcacaaucauaggaaaauuauguuuuaugcuuuauuuauuuuucauggaauuuuacuuauugcuauguaucuguccucaccuuuuaaauuauucauuccuuguucuuuuucagaacgucugcagccugguauagcccagcaguggauccagagcaaaagggaagacauugugaaccaaaugacagaagccugccuuaaccagucgcuagaugcccuucuguccagggacuugaucaugaaagaggacuaugaacuuguuaguaccaagccuacaaggaccucaaaagucagacaauuacuagacacuacugacauccaaggagaagaauuugccaaaguuauaguacaaaaauugaaagauaacaaacaaaugggucuucagccuuacccggaaauacuugugguuucuagaucaccaucuuuaaauuuacuucaaaauaaaagcauguaagugacuguuuuucaagaagaaauguguuucauaaaaggauauuuauaucucuguugcuuugacuuuuuuuauauaaaauccgugaguauuaaagcuuuauugaagguucuuuggguaaauauuagucucccuccaugacacugcaguauuuuuuuuaauuaauacaaguaaaaaguuugaauuuugcuacauaguucaauuuuuaugucucuuuuguuaacagaaaccacuuuuaaaggauaguaauuauucuuguuuauaacagugccuuaagguaugauguauuucugauggaagccauuuucacauucauguucuucauggauuauuuguuacuugucuaagaugcaauuugauuuuaugaaguauauacccuuuacccaccagagacaguacagaaucccugcccuaaaaucccaggcuuaauugcccuacaaaggguuauuaauuuaaaacuccauuauuaggauuacauuuuaaaguuuuauuuaugaauucccuuuaaaaaugauauuucaaagguaaaacaauacaauauaaagaaaaaaauaaauauauuaauaccggcuuccuguccccauuuuuaaccucagccuucccuacugucaccaacaaccaagcuaaauaaagucaacagccugaugugua

SEQ ID NO: 191351 - RNA, 83069 nt, Homo sapiens
ggcgcuuuggucgcagcggcgguauggucgccgcaguuucucggucuucgcuucggcgaccuugacccccuugugggugggcgaggcuggaagagaggcuccccaccccacucggcuuccugaucccugggggcgccgggcggucaccgagggccgugugagcgccgcucugccggcuccggguccaugcggcugcgggagaagcccugggcgucggggcuggccugggaggggcccgaguccccuggugaccugggcgcgcggcggccccacaccuuuccguccgccucaucgcggcgcauuucucuucacauccucgggguguguguguguuggugaccggaggaagccugucuaaugacuuuucuggaagcgucguguauuaggagcuccggggccggacugcuuggguccgcaucuccauccaccgcuuacuggcuuugggaccucugcaagucacuucacuucucuuucucaguuucaaguguaaaaugcggaaaauaauagcaacuuaucuccuaaggugguugugaggguugcguggguuaauauuugugaagugcuuagaacugagcgugauacacagcaaaaccauaagugcugcucaucuuuuugagcuugguauauaaaaggagauagugaccuuuucuucucuuuccaacccccauaaauaauugcccaagaguaggaaaaaaggauuuuuuuuucuuaaggauaugggcuuuuugcauagccuguuuaaaaacaaagcuuucuaaacaacuuaguugcacauccuacuuuagagaaaagacaaguguuaagugauggugacuugaaaacuguaaaguuuauuguuuggaaaaccgcaugagaaaaauggccagaacauauuugugcuaaaaagaguuaacauagcaggccuuaagacugcuauccuuagaaaggacugcuugcaauguuggugcuuguuuggcaucugggaacuuagauuuuuggguuugugcugaacaguauguuuuaugccgaaauuaccagcuucuguaaaaauccgggacaccaagucuuuaaugggcuucccugcgcggaaacugcugcauuuucacugauggaggaaggauguguuuuguuugaccccucuugggagggagaccgcauaaggagccuacacgugauuccuccagacuccgcuugugucuuuuucuauuaugaugagccuuuauauccauacugcauuguguaauaaaugucagccaugaauucaacuauauguugagucccgugcauccuaucaaagcucuaaaugugggggagaucacggagauccucagccacaguuuuguaaauuuguauaaagguaagggauauaagugccguuuuuuuacgaggauauauuuccuagugguacugggcuuuuaguguaaccaucaccugaauaauguacauuguguccauuaagcaauuucucauuccucaccccacucccauccuucccagucuccagugcccagacacaauuuugaugauaaaaaguauuggaagcucuaauaauuggacuuuuaauuuugcccuuuugccucaaauggaaauuggaaaacuacagauaaauaauugccgaauucuggguuacuguaccaaaugauucugucuguuuagacauuacauauggcagaaaaaucaucagaaauugccucuacauuaccaaguuaauuuugagucaguguuuuugaaaaaaggcacagguugcuuacaguauguaggucaaaugccugguuuuguuuauuauuuugcuagcauuaucuguguuaaugcucaucuuuaucaagagcuuaucuguaccacagcgagaaaauauaaucaguuucucauaggccauuuucccuguacuuuauuaguuauaccuaucucuuuucaggacaucaaauuuaaauugauggagguagguuugcaaauuugggguuagaaagaucaaauuugccgucugcuuaugucucuuuucccuuauaaaagacuagaucaguuuuugguaaguuaguugggaguuggagggguuagagguuugaggaaagugaagaagauuugaaauggcucuguggauaguauguaaguugaccagaaggugaagugaauaauaauggaccuagucugcuuucuuaagagacuuucucccgacauggagaaaaugguuaauuggguucaucuaggauuggguucugcgagagaggugauguaguccuuaaggcucugcacaaguauuccgguucaccuauuuuuggguacauguaaugcugcacucuuuguacaugggcaaccccucuccaugucugcuugaaguuaaaugugccaugugacuugcuuuaggaagcagcucuccauuugccauuuccacuucucccugcccugcuguaagggucauggaaggacuuguugagaugcagccucuugucagccuggacacuauaggaaaauaugaguggcugaucaggcaaguuggaagaacugggaaguugcugucagagaaggggauacuuaaauuagugauuuuauaagguggaacuguaggggagaguagaugaggaaguuuggagggagaagguagagaugaagugcucaaggaacucagaggcuuuuuacauguuccuaacccggaagcccuuaauuuauugcaacuuaguucaguagugaugaccguuggacuuaaugguaaacuugaaagcucccuuauugugaauuauggaaugaauaaaucaagauuuggaauuuaguacugaauugaaagauucauuaccuugaucauugagaaguaagucagcaaccaugaaaauugcgauguugcuuagccaccaggcaggagaguaaaagguaggccaagcuacucuaacagagacuccaaaauauaguaguuuuaaaaaaugcuuagcuuguaucuaaaaucuuugauaauuaacugaauuuuuaauaaauauaagggauagagguaaauaacacuaugaagaaagagacaaauucagugugagacauuauauaacuuugcugucgaaagaguauucuaugggcccccagcaguggcuucaguuagaagcuuuuuagguagguagaaucucaggucuugugccagacuuguugcaucagaacuuucauuuuaacaagacccucaaggugacucaugcacuggccugaucucuuuaaaaagcuaaagucuuaggcaaguaacagguuggaagaacuguucuguuaauagauuaaaagauacuaaagagacauaaccaauaucaagugcaaaccuugauugaaucuuuuucaaaaaaccagcuauagaagacaauuuagggucaacuaaggaaauuagaauaugauggaauaugagaugauauuagaaaauuauuaauuuucuuagauaugauuacauuguuauauaggagaaugugcuuauuuuuaagagauacaugcugaaguauuuagggaugaacugucaagaucucuacaacuuucaaauaguucaacuauguguauauauauauauauauauauauauauauauauauauauauacacacacucacauacauauaugugucucucuauacacacauauugauauuuagauaaaaacaaacauagcuaauuguuaauagguguggaauugguggggcaccauggcucauaccuguaaucccagcaguuugggaagccaaggcauguggauugcuugagcccaggaguucgagaccagccugggcaacauggggaaaucccaucucuacuaagaaauacaaaaaaauuaucugggcauuguggugugcaccuguaguccuagcuacuugggaggcugaggugggcguaucaccugagccuggggagguugaggcugcagugagcugaaaucaggccacugcacuccagccugggccaucagagugagacuuugucucaaaaaauaauaauagccgggcacgguggcucacgccuguaaucccagcacuuugggagacugaggugggcggaucacgaggucaggagaucgagaccauucugacuaacacagugaaacccuaucucuacuaaaaaugcaaaaaaaauuagccaagccugguggcacacgccuguaaucccagcuacuugggaggcugaggcaggagaauugcuugaacccaggacguggagguugcagugagccgagauccaucucaaaauaauaauaauaauaauaauaguaauaauaauauaaauguggaaucuaauuaguauaugaguguucauuauacuguucuuuuaacuuuuguagauguuuaaaauuuuucaugauaaaaagcuagagugaaaaacccccaaaaauguaguagcuuaaaaagauagaaauuuaauuuucucuuaauauuccagugcuaguuguacaacacagguauagaguggcuuuacuaugcuuggcuuacagcuauccauuuuugauccaguauggcucauccagcuccuacuauuuccuugcuagcagaagggaggaaaggguaaagagaacucauuauccagaagcaauacuuacuccguugaugaaaacuuuaguuuuggucauucaccuggacaucauauauuuagggguugugucuugguucagccugguauagcaaauuauuauagacugggugguuuaaacaacacagacuuauuucucacaauacugggagcugggaaguacagggucaagaugcuggcaaaucuaguaucuggugagggccuucuuccugguuuauagauggccaucuucucguauauccucauguggauacaaagguagcuuucuagccucuuauuauaagaggccagucucauucaugagggcuccaccuacaugaccuaauuaccucucaaaggcuucaccuccaaguaucaucacuuuggggauuagaguucaacauaucaauuuggaguggggacacaaacauuuaguccauaaugguauaguuggcaaaagccaauggaauauaccauguguauacugauuuaacaaagauuuauuucauuucaagugauguuccccucuucuuccucuguugauuucccggaccaguugaaauugaagucauuucaguuuuaauacacauuaaauaaaauauaaaauuuuaauuuugaagacuaaaauguaugaauuuuuuucccucaaucccuucaguaaauaacagaugcgggugaaagauccaacuaaagcuuuaccugagaaagccaaaagaaguaaaaggccuacuguaccucaugaugaagacucuucagaugauauugcugguaaauugugauauauggcaucccaaauaguguugagaagaaauaacaaugcaguugacccuucaacaacauggguuugaacgcugaggaucaacuuguacacaaauuuuuuuccaccaaaccuagauggaaaauacacuauucuugggaugcgugaaaacugcauacuuggcaggcugacuucuaaaugcagauuccacggggcccacugcgggacuugaguaugcacagauuuggguauauguggggagguccuagaaccaacuaccccaccccaccucccugccucaaguaucugagggaagacuguauauguuuuuaauuaagaaaucuguuacucuuuauuuuuacuguuuucugcauaaauauuagaaucaccuuuucuaguuccaaaaaauccuguuggcauuuuuauuaggauuuuguuuaguuuauaacaugaaguaacuuagauuggcuuuuuuuuuuuuuuuggucucuuucucauggccuauuaaaaccaugucaccaagccaccagagcuuggcagauggcuuuugggagcugcuggccucagggcuugguuuucucuuuagccucaugcuuuugauuugggccucugaggauuuuccucacuuucuugcuaguucucuccauuuaaagggauauuuuuaauauauuuuuuccauuuuagguaugcauaguugcauacagcuauacacaaacacacucacauaugagugccuaugucuucugaaauccgaauaaguucuaaggauuguaccaacgucagcuuccugguuuugauauuuuacuauagcagugcaaaacauuaacaucaggggaggcucagugaagggugaaugagaccuccuuguauauuucuuuauaccuuccugugaaucuaaaauuaguucaaaaauuuaaacucuaauaaauuagggacaucagauaagguccuaaugauauuuaaagagauaauucagacauccuucagugcagcaaacuggcuaucgaaacaucaucccauuuuaguacauguauagcuuuguauaaccaccaccaaucaagauacuugacugugucaucaccacucuaugugcuguccauuuauagcaacacccucugccuugcguccauugcucccuacaaccaugaaucucuucucauucuauaauuauguuauuucaugaacauuauauaaauggaauuauauagcauauaucuuuugaguuauuuuguguguucaaucucugugcuuuuuaguuaacagcauuuaauacuuuugagguuugcucaguaaugguagcacuuugguguagcaaagaaaauguugagauuuuguuuuaucuuauucaguagguuuaacuugccaacauguaagucaugcuaucagcgugaaucauguaaagagagcaauagcugagaaucuguggucaguuugcucagaauguuuaaaagaaagaagauucuaugaugggcagcuaguacuuacuucugauauuugguugugccucaaguguggcuuccagguaagaaaaguauuauuuauaugugaguuugucugaaauguuuuccuuaaaugcuuauugugaguuggacuguuggucaugcauaggaguuaagauaaauuuauuccaauuuagauagaaauuuuccaggaaugaacuuaaaaaugauuguuaagguaaaguaaaagguaugcuauguucagaaaguaaucaggugugguuuauaaauacuugcagagguaauucaaccuauuugcaguaguucccauaucuggaccagucuuuaccuuuuguauuuacuuaggaaauggaucuaccuuucagauuaauuuuuuucucucucaaaacagauuauucugcugcuuuugcaaaguaauuuaaaaucuuaaaguuuaaaaguuauugauaucuguaauaaaggaauuuuuuuaaugaaauuaaaaguauauacuuuuuuaaaaaaauaagagaaaucuuuauuauuucacacaaaauguccagaaguaaggccacuucaggauuaguuaauuuaauggaaagaacauuaaaaacugagguuuauucuguuuucugcugugccauccucaaccucaugguuguguuccucuuaaaaaacaaacaaaaaaaaagccuucuggaaagauucagcggauuugacuuccccucauguugcauuaaccagaauugcaucucauuucuuuacuuaccuagugagggaaaucgcuaugauuggucugugucucaguaguucucaguaggcuggggugaaguuguguacgggauugggaaauguguguuugcagaagggcaccacuggccugccaggaugcuggguguuccacagugugcacauuuuuaaaugauagggaaauuaacuuugcccaugauuguuuuagguaaauacuguauauugagcauguuagccuguuggcaagaaauuaaauuuaaugagaauccauauuacuuuuuugaaacuuucuccucuggccugaaauuaaaaacaaaacuuuucaguauaagugugaguauaauuuaaguuuugauuaauuugaaacaaacauuuguaagucauacaaaauaaaauucuguucaucuucagggaugugguaaaaacucagaaagccaacauucauugaagcacuuuaagaguuccagaacagagccccauuguauuauaauuaaucugagcacauggauuauaugguaaguuaaauuuuguuaguucuuguguccacuaaccacagccccccaauuuuuuuuuuucuuuaagcuuuuaagguaaaauauuuaaagauguucuaucagcuuaugguuuuuuaaccugaacacaaucuaugggauacuucaagaaaauuaauauuaccugugaauauaaaauuuaaauuggaaaaauuuuaacuaucucucuacuuuuuguuguuguugagacagagucucacucugucgccaaggcuggagugcaguggcgugaucucagcucccugcaaucucugccucguggguugaagcaauucuccugccucagccuccugaguagcugggaccacaggcgcaugccgccaugccugccuaauuuuauguauuuuaguagagacaggguuucaccauguugcccaggcuggucuuugaacuccugagcucaggcaauaugcccuccuuggccuccccaagugcuaggauuacaggcgugagccacugcgcccagccuuucuacuuuucucuaucauuuuccuuguauaauguaaagaaaaauucuuuuuaguugauuuuuuugguagugaacuugcuaauacagaauucuaguguuguagagaaggaagauacuucaagcagucaggucauuuucugaagggagagggaagagcugggcauaaguagcuuguaaaaacuuuucaggucauucugcuguuuaauccugguugagaaucuaguccaguuuccuauguuaccuguaaggaaacuauguaauauuuaccuuuuugugguuaugaaguaaaaauccagguacuaaaacaaguuuuuuguggggcgugauggcucacaccuguaauuccagcacuuagggaggcugaggugggcggaucacuugaggucagcaguuugagaccagccuggccaauauggugaaaccccgucucuacgaaagauacaaaaauuagcugggcaugguggcgcacgccuguagucccagcugcucaggagguugaggcaggagaaucgcuugaaccugggagauggagguugccacugcacuccagccugggugauagagugacacuccguuucaaaaaaaccaaaaacaaguuuuuuuauuuucuaguuucuuauuagcauaucacacuguuuugguaguauaaauggacacuauguugaaaugcuuccucuguguuuuacaauaauuuuccaacuugaaucuauggacuccuaaggguuccuugaaugaauuuucaggagucucagauuuucuuuaacauaaaaauauuuugucuaaaauuaauauaaggguauuuuggcucacagaagaggucaucaucuuuaauacagccagaaggguugggcaccagcugcauuuguguuuuuauuuguuguugugagucccaaguaguaguacuggggagaaugacgaaagaacagagggaacuuaauauauaaaugaugcauuggaaccaauggagacagcaauggugccauaguguggcaguucaauaaggauuucacuuuaguggucucaaacucuaggugcaucagaaucucagggagaucuuguuaugacagauugcaggaucccagucuuagaaauucuaauuuaguaguucugggguggaggagccagagaauuugcauuuaacaagcucccaaguguugccagugcugcuggucuguagaccacaguuuaagaauuacugaauuagaaaaagguggguaagaagauugugaacauguaauguagcauugguguaaugcauuauguuuuuuuuuuuuuuuuuuuugagauggaaucucacucugucacccaggcuggagugcaguggcgugaucucggcucacugcaaccucugccuccugggcugggaguagcuggaauuacaggugcccgccaccacgcccugcuaauuuuuguauuuuuaguagaguugguauuucaccauauuggccaggccagucucgaacucccaaccucaagugauccucccgccuuggccucccaaacugcugggauuacaguugugagccacuacacccggccauaaugcauuacauuuauaaaacacuuugaacacuuuccaacacauguucuuaaaugaucacuggaucucaugaggauaaaggaaacagguaauuauaauauacagaagaaacaaauuaauacgauguauuaaugaguaaacuuaauugaggguaguuuucugaauuggaaugugcuuuugaaaaugucuuuccuaacccucugccuccaaauaagcgccaagcaaaauagaacagcuauuucuuugagucuuaccuaucucuauauguaaucaagcuagaagccuggcaguuauuuccuucccccuuuuuaucuuauuuuauuuuuuagccuguuaacaaaaguagacagagugguauaaugaauuuaccuauacccaucaaccagcuucaguuguuguuguuguuguuuuuccagcuuuaaacauuaucaacucacagcaagucuuguuucgucuaggccaggauuucucaaucucaauacuauuggcauuuggacuguuaauguucugugauuaauuccuugcugugcuguucuguacguuguuggauguuuaccagcaucccuggccucuacccacuuaaauacaaguagugguccucucaccucucaccaguugucagaaccaaaacugucaaauguccccuagguggcaaaaucacuccucauugagaauaucagugauucucaacaacauugagaaucgcugacauugucucacucacuucucccuacccauggcaguuauuuugacacuucccuuucccuccucuuuuauaucuaauuuguuacuguuucuaccugcaaauauguauauaaagaaugcccauuucucuccagauccucugcuacuauacuaaucuguuucucuuccuaaugcccuccaaucccuccaaucuaguuuaucacauuagugagagugauguuuuuaaaguguaaguuggggcugggugugguagcucacaccgguaaucccaauacuuugggaggccgaggcggguggaucacuugaggucaggcauucgagaccagucugaccaacauggugaaaccccaucucuaauaaaaauacaaaaauuagcugggcguaguggugcaugccuguaaucccagcuacuggguggcugaggcaggagagucacuugaacccuggaggcagaggcugcagugagcugagauugcacagcugcacuccagccugggaaacagagcgagacucugucucaaaaauaaaaaauaaauaaaguguaaguuggaccauaucauggcccugcuuaaaaacccucucguggcauuucauuauaccuaagauaaacugccaaaacuuucauuucaacuguaagucucuguaugaauuguccucugcuuauuucucuagacuuaccugguggcuuccccuuuguauucccucccauguaauuuaaagacaaaaguaacuaaauaccaacuuuguuaucugaugugcaaaauuauugagaauauuuucauaauauuuucuuaaauuuuauacuuuuucagguguuaugaaugugaugaaaaauuaucaacgcauuguaauaagaagguuuuggcucagauaguugauuuucuccagaaacaugcuucuaaaacacaaacaaguaaguuaagcgaugacuaaaggaaucuguguuaaaauacaguauuucauauagaguucauaaauucauaaagaauacuuuagauuuuacugugacagcccagccaauaauuugaauaaagauauuaugaguaucggcugggugcaguggcucaugccuguaaucccagcauuuugggaggccaagguggguggaucaugaggucaaggguuugagagcagccuggccaacauggugaaaccccgucucuacuaagaauacaaaaauuagccggguacgguagcacaugccuguaaucccagcuacucgggaggcugagacaggagaaucgcuugaaccugggaggggaggcggagguugcagugagccaagaacaugccacugcacuccagucuaggcaacagagcaagaccccgucucaagaaaaaaaaaaaaaaauuaugaguaucaugcauucuuagguggccaccuuguuauacguuuauauaaccaauuugagaaacugaaguaugucgugucuagaccaugggcuuugaagucaguccugauaaguuugaauuuaggcuuccccacuuacuggccauggucacuuuuauugcuuaguuuacuuauuuauaaaauuaggaugauaauucugucuuauggaguuacugugaggccuagagauaauauuuucuaaagauuuagcaauagugcauguaaaaauacuugcauaguaccuguauuagucuuuucuuguauuucuauaaauacccgagauuggguaauuuauaaagaaaagagguuuaauuggcucacaguuccacauguugugcaggaagccugcugcugucaucagcucagcuucuggggaggccucaggaaacuuucaaucaugguggaaggugaaggggaagcaggcacgucuuacaugguggaacaggaggaaaagauagacgaggagguaguacacacuuuugaacaacuagaucuugugagaacacacugacuaucaugagaacagcaccaaagugauggagcuaaaccauucgugagaagcccacucccaugauccagucacuucccaucaggccccuccuccaacauuggcgauuacaacucgacaugagauuuggguguggacacagauccaaaccauaucaguacuugacacauauguaugaaauggugucuguuauuuguuacauaauugcaguguaguucugacacuaacuacugggaguuaggccagacuucacaggcuaagggcacaguugcccacaggacugcccucacaucagaaacuagcugcaggcuugaggguuccuagaccacugaauuucugaccaacuguccacaaauuuggggguuccuaccauuucuucagguucagugauaauuugcuagaaugagucagagaacucaggaaagugcuguacuaacaauuauaguuuuaauauagcaaaaaaggauacaaaacagccaaaggaagagaugcauagggcaaagucuggggagggucccaaaugugaagcuucuguguccacuccagagggaaugaggaugcauucuccucacucuccccagcccaugcauucgugugcacuaauauacacaagaguauugguaaccaaggaagcucacuggaguuuugguguggagaguuuuauugggauuucauuguguaggcaugauugauugaaucauuggccauauugauuuaacucagucucuaggcccccaacauucuaaucacaugguuggucuuucuggcagggccaggccccauccugauucaucucuucagcauaaacugucuaggggcccacagugagucaguuuguugauauaaacugucaaauguggccugagggacccaucaugaauaacagacacucuugucgcucuggaaauuccgaggauuuagaggguacuucccaggaaccuggggagaaaagccagccagauccuuuauuauauaacaguaauguauuauguauuuuguuauuguauacuuuguuaccuaacaaauaaauaauacauaacguauguuaagaguguauaggauaauaguuucuuccuccaaaaauaguaagugcuucccacaugccagguauuaaauuuuauuuggucuguaguauuagaguaaaacaaaaauaguuuuaucuugcccucuaggcguuagauuauagugggagcaacaagcaaaaaaugcaaauauauaaugacuucugguaagugcuacaaaagaaaggaacagauugccgugcuggcuaauaauauaguagucacagugaucaagaaaggcuaauauugcagaaacgugguuuguuaggagagagugcaaagagaugaaguuacgagguagaugagcuggucaugacagauacuguaaugaacuccaugguaaggaauuuuuauuuuuuuggaaguguaauagaaauuacuaaaguauuuuaagcagggggguaucacgguaauuucauauuuuuuuaaaaaaauaaagauaagugauugcuauguggcacacagauuguagggaguuaagcauggggguggggagaucaugaagaggguuaaggaggugauugugggggggcaggugagaggcugauagauacucauggggagugaguggauuacauguagugagggagggagagugggaggaauuaaguauuaauacaaaccucaggauuuuuacugaacagcuaggugaauggacgugauaauuuugaguugccuuugaagcagaauugaauugcuuaguagguggcaucagaaacugaaaagcuauauaaaaauauaguugccaacuguguuuucuauagcccaguguacagcuguuuuuguuagccaucacccuaaugagacaguaauggugaaggaacuggaggaggaaccagagaagguaaacucaggcuccuggacagcaguagaagugauucauuugaucacuuaucauuuacuuauucaacaaacauuuauugaauucuguucugcagcaggcauacuagucguagcuccaauucugcucaaauaaagaaccaggaaaauaugguggugaaagacuuguaacacuacuggaacugaaguuggucauaauucugucugcugaaaaaugagcauuaaguuucauuggccauaauaagaagauaggcagggauaugauggcaugggugaugaaaguacaaguuuagaaauuauuuucucuggauuuuuuuuuuaccuuagagauucccuaagguuaaguacaaagccagucugauuuucauucaauuuuacugauuucuugaauaaguauuauaagaaagaugcuaggaagggagcauggacgguaugauggaaaguacauggcuuugagguugggcacgguggcucaggccuuaaacccagcacuuugggagcccaagucgggcagaucacuugaggccaggaaucgagaccagccuggccaacauggugaaaccccaacucuacuaaaaauacaaaaauuagcugagcauaguggcacauuccuguaacgccagcuacucaggaggcugaggcaugagaauuguuugaacccgggaggcggaggcugcaguaagccgagaucacaccacugcaugccagccugggcgacagagugagacugucucaaaaaaaagaaaaaaagacaguagauggcuuugagucagggggucugguguucagauuugacucugucacuaggugugugaccccaggcaguaaucuguuuaugcaagccucauuuuuccuuaguacuuuauauuuccaaggugcuucagggaauagagauugauaagacagucacuaaaucuuuaagaggcuaaagaucugaaagaagguguaagauuaaacaguaaugauaugcaaguagaguaagauuucuguuuuagguaacaaccaaaguccuucaaauauccaaagagggauauaauguucaguuguaggaacuaaaaaggaaucauggaugagccggcuuucaagcugacccuuaaaggaugaacuuugggcaggugaagaugagagaagaaaucauuucagguggugggaagcacuaauauaagccuuaauuguguuuauggaaccgugaauagcaccuggagugguggggcacgggcuuuugagguaguuugagagggaguggagcuuucaaaguuugagagauacauaguuguuaguuuaaggcuuuuggcaguucuagggcaagaugucauuaucccugugggucaagcuacaggaucucucaggcaaguuugauuuaaaauaauauuccuuggcauucuagaauaaguuuuuggauauaauaguuugccauauugugccuuguaugcggcuuccguauauuuuuauaaaauauuuggaaaaucaaauaugaaaguuuuuauugagguuuguaagaaugccggauaugauuuugcacuaaaugguaaucgugaaacauugugaaaacaccuauuuaugauaaaaggaauaugaaacuguauuauuguguuugggugagaggauaaguaugauuuuaaaagguuauuuuuauauuuuuguacuaaguaaaaauaguuauugagaagaaagccugugccuguauguuaaacacauuuugaaguuaugcaugaccagaaauuuucuuucucuuuaaagcaugucauuaauucuuuuguuucuuuauuccuuuacuuuuaggcaucacuauccuaaaaucauauaguauauggguggcucacuccuguaaucagagcacuuugggaggcugaggcaggcagaucacuugaguccaggaguuugagaccauccugggcaacacaacgagacuuggcucuaaaaauaaaaaugaaauaaauacuaugccauguuaacacaaauaacauuuguagaaaagauaacuuucaaaacaaaaauauaaugaguggcacugucuugcauuuuuauaagacucuuaagugucuggcuuaguagaaaacagcuggauucucauaucugcuucugcauuuaauccuuugugauaucacaugccauauggccucuggagaacggcauuguauaauugagagugaaugaaaguaaaaaaagcaaauaaaaucuuaggcuuauuaugaaaauacuuuugaccuuaaguacccuugaaagaaggaaguugucuucugacccacuuugagaagugcugaacuguagcacauuugucuuuauauuuucugucuucagccuuacuuauccauuaaggcucagcucaaauccuacuucuaggaugcuuucccaauccuuaucucuuuuuuggcacucagugucugugcagcacacuuuagaaucuaauaacacacuuuuuugauguuucauauuuauguuuguacaugucuuauuuucucucaagacuguagguuccuuaagacuggacucuggauuauauucuuuuugauuuuuauguggguagacaguaaauacuugcugaauaaaccaaauagaaugugaccaguuuuuguugaggaaguagauagauaagcuuugcacuuucacccuccaaaauccuaaauauuaauaucaaaauuauuuauucagucuuuuaauaucucugaguuucugcuuuguaccagaugcugcauuagauguuggagaugcaguagugaaugagacagaucuacuucuaguuccugucauuacugaucuuuuggucuauugagggauauagacaaauugcacuuaguuauacuugccuguuuaaauagugcugugauggagcaaguacgagggaccgugagaacaauuuggaauaguaccuaacauucgacuggaggagucaggccaauucuauuuagaagaauaauccgacuuaguuggaagcagaagaauaucuagaaauuaucugggcaaaaagggaacagauuguguguuccaggcaaagaaaauagcucauugacgagagcucgauagguucaggcaagucuagacagcugaaaaguugaguuuugugguguagaagauggugagaggugagacuugagguaaguaagaacagauauuuaagggccuuguacagauagaauuuguucugagggcagugaggaaccacuguuaaguuuuaagcagagaaguggcugaucagugauuuuguagaucucaguuugacuuguauggagacagauaggaaugccuauauauguauaacugcccauuuauuauguuaauaucaauuuaucauaugacuaaguaaagauuucuaaggcauaaugguuaacuggaaguuagucgauuuugagaguaaacuggcaagcuaauuauuauuugguuccaagcuaggggaauuguggggcaccaaguugucucuuuuuacucacucuuuaaauauuaaacuucuuuucagcuguagaaaugggcagauuacauuaauacuacaugacugguuuagguaauugcauuaagcaguugagaugaaccccagcucagguucccagaagaaugcuuacagcuguguagauuucacaucugauguuaggauuugcuuauagaaacaaaacucccucuaccucccccuuccccauacauggaauaaaaaggucauauauaaugcaagacugaaaaugggcaaauaagcauuuuugugagucccacccagaaauagguauuguuaaaaaguagaccagaaaacuggagacaguaaaaaaaaaaucagugguugaaagggguugaggggaagaaggggugaauaggcaaagcacagagaauuuuuuagggcaauaaaacuacucuguaugauacuauaaugcuggauccaugucauucugcaucuguccaaauccauagaauguacacugccaagagugaacccugauguaaacuaggaacuuuaggugauaaugaugugucagugcagguucaucaguuacaauaaaugaagcauucuggugggggauguugauaauggaggcuaugcauguguugggguaggggggauauggaaaauccccauuaacguaugcucaguuuugcugugaaccuaaaaccugcuugaaaaaaaauuuuuuuuuuuaaagugggccauuguccucugaaagucucagagauuucucacuuuaauagucuuuuaaaugucaugaaguguucuacaaauauuuagagaaucuaggaauuccugguaaaaucauguaguugaauauugguuuauuuuuugugaaauagaugacugacaaucccauguucuuuucuaaaccaaugcauuuggcucauaauuuuaauauugaugggaugccauuuuuaacaagguuaaagagaagacaaaauacuauauccugcugaauuuauuaagcucaugcuccugguuuacaauagacaugaauuauguggguuuuaugaaguaugaguuugcuguaucuuuuuuuuuuuaaauaagaaaguaaguggugguauguuugggaucugaaacuccaucugaguauaauauuaugaccuguuucaguaacaauuugauuacuauuuaauacuuuaaaaaaaaaggugauacaugcugggcacauguauggcucaugccuguaaucccagcacuuugggaggcuaaggugggaagauugcuugagaccaguucuucaggacgagcauagacaacauaacaugacccuaucucuauuuauuuuugucuguuuuuuuaagagguaauacaguucucuaaagugacagucauguuucuaagaaauuugcauuuucaaaaauaagcacuaaaaaucguuguuucaguguauacaaggggcuagguucaaaaagauaaugacauuuuaaaaacaaccuauuuuuacauauaggguuuuuaauuugggguuccucaucgauacuacaaaacacaguaaaauuauuagagugacuauuuucucaguuuucccaaagaugucacauaacuaguauccuuccagauacauagggagauguuaauugcaugcaguggguaccuaggauguuaggguguuaauuuuuuaaggaaucauuugagaaggacugcuacaaacuaugacuaaaaaagcuauaaauccaaacacaaaacaugugcagcaauggauuacauacagcuuuuacuuaagaguaauggcuuugcuauucauaucaccacuggcauuuuguuagugucuuaaacuacuaucacacuuauaaauugcaucaucuuuauuauaacagacaguagauaauguuuaagugugugaauucugaagcuagacugcccggguuugaaucuucccucaacacuaaccagcaguauaccucaguuucaucuuugaaaugcuucaguucuaaaauggggacaguuaucagaggugacaauuuaagggagauacacucucaaacuauccgacucuaaaugcaaaauaaguucacuucucccuugccuaugggaagaaagggaagaaccaguguuccccacuuuugguuuaaccaaggcaauucacaaauacaccuuugggaaaagaaagacaccaauuuaguauuacuucacaacaaacccacuauugguuguuuucaauuuucuccugugauaaacaaagcuguaucuuuguauacuugcucuuuuauuuuguaggugaaauuuuuuuggaauuucuuggccaaaguauaaauuuugauuacuguuguaaaacugcccucaagaaagcuuguacaaaggguauaguugacaauagugcccauaauuccauauuuaacuuuguuuauaguucaguuuugccauaaugaagcuuuuaaugucauuguugccaggucauuagucuuuucuguuuuuagccuuuggggucaugcuuugaaagucuuugcucuccaagauucuaaagauauucaccuaaaauuugcugguacuuuugaguuuuuuuauguuuaugauuuaauauccuugaacucaguuuuuuuguuuguuuuuugaaacagucucacucugucaccuagucuggagugcaguggcaugaucucagcucacugcaaccucugccucccggguucaaacgauucuccugccucagccuccugaguagcuuggacuacaggcaagcgccaccaugcccagcuaauuuuuguauuuuuaguagagacgagguuucaccauguuggccaggcuggucucgaacuccugacuuuaagugauccugccaccuuggcucccaaagugcugggauuacaggcaugagccaucacacccagccuugaacucaguuuuuaaaaagauaguuauaggaucucuaaguguugaaguaauuuuuaugcuggaaaaauuugagguaauaucuuaaguuuuuuuuuuaaaguucuuagacaaguuguuuuguuguuuauguuguuuuguuuuugcuuugcugguauuucagccaguuuugucuuugaagacuugagguacaugcaaaaccuaucaguccucaaucagcuacuuuuugaggacucagauuauaggcuuaaagguaaacuacagagauguacaagagcuuuaaaaacuuuaaagugccgaaagugugcucucaauguucuuugcauuccaggucuauauuaucuuuuuauguaaaggaugacaguguuaguaauauagaagugauaaguagaguaaauuaaauugcuuuuauuuuuuauuaguuuugauuuauuucccaaggugagauaaaucccuuuuaauaaaauaaccuagccuggaaacuuugugauuaccuuuuugacuaugcagaccacuuuuuuuguagguguggguaaaacuuuaggagaacaaaagaaaugauaauaaaaauuuuguauaguuugucuuuauuguuguagcaacuuuguccucuuacuuauaucauacuuaaaaacaucuugaaguucauuccuuauuguauuugguucuguguuuauaaaggaagaagagaauuuuuaauaucaucuaaaauguuugcacugccagauugaaaaaugcuuuguuaucucugaaaacaaaaugaucaaaauaguucuucaguagaagcuauaagcugcuuuuuauuaaaacauacaggccaggcgcaguggcucgugccuguaaucccagcacuuugggagguccaggcagguggaucaccugaggucaggaguucgagaccagccuggacaacauggugaaaccccaucucuacuaaaaacaccaaaaauuagcuggacauagugguggacgccuguaaucccagcuccucaggaggcugagacaggagaaucauuugaacccaggagguggagguugcagugagccgagauugugccauugcacuccagccugggcgacaagagcaaaacuccgucucaaaauacauacauacauacauacauaccugcaugaaugucaaguaauugagacugauucagacaucccuguuuuaaacuagaauuguaaacucucaguugacagcuucuuaguaaacacaugcacaacaaguauauuuagugucuaaacguuuuccugagauauuacaguuaucauaaauuuaaggcuuggccgagugugguggcucauguuuguaaucccagcacuuugggaggccaaggaggguggaucaccugaagucaggaguucaagaccagccuggccaacguggugaaaccccaucucuacuaaaaauauaaaauuagccaggugugguggcaugugccuguaaucccaguuacucgggaggcugagacagaagaauugcuugaacccagggagcggagguugcagugccaagaucgugccacugcacuccagccugggcaacagaaugagacuccgucucaaagaaaaaaaaaaaauuaaggccuaaggucucugcuguuuacuaguuuacuauguaucaauucuuuauacuccagucauaaauaagaaauuagguguaaacaguuauagugguucauauagugccugauacacaaagggcauugauaaaucaauuuaaauuguuacauuuuguaaauguacuccuuaguaaaauuuaagacuuacacuuuuauuuuaaguaaaacacuuaaauagcucuuagaaauguuauucuggccaagugcggggccucacuccuauaaucccagugcuuugggaggccaaggcgugcagaucacuugaggucaggaguuugagaccagccuggccaacuugaugaaaccccaucucuacuaaaaauacaaaaaguuaggcaugguggcgcaugccuguaaucccaacuacuuaggagacugaggcacgagaaucacuuguaccugggaggcggagguugcaguggagcugagaucacaccacugcacuccagccugggagacagagcaagacucuaucucaaaaaaaaaaaaaaauucuauuuucuaguuaaauuaucuguuugauagcguaguuaauuuuuaauauuuucucacagacuuacauguaaaagucaacaaacagacccuuggccacuugugugaaguggcuauuuaaccaugaaauaaacucuuuuuauugccacugcccuguggguauguucuuucuggcagugcuguccauauuugguggcuaugcauggagagccagguggugcugaaaagcaucacacagugaagcguggauauaucuugguuugacauuugucgucccuuacugcugaagggagggggaaaaucuguuuuuccauauguuuaugcuuuauuuugccugcaguuuuguccagauggucuuaugaacauuguuuacuuugggaugccaucccagauguuuugaaaacuguuggauaaauguggcacacagauacauuugcauauuaugguuuuuaaaauguuaugugucuuugcaagauuaaaauauaauuuauuucuaggaguauuuucccaagugaauaaugugucuguguauauauguauuuuuuaauguuuuuuaaaacaggcccaauaggcgucguguauauauauuucauaaguauauaaaacauauauaguuauuaucuauagguuauuucuuccagccauucuguuuucauguuaauaagcuaaaaaauauuguggcaacauuuauuaagaauguuaagucugcuucauguuuuggaagaagccaaaaaaaaaaagauauuuuugaggagucauauuuguuuaggguugcauauacccaaaucuguaagaaucuugaccuacugucuuuuauaauucuucucauuguacauaaaucacugaagagaauuuaggugguaaaaugacaaugaauuuauaaucagaagauuaucauugugaccuugggcauaucacuuaaccuguuggagacugaguuuuauaaauguaaaaucagaguuaacagccugaaaaaauugaguaaugcuuggauuuaauuucucucucaucuuaaaucucucaaaaaucacuaugaaaccaccuuuuggcaacagcaauaaugagagucugaacccauccuauucuagguucuauuuacagucucagauauaaacaagaagcagacuguucugucuguaaacccagccagcauccauaucaggguuccucuuguuuguguagugcuucuuaaguacugacuggcuuuuuucauuugcuuuuauauucauuugaaaacuaccuggccucuucccccuuuucuuuuuuccaugccugguguuuguacuucagugacccacuucauugauugugcuggccuuugcccccaagcucuagugugggguuuauuauuuauuauaauauuuggaggacaggaaaagagaccuaucuugcuaguucuuuucugcuuuaccucaggauucuggaguugggaguuaaaaauagcuccuuaauaucugaacacauuccaauaacaaccaauaacauuuaaagaauaaaaaaaacaggaauagggggaaaccaguuaauagcguuuauaaaaacuauuguagcacaggauaaaaguuguuagaacuuaaagaaaacuuuuuuccaugaaauagguuugcuuaaugaaagaaacaucuucugcugggcgcgguggcucacaccuguaaucccagcacuuccugcuccuuagaacagggccacucccacucggguucaucuccuuuaauguuguuuacagaaguggggcaggugucauaauuuauuuccucuuaagaacuugucagagacguaagaagcuaacccacuaguucugcuguuuaaucuugcagauuuuuauguguuucgaauuuuuauuaugaacaguccccccagugcuguaccccuuuggcaggaagagcaagaguaagagauguuccccuauuuccaucaaucagccaaauauuuauaaguuaauuaguaaugcaaggcagcaugucaguauuaggugaaaaaaacauguaauuguaaagaacuauaaaaucuaagggcuggcuggcuacgguggcucacaccuguaauuccagcacuuugggagcccgagguggguggaucacuugaggucaggaguuugagaccagccuggccaacauggugaaaccucuucucuacuaaaaaaaaaaaagaaaaaaaauacaaaaauuagcugggugugguaguaggugccuguaaucucagcuucuuaggaggcugagacacgagaaucacuugaaccugggaggcggagguugcagugagcugagauugcaccacugcacuucagccugggcuacaaagugagacacuguuuuuuaaaaaagaaaaaaucugagggcugaaaggaauuuaaaagaacaucuaguuaaaacuaaagcauuucagaacuugggaauuucuuaucaaacuucaaauuaucauaauuuugauucagagaguaaucugcuaaauacauguagucaaccaugucaguaaauguuaggaauuguucuuuguuuucauauuaguaaacaugaacugauaauauaauuuucuuuuuuucuuuugagacagagucucacucugucacccagacuggagugcaguggcaugaucucagcucacugcaaccucugccucucagguucaagugauucucaugccucaaccuccugaguaguugggacuacaggcuugcacgcaccaccacgcccagcuaauuuuuguauuuuuaguagagacgggcuuucaccaucuuggccaggcuggucuugaacuccugaccucaagugauccaccugcuucagccucccaaagugcuaggauuacaggccugaggcaccguggccagccuaauauaauuuucaaaucugcauuaauuauacaaaucuguaagcacaaaacaugcacuuaugugucauauacuuagguauuuuacuuuuuguauuacagugugguucuguuuauuuuuaaaaaacuuuuaauaugaacauuuucaaauucacagaaauguugcaagaauaauacaaaaauugccacuauaggauggugauuuuccuaauucugucauuucuucuauuagcuggcauucucuuauaaggaagucucuucccuacuuuuucucauuuaaaaaaucuguuaccaauucagauucauucugugaauaauaaucuauuauacuacccuuacuuauuuuuaugaucaaauuaucugaauugaacgagcuggucaaaaucccuguguauuuugacuuauucccaaucacacauuuugagcacuuccuuacucucuggcauggcaaaauguuauggguucauuuugcaucuuugcuacccuggguuaagaaucagccuuuuccccuagacguccuuauuucuuuucauggguaaugguauuuagaaguuagaccuuuucuacuuguucucgacuguucuuuuacauuuaguuuuuuaauucaucugcaauuuauucuguaauauagugugaggugcagaucuguauacuaaaguuuaaauuaauuccucuagcaauaaaauauaaaaccaaagauaguuguguuuauauucuuccccuucaggaacacugauucagggagauaaucuuauuuaaauuuaauuuuaaauaauguauauaaauuauguuaagugacauauuuaucuuuacaucuugugucaguuauuuuuucucuaacuuguaggugcauuuucuagaaucaugaaacuuugugaagaaaaaugugaaacagaugaaauacagaagggaggaaaaugcagaaauuuaucuguaagaggaauuacaaauuuaggaaauacuugcuuuuuuaaugcagucaugcagguaagagucaucagaaagcuuuguaauauguaaaagauucucuuaauuuauguagucauuggcucaccuguagacugucaaaugacugcuaaauguuccucuagaaauuucucuguuuuccuuuuguuuacgcuaucuugggccaucaccauauguauacauguaccuuauuuucacacagggcuucugaaaggucuucuguguauuuuaccauggcucuaucgguaauagugaccuuuacuaaauguaaaauguacucaacuaaaucuuaauauuuuuugaaauagacacuuuugcuaugcuagaugaaauuugagaguguauuccauaaaaucagaggcauauuuuaacugaaucugaagacuuuaauuuuguuuucuuuuagaacuuggcacagacuuauacucuuacugaucugaugaaugagaucaaagaaaguaguacaaaacucaagauuuuuccuuccucagacucucagcuggugaguaauaacuguuugaauaauagcugcuuucagaugagccacugauguuaccaaaaucucuuuuccuaauucgcagaucagucaacuaagauaguagccagggggcuuaaaaauaauuuaaaagcauucugugaaaauaaucagauuuaaaauuucuaaaaucauaacuuuaagguauguuaugguuccaauaugccauggaucaaauaauaaaaagauaucaaggcagcuuuaaaauaaacauacuggaagaaacaaaagaggugugacuucuauugagcaaaaugccuauaaccccuauuuuguaguuucuggugacauuuguuuaaauuuagcauuuuuguucuuuaaagaaagaugaaauuuuaauagugagcaucuaaagguuuuuuuuuugagacggggucucgcucugucgcuggagugcaggcuggagugcaguggcgcgaucucagcucacugcaagcuccgccucccggguuuaugccauucuccuaccucagccuccugaguagcugggacuauaggcgcccggcuaacuuuuuuuuuuuuuuuuuuuuuuuguauuuuuaguagagacgggguuucaccauguuagccaggauggucuugaucuccugaccucgugauccacccgccucggccucccaaagugcugggauuacaggcgugagccaccacgcccggccacaucuaaagguuuuuugaagccuagccugaugauagauuuuuaagcuagugagaaagaugaaaaaaagagcagccccugauauucagaagcuggccuggcaccaacaguuaggccauguuauucagauaaucccacagaauaacaaucugauaguagguuucucugagacuacgaugaaauaagacaaagcaaguccacuucaugauuuugucuaaaacaagaucacuuugccauuuagaaaaucugaaacacccuccuucagccaaaaugagaaaugaaggaaugcuacuuuacuaguuagagauuuauccucauuuuagucucccccaccaacugccacaauauguaagauuuauugagaugucccaugauagaauuagccucgcuuucugagggcauucacucuagaguaaaccucugcuuccugaaacccaccuucagguuauucaaccagagccuaaauccuggguagguucuuuacagcacucucuuacuaggacacccugugguuccccaugcugcgugaucucccucacugccacaaguaauaaacccaccuaguucaacgauagguguguuucugauggacuuuggcugggagguguugauacuaguaaggauaauuuuagugagaaauugaucagccuguguguguguguuuguguguguguguaaguguguaagucagaguauauguauagcucaugaucugacuuuugaaaacaauuaaagaguucuaaaaaugcuuagcccucuaaacaugcuuaguaaucuuagauuguuuuucccaguaggcacuuuugaaagacaguauuguuuuauauauauaucuuugaaagacaguauuauuauauauauaacauacuguuauauauauauaauaaccuccuuuuuauauauauauuuacauguaaauguuuaccauauauauauguauauauagucgaaaagcagccuguaaacauuuguucagccccuuaaaaauuuaaugauagauuccaaugcccuauucuaaauaaaguguagugagauccuuaaaacuacuaaagggaaguuauugccuagucauuuaaaaagaccuguuaaaugugauuuccuguuaaaugcgauuggauguugaguuuaaauauuugacaugcagagcuguguuucaggauuacuauauggcaauuagauacuguaguuaauaacuuuagguuuguaucauucuaacaggguaauuuugaaucuuauaucuuagguuuuuagggcauaaaguugaccugagcuguggcacuguucuuugaguugguuacugcccuuugaaucaccaguuuaucuuugucuuuugucuauauaccguuuauuuuuuuauuuuuauuuuuuuaccuuauugugcuggcucagagcuccaguaacauguugaauagagaugaugggagcagucagccuugccuuaaucccaaaauuaggggaacaaacauucagccuucucccauuauuacauacgaagguacgauuuucagagguguucuuuguaagcuugaggacauuccuuucuauugcuaguuuucugaaaguuuuaucggaauggauguugaauuuugucaaaugcuuuucccacaucuauugagaugaucauaugguuuuucuucuuuauucuguuaauguggugaauuacacugauuccuuuuucaaguguuaaaccuauccuguauucuuguuacaaaccccaguuaugauaugcuuauaugcugcuggauucaauuuaauauuuaugcgcauaucaacaguguguguggaaaacuuuuuauuuaaugaaaauauucuuuaaaauguauauuaugaguguauaacuugaugaauuuucacagcuaacacacuuguguaacuaacaccuugcucaaguaacauuaccagcaucuggaaggccccuucaacucccccccacauucacuacuucccuaacccacaugaguaaccacuaaccugguuucuaacaggauagauuaguuuugccuguuuuaauacugcauauaaauggaaucuuacuauauacauuauuuugcauuuggcuucuuucugucaacauuaugugugaaauucauccuucuugcguuuucagcaaacuuuuguuuucaaaguuuaaguguauuuuuuauuuuuauuuuauuuauuuuuugagauggagucuugcucugucacccagucuggaaugcaguggcacgaucucggcucacugcaaccucugccucguagguucaagcaguucucuugccucagcuuccugaauagcugggacuguagaugcgugccaccacacccagcuaauuuuuuuuuuuuuuuuuuuuguauuuuuaguggagacaggguuuugccauguuagccaggcuggucucaaacuccugaccucaagugauccaccugccucggccucccaaaaugcuaggauuacaggcgugagccacugcgccaggucuaaauguacuuuuuaaaacuaagguuauuuccucaucucauucugaagguuuuuuauucugucuaaaaaauauuuucauugagaaaagggaagugcaacuugguacuugaaguuuaaaauuaccuuagauuuuacuuuugacccuugagguaacuuucaguuaacauggcagaaaacacuuuaaaaaaaaauagacuuuauuuuuuagagcaguuuuaaguuuacagcagaagagaaaacacuuuuuuuuuuuuuuuuggagacagucucauucugucacucacacuggggugcaguggugccaucauggcucauugcagccugggcuuaagggauccucccacuucagccuccugaguagcucggacugcaggcacgugccacuacacuuggcuaauuuuuaaauuuuuuuugcagagacggagucucccuauguugcccaagcgggccuuccacucugggcucaagugauccuuccaccuuggccucccaaaguguggagguuacagaugugagucauggcauccagcccagaaaagcacuuuugacauucaaaagcuauggaaggccgagcaccauggcucauuccuguaauccccuagcacuuugggaggccggagugggaggaucacuugaagccaggaguuuaagaccagccugggcaacaaagugagacccccccucuacccccgucucuacaaaaauuuuaaaaaucaacuggauaugcuggcauucaucuguagucccagcugcucaggagguggaagcaggaggaucacuuggguccaagaguuugaaguuacagugagcugaccgcaccacugcacuccagccugggugacagagugagacuucgucuaaaaaaaaaaaaagaaaaaacacaaaagucugucuugaguccucuguaauuuugacugggugugguggcucaugccugcgaucccagcuacuugggaggcugaggcgggaggauugcuugagccuuaggaguucaagaccagccugggcaacccugucucuuuaaaaaaaaaaaaaaaaaaaaacuauggaaaauuauagccuguccuuucugugauuauaguggauuuuuaaggauaguuguuauaaaauacauauguaacaguuauuucaugaauauaggaauaggacaauauauucaauaguuaucuuggaagauaacauucuuuuuuuuuuuuuuuuuuugagacggagucucgcucugucgcccaggccggacugcggacugcaguggcgcaaucucggcucacugcaagcuccacuucccggguucacgccauucuccugccucagccucccgaguagcugggacuacaggcgcccgccaccgcgccuggcuaauuuuuuguauuuuuaguagagacaggguuucaccuuguuagccaggauggucucgaucuccugaccucaugauccacccgccucggccucccaaagugcugggauuacaggcgugagccaccgcgcccggccggaagauaacauucuuuaaugucccaaguuuauauuugggaucugcuuucuauuccuuguccuuuaggagaaaguguuauugguggggauaguacuuuagaaaccagauuucgaggggaaaaaaauucuagaauuaaauggguuaauccuucacccaauguuagcugcuuuugucaagcuuuaugucucuccccuuuaaaagagggagauguuaugcugauuuuguuacaugauuccacauuauuacuuuacuaguaaaauauuuggggaaaagaaagguguauaauccuacauuauacacaaauaaucauacauuauuuacuagcaaauaauguaugauuauucguggagugguacaaacauuaaguagauuagugauuuuauuuauaggagagugcauuaaaggacagugacaagcaacuaaagauuggugauaucauuugaucuaauaguuuuauuaagcaaagggcagaggauaugaaaauaccuguguuuuucaaggcagguauucuguuuuccauuuuuauauauuuuauuuaugaaauaauaaaguuucuuaauacaauugaggcaauuuaguugguguuauuuaagcagaguguaacucacagauuuuuaauauguuauuuuuaaauuguacauuucugacauagaguugaucauguuuuuaaaggacccauuggugguggaacuuucaaggccuggaccacugaccucagccuuguuccuguuucuucacagcaugaaggagacugaaaaaggaccacuuucuccuaaaguucuuuuuaaucagcuuugucagaagugggugcaucuacauuuaauauaaauaauuaugaguuacaaaauacuaauguauucaucauuuaacaugaauagucguuuuuacuguaacuuugcucuuauugcccugacuaugaagagaacuaaaauuuguuacagcucuaugcuuuaugaaaauuauaucucaguccucagaagaagcagcuuauccucauauauaaggaaauggagacacagaaauuaaauggcucaccuagucugagugaaaagcugagaaucaaauggagaucuguccugacuuggaugccuauguuguaauaccauaaagugagaaaaccauagaguuguaaaaucuagaaaguaccguaagauaacaucuaaucuagcuuucuuauuuuaaaagaugagcugugaggcaaauagaguuuaagugaauuucucaagguauuacaguauguuuaaaaaccaaauccuuaugugccuggaaauaaacacauaaaggaucugacuugacuuuaaugcauucauguauucauuuauauaaaaaauugagagcuugcuuuuuaugagguacuugcuacaauucagggguacacaacauauauugcgucacaaaugcacccuguccucauggaacucacaagcuaguccaguccacaauuacuaaaauauguagaaggaaaauuauuugaauaugagcuuguguuuuuguauaucuauagacuuuaaaaucucauuuuaauuaaaacuaguaaugaaugccaugauauuuuaaauauaguccaaaauagagggcuuaguguauguuucauuugguuggcaaaugauguuucuucaaagccugaggaccaaaaaaaccugcaaaauucucagaggcaugagugucucacagaguuaaaaaguuuuuagcacagccauaauaaagaaugaaaucauauucuuugcgacaacauggaugcagcuggaggccauuauucuaagugaauuaaugcaggaacagaaaaccagauaccacauguucucauaaguggaagcuaaacauuggguacucauggacauaaagauggcaacaguagagaguggggauuacuagaggugggagagauugagggaggaaggguugaaaaacuaacuauucgguacuaugcuuaguaccugagugacgggaucauucguacuccggaccuuugcaucacacaauauacccagauaacaaaccugcacauguaccccuugaaucuaaaauaaaaguugaaauuaaaacaaaaaaaguuacuaggucauuguaugcuuuagaaauuuguuucugacuuugccagaaauaacuuguuuuguauaguuuucuuccugguuauaaagguuuauuaacauuuuaaaaauuacuauuaaaauaaugggcacucauagauaaaaauucaaacuccucucuaucuuuacuccucagaaguaacuauuaucugauucuuuccaaaagugaucauacauacacagacauaugcaaauuuuuugcaacuugcuugauauauuuuauacaucuuuccauguuagcacauguguguauaacuuacucaguuuuguaugaauacacuguacuugcggaaguacaucuguaggauaaauucuuagaauaacuagaucaaacauuauuugaagauuuuuauguauuuuuuguauuuuuuaggagacagggucucgcucugugcccaggcucaagugcaguggcccaaucauagucgaauuccugggcucaagcaugccucccugcucaaccucccaaguagcugggauuacaggcaugagcgucauccaugcuuggcugaaaaguuuuaaauugccuuuuuuuuguuuguuuuauggcguuuacuuuuaaaagaaguauacauuagacaaauauauuuuuuuaaaaucaaguaaagauuuaagccacauguguuuggguuuauuucugaacuauauucuguuucauugaucuacaugucuugucuuuaccccaaagccuacacugucuugauuacuguagcuucauaguaagucuugcaauugaguagcauaaguucucaaauuuuggucauccuuuucaaacuauucuagguccucuuuuuuuuuuuugagacggaguuucgcucuuguugcccaggcuggagugcaaugguaugauuuuggcuuaccacagccuccaccuccuggguucaagcaauucuccugccucagccugggauuacaggcgcccgcuaccacacccggcuaauuuuguauuuuuacuagagaugggguuucuccauguuggucaggcuggucuugaacucccaaccucaggugaucugcccaccuuggccucccaaagugccaggguuacaggcgugagccacugcgccuggccgguccuuugcuuuuuuauguaaauuauagaaucagauugucaguugggauuguuuugaauguguagaucaauuuggggagaaucaacaucuuaacaauguugaaucuuuucauguaugauaucuuaccaguuuucuaggucuuugauuuuucucaucaaggguguauaguuuucagcauacaaaucccgcacauauuuuguuagauuuaucuuaagaauuucauguuuuuaugcuauuuauuguaaaugguacucuuuuuaaagaauucaauuuccaauuguucauuguuaauauacagaaauacaguugauuuuuguauguugaccuuguuucuugcuacccuacccaacuugcuuuacuaguucucuuagcuuuauguugauucguugguauuuccuauguagacaaugucauuggcaaaugaagauuguuuucuuucuuuccaaucuguaucauuuuauaucuuuuucucauuuuauaucacugucagggacaaccaauacauauugcaauaggacucuucuuggaaaaaaaaugaaaaaggaccaccaauacaauguuagaauggugaaauaggcaucuugccuuauuccugauauuaaagggagagcaugcagucuuucacacguaagugugauaauaacuauagaguuuucauacaugccuuuuaucagguugaggaaauucccaauuauucuuaguuuuucuuuuuucugagaguucuuauuaagaaauggauuuuuuaaaaaugcuuuuucuguauccaaauaaucuuuuuuuuuuuuuuuuuugucuguuggaauaguaaauuguauugguggauauucuggcuagcuuuaguaagguauaugugacauaaaauaaauuguacauauuuaaaguguacuacuggggccagacacaguggcucaugccuguaaucccagcaguuugggagccaaggugggagaacugccugaggccaggaguuugagacuagccaggacaacauagggagacucuaugaaaaaaaaauuagccagaggugugauggugcacaccuguagucccagcuacucuagaggcugagguaggaggaucacuugagccuaggaguuuugaguguucagugagcuguuaaugucauugcacuccugucaccccugucucucuaaaaaauaaaauauacuauuggauaaguuuugacauaucuauacacuuuguguauguguguguguguguguguguguauauauguauauauacauacauucauucaauguaaugaauguauccaucaccccccaaaguuuuguugggccccuuuauaaucccuuucucuagaaccucuccccuaaacuccaucccugggugguauaccccuuaccuguuuuuuuuuuuguuguugcaauagauuaguuugcauuuuggggaauucuauagaaauggaaucauacaggguguacucuuuuuuuaucugacuuccuucacuuggcauaauuugugguuuauucauauuguguguacaugaaccagucucuugaaguuucuguuauaguggugauuaucacacacuuugaccacuugugaugagccuuauuugggagcaaggucuucaacuuugugguuuuuguuuguuuuauuugguuuucugcuucugcauuaguucacuuagggugauggcuuucagcugcuuccauguugcuugcugcaaaggauaugauuuuguucuuuuuuauggcuguguaguauuccaugguguauauggaccacauuuucuuuauccaauccaccauauaugggcaccuagguugauuccaugucuuugcuauugugaauagcacugugaugaacauagaaguggauuaaauuucuuuuucuugacagucuccuaauuuaugcuuguacauauauuuuucucucaugccuugagguuuuuaaaaguccucuccucuuucucauggcaauacuuuuacuaaaguacauuuccugggaauccuuaggguuccccuuauuuugaauaggcugaauauuuucauauguuuggugauuuuuaucuuuuaauccuuuaauagguuugaaagucucucuugauauggguagcucagauaggcuccaucauagagucuagaaaucauccuaugauuuuuuuuugcccauuccuagguuaaaaaaaaaaaaaaaaaaaaaaaacaaaucuaaguuuauuaaauuuucuucagugguuuagaaggcaguaaauaguuuuugcauugguugagaaggagcuauaggcagagacaugguggaggcaguuucucuuuguucaggaaugauuuccuccuugugugucugcuuugaaagccauaaacugcccccuccuccuaccuaccacuuggcuagugaagaucucugagggauucuccuguucccuccucuagucaucugcuacuucacuggccuuccuuggaguauacagcauaaguauaggguucugcaguuucugccucuccugaugccagcuguggagguccaaauaggauuagaauauguguccaucuugguuucuguccucaucucuaaucuaggagguggguucuguccaccaagugcagguagggaagcccaucaagguaauaaaguauugucagcauguugcuaugugcugcuaguuagcaagaaugucuggagugguguuuccucuuacaggcuggauugaugaccgguuaauguuuuagcagucagggacucacuuucuuuguauuauuaggauuaauauuuauccugagauaaugaagaauaaugcugaaaguacugcacuuggccgggcgugauggcucaugccuguaauuccagcacuuugagaggcugagguggguggaucauuugaggucaggaguucgagaccagccugaccaacauggagaaaccccaccucuacuaaaaauacaaaaauuagccgggcacgauggcagguguggccagcaacuguagucccagccacucaggaggcugaggcaggagaauugcuugaacccaggaggcggagguugcagugagcugagauugugccacugcacuccagccuaggugacagagugaaacuccaucucacaaaaauaaaaaugagauaauaauuaaaaauaauuaaguacugcacucugucaaaagaccuguaguuauguuaguggcacuuagcuuguucuucgauuuucucaagcauaaaguagaacuuauauuaauuauaaauuccugaacagugcuguuuuguauaucacaugagauauguuguaaauaucauaaauaguuguaaaugugucuucuacuauaauauauucuaauuauuuuguauuuugacagaauuauuucuucaucuuaggucugaacacuuucuagauuuaauacuugucugcacuuaaggcaaaauguucauuuuagcauagaguuuacuguagguuacuuuuuaaaguuacugaaaucaaccaaauauuuccuaugucagugucuccaugaauaguaccugaucuuucuauuaaguuaauacagaggaaauuuaauuaucaaguccuuaaaaaacauauucacagggagaucaacuuauaguccuuuauaugaaauagaaacacucucuugcuuuccuuuugguuaagguaggaagauaauaaaucacaguggcuuggguuugaauacugguuuauuugcuagcuguaugaccuugcaaaugauuuaaacaauacugcugaguccucauguguaaguuggagaaaacaguacaucccaacaaaguuguuggaggauuaugccugaacaugugaaaaacuacuaguauugugcuuaacauauaguaguugcuuaauaaaugauagccauauucucagugcacacuuaagaucacacccuaauuggaccaguaaucacauuucaucuauuuaguuggaaaaguaguaaacugugucuuuaugccauuuuguguguguggguguguguuuugguagagaacgggguuuugccuuguugcccaggcuggucucgaacuccugagcucaagugaucugccccuuggccucccaaaugcugggauuacaggcguaggcugccgcacccagcuaauaauaugcuauuucaagugcauuuagagaagaguguugaugaaccauggaaugauuauucuuuuuuucuuuccucuuuuguuuuuaaaucacagggcaccucgauuuaaagauuuccagcaacaggacagucaggagcuucuucauuaucuucuggaugcagugaggacagaagaaacaaaggucagguuucuuuauguauaucauguauucucuucaagaagaggauacaaaacuaagggauuauuggggggccaaggcgggguggaucaucugaggucaggaguuucagaccagccuagccaacauagugaaaccucgucucuaauaaaaauuagccgcgcaugguggugcauaccuguaauuccagcuacuuggcaggcugagacaugagaauugcuugaacccaggaagcagagguugcagugagcggagaucccgcuacugcacuacuccagccugggugacagagugagacucugucucaaaaaacaaacaaacaaaaaaacaacuaaguaaguaauuucuauuacaauuuaaaaguacaguugagaaauaauuuaauuuuuuagaguaaauauucuagauauuuuuucuuucuucuguaagauauuuaccuuuauccuuuuacagcccuauuguccuuuuuaguuaauguccuuuggcuguaaauaaaauaauuuaaacuagcuuaaguaaaaaggaauuggggccaggcaugguggcucaugccuguaaucccaacacuuuggaaggcugaggcagguggaucaccugaggucaggaguucaagaucagccugggaaacaugcugaaacccugucucuacuaaaaauacaaaaauuagccaggugugguagcgugugccuguaauccuagcuacuugggaggcugaggcaggagaauacuugaaccccaaggguggagguugcagugagccgagaucgugccacugcacuccagccugggugacggagugaaacgcuguaaaaaaaaaaaaaaaaaaaaggaaucuuaagaugcagggagauauuauuccugggcgauagggggauauaggaacaggaaagcugucaggaauccagaaagcauucuucuuauuauccuaguuucucuggcucuguaaauuuucuucauuuuucuccaugcagaccaagcaguauuuguaugucauaguuccauguauguaaaaacuauacuggcuauucaugauucucaauuuuuaaauucccaguagacagaaacuucauuauuccauguuggauuaaauuccacucauggaucaguuguuuguggcuaggagagaggagucccagccucuuagaugagagagcauuucucagaaaaggaauagccuguggacuggauagauuccccaguguugauuguaggccuauccccuaacugauaggcucuuuauugacuuuaacguuaaauuaguuaaauucaacuucuucugggagggguuuccugugcacauaggaucaguuuaucagagaaaaugcaagauauuaaggauaucagauacacagcacacauucuccauuuuccucccucuuacucauagaagacauugcugaucguuccuaacaguccaggugaguuuggguucagccucagaauuauuuucugagcacaccauugugggcagcccuugucagucauaauuggaguaauaggugaaaaccuguuuuccauucaaggcaaauauacuucuuaaucuauaugguaauauguaauaaaagcagccaaguguucagugaagugcauaugugcuugugauaaguagugcuaggcaagauggaccuuccuuuuuuaaaaaaaauucugccagauaugguggcucaugccuguaaucccagcacucugggaggccaaggugggcggaucacuugagcucaggaauuucagaccagccuggccaauauagugaaaccaugugucuacuaaaaacacaaaaauuagccaggcgugguggugcacaccuguaaucccagcuucuuggguggcugaggcaugagaauugcuugaacccgagaggcggagguugcagugagcugugaucgcaccacugcacuccagccugggcaacagagcagagccuaccucaaaaaacaacaaaaauccuguuuuaauuguaguguggcagugucucuuuacuccuagugaccaguuuccagugaagagaaaauuagaguucuaauauuuucuuuaaaguuuccuuuaaaaguaaggauugaguuaauuacucucuccugcuauaaaacaucauguaucacaauccuauuuuuaauugucuguuuauugacuuucuuauuaagcuaauugaauucagcuuuuagaggugucauuccuuuucugccaccucucuacuuuuacauauuugaucauaaacccuaccacuuucuauuuagauuuaugucccuaucugucagcuuucuuagauugugaucucuuugaggaaugguacuauguauugucucuguccugugugccuugcacauaguagauguucugugaauuuguguguguguguguguguguguguuuuguuuuuuuuguuuuuuuuuugagacagggucucacucugucauccaggcuggagugcaguggcaugaucucagcucacugcagccucugccucccagguucaagugauucuccugccucagccucccgaguagcugggauuacagggugugccaccauucccagcuaauuuuuguacuuuuaguagaaaugggguuucaccauguugacuaggcuugcuuauuuauuuagacagugucuugcucuguugcuuaggcugcagugcaguguugugaucucggcucacugcaaccuccaaccuccuggguucaagugauucuccugccucagccuccugaauagcugggauuacagacacauaucaccaagccuggcuaauuuuuuuuuuuuguauuuuuaguagagacaggguuuuaccacuuuggccaggcuuguuucgaacuccggaccucaaguaaucugccugccucggccucccaaagugcugggaucacaggcaugagcugccacuccgggcucccugugaauguuuuuugaaugaguuguaugugcuuaaccuuaaacgcaacuuuuuuuugagaauuugaauugggaagaaaucaaaauaauuauucuuauauguuauacuagcuaguuucuuugugauuugcaauuauuuugaauauguuguauuugaauaaacuaauaaaccgacaggauaauacuguguuguuuuaccuacauugugucuaaaaaagaaaaaaaaaaagagauuuauaauuaguuaaccauugaggauauuagcguaguccccuagcuaguauuugaucacauuuucuuagagcuaggaacugauacuuagaguugagcuucaaacucaagucuuucugacucccaaacuaaugaucuuucuaauucuauaaaauacugcugauugaaguuuaaaugcuuggacaucuguagucaguagaaauaaugauuuuaagucugcuauuuaaaauguaaccacaauuauuuuacuauuuguaaaaguauuaaauuggauucaauaauuaugguauauugcucuucuuguugagggguagaugcauguuggcacggugggaacagguugcuuuuuguauugugaacaauaaaugggccuacagaugauaugaguuacuuuaagauuaauucagauuuaucaauugcuagaauuauuuuuuuccccaugauuugcaggaauacguuuacuaugugguggucauguaucauuaaauggaauuaaaaauuauguaagugggcugggcaugguggcucauuccuguaaucccagcaguuugggaggcugaggugggcagaucgccugaggucaggaguucgagaccagcuuggccaacauggugaaaccccgugucuacuaaaaauacaaaaauuagccaagcauggugaugcgugucuguaauccuggcuacucaggagacugaggcaggagaguugcuugaacucgagguggagguugcagugagcugugaucgcggcacugcacucuagacugggugagggagugagacacguucucaaaaaaaaaaaaaauuaguaagugaaguuaaaagucaugugaauggauuaaaauuaugucuugggguuuuuuuucuguugauauuauaaaaaaaguaaaauauaucccugucacuuuuuucuguuuuaccucuauaauuugauagcagucuuuguuauaauuaaauuauuguuuagucguaauggugcauugggaugcacaguaucuuaggcagcccagcaggacacauugguuuugaaagcucuuaucuuucuugcacuauuugaaggcuuuaaauggugcaguaaaauuaaaaugucaagucuguggaucuauucaauuucauaagcgaggacaguccugacggucagcuacaguaucagggcaggagcugcauugucuggccugggaacuccacagcuguuaaucaugcuguuguuguagggugucacugccauguguuucuugauugaaggaaggcuacaguguuaugucugccaccagaaucuuuuaguaaugaugaaaaacuacugaccuccuuucauaugguuucauuaaagucuuuucugaacuacaacauugaggaauauacucuugcugaauauaguacuuaaaggaucauuugugcagaaauuguaaauuuuucauguacaaaaucaaauuuccuagaaguaguucuuuuauaaggcagucuuuuuaauuuauacauuuaugcuucuuuguuuuuuccuuuuaauuugcacagucacuaaauuaaugauacuauauuuuuauuaucuucaagauuuauuacuguaauauauuuuugguuagaauuauuuuaaagacagaauaucucagcuaaaacuguacauuauuuucauucuuguuuuuaaaguauaagguggagaucugaaauaguugaaccuugauacugcuaauugauuaagugcuacaguuauuaacagcucccugaccaaaguauguaucuuucuuuuaaccuaaauuguucaaagcacaacucuuaacaaugaggaauuguauauggacguaaacucauuuauuuuccucaacuugaugaauuaccuauuaauugacuuuuaaacaguuuggaguagagaauauaaauucacgguuaggaucaaaauuaaaaagcaaaagucuaauauuuaaaaguuaauaauguaaacaauuucauuuuacucuuuuuagaguguaaucacagcuuuuuagcuuuuuuccugcugcuugaauugguaacuucuuagcuucuuuugagugauaugacauuucaggauauauagcaaaguuucauuaaaucauaucaaaaaucaugucugaauuaguaaaauguuuaaauuguaggauaaauuuacagacugaguugaguuagaaguauuucucuugaguuguuugaaauguuaugauuaucugaaauauuugcgagugaacauugguauuuauuggaauuuuucauuuaaguucauuaaauauuucuccugcauggaauuuacacaauuccaauuugcuuacuuuaguucaauaaauucuuuuuucaagguguaaaagccaacuuuagcuuagacaaugucugaauuauaucaacuuucaaauuuauugagucugaauuggagauuauuucaguauuuaauagcuucugggagacauuuuauuguuugauuucuuuauaguauauaaguguauuucaggacuugugucacacgguaugaauugcuuuauguuugcuuuuauccccuacuuuguaaaauauuuaaguguuuugaaucuuguauuaauuuucaaaauaugcuugaggacagugaacaguuauaggaaauauaauguguuaaucacaggccaguuaguaauaagugaaacucgguuucacaauuguuggaggaggauguguuaaaaaacauauaucauacacagaagaaacauaaaucauacacagcagaacaauucugggggucaugagugucuucugcuuauccaggcagcagggcauggagcgagaauaagaaugugaucaccuccuucuccauauaauauuguguucuuagauuaaaagcauguuauaauggcagaaggggauguugguguugacaauauuucugauucauaagucucauugcuccaaucuggguucuuuaccucucauaucugauguauaggugucacucuggaauuccuccuaaccaugcuccugggagaucccuuugccucucuuguguuuugacuuugccauuguuuauaucccguguucuugucuuucuuccuuuaugcucuuuuuuuccuuauucaaaagguggcauauaccauauauauaacuuguacuuugucuuuuuucacuuaauauaucauagugaucuuuuccaauuaaaagauaggaaggaccaggcaccaccuguaaucccagcacuuugggaguuugagaccagccugggcaacauaggaagagccugucucuacaaaacgaacaaacaaacaacaaaaaacagguguggcagcucaugccuguaauuccagcacuuugggaggcugaggcagguggcuugcuugagcucagaagcucaaggccagccugggcaauauggcaaaaccccaucucuacaaaaaaauuuuuaaaaauuagccaggugucauggugugugccuauagucccagguacuugggaggcugaggcaguaggaucacuugaacccagagaagucaaagcugcagugggcagugauuacaccacugcacuccagccugggcaacaaaacaagacucucaaaaaaaaaaaaaauauauauauauauauuauauauauauuaauuauauauauauuuuuuggaaagauaauuaaacuuuucccucauccuacugucauaaucugaauuaggaagacaaaauucauccacuaauuaggggcauaguuaauguuaaaaggucacuuacuaaguuuuauucuuggaguauguaguuuuauucugaaacuuuucugugagauuggaucuuuccuaaaacauacacaagagauguagaaauaguuaauauaaaccuugucauuuacugagagcugcugaaaacauaaucauuauugacaacuaaguucaaguaaaaccauaauuaaaauuugggggauucuucuugcuauggacauuaauugauaaauuuggacuuuaguuauauguguauauaaaugagguaguccacauagcauagagauuauaguaaccagcuugauagcuucuuaauauagaaaggucuucauagacaauaaauuucauauggucuauuuucuuuuuugguccuaauuaagaagugucauuuuagagagagggagaaggaagaaagagggcaaauuaauuuaugcuaagcaacaggacuaggcugcuugcuuuuuguacacugauaaaaauacauuaaauccaagagagaaccuaaauguaaaaauucugacucuuacuugggaaaauuugacauuagagcaaucuauucauggaauuugagaccuggaagaaauuacauuuuuuaaaaaauuuggucauuuuauuuucaaacuagggaacugaaauccacaguguaccuugcuguuugaaaguacuuuuauuaggaggaugaggccugaguuaacuauuauuagaccagaaucuauuaacuuuguuuuacagcgaauacaagcuagcauucuaaaagcauuuaacaacccaacuacuaaaacugcugaugaugaaacuagaaaaaaagucaaagguauguugacucuuuguuaaaacuuuuuucuuuaagaaaauauuaaaauuuuauuuuaguuggaaaaagaacugaacauuaugugaacuaauccaccaaaguaguggcuuuaaaaggaggacguaguugcugcagugucugaaaaauacuuuaguggaacauagaaaaugcuagaauguauucaugugaauuuauaagaauaaagcuauaccaaguauacagauugacaccgauaccuuuaugugaggucuucuaagggaaacuugaaagguuguugaaaguagcaaccacacuuggaaguucauauguaucauauuguaucauuugacauguguuuggaucaauggauuuauggauauuuuuuagauguaacuagacaaaauguuuaagugcuccaaagacuccugcaaauaaaccguuuauugaagagagugcugguaagucaaguguaagugcacuuugccuacuccuaguguuugcuauucauccauaaaaauaugagccccaaaugaugauuaccuaaucaaaguugguuauuuaucauuaucaauacuauauaggguuuauauaccuugcccuaaauguauauucugcauugagauacuaacuaauguuagcaugaagugauuuuuagaagacauuuaaaaauauuauuuguauuuuuuucuaacuuuuguuuuugugguuuuauaauguauguacuacaggucuauaauuugcaaacauacacacauuguuacugugcacuuuauuguaauuaaggguucaagauuuuuaaaaaacguagcugcucaaauaugccuuguucuuuuguguugagauagugccaucucguggauguuuagaauaacagccccguuuuucuucccccucuuuccaguuuuguacuauuuccaaucccuuuuaguuuuucuagaagaaauaucuuuauuauuauaguauuucuaaauacaauuuuaauuaauguuuacugauauauucacauguuuucugucauucagugcucuaauauuuuaaaugauuuugaauauuguuuguaugaaacuugaagauagaggcucaaaaaagaaguuugaaagaggggugaauagguuuguuaauauacuuuuuccucccaugguuuaugauggaaaguuucaaauuuuuauuaaaguagagagaauagcauaaugcagcccuuuauaucugucacccaacuuaaacugcguucaugguuuauguuuaauccauuuucucccaaccucagguuauuuuaaacuaagucauuggcauuuuuuuaauuuauaaauauuuccugagcagaauaauuuuaacuuuuaaaaauauaaccauguucuugaguucuuaauuaccuauguuaauuccuuacacuugccuuuuacgacuguuauuuucauagccgugauccuggcauccguaguccugauagcauaaucuccuuuuccauucuucuggguacuuauugguuagacaugagguuuuauaaguuuuaaugggagugguugaggugugguacgaauagugguuguuuuguuuuaccucuuaagaauaguucauuauuucuuggagacuaaaguaguugauagucguaaaucugcuacaaaauuguaaaggagaaagacuuuagaauguuguauguauaguaaaauguauuauuaaauguaguacagaauaucuuauucagauuacuuuugaauaaccagaagauagccuauuauacugcuagauggaugguugacauguuuuuugcauuaaaaaguaugauuuuuacagcauauggaaaagaaggugugaaaaugaacuucauagaucggaucuuuauuggugaauuaacuagcacggucaugugugaagaaugugcaaauguagguacuuuagaauucaauucagcauggaauggauuacaaucacaucauuuuuauuauauuuucuuucacauauaaucauuggcagucauuuuuaaaauuugacagaugauuacauaaugauucuugaaagucuuuuuauacgcuacacuccuagaaaguaaaugugauaauuuauauauuuuuaaaaguaaauguauuuuuguguuauuuuuccucaugacacaccuaugaggcaguuuuagccuaucuuaauauacugaaauucauuagcuaucuguuugaagugagagaaaaacuucugugaagagaguaacugugcuacguugcagugcccuaaaauguaauuccaggcugggugcaguggcucaugccuauaaucccaguacuuugggaggccaaggccggcggaucacuugaggucaggaauucaagacuagccuggccaacauggugaaaccccaucucuacuaaaaaaauacaaaacaauuagccaggcaugguggugggugccuauagucccaaugacucgggaggcugaggcaggagaaucacuugaacccagcaggcaggguugcagugagccgagaucgcacuacugcacuauagccugggugacagagcgagacucaguuucaaaaaaaaaaaacuaauuccaauagaaauaacuuaauguauuaacauaauuuagggugguuauaucaccuuugauuuaaaguuuauaugacguauuaaagauuuuuguguagacuucacucacuuugaacuuaauaauuuuuauuuugaaugccaucuuuaacaacuuaaagcauguaugaauuuuuuguagauuuucaauugcuuggcaaggaauauuucuguaaguguaugacuuagaguaugauagguuuaaauuucuguuagauuuuaauaguaaaaggagccuuuauucauuuuccugucccagauuaugaguauuuuucuguguucucuagccuuaaagaagcaggauuauaaaauauaucucauucuagccugucacauugaaacacagaaugcaugaccaugauuauuuaaguuucuagacuauucaacacagaaguuguuuucucucucacaagauagagaguaucuuuuaaaacaaaauuaucuuaaagaaucuauaaaacacagccaagcucucugcuuuuuuucauggcuuuuucuuaacauuucauaguuuacuuauguuacagcccuaagcuaaccaaaaaugucuagucucuuuaguuaaucuguuuuauuaaacaguuuuuuuaaguuauuuuaaauauuacaggccagucauauugacaguaauauaaaauucaauuggaucaccauucacugauguuugagaauaucuuguuuugauuaacaaugugcugcaauacccaauuaaauugcuauuuuuuucaggaacaguuuuuaacguaaaauuuuagguugcccgggaaguuugauuucuuuguacuuuacaaaacuguauguuuauauuagaauucuaacugaaguuuucaauguguuuuccuuuuaagaucuccacggugaaagauccauucauugauauuucacuuccuauaauagaagaaaggguaaggagaagaaaacuaaugaugaagcuuuggugaagaacauuuaaucauuuauuuaaacauuuguugaguauauuaccagauaucugagagucauuauuuuuuauauauaauugaguuuguauucauaauugagucugauuuggggguuuguguaaguaugcauaaaguaugaugguuuuuauucucaaggaauuuaaacucuuaaacacuuuuuauuuugauaauuuguuaauuuuuuguauuucaagucagucaaaaauuuuaagaugaggacauccagaauuuauuuacuaaagagguuuugguuucuguauguggcauuuacauagguuucaaaaccuuuacuuuggggaagaaugaauaaauauagaaguuuacgggagacagaucaugaucgauacaguggcaauguuacuauagaaaauauucaucaaccuagagcugccaagaagcauucuucaucuaaagauaagguaagaccauaagcaucuguuagacgucuguuuuuuaacaguuuauuaacaaaaguuucaagcacaucuaaaaguagagaacauaguguaauaaacucucauguacccauuuuuuggcuucauaauuaucaacuuggcuacuuguauacuaacuauauauaucccacauccuccccuuccucccaucccagacuauuuuuggauaaucccagauuauuuuugaaauaaaucccaaauauaucauauacuucaauguguaucucuacaagagaguuuuuguuuguuuguuuguuuuuuaagacggaguuuugcucuuguugccuaggcuggagugcaauggugcaaucucagcuaacugcagccuccgccuccuggguucaagcgauucuccugccucagccuccugaguagcugggauuacaggcaugugccaccacgccuggcuaauuuuguauuuuuaauagagacgggguuucaccauguuggucaggcuggucucgaacuccugaccucaggugaucugcccgccucggccucccaaagcgcugggauuacaggagugagccacugcgcccagcacuaaccgagggauacucuuaaaaaccaaaaaccacaguaccauuaucauaucaaaaauauuaauucauuauaaauaaauaaggauucagucauuauuuaaauuucugcaguugucucauaaguacuuaguuuuuuauuuugcuuucuaaaguuuggauuuuaggauuuaaaagaggucuauggauugcagugccucuuuuuuuuuuuuuuuuuuuuuuuuuuuugagauggagucucgcucuguugcccagguggcgcgaucuuggcucacugcaaccucugccuccuggguucaagcgauucuccugccucagccuccugaguagcugggaguacaggcgcaugucaccacacccggcuaauuuuuguauuuuuaguagagaccagguuucaccauguuggucaggcuggucucgaaauccugaccucaugauccacccgccucagccucccaaugauugccaugucucuuaaaucucuuuucaucuacagauucccucucccucuuuuuccuccuuugcaguuuauuugcugaagaaaucagguccuuuuuuucagcagcaugguguuaacagauuccucugucaccuuuauuucuccucugagacauuuagaucuagaggccuaguuagguucagauuuaauuacuuauuuaauuuuuagcaagaaaacuuuuaggugguggcauguauacuuccaucagcuagaugcacauaauguuuuaugucucucuaugauauuaccagucacugauaaccauugucuagaucuauuauuuuacuagggacauaccugguuguugaauuaucccaugaaaauggaaaauuauuccaugaaauggugaucauuguaaccauugucuagaccuauuauuucacuagggacauaccuggcuguuguauuaucccaugaaaauggaaagaaaucaaucugaacuuauacuucagcaaaaaaaacuuuuuuauaugaaaugauuuguauuaauuuggcaaauuaauauuaaauuuaacuuacucuauuaauuaauuaauuaauuaauuauugagacagagucucacacuguugcccagccaggcuggagugcaguggcacgaucucagcucacugcagccucccagguucaagugauucuugugccucagccucccaaguagcugggacuacaugugcacaccaccaugcccggcuaauuuuuguuauuuuuuguagagauaggguuuugucauguuggcugggcuggucucaaacuccugaugaccucaagugaucuaccugccuuggucucccaaagugcuggaauugcaggugugagccacagcgcugggccugaauuuaacuuacucuguuagaagacuuauguuagaagucacaagacuucagaaaggacaacauguuuucuauaaauaaaagcuaauuuugcuucauaagauauauaggacaguuaaauucaauuugagcauaugcuuuauucuaaugguauaaaacaaagcaucuuacagaguuugaaaagguuaaagcauuaauuguguugcuauuccccuaaaaagcacugguuauuaaaauauaaauguguagugauuuuuuuucuuuauuuuuauuuaguuuaaagaguuaggagauucugugguacuggccaaaguaguuuuaauacauccgcuauccaaauguaugagagaaauacuuuccacacaguauugguuaggaacugagaauaugcauauaugauauauagaaacuguaccucaaagaucuggacaccacauggauauaacuugugcuugugcugaacaaauuggaccuacucuuuauugaaaauuuuuuucauauaauauuuuuuguuacuuuuuuauuggaccuauucuuuauugaacguuuuuuucauguaauagaguuaccuuuuuuuugguuuugaugggaaaaagugcaaguuugcauacgguucuaaaauuagaaaaguacaguucuaauaacaucuuuaagguacuauauucaagaagcgaaaauuuaaaugacauaaauguauuucagucauuaggaaguuuacguuuagaaguuauuuccaauaguucaacuacagaaccaguuuaaucauggaaccagaaugauucaguaguuaacuacuuucaguacuaguuuuauaaagaucaauaaagucuuguuuugcugauuagugaagcuguuaauaagaguauaaagauauuugugacaaacuuuauaguauuuuuuaaucucuuacaguaauagaagcaccuugcaucuuuuaaaauuauacuagaggcacaaguacugauuugaucauaaguuuuugaguuuuuuaccuuuucuguuugccaaauuauaugaguuaucucauuaaaaccacacaaaaacuuaauaugaagaaugauaaaaauaauuacauaaaaauagugaaauuagcugagaaaaucuugcccucaaguuggaagauguuaucucugaguaccuugaaaaagugcauuuucuuuugcuuacugauaacaggcaaauaauccaguuaaauaaagcacuguaaaacuagugugugcaauuucuggccuaaauacagaaaaaauaguaacaggaggcagauacguaaacagaguaaauagccauaggccuauauaaacauccuucuugaaccaaaaacuaagguaaaaugagcugcaacaaauggcuaccaaaagauauuaugugaagucuauuccauaggcuauuuuucuucccuucuuuccccuccccacagcuuuuuaaaaaaccaucaugcugauugaauaauuguagagacuggaaaaucucaaauugauauccuuauauaaaauccugccucagcucauuaguucagaaagaaauccaaaaguucaguucucugaguugcuucaacacauaaguauauuaguuuuaugaaagauuuuuuuuuuauuucauaaaaccuuaauacuucugccagaaucagaagugcauugugcucugguacaauuuacaugaacuuugguucccaccaccuguuagcugcgcagcguuuugccaauuaagcucuuugagacucggcucuuaaauucaauuauaagaccagaaucuugcuguuuuuucuauacaucccaucuguuguuuauuucuguuucuacuuuucaugcacuuuugguuuuaauugaauaauuuuuguguuccaucuuauuuccucuguuuucuuuuuaguuauuauaaaagguguuauuauggaauugcugaaaccuguguugugccucucaucauugggguuauauucagaaaaucauaguccucuuauuuacauggaagaaauuaagaaaauuucaaucuuucuauuauuuuaccaaucagaccagucaccaaaagaauacuguguaguuacgguaucuaucaauauacuucaaaauagauuugaggaaaacgcuguauucgaagggaucuuaccugauuuuaccauuuuuccuaggugcuaaauugcucaagguauuauacagagauauuugagaaaauggcaacuuaaccuauguaaauuuuuuuaaggauaaaauugaacagguacuuaguaguuuuaaaguccaaguaaaacaguugcaaggauauuuuuguuuaucaugugguguuggcucaauuuacucuugggaauuuuggaaacacccagagaaggucauauaucuccccuuugaucauuuucauuucuuauauuuuuaaacuuuaaaagugggcuuuuccccucuacuuagugucuguaacaaaaagagaagcuccuugcaucuuuuaauaauagagguacaaguacugauuugauaguaaauugaguuuuucacuucucuuugcuaaauuauacuacaguuaucucauuaaaacugaacaaaguuuaauaugaaggaugauaagcaucagguaaggaaaaaaggagaaauaaaaccaagauaugguaaugugaauacaaaugaaaguuagcacugguggaaaggcaacagaucuggccugaguauuuuagaaaguuuaaaaaauagugaaaggaaacagugaauagaaauuuuuuauuggaaaauuaugugaggcaaaaaaagcacuacccaaaaggucugagggaaaagauagggaauuaucauguagccaucugauuaauuuuuuguuucccuagaccccacuccucucccuauuccccaccaccauuuggugcuccacauugcagacagggcaauauuucuaaaauacaaaaauaggucaucauauuccuuguagcccucagaaucaagucugauacaugcagccaacaggcauaugaaaaacucagcaucacuaaucauuagggaaaugcaaaucaaaagcacaaugagauaccaugucacaccagucagaaugcuauuauuaaaaagucaaaaaauaaaugcuggcgaggcugcagagaaaaggaaugcuuauacucuguugguagaaguauaaauuaguucaaccguugcagaaagcaguguggcuauuccucaaagagcuaaaaacagaacuaccauuugacccagcauuuccauuacuggguauauaccugaaggaauauaaaucauucuaccauaaaaacacauguaggugaauguucauugcagcacuauucacaauagcaaagacauggaaucaaccuaaaugcugaucagugacaguuuggauaagaaaauguuguacauauacaccauggaauacuaugcagccauaaaaaagaauaagauugugccuuuuacaggaacguggauggagcuggaggccauugucguuagcaaacucacacaggaacagaaaaccaaauaccacaaguucucacuuauaagugggagcuaaacauugaguacacuuguacacaagggaacaaagacacuggggccuacuggagggugcacagggugggaggagggagaggaucagaaaaaauaauauuggauacuaggcuuaguaccugggugaagaaauaaucuguauaacaaaccccugugacacaaguuuaccuuuauaacaaaccugcacauguacccugaaccuaaaauaaaaguugaaaaaauaaaucucauugcuguucaaaacaaaaacaagucugugacuuauaugcaucugguuaauuuuuguguguccuucucaccuccccacacuuguacucuauuuucuagcuagacuucccuaauuucuuguucuuugucuuaccugugggccuuugaacugucucuucugccacgaacagucccauucuccuccuguagccucugcucaauuucugcauauuucucugauccacucaauucuggauuaguucuuuuccucuggcuuucuauagcacuguauuucuccuaucauaacauaaguuguaccuaacauuugaguucuuaauuauguuaugaucacuguuuucaguuauuuacaccaauuauauugagccaagagguggauuaaauaacaugccuaagaucauacaaguagucuggcagaaauggggauucagacagguuaaacaaggaccauguucuuaaccacguauacugcccccugcugacuugaacuuaugucucaccauacuuuuauugggauggauugcaggaucugcaaacaggaacugagucuguccuucuugccacuaugucucaggugccuaguucagugcuuguacauggaugguguuuagggagaccacugagcucauucucaugauugcugccaaucguaauagcugauacuggcugggugcgguggcucacgccuguaaucccagcacuuugggaggccgaggcaggcagaucccaagguccggagauggagaccauccuggcuaacacagugaaaccuuaucucuacuaaaaaugcaaaaaauuagccggucaugguggcacacgccuguaauccagcuccuugggagguugaggcaggagaaucucuggaaaccaggagguggagguugcagugagccgagauugcgcuacugcacuccagccugggcaacagagcgagacuccaucucaaaauaauacuaauaguaauaauagcugauacuuacgcugcuuacugugggcuacgcacugcucugugggcuuuucuauagucucaaaaaauaaggaugggaagggguacuuuuauauuucacuaggaguaggaggauaaaagggauagauagaauagucucauucaaaaguuccuaagaccagcugaugaugagaaucaccuguuuauuaaaacgaauucucauacccaaccucagacaugauuaaugggaauuucuuagugguaaugccucggauauguaucuuuuaaaacaacaagcccucuuaggugagucugauaaucaccugaauuuggaaacuauucaaucagaauuagauuaauuggauucuggacacagcuauuuuuauuaguuauaugaucuuggacaaguuacuaaaaaccuguaugggucuauauuuuccauugaccauuaauuuucuguugguacauaauauuuguacauauuuaugagguauaugugauauuuugauacaugcauagaauguaucaugaucaagucagguaucggggaaccugccccaauauucacauagguucuuuucuauuuuccuuaagcaucggccagcuugagaaauaaagggacagaguacaaaagagagaaauucuaaagcugggcguccaggggagacaucacaugucgguagguuacgugaugccccacaagccgcaaaaaccagcaaguuuuuauuagggauuuucaaaaggggagggagugugcaaauaggugugggucacagacaucaaguacuuuacaagguaauagaauaucacaaggcaaguggaggcagggcaagaucacaggaccacaggacagaggugaaauuaaaauugcuaaugaaguuuugggcaccauugucauugauaacaucuuaucaggagacaggguuuugagagcacccggucugaccaaaauuauuagguggguauuuucccuuccuaaugagccugggagcacuaugggagacuggggucuauuucaucccugcagucucgaccauaagagacggcuacgcccaggggggccauucauaggccuacccccaggcacgcauucucuuucucagguauguuccuugcugagaaaaagaauucagcgauauuucucccauuugcuuuugaaagaagagaaauauggcucuguuccgccagcucaccagaggucagaguuuaagguuaucucuccuauucccugaacaauugcuguuauucuguucuuuuuucaaggugcccagauuucauauugcucaaacacacaugcuguacaauuugugcaguuaacgcaauuaucacaugguccugaggcaacauacauccuccucagcugacaggauuaagagauuaaaguaaagacaggcauaggaaaucacaaggguauugauuggggaagugauaaguguccaugcaaucuuuaugauuuauguuuagagauugcaguaaagacaggcauaagaaauuauaaaaguauuaauuuggggaacuaauaaauguccaugaaaucuucacaauccacguucuucugccauggcuucagccggucccuccauuuggggucccugacuucccacaguagucaggguauuugggauaucaguuaccuuaagcauuuaucauuucuuugcauugagaacauuucagauuuucucguagcuaccuugaaauauguaaucuauguuguuaacuguaguuaccauacuguucuauggaacauuagaacuauuccuucuaacucugucuuuguacucacuaacauaccucucuuuuuagcuucuccacuacaaccccacucacucuuuucuaagccucugauaucuaucauucuacucucuacuuucaugagaucuuuuuuuuuuuuuuuuuuuuuuuccgagacagagucucgcucuguugcccaggcuggaguacaguggcgcgaucuuggcucacugcaagcucugccucccagguucaugccauucuccugccucagccucccaaguagcugggacuacaggugcccgccaucaagcccgguuaauuuuuguauuuucaguagagacaggguuucaccuuguuagccaggauggucuccaucuccugaccucaugauccacccgccucagucucccaaagugcugggauuacaggugugagccacugcgccugccccaacuuuuuuuuuuuuuuuuuuuuuuuuuuuuuagcucucacauaagagugagaacaugggauauuugccuuucugugccuagcuugccuuacuuaacauaaugaccuccaguucaacccauguugaugcaaaugacaggauuucauucuuuuuagggcugaagaguauuccauuauggauauauacuacauuuucuuuauccauucaucuacugauggacacuuagauugauuccauuucuuggcuauugugaauagcacugcaguaaacaugggggugcaaguauccuuuugauacacugguuuucuuuucuuuggauaaaugucuaguagugggauugcuggaucuuaugguaguuauauuuuaguuuguuguuguuguuguuguuguuguuguuguuugagacagagucucgcuccaucgcccaggcugaagugcuguggcacagucucagcucacugcaaccucuuccuccuggguucaagugauucucaugccucagccuccaucucccaaguagcugggacuacaggcaugugccaccacgcccagcuaauuuuuguauuuuuauuagagacaggguuucaccauguuccccaggcugguggucucaaacuccugaccucaagugaucuacccaccucagucucccaaagugcugggauuacaggugugagccaucgcacccagcccuauuuuaguuuuuugagaaaucuccauacuguuguguuuuguuuuuuuguuuuuuguuuuuuuuuuuuugagauggagugucgcucugucacccgggcuggagugcaguggugugaucuuggcucacugcaaccuccaccucccagguucaagugauucuccugccucagccucccgaguagcuggcauuacaggcaccugccaucacaccgggcuuauuuuuuuguauuuuugguagagacaggguuuucaccauguuggccaggauggucuugaacucuugaccucgugauccaccugccuuggccucccaaagugcugagcuuacaggcauaagccacugcacccagccaucuccauacuguuuucuaugauggcuguacuaauuacauucccaccaaccguguuucagacuccuuuucuccacauucuugaaggcaucuuauuauuugucuuuuuugauaauaaccauucaacugggguaaaaugauauuucauugugguuuuaaucugcauuuccuggaugauuagggauguugagcauuuuuuucauauaccucuuggccauuuggaugucuucuuuugggaaaugucuaacauuaguuccuuauaggaugaagaguuugcagauauuuucucccauucaacaggaggucucuucauucuguugauuguuuccuuuucugugcagaagcuuuuuacaguguagucccauuuguuuuuguugccugugcuuuugaggucuccauaaaaucauuaccuagacuaauguccugaguguuucuccuauguuuucuucuugugguuuuauauucuagauuuuacauuuaagucuuuuaucuaucuugaguugauuuuuguauauggugagagauaacauucuaguuguauucuucugcauauggauaaccaguuuucccaguaccauuuguugaagagggcguccuucccccaguguuuguucuuggccccuuugucagaaaucaguuggcuguaaguauguggauuucuuuauucuguugcacuggucuaugugucuguuuuuauaccaugaccauacuguuuugguuacuguagucuuguacauuuugaagucagguagugugaggcuuccagcuuucucccuuuugcccaggauugcuuuagugauucuggcucuuuuuugguucuauacaaauuuuuuucuuuuuuuagauggaguuucacucuuguugccaaggccagagugccacugucagaggugcaaugucagcucacugcagucuccgccucccagguucaggcgauucuucugccucagccucccaaguagcugggauuacaggugccugcuaccaugccuggcuaauuuuuuguauuuuuaguagagaugggguuucaccgugcuggccagacuggucucaaauucuuggccuuaguugaucuaucuaccucagccucccaaagugcugggauuacaggcaugagccacuguacccagccagguuccauacauauuuuaggauuguuuuuucuuuuuaugugaaaaacgucauuggaauuuugauaggaauucauggagucuauagauugcuuuggguagcauagucauuuuaauauuuuccugauccaugagcaugggaugcuuuuucguuugugucuccuucaguuucuuucaucaguauuuuauaguuuuccuuguggaggucuuucaccuccucaguuaaauuauuccuagguggaauuuuuuuuucuuuuguagccauuguaaacaggauugcuuuguugauuuuuuuuuccagcuacuuuguuguuaguguauagaaacgcuacugauuuucauauguugauuuugcauucaacaacuuuacugaauuuguuuaucaguucuaagaguuuuuuguugaagucuuuagguuauccuauauguaagauuaugucgucugugaagaggaacaauuugacuucuuuuccaauuuggaugccuuuuauguuuuuuuuuuuuucuuuuuuaaguucuaggguacaugugcacaacgugcagguuuguuacauauguauacaugugccauguuggugugcugcacccauugacucgccauuuacauuagguauaucuccuaaugcuuucccucccugcucccgccaccccacaacaggcuccugugugugaucuuccccuuccuguguccaaguguucucauuguucaauucccaccuaugagugagaacaugcaguguuugguuuuuuguucuugugauaguuugcugauaaugaugguuuccagcuucauccaugucccuacaaaggacaugaacucauccuuuuuuauggcugcauaguauuccaugguguauaugugccacauuuucuuaauccagucuaucauugauggacauuuggguugguuccaagucuuugcuauugugaauagugccacaauaaacauacgugugcaugugucuuuaaggcagcaugauuuauaaucuuuuggguauauacccaguaaugggauggcuggguuaaauggcauuucuaguucuagauccuugaggaauagccacgcugucuuccacaauaguugaacuaguuuacagucccaccaacaguguaaaaguguuccuauuucuccacauccucuccagcaccuguuguuuccugacuuuuuaaugaucaccauucuaacuggugugagaugguaucucacugugguuuugauuugcuuuucucugauggccagugaugaugagcauuuuuuucaugugucuguuagcugcauaaaugucuucuuuugagaagugucuguucauauccuuugcccacuuuuugaugggguuguuuuuuucuuguaaauuuguuugaguucuuuguagauucuggauauuugcccuuugucacaugaguagguugcaaaauuuucucccauucuguagguugccuguucacucugaugguaguuucuuuucaugugcagaagcuccuuaguuuaauuagaucccauuugucaauuuuggcuuuuguugccuuugcuuuugguguuuuagacaugaaguccuugcccaugccuauguccugaaugguauugccuagguuuucuucuaggguuuuuaugguuuuagcucuaacauguaagucuuugauccaucuugaauuaauuuuuguauaagguguaaggaagggauccauuuucagcuuucuacauauggcuagccaguuuucccagcaccauuuauuaaauagggaauccuuuccccauugcuuguuuuucucagguuugucaaagaucagaugguuguagaugugugguauuauuucugcggguucuguucuguuccauuggucuauaucucuguuuugguaccaguacuaugcuguuuugguuacuauagccuuguaguauaguuugaagucagguagccugaugccuccagcuuuguucuuuuggcuuaggauugucuuggaaaugcaggcucuuuuuggucccauaugaacuuuaaaguaguuuuuuccaauucugugaagaaagucauugguagcuugauggggauggcauugaaucuauaaauuaccuugggcaguauggccauuuucacaauauugauucugccuauccaugaguauggaagguucuuccauuuguuucuguucucuuuuauuuuguugagcagugguuuguaguucuccuugaagagguccuucacaucccuuguaaguuggauuccuagguauuuuauucucuuugaagcaauugugaaugggaguucacucaugauuuggcucucugucuauuauugguguauaagaaugcuugugauuuuugcacguugauuuuguauccugagacuuugcugaaguugcuuaucagcuuaaggagauuuuggguugagaugaugggguuuucuaaauauacagucaugucaucugcaaacagggacaauuugccuuccucuuuuccuaauugaauacccuuuauuuauuucuccugccugauugcccuggccagaacuuccaacacuuguuaaauaggaguggugagagagggcaucccugucuugugccaguuuucaaagggaaugcuuccaguuuuugcccauucaguaugauauuggcuguggguuugucauagauagcucuuauuauuuugagauaugucccaucaguaccuaauuuauugagaguuuuuagcauuaagggcuguugaauuuugucaaaggccuuuucugcaucuuuugagauaaucaugugguuuuugucuuugguucuguuuauaugauggauuacguuuauugauuugcauauguugaaccagccuugcaucccagggaugaagcccacuugaucaugguggauaagcuuuuugaugugcugcuggauuugguuugccaguauuuuauugaggauuuuugcaucgauguucaucagggauauuggucuaaaauucucuuuuuuuguugugucucugccagguuuugguaucaagaugaugcuggccucauaaaaugaguuaggaaagauucccucuuuuucuauugauuagaauaguuucagaaggaaugguaccagcuccuccuuguaccucugguagaauucggcugugaauccgucugguccucaacuuuuuuugauugguaggcuauuaauuauugccucuauuucagagccuguuauugaucuauucagggauucaaguucuuccugguuuagucuugggaggguguauguguggaggaauuuauccauuucuucuagguuuucuaguuuauuugcguagagguguuuauaguauucucugaugguaguuuguauuucugugggaucaguggugauauccccuuuaucacuuuuuauugugccuauuugauucuucucucuuuucuucuuuauuugucuugcuagugguuuaucgauuuuguugaucuuuucaaaaaaccagcuccuggauucauugauuuuuugaaggguuuuuuuuugugucucuaucucuuucaguucugcucugaucuuaguuauuucuugccuucugcuagcuuuugaauuuguuugcucuugcuucucuaguucuuuuaauugugauguuagggugucaauuuuagaucuuuccugcuuucucuugugggcauuuaguacuauaaauuucccucuacacacugcuuuaaaugugucccauagauucugguauguugugucuuuguucucauugguuucaaagagcaucuuuauuucugccuucauuucguuauguaaccaguagucauucaggagcagguuuuucaguuuccauguaguugagcgguuuugagugaguuucuuaauccugaguucuaguuugauugcacuguggucugagagacaauuuguuauaauuucuguucuuuuacauuugcugaggagugcuugacuuccaacuguguggucaauuuuggaauaagugugaugugcugagaagaauguauauucuguugauuugggguggagaguucuguucaugucuacuagguccacuugaugcagagcugaguucaauuccuggcuauccuuguuaacuuucugucucauugaucugucuaauguugacagugggguguuaaagucucccauuauuauugugugggagucuaaguuucuuuguaggucucuggggacuugcuuuaugaaugugggugcuccuguauugggugcuccuguauugggugcauauauauuuaggauaguuagcucuucuuguugaauugaucccuuuaccauuauguaaugaccuucuuucucuuuugaucuuuguuguuuuaaagccuguuuuaucagagacuaagauugcaaccccugccuuuuuuuguuuuccauuugcuugguagaucuuccuccauccuuuuauuuugagucuaugugugucucugcacgugagaugggucuccugaauacagcacacugaugggucuugacucuuuaugcaguuuuucagucuguaucuuuuaauuggagcauuuagcccauguacauuuaagguuaauauuguuaugugugaaucugauccugucaugauguuagcugguuauuuugcucguuaguugaugccguuucuuccuagcauugauggucuuuacaguuuggcauguuuuugcuguggcuaguaccaguuguuccuuuccauguuuagugcuuccuucaggagcucuuguagggcaggucugguggugacacaaucucucagcauuugcuugucuguaaaggauuuuauuucucguucacuuaugaagcuuaguuuggcuggauaugaaauucuggggugaaaauucuuuuaagaauguugacuauuggcccccaaucucuucuggcuuguagaguuucugccaagagaucugcuguuagucugauggguuucccuuugcggguaaccugaccuuucucucuggcugcccuuaacauuuuuuccuucauuucaacuuuggugaaucugacaauuauguguuuuggaguugcucuucucaaggaguaucuuuguggcguuuucuguauuugcugaauuugcauguuggccugccuugcuauguuggggaaguucuccuggauaauauccugcagaguguuuuccauucucccugucacuuucagguacagcaaucagacauagauuuggucuuuucacauauucccauauuucuuggaggcuuuguuucuuuuuauucuuuuuucucuaaacuucucuucuugcuucauuucauucauuugaucuucaaucacugauauccuuucuugcaguugaucaaaucggcuacugaagcuugugcauuugucacguaguucuccugucaugguuuucagcucaaucaggucauuuaaggacuucucuacacugauuauucuagucagcccuuugucuaaucuuuuuucaagguuuuuaacuuauuugcauuggguucgaacuuccucauuuagcuaggagaaguuugaucaucugaagccuucuucucucaacucgucaaagucauucuccguccagcuuuguuccguugcuggcgaggagcuguguuccuuuggaaggggagaggcgcucugauuuuuagaauuuucagcuuuucugcucuguuuuuuccccaucuuugugguuuuaucuaccuuuggucuuugaugauggugacugacagaugggguuuugguguggauguccuguuuguuaguuuuccuucuaacagucaggacccucagcugcaggucuguuggaguuugcuggagguccacuccaggcccuguuugccuggauaucagcagcggaggcugcagaacagcgaauauugcugaauagcaaauguugcuaccugaucguuccucuggaagcuuugucucagauggguacccggccgugugaggugucagugugccccuacuggggggugccucccaguuaggcuacucggaggucagggacccacuugaggaggcagucuguccguucucagaucucaaacucugugcugcgagaaccacuacucucuucaaagcugucagacagggacauucaagucugcagggguuucugcugccuuuuguugggcugugcccugaccccagagguggagucuacagaggcaggcaggccuccuugagcuguggugggcuccacccaguucgagcuuccuggccggccgcuuuguuuaccaacuguuaguauuauauguauaauaggaaaguuuguuuccaaaaaaaaguacuauauaaauucagcggaguggaacuuguuggcuaauguuauuuuuccugauuuugcagauaaaaaaaauugaggcaagacacuuuuuauaacuuacucuucuuccccugaauaacuaaaacugaguaucaauuacucaugauagucuuuucuuuauuuuuugucuugacccuucagccaagguauaggaaaagaaaaauguacuucaagccaucagcuguguggaaacuuuagugaaacauuucagguagcuuaaaauuuuuaauuaguugauuccccccuucccaaacuuagguuauuuuuuucccguaauuuucuuccagaucuauggcaaccaagcaacacugugucauaauaguuuauaguuuacuuuuguuacuuuuuaauuuguuuaaaaaacagauacauuuucaguguuuaaaaaugaacaaguauggaaaggcuuauacaguaacugaaaagucuccuuugggaagccaaggugggaggauugcuugaggucaggaguucaagaccagccuaagcaacauggcgagacuuuaucucuacaaaaaauuaaaaaauuagccagguauggugguacauacuuguaguaguaacuacaugggaggcugaggugggaggaucacuugaguccgagaguuugaggcugcggugagcugugauugugccacugcacucuagccugggcaacagagcaagaugcugucucuaaaagagauuuuucuuuuaaagaaaaaagucucccucauagcccuguucuacaaaaguccuauuuccuuccccacaaauagccucuguuacacuguuguuaguuucuugugugaagauuuacuuuuaaaauagaacuauuuuuuaguauaucuucuagugaucuuaguuucaguaggcuuaggaaauggaucugagagaaaugguauuuaauaacuaugauauguuuaagaauuauuggcauuuauuuucaaugagguuacaagacucuuuucuuugaaaacacugucaacuuacagagucaacuaauucaugaccgaaaauguauuagaaaauugucaucuggagaaacugucacauaccagaaaaaugaaaaccuugaaaugaauggggauucuuuaauguuugccagccucaugaauucugagucacgucugaaugaaagcccuacugaugacagugaaaaagaagccagccauucugaaagcaauguugaugcugacagugagccuucagaaucugaaagugcuucaaagcagacugggcuguucagauccaguaguggauccggugugcagccagauggaccccuuuacccucugucagcagguaaacugcuguacaccaaggagacugacaguggugauaaggaaauggcagaagcuauuucugaacuucguuugagcagcacuguaacuggagaucaagauuuugacagagaaaaucagccacuaaauauuucaaauaauuuauguuuuuuagaggggaagcauuugaggucuuauaguccccaaaaugcuuuucagacccuuucucagagcuauauaacuacuucuaaagaauguucaauucaguccugucucuaccaguuuacaucuauggaauuacuaauggggaauaauaagcuucuaugugagaauuguacuaaaaacaaacagaaguaccaagaagaaaccaguuuugcagguaauuauuuuuuuaauuacauaauuauugaucuccugauagugucuagugaguuacaaauuucacugagaauuuuacugagaaucuugucccuauacuuguguuacuuaggcagagauuguuucauucauauuuguaccugagcgcuuacaauacugggcagaacagauuuucaaguuuuuuuauuuaaauaaagagcaggaaguauacaacucugccuugaaaaugcaaacccauauaaucuuauuugagggaacuaccuaucugaaaucuauccagaagaaauaucccuacaacuuuuuuuuuuuuuuuuggagauggagucucacucuguugcccaggcuggaguacaguggcgcgaucucggcucacugcaaccuccaccuccugaguucaagcgauuauucugccucagccuccugaguagcugagauuacaggcgcccaccaccaugcccagcuaauuuuuguauuuuuaguagagaugggguuucaccaucuuggccaggcuggucuugaaugccugaccucaugauccacccgccuuggccucccaaagugcugagauuacaggugugagccaccaugccuggccucccuaaaacuucuaauuguaucacugguaagauaaaugauaaagcuaauguguuucacagauccuaucaaucuguuguaaacucaacguaagauaaauuuugaagauuuuaaauaguagcaugucauaaagcuagcgcuauaauuaccaugauuaguuggucagagagaaguggagaaagggggaaaauaagaaauuuucaguucaucuuuauccuugaguaaauggaaagaauacucugauucuuagugacuacuuguuuuaaaauguaggcuuuauuauucagguacggugaggcuaaaagaucaggagauaauugccacugaagaaauaguguguuauucauaguucccaagaagugggggcccaccaugcugcacaggaccacacagggaagcaccagcgucagucaggagguaggggagugaggggaaaacaugggcaggagccuuuagugugauuucuaaaggaagaaauggguaaggcaggcuaagcaggcuuaggauuggcuaguuugaauaauauuagugggcucugggauauaggagcugucucuaguuaucaggugccugguccuagagugauuacagcaaguggauagugucccagaguguaagagcccagugaaggagguuguugggguaugcgcucugggcucuggauugguuugcaugugacaggcaugcauauguaaguuguuuacuaucucuaggaauuagcccugggagggguugucccuccaauguuaaccagacccuagaugucaaagcaucagaauaaagacauacuuaauacacuaguaauaaagaaaugggagaaggaagaaauaccuauaugcaauuggcaauguucaaauacuaacauaaaucuuaggaauuuagaaauuggggcugggcacaguggcuuacaccuguaaucccaacacuuugggaggccaaggcaugaggaucgcuuguagccaggaguucaagaccagucugaggaacauagugagaucccaugucuacaaaaaacguuuuaaaaauuagccaggugggguggcaugcaccuguagucccagcuacuugggaggcugaggugggaggauugcuugugccugggaggucaaggcuacagugagccaugaccaccucacugcacuucagccuggguaacagcaaucucaaaagaaaaaaaaaaaauuagaaaucuagaaaucuuuuuaaacccaaauucuucaacuacacgugcuucuggugauuuuuggcuggagggcauugacagaaauuaauucuaguccaucugcuuucuaccuuccaaaauuuuguuucguguuaccucuccuauucuuuguucuuauuaacugugugccuuaaaaaaaauuccuuuacuuucauuuuagcagaguuuuaggaaggaguaaagacuguccuuucaucagaaguccaauuucuuuaacauuuuuaaaaaugugguaugauacuucuguauaaauuuuuauuauaugguagauaauguauaaaauggaauuuuauaaauaaauuuauuguauuuuauguagaaaagaaaguagaaggaguuuauacuaaugccaggaagcaauugcucauuucugcuguuccagcuguccuaauucuccaccugaaaagauuucaucagguaaguuucuucaguagcaccauaauuuucaucauguguuuuacagagcauuaaguccuauagaauauugucaagaauuagacaauaaccaguaacuuauugcauuuuaaaaugugucaugugagauuuacugcucaucuagccauaauaguuuauaagacuuuccugauuaaaauuguuuaauucacaauauuugaaaauuuaggcagcaggaaccuaaaugguaucucuguguguguuugugugguaauagaaaauaaguuuuguggcugggcacgguggcucccucggccuuugggaggcugaggugggcagaucaccugaggucaggaguucgagaccagauggaaauaagagucuugcucugucacccaggcuggagugcaguggcacaaucucagcucacugcaaccuccacuucccggguuuaagcaauucuccugccucagccucccaaauagcugggauuacaagugcccaccaccacacuggcuaauauuuguauuuuuaguagaaauaggauuucaccauguuggccaggcugguuucgaacuccugaccucaagugauccaccugccugggccucccaaagugcugggauuacaggcaugagccaccacacccagcccauacaauuuucaaauaaaaaucuuaauuguauaaaacaaauuaucaagaaaacaaggagaaaacuuaaauaauuuuuuugggaggguagaggagagaaucucccucuguugccaggcuggaguacaguggcacaaucucggcucccugcaaccuccaacuccuggguucaagcgauucuccugcuucagccucccaaguagcugagauuacaggugugugccaccacaccuagcuaauuuuuguauuuuuaguagagaugggguuucaccaugucggccaggcuggucuuaaacuccugaccucaggugauccgcccaccucggccucccaaagugcugggauuuuaggcgugagccacugcaccuggcccuuaaaugaauauuuaacuugaccucugugugaaagacuuucuaaauauaaaaccuuaagaaggaaaucucaaggaaaacuauugauaguuuacauauuugcaacauuuuaggugggauccagaugugcgagaggagauuuuucuccauccugccaucccuauccacagauuagauuaaguucugaauucuuccauagccaagguuguagaagcucaauggaacugaaaugacacagagaacagaagcagauguauuaugucuugucauaucagagcgccuaauggaaaggguacaucugcagugauucugugugaauaagagaggauaaugccagauugcagaagcuaauuucaugaugcaccgcaguuauuuuauauuugguacuugcaucccuguuuagaaacaacuuacagaaauaauucuugcccuuaaagggaaauauuuauggacauccaucuaggucccuuuuucucucaagcuaaauguaaugucagcaaagccacauucuuauucccaggguuugggcauuguagggagcagagucccuaagcaaugccuguguuucuaguucauugacaucccugaacgccuucucuaugguagcuuuagggcuguauaucagaaacauccacaacacuuaaaugcaaaucugaaacugaauagagaucuuugucauaaauaugccaaaauuuuaauauuguaaguauauaaagagucuuaaagaucaauaagaaaaauaucagacccuaauaguaaaaugggaaaagaauaucaacugacauuucuagaaguacaaaguccaggcaaguaugaaaaagguccauccuucccagcaaaagaaaggcaaaauaaaauggcagauucuuuuuucaaccuguccaaauuagcaaagauguaguaguguugauaaggaugaacugagauagagacauuuucauuuaccagcauugggaguguaaguugguaacaccugcuagaaagcaauuuaguaaugaauaugaagaacauugaguaauuuuuuuuuuuuuuggagauggaguuucgcuuuugucgcccaggcuggagugcaauggcgcgaucucggcucacugcaaccuccgccuccuggguucaagugauucuccugccucagccuccugaauagcugagauuacaggcacccaccaccacaccuggcuaauuuuuguauuuuuaguagagacaggguuuuaccaugucagucaggcuggucuugaacuccugaccucaggugauccacccaccucggccucccaaagugcuuggauuacaggcaugagccaccgugcccggccgaguaauguuuuaaacaaaacaauuuuugaacaaagcuaauuacucuugacuaagaaucuaccacaaggaaauagauauacacaaaaauuugugugugccccacucagaucaugccagacguaaggccuagcuuaaauguccaaugugcaggauaucaaauuuauauuuuaauauggaaaaugcaguguaucauuucauuaaagggaaaaaggcaggagacuguauaugcaaauauaagucuagauauuuuccaaaaauuaccaccuaaaaaaagauucaucuuauauuaaaguccuucacacagucucuuguaugaugggguaguuucucaacagcaaaguacugauugaggagaacacaauagcugaaaugaucucagacagugcugguauugggugcuuauagaggucaccugaugaaaaaggcaaagaaauugaauguagauuaaauauuccugggauaugaugucauaauuucaugucagcuauuuucaagccuucuaaagaucacuugaaaaaacaaaucaguaggugaauacacuucggcaaaaaaaaaggguuuuuuguuuuuaaagaaagauaagccauaaaaaagcaacagaucuacaguaaacuugugauuaguaugcaaaugaaagaucagucauugacgucaugacagguugccccuuuucguuuuugucuacccauucauuucagauuuagguaucuuuucauuccaacagaguccauuucuauuuaugggucuccucaauaccuuugauauuuuauuagcuaguuuuuauuaccauuacauaaugcaaagcauauacuuuuuaagguuugccuuugaaaauuagaaaaagagagcauauuuaagaacauaaaaguacaauuuuauugauguaauauauagcauuuacuuuuacugauaaaauguuuugaguguucagguuguuuguuuuaaugaaugaauauaauugaauuuuagaacugaaaaggaccuaaucucauccuuuuauauauggaaucaaguugacaaccagucacugaguuaggccuagaacaccaaucuguuuacucuuuaguugaauauauuuucaugauagcauaugugucaguagcuuagcuuuuauauugaauuuauuuuuccauaaguguugaaaagccauaaugaaaguaacuauucccccuauuguuugugguaaaaauccccauguaaaugaauaaucuuugcaguaacaauuuaugaaaccuaauuuuuaauuuauucauauuaauuuuagacuauacauuagucacauuuuuuaucuaugaaaaaacuaaguccuacaauuucucuuuugguuuuaguuaacaaagacaaugcuuuauuucuaauuguugcauuucaaaaauguuuuggucuuuuuaaggcuggcuugagucuucguaaaguaaacagacauguagauuuuccacuuaugcucgauuuagcaccauucugcucugcuacuuguaagguacaguauauuaagauauuuaauugauuuauaaauuaauaugcuugaaaguauccuauauauuauuagacaaugcuuuuucuaaaaaaauaacuucucuucugaaagggaauuuuaauagccagugauuaagucaguaauauguggaacacuuaauacauugaauaugauuuuuguccuuugggagacaaaggaaaauugaaaagguaaggcaugaggcaugaugguuaugaaggucuaagcuguuuguaagugcuacuggaagcugaugguugcugagagaaggagguuuuguguccucgauuguuccuugugaacuguuuaaucaguaguaguuuuaccauuugcggaguucuguaucuuuugcaaaucaguguagaagugaauugucuuucgugccacuucauguguacuacugagagugguguacuugucagcggagugugauacuucaaaacugcugcuacuuuaauaauuagguacagaaagcagacuggcuuaucauugcuuauuuuacauguaagaauuguguagaugaaguagaugacuuggucuuccuugaaggaagcaguuaugggguaacauacuguccuguucaugauuacuggcuagaagucuagauuuuguaguauguaauagaaugcuuauugaacuuaauacuuucagcacauugauaaucaaaacaaaaucaucuuaaaugcaauuuuugguugaauuacaguguaucugcuguggaauaccagcacuaucugucaauuguuaauacucaguauuccuagaauuuaauaaugugguaaauaauaaugaaauuuaacaaucuuuguguuaaacuuaugaaaacauauuuuuaaaaaguaccuauuacggagaauuuccaauaaacacaaaagcaaauagaacaguaccaugaacuuccagcacccagcccuaaaaccuuacauccauggccaguccugcccuauccacacacuaauucacuuucuucuccuuuauuauuuugaagcaaacaucaggaaucauuucacccauaauauuucacuauguaucucuaacagauaagaauugcucccucuacacuuuuuaacauaaccacaauaucauuuaauaauucugucauaucaccuaguguucauauuuucaauugucucauaaaugugauuuuuaaaaucaauuauuauccagauaaggacuggaucuauuguucauuugugcaauuuuuaauuuucacuuuuuggaauuucuuuuaaaauuuaauuuuguuuaauaauuacauaacauauuuauauagguccaaagucaaauguaccuaaauaagguaaauugaaagauaucuggcuuuucuccaugacauucuaccuguuugcuccuuccccuuauagguaaccauuuuaaaaauuauggcuuauucuuuuauaauuuuuuuuaaauauaagcagacaggcauguauauuuucaucuccccucuuaaauaaugguagcugacacuguguauccuuuuuucugccuuacucuuaacauuauauccuacagcuuauuccauagcaccauuuagagauagucuacacuccauuuuucaagcagcauaauacucuauuguguggaugcaucauaguuuauucaaccaguccccaauuuauagacauuuuaauucguguuuugauauuacagauaauccugcaauuaauagugugguacaugucuuuugacauuuugcucauguauuugugggaucaaauccuagaaaaaggauuaaugaauccaagaguaauacauacagaacuuagccugauaacaugaaauaucccugcauaggccaggcucaguggcuuacgccuguaaucccagcgcuuugggaggccaaggcagguggaucaccugaggucaagaguuugagaccagccuguccaacaagguaaaacccuguuucuacuaaaaauacaaaaauuagcugggcguggugacagaccccuguaaucccagcuacuugggaacgugaggcaggagaauuucuugaaccuggguggcggagguugcagugagccgagaucacaccauugcacuccagccuggguaacagagcgagacuccaucucaagaaaaagagagagagaaaaaaagaaacaucccugcauagggauuguacccuuugcauucccaugugcaauaugugugagugcucuuuuccccacaaaucagccaacagagaaccuuguuaagguuuuuccauuuugccagccuaguaaguauggaaaguaucucaguuuuacuaugcauuuuucuuauguuaagcagauauacauuuacuuacuuuuccuuaaaacaguauuuaacaaauauuacuaauuuggguuuuuuucuuuguuuaaaagaaugcaagugugggagauaaaguucucuacggucucuauggcauaguggaacauaguggcucgaugagagaaggccacuacacugcuuaugugaaagugagaacacccuccaggaaauuaucggaacauaacacuaaaaagaaaaaugugccugguaugccauccuaaguuuauuuuauucuuaaaaacaaacgaauaugugcuuccuuuucugggagagcuaaguuauuauuucauagaugccucuaguggauuugcuugcuugcuuuauuuuaacuuaauugauugauugauugauugauugagacagagucucagucauccaagcuggagugcaguggcacgaucuuggcucacugcaaccucugucuccuggguucaagugauucuuaugccucagccuccugaauagcugagauuacaggcacgugcuaccacacgugacuaauuuuuuauauuuuuaguagagacgggguuucgccguguuggccaggcuggccucaaacuccugaccucaagugauuugcccgccucggccucccaaagugcugggauuacaggugugagccaccaugcccagccucaacuggauucaccuuaagaauucccucuaggagugccuagaaaaucucaaauauuaugaagacuguacccuucuaggucauaugagaugacaugguauuuuaagguacugagucauuguguauuauaguggaguagcauuuuauuuaacaauaccaaaaguuuuugaagccauaucagauugucagaagaguuggaguugaaaauuugcuggcuuuguuuaugggucauccaacuaacuuugcuuuuuuuguuuguuuuugaaaugaggucucacuuugucacccaggcuggauugcaguggcaggaucucggcucacugcaaccucugccuuccggguucaagcgauucuccugccucagccucccaaguaccugggacuccaggcgccugccaccacacccggcuaaugucuguuguuuuuuaaauuagagacgggguuucaccauguuggcuggguuggucucaaacuccugaccucaagugauccacccaccucagccuccccaagugcugagauuacaggcaugagccacugcgcugggccagacagcauuauuaauuauaccuauaauauuaaugcuuugaaagaauuuguucuaaugaguacacauggacacagggaggggaacaucacacacugggccugucgggggaggggggcuaggggagggauagcauuaggagaaauacguaauguagaugacagguugaugggugcagcaaaccaccauggcacauguauaccuauguaacaaaccacauucuacacagauauuccagaacuuaaaaauauaauuuaaaaaaaaaaaaguucuuuuuggaaaaugcuuaacccaagaaaaaacaggcuucucagguaaaauuuggcauuagauagaguuuguaaugaauauguuauuguuuguaauuuagaguaagaaccuaaagcauacuuacuuuaaaauuguacuucuuuuuguuuugcuagguuugaaagcggcugauaaugaaucagcaggccaguggguccauguuagugacacuuacuuacaggugguuccagaaucaagagcacuuagugcacaagccuaccuucuuuucuaugaaagaguauuauaacuauuaaugguaaugauuauuuaggucauuuguuuuugaaugccacagugauaacuauaauauauaaugugccuuucuagucuucccucuucuguaggaauagcauguuccucaaaugguccugaacuuuuucaccauuuuggugaacccuuuuaaaguaaauuuacucaaugcuuuaaaauucauagucuuaaaauaaaugugaauuuuguuuccagguauuuauucugggguacaaaaacuucccagaauuuacaguaggaaaggaaaccccuuuaugauguggcuuauuauuacaagcauucagaaaugaugcuggcuaagucaaaucauuccuugagacagugauuccuaaauguaaugccaccuuccugaacucucacauauucuauaucaugguuauuuuaaaaaauauauuuuuagccuuuuguaaccuuagucuuguuuugagcaaucauauuccguguuuuaugugcuuuuauauuuuuauaauaaauauuaaaguaaaacuauuaaaaauuguuuauccacguaccacuuaacuuaaaaucaucucagggccaucuagugguauauauguguacuaccauuuaggaaacugcuauaacacauaauuucaugaaguaacaccuaauacgguguaguucccuggucauauuuuauacaauucaaccauauaaaagggugucacuguaauuucaguaguguggguuuacaaauaaucugcugguuagcuuauuaccuugagguuuugaaaaacuagaauuauauugaggcauuucauaaacauaucucuugcacccucuucaugguggaguuaaggauaacuugcaggugguuggccaaggcccaauauagaugauuauaacauuuagaauuggcaauuagaaguugauaauccauauaggaccauaggauagcuuugaaauauaaauuaccaaauuauauuuguaaaugauagagaauuauauucuuaacagaaaaauauauacuuuuucuacuucuuguaaauacuaaacacaguuuugggguuuugaaaucacuuugucuucagcaagcaucauuaauaaguucaggugaauuuagcuuuuaauggggcauuaagcuggcauuuuugauuuucuuuuuaaauaauagcaaaaauaucauuuuuccccucuagaauacaaauuauugagcugucaaaacuuggcaugaagaauauacuauuacuuaggcuuaaauaucaaaagauaauggcuacuucagugucauauuguugaaauagaaacaaaacugcaugguucaagcauccuaaucauuagugccaaugaaugauagugcaggcaagugccagguaaaugccuagucccacuucauucuccuccugggaagaaaggauaagaauaguggcugcagauaagguauggaaauauuuaaucaagacugucuuaaacacauaagcauauauaauguuaucaagguuaccagugcugccuuuugauauauggaugaacauaacuguaauuaaagacgguaauaguauacaaaaugcagagcuuaaaaaugucauugcauaaauucuauuuuuaagauguugaaauguuaguaguguuuuucuugauuuuuaacagugaaauaaucaagaaauauaucuuuaaguuaaucugcaaagucaggcuguguucuguaaaagguauuucacagcauuuucuguuuaacuguaaucuguuaucauggagaucucaguaccagagcagugaauuuuuugaaaaauauugacugucuuuauucaagucagccaucuugguaagagcaguuuucauccccccacugcccaaauguaaauauagaucaccuaauuuuucuuacagaaagauacuguuaagaggcaugcacuuuucaucggauggucacuuguuucuuguuucaaagacaaauauuuggauagauacccauacuugcuaugagucagucacagugcugacacuauuuuaacaucauuuaaaauggaaagaucuacauagauuuuugacauuauuccagaaguaacaugcaaguaagauauuuuuauugucauuuucuucauguuaaaggagcuacuuaugaaaccuauuuuuuuauggccuagaguuuaugagugcuuuuuccuugucuucugaaaauggaauaaauuggauuuuugauacuuaagaauuuccuaaagauagcuuuuguaacagagaaagcauguuaaauuacacaugggucuaccuuaaaauuuuuguuauuauuuccaaagcacauuugcagggauaguaaauguauauaguagcaagucuacuauaauaacaguaguuucuggaucaccucaggaaacaguauaaauaaauaauaauguuuacuuaucaucaacauaacuaccauaguguuugaaugaauuaaaguuucauuagcuuuauuuagaaacugguuuaccccagcuucccguuuuuuuccaaauauaaaaugauaaaauauugauuaugugccaauauugucauuuaauguucuuaaaacuugugaagaccaccuuuuuagguagcugagaagagugauaguugguaucaauuuguuagccaggcaugguggcucaugcuguugggaggcugaguggggaagaugcuugagcccaggaggucaaggugcagugaaccaugaucacaccacugcauuccugcagagugacggagugagacccugucucaaaaauaaauaaaaagaagacaguugguaucaauucaaagaauaguugaugccuguucucuuauuuuaaauguaccaacagagcuauuuuacuguauuuaauaguucuuagcuuccaugugugaugauuuuaaucagugauuuuaugcaauagcugaagaaaauuuucugaagauuaagcugugaaauguaucaacccucaucuaauuuuuguaguacaaaaugacauccugauuccuuuuaaaaauucacguuuguaauuuauuuuucugcauguauugaucaaauaagccuaaaccaaauaugugcaauaaaauugagccuuuagauaguaucuagugcauuguuaaaaaagauuauuucuagauauuuaugauguuuuuguuuacguagaaaucaugaauucaaauguuuaaaagaugaccauauuuucaauuuugaguaauacauauuauuccuacuguuuuuuuucuuuugccauguuucuagaaaacagcuguguaacuuauugagcguuauuuugguguuacuguauaaaacaugcauaauaaauauucuuauuuaucucauguuacaagauugguccuggaauuuucacaguuuacguuauugacagaauguuuuaucaacaaugcauuugcuuaugucuuaguccacucaggcugcuauaauaaaauaccaucaacuaugugguguauuaacaaa

SEQ ID NO: 191352 - RNA, 199644 nt, Homo sapiens
gcggcaguagcuguagcagcuucagcgaagccggagaugggcagagagcgcgcgcggcgcagcagcuccagauucacugcucuccccugcagcuccccgcgcccccgccgcugucgcugccucggugucccccagccccagucgcgcucuuaggacagcgccgccaccgccgccuggcccugccugccuccugcgccgcgcagcccucgcgagcgccccggauggcgcuuuaccccuaggaccggugaguaggcgggagagugcagggggucgggcgucaaagcuuggcgcggagagaacaucuuuugguuugggaggcaccccaaaccagcugcugugauuccccguccuccaggcagaggguccagggaggguguugcucugugguccccaaggggauguuugauuucaacuccaccugcuggcaaccugaaccccucuccgucuuggggacagcugccugcagcucgcagucccgccucaccuuccagcccccaggcucccacacuagcagcaguagauggccccgacccucuggucaccccaaacagggucaucucuacuguuacugucccugcguucccaccuuaugccagugcacaaacgccccuaucugccacccuucacccgaucucgcgcugacaaagccuucuccacaaaguccucccugacccaccuucucuccuuucccaaagccuggcucucgagcccgacugucccguccuauuccuucccagggugaaugguccuuagugaauucugaccucauucccucuacacaauggugccuguccagauuuucugacagucaccucaggaaauugacacagacacgcugugauccugguuucuguacaguuacuuuguguguuacucagcaccugggcuguuaaggguauuaucaagcgugaaaaaauaaagacaaaaaccaaacccuuuggaaacaaacuuuuuguuauuguuguuuuaaagcgcagaacuauuugcauugcuuagguuuguucuguucauugagaggcgucuuagcugaguacaggaaauacaccuauuuuaccuguuccugcggaauuggucuuacuuccagguuaagaacggaggacuugccuagguggugaaucucuuucagcaacaacacuaucaaaagcucagcaacucuugaggauaagaagcuuuuucuugaaggagaugagaguagcaccaaacuuacccuuuaaaaucuucuuugaaauugcaauaagccaaagcucuuauuuuucuuuagguguaguggcuaaaagagcgauauaggaggauuagaaaacauuguaccaagaagcuccugcacuauuugggugcuuccagaguuguguaguaucuuagcaccagacgguauugcuguagaaguuuucuuagaacaguagucguuucuucugaaaccauguuuaccguuuuauuauuucuaguuggagugcgagaaaauaaagaguuguguucgaugaaugaauaugagcaagggggauggagugaacaucgggaggggucauuuaaauaauaaaauuugugcucucaauuucucauguauugaaaucuuaaaaacaaaacuaccccacaaaauuuaugguuuaauauuuuagagaaaugaugaaaaggcauucauuucaacauggcauuguacuccauggaacccuuggucacagggcuuguguucuaagcaauacggauaagaauauccagaaauaaauguuaggaacuuuaaaaggugccccacugaggcaugcagugugucaauauaaauuuccugguauuauuaucacuauaauuugaggggaauauaaauuaaagugccauucuugcucuugcaguugguggagagagauguaugcuucaucaccuuaaaggagcaagucucaggcuacauaagaaauaggaagggaaaguugagccaucaucuagggaauuuguuaguuaauauugccuuaauaccuucuccaaugucaggaauuuuuguugguuuguuuucauucaaacuguaucugagauuuuauuucccuuuuguguaagacauaggcagaaaugcacugagcaaguccacugacaaggggugguuuuaaguaaauguggauagccgcauuaaaagucaagaggggcugugaauaaugaguuuauuguugguuuucuaaauuugaaaauuuuaguugguuauauuuagggcuugacugagaacauucaaagcuguucucauuuggguaacauuagggugacuacuaugcacaguauauccaacaguaauuaaucuguaucagaaucgauacaucccaaauugaaagcaaggaguaauacuuugaucaguuauugcccauaauuauguuaaugauaaauuaaagucaauguauucuaauauaauuccaauuaacaugaaaauauuaacaaggucucagaauuaucuaugagaauccaaauaacuagucugccaaaaauuuuggcaagaauuucuauaaagaauuauggugagcugaaagucaagaagaucugccaggauuuaaugucauuggcauuaguaagaaaggcuaaacaguuaaauauaauguauggggagguaaggcacaccaauauuggaauggcauaucuuugaguaccauugaacuguaucuuauaaugcucauaauuauaugccaccuagaggaugacggguuuaaguauuugcaauguuaaauauaaauuaaacauuauaaagagauauuuaaaauuauggaaauuauauagauuauuccaucaacaaguugccauugguugaauguuccaugugaaaccauguuuugccuugugugugaugaagagaaagaaugguuaaggaagagaaagcugcaggaagggagagauagagagaaaggcuucaaccccuuggagacuggcuuaaauucuuuaaucaaauuaagguaacuaaauaugaguucuauuauuuugguauuuaguuaccuuauuugauucuuuaaucaaauaagguaacuaaauaaaaguucuauuauuugguauuauuuugguauuuggaauagcaauuguuuucccacuugaauuuuaggauaugacuccuuaauuauagcaauaauaauacaaguuuuuuaaaauaaagccuuuuauuccuuuuauuuaguaaaaucugagcaucagaggcaaaccauuuuguguaauccaauugaugaauugaacuaaauaaaauucuagacaaauuuacaaaaauaccuuaaaaaaagcacacauauuuacaccucacacauaccuaaaauuauaauaauagauaaagagcuaaacaauuuagugucuuaugaaggcaagaggauucagucaagagauaaccacauacaauauuuuuauacucuaauauauauuucuuguauuuucuuuuucauugcgguggauguauuauuacguuuuuauaaguauuugcauuuuuauuuauaaauucaugucucuauauuauaaaaugcaaauuuuauaaauucaaauaacccccaaauuacacuuguaaguaucaaauuauuacaaaaauguucauaauuuugcuuucuaucuugcauucaggagggaguauuuagcagaacgcauucuuaggagcaaauauguaaaaugaauauuucaaaauaagcaugaugauucaaccaaaguuuuacaacaaugcuauaaagugauacucucauaaacucuaauguacaauuaaaauuccuaacagaaacauuuaaauucugugauuuuuaccugugacugauuguguaaaauucaauuuuauuaauuuagcugcaaauggaaugcucggcauucuuaauagaaagauucacggaauucagauguugauuagaaauauagagaacauuccauuucuguuacucuacuaaugacuugcucaaaguuucaaaguaguuaauagaaacagaauucaaauccuguucuccugauuccaugcuguauuugucuuucuauaaaauaaaaacauuuuccacuucuuuuauuuuaagauguuaauaaaggagaagucaguauuaauguuaaagaaaucugaaaauaaaaugaaauaaaaggucugugcuucuucaaggaccaucucaaugccuagacuucuaacacaccauaguuaaagguaaucagucaaccagacuuuuucauucacucccaccuucagguuaaagcuugggaaauauucaaaaauuaaacugcaacuagcccaccuaaaaaucuuuuaacauuuuugcauaauuuuuauuagaaauuccucacuuaugcaguguaagguuuuucauguuaauagcaugucauggacacuuccauauaagcuuuuauagacaauugacugaaaaauauuccuaaaauaacagauuuuaguuucuguaagcaaaaugcacuuacaguuucaucuccaugcugauucaauauuuaugucaucacagagaagguuucguauccauauguuuauuuauuuuuaaauuuuuaccuccauagacugugaauaacucagguggucagggaagguaaauuuguuucacaaaguuucaagcccacagaugaaaauccuggcacuuuuagcuuucucuucacugauagccagagggaucaauggaagugaaugacuaaaucaauaggaaaccaucaucauuacugcguaaaaaaauaagcucuaaacuguauucuugguuaugguggcucaucaccaucauuucaucuaggaagaauaacauggugacauauuuugauaucuccauuacauuuucuggaacaacacuauauuaucuaaacgugcuuggacugauguaaacuaggggaaccagugaucuugcacugcuggguggcugauucaaaagcugaggcauugaucuuaggcauuggucuucuuauagcacaucaagaugcaaauuuggaugagaggaaaacuacacuucuaaggcuccccugacauaguuucuuuggagugcaauucagccucucuuuauugagggccuauggggcaagaacugaagugaugauggcaggcacaagaguaaguaugauuuaagcucugaccucaagcagcuuagaguuuaaguggagaagccaguaagaacaaauagaaaggagugaugagacaccagcugcuuuaaccuagggaugucaccuugguauuaaacaaggguguccaggaaaaacucaaaaagaccaaaaaagaaaaucuguuuuguguaacauggaucuaggcaugcuguggcuaaggcuugacaacaaaaauuauuuaguuccuuaaaaaaagcaaguuuccauugcuuucuauacuaauuuuaacucugacagaguuuuuuguuguuguuguuguuguuuuguuuuuuuuggacaaugcaggaaccuauuaguaguaugaacacagguagucccaaacuaacaaauucagugguugauucaguccuuggaggucauaggguaaucuuuuaauggaaauguaacuaaguauauacuuuuaaaguaaguaggaaaugcuuaccuuuuaagaaacuuaaaucuucaaggaauauucacagagaaguacaagcggaggaugcagggaaggagguuaugaacaauauguguaauagcuauccuauaaucaaaaguuuaaaaaccacuuuaguaaguuagacaaccuuaaaagguauuuguaauuaucuauguuuuauuuacucugaugaauguuuauugaacaguugcaauucagugauagaaaaggaagaugacauauaguugggaugauaaaauauagacucauuaaguaauuugggagaaguauauggcagcauuuaaauaauacguauuacaugucaucugaccuagaacacggacuggacaauuacuuuuauagccagguaaaguuuauaauauauauguuauugaaaaaaauaauggcuccaaacagcuucugaagguaccugaauuauacuauaguaggaauagcuuacgcccaugaaggaucugguuaauuuauguucaauauugguuuaccaagagaaaaaaauaaggucuucaauuuuuacaugagagggaaaaauauaccuccuaacuuguugacuguuuuaugaauacuuuacaacuuuauguuuucaugacauucguugugugaagaaagugucugaguuacauggguaauaugauuagagagcuucaaggaaaaauggggaaaucuuugacaugagaugagcuacaagacauagguguuagugauaacgauguuucacugcccugaccuguagagagccaacugagcuauuucacuagucaauuccugcugacuuucaaggguccuaaaaggucugagacuaauuuaacccacuaaguuaaguaugagugacugguuguacuccuuguuuugaagaggcugcaugaaggcagucaauccaacuuguccuauuugucuucaccaacagcuuaauuguguuugucugucugcacugaaugguuaagcaagaguuacagaaaugggagugggaaagacaucuggagguguugacagguauugcaugggaaaugcagaaacugagaccaucuccugauauuuccaguaguuuuuuugcuuuuguuaaggugaauauagaucaaaucauggucagagcuuucuggugugggauggcagaucuggcagagaguuaaauuuaaggcacuugcaacaguugaaugagccacuuuuucauguaaaggugagauggcacuggagagcugggcaagcuacaagcuggaauauacucuuucuauuuuauaagcgagguucauaggaccccuuuuuaccuuuguucgucauugaaucugaguugguacaccccaaaaugaaauaguaugccagacagucauaaggucuucaggaucaggaguucaguuuugacaagagcccaguagcaagcuaauagcugcuuuucaaaugagguguaccugguacguguauauccuguauguuaaggaggugaucuguccaaaaucccaaagggcuccugugaauggaagcugcuuacguuuuccuggggcuccaauuagaaaaaucauuagucacagaaacugguagcucacagguuaauuagggaugugggaccccaaauauagagagaaggccacagccuacuaacacaguguguugguuucugcuucauucaaaagaugcugauauuuuggaccagcuaauauagaaguccaaguagaauuuccaagugaggaacacaccaucuccaaugcccaaaugucccaauaaggugcugaacauuguuuuuguuuguuggggaugaagagacagcaguuuuucuuugacuaccagaaggauuaaacauugugaaucugcucauuuagucccaagaaacuuuauuugacaaucagaacccugaauuuugucagaauuuaucagcugccgugguugauagaagugugauaacaccacagucaauuuccauugcaauggaagcuucuaacuggcugauuaacaggacaucaucuguauagugaaagcuuugcaccauggagaguagggacacuuaugcugacuuauguacuacugauggcaaauggcagaggaauguugguaccccugggaguaaccuguaguaaugugggagguuacuacaaauguauauugguggcuauguugugacuugaucuuuguccucagaagccagugguauagaaaagcugguacuggcacaguccaagacaggauaccaagaguuuaaucugugcaauggauucaguuacaugaauaguugggauuaugggauuaacaacuugauucaguuggugauaauccauuccaagcuucuagcucucauuacacuguuucacuggucauacagugcuguuguauuaaaacacugcaucucuuagcacccauguucccuucaagucuguaaucaaggcugugauuuucuuuccucuuuuucuucuuauuguuuuuguuggaccaucugggaggaaauagagaacaagaccagaaagugauuuaugugucccuuuagcacuucacuacauuuggccuuucccaauugugauaaucuccccaggcacuuaacugaugaugaaguauaagcacuuaauauauuaauuacuauacaaucggauauagaaaauacaacaguacauggaauuggcccaaagggcuccauucaugagaugauguuaacuugccuuucucacugugaacacugcuuaaacuccauuagcuaaaucagacaaucuuuucuuucuauaaauccaguuaaaaacaugacuuagguguccacaucccaauauccuaaaagucugauucccuuauuuuccugaaauuccccaacauucuuggauaggugcauaugucauuugauacccauugggaauagagauacccugacuucuaguaauauuucucuuuaaauaagcugagauuaugggagaaggggacagaagaaucagaggguaagggaggagagagacuucauauguauuaucccaguuucaaugauauugcaguggcucauggcauaaccaaauuaacuuagaauauuguuguccagccaauacucuauauugggagcaggacuccuguggcuggcaccaucuauuucauccuuggggauccuuugacucaguagccacagauacauugcuguuuuucuaggguaugggguuugugaccucuggcugacucagucuuggcucacacaauggugacuuuaaggcauccaccuuaauuuggggcauuagcugccgcaauaucuuauaucucuuaaguucucccaguuucagcaucaaggauagggaaguuucucugcacaguguugauaaccucaagaauuuaccuagguuucuuugggucucuuucucaauuuucuagugggucaauuuuaucagaauucuagacucaauccaggccauuaagagcccaaauacuagucaaugccucaucugugguuuuccacaggaguuuuucugucucagaaaaaucuccucaagaggaguaaagcuuccuuauagcagcaaagucccacugcaaaaaccuuugauagauuuucucauuacuuccaaguggaucuaagguuggcacgaaggcgagauuuagcuguaagucaacacagcauuugccaugauuccuugagaagcaguaugauccauaacccccuccuuuccauugugagccaaaauucuaaugauucaccugguuucuggcuacagauuucccuuuucacacucaauauauguacacauuacucuuuacuauugucugaaagaggguagaagcuucugccuacccagugcaaaucuuaguauuaguuguuacagugcugcaggucugagacuggacucgauuccagucuggaauucucagacaaggaacucguuccauuuagaggaaaauucuggcaucuguauuuuaccuauuuuuguuauuuagcuugcaaugaccuccuugauuccuccucauuaaaaggcaaagaagugaaggacugucuaucgcccaguggcccauauaauuugcaaacaucuuuguuacugauucuuacagacuucucucaaauauuuaucuuccugaaauuuuucaacauucuuggaugaguguguauauccuuugauacuuauuggggauauggacccuuaguuauguuucuguguaaauaagcgaggucgugguacagggacagagaggaaucagagagcagggaaggagagagacuucauauguacuauaaguuucaagugaugugguggugguucauggcauaacccaauuaacuuggaauauuuaauaggccugcagggcucucaucuuuucucuuccagaaagccaugacuuugucagcaucccauccucaucacuaacauuauaaaaaucucugaagggucugagauuuuucucugcucacaacuuaacaugaaagucugccacaguugaauggaugcugguagaaaacaauagacuccuaggucagagaugaaggacaauuuauuuuucacagcaauagcaguagcaaaaauaucaacauuuugguccuguucccugggucccaauuuccacaaggcaacaugaaguauacacauuacaaacaaaaaggcccucaauuuaaggaaugucaccccuuuauaaugggcagugaacaugccucucuuuguuccagaagauacuauuucuauccaaggcugucugcuuuacaaacauguucuuaaaacaguucaaaacaaaagcagucaaugauucuuucauaagaugugcaaaaugugaaagacccauggaaaauugucucccaguagugacaaaagacuucaauaagugacuguuuggauaggcuucuuaucugugguaugauauauguucauccuugcuauuuccuacugauggaaugcauuaaacuuuuguuaucugagauugaugaaccuuucacuaagauagaaaauaagaaggaagcuuuuggaacaaauauauuguauuuaagcugcaauauuagagucuaaauuaguaauuucugacuauaaucuauauagauuacagcauagggcguguuaaagaauugggaauuucuaugucaggaaguaaaaaugugagccuaaaccacaaaauauauuaagcauauacuuuguguaauuauaauguauuguaaaucaaaaucauuaagcaaaaauguguuauuacauauuucccauggccauaauauuucuccaaugcuuuauaguuugaaggguguccaaauuuuccuaaauaaucaaaagaaaaaggugcaaugcugcuuuaauauguuuaauuuuuucaagacugagcauaauugucaucuucucuaauaggcaucuccuauacacuaggcuuggacacaugccuuucuuuguauuaacacaauggcagguuuauuuguaccauuuuaugccuuuacaacaucauauuggccuuauauauuuauguuucccugacuggauuacucugaaauuaaaacuuguugcuuauuacucuucguacuccuagugccuaccuccccaacugaagcauggugaguauccaauaaaugcuaguagagaugaacugaaaguaacagugucuguuaauguugaauuuacuuucagauauuccagacaauuaugucccaugaugaauaacugaauggaagauguauagcugaaauaauuuauaaaauuucuuaaugaccauuguuuuacuuauagucauguaaauauucauauccugauacucauucccaguuuugagacauccugaaacauuucaaauuuugcauuuauagugaaacuuuaagauuuuauaucgcuuuuauacuuuuagacauugaagagagccucacaaaauuaaauguaagacuuugguuaauuaucaaaagguuuggagucacugauuuauauuauacagaauuuacuucuauucuaacccugcauuagaaauuucaaagcaucucgccuuucuucuuuuucaaagagguagacugaagaugaauacaugucccuuucucugcccugaugcacagauguucuuucuuuauuucuuugucauaguuuuuuucucucucucuugcguucagauagaugucugcugcucauaucuaccuuugcgguuucugucaccaccccaccuaaucauuauuguuguuaucgccagugcugccaacccugaaaucugguguacuucuccccuuccucuuuucucaaauuuuccaauuucuucugacucuuauugcuuacucauauucuaaaaacaacaaaaacaucaacaaaaggacugucucuaagggacagcugcccuuuccuucugugcagugaacuugaaggaucagauaaagugauggguucucuggcuuuuauucuuuauuuguugguuauucaagggcuggcugugucuucacuucacuucaagggcuguauuuuucugcuuuuuuuccagagccauuuuggaaauuuaagaauucuaaauucuuggauuuucauuagccaauguuuugcuguuuucuucauaaaaaaacagguuuuuguaauuuuuuugucccuacauugccuuguuauuuaauagcaacauuaacaugugaauaccuuagaacuuauaaaauaugugugucauuucaaggaauaaaaagguuggagugaaucaaacacaagacagauauguuuuuaugggaagaauggaaggucaagaaaugacuggcuugcuuggaguaugccaguggcaaucuugugcagaagaaaagaggaagauaucaaacaacagaaaaacaaagaaauucuguagagagaagaaggggcaaaguagaaguucuagaaaaauagagacaaauauuuaccuauauuauaauagggcuucauggaaacacugcguuacauggaaaaaaaaacacagagcuguaaccagauauaacuggguucaaauucuuaccuguuuauugaguuaacuguucgacugguacaaaaucacugugguuuuggccaguauuuuuaauggcaaaggaaugcuuaauuaaacauugaguaauguuuaauguuuuuaauuaaacaaagacuuaauaucaacuauuuagcugagagauuaaagucaaauuucuuaguauaucugagacucuuuuuccuauuacauaaaaauuuugcuuaauuauuuugaauauggaauuggauaauauguagaaaucuuugaaacacugacuggcacuguaaauucuaauucaauaaauguuacaucuucuccauacuuaagaauuuaagaagacauaaucauuucaguuuguaacaaauaaaaugagccuauuucccaaauagacaauuagcaagugacaauuggauaauccaauucgauaaucagcaacuaggagaacuuuggaacuuucagaauauuauauaauaaugcaggaagaagcauauaaugagcacggaagagcuaauuagaaucauacuuuccaugauaauaugaaguaaucacuuagaaaagaaguuaucuauuuuaauaauuauucagucacagugguauaaaauuuuuuccacaagaauuaaaacucaugaacaggaggaguucuucuuuuaaccaggaugaacaaaacuggaaagacuaucaaucccaccaucacaaaacaaagccagaggaacuacaaaaccauaacuuuuguuaaaccuguuguaaaaccgaguucaccaggcaaacaaauaucuagguuuucaggaaaugauagguuccuccacugagaaacgagucauggggauagugucauauguggcagagaauagaauaggaccuggcugucauacaagcgaugauagaaauuauuauuaucuaaauuaucuaacaagaaauucuguaaaaagcuaaaaucauuacaaauugccaaagacugacugacaguuuagaaacucugguaaucccugacgcaaggguaguuugaugucacccauuggggcuuauauguggacuuccacuagguacguaugagaaauauuggaagcaggguggggacaggagggagccucuugguaauacaggugcagaguaagggauuggcugccacuucagauaaagcacaaaaucccagucuauucaagcucgcaucccacauccuaagcacaaggcuagaggaaugugaagucuuuggcauccugaagaucaacucuugacuagaguaacucaaugccccaaacgaauggcuucagaauagcaaaaguacacucuguuucuagguauaaaugauuggcaucauucccaauuauuuugcacuugauauuugacauuuaauugacaaauuauaagauauacaaaaauuuaaagaaagaaaaacgauugucaaaagaagucaagcaaugaacaaaaccagacuuagggaugauccaggaguugaaauuaucaaacagggacuaugacuaauguauuaaagaaccuaauaggaaaaaguggacaaucugcaugaaaggauggagaauuauggcauaaaaauugaaagagcaggaaagagcaaaaugaaggugagaagugaaaggaaauauuaucacagaucacaaauucugcaauaaguggauaaauuuaccaacaacaaucccaaauauggugcagcuaagaacagaguuucagaauccaagaagcgaaauugaucaaacugaaaggauaaaaagauaaauccacaacuauggguuuuucugaugaccagaacuccucugucuguaguugauagaaugagucgaaaucaguaacuauauagaaggccugaacaacauccucaaacaguuugacauaaaugauaauuauagaauacuccacccaauaacagcagaacauggaagaaaauacuuacaaaauacacaucauaaaggacugauaugcaggauauauaaagaauucucacaauucaaugaucaaaaccauauaacccaauaaaacaaguugcaaaauauuugaacagacauuuuaacaauggagauacaugguaggcaaaaaaaguagugaaaagauguucaacacugguaauuacuaagaaaauuaaaaaaauuaaaaucagaguaagauaucacuguagaccuauuagagcaaaaugaaaacagaacaaacaaacaaaaucaugaccuuaccaaguccgagugaaaauguggagcaguuggaacacugguacauugcuggaagggaugcaaaauaguacugcaauuuuggaaacuguuuaauaguuccuuauaaaguuaaaaauacaaauaucauaugacccagcaauacaauuucuagguauuuacucaaguagaaugaacauguguuucuacauacaaaguuauaaugaauauuuaagugugaaugaauacccauacuugccaaaaacuagaaacaaccuaaguguccaucaacugcugaauaaguaacaaacugguauauucauacaaugacauacuacuuagcaauaaaaaggauugaacuacugcccagugaaaaaauacacucaaaaggcuacaugcugcacaauuacauuuauacaacauuaaaaaaauaaaaacguaggaacagaaaacauaucagugguuucgaaggguuagggugggaaguugaggcugauuuuaaaaugacaagaaguaagauuuuggaggugauggaacugugcuauaucuggauauacacuggugguuuguaggccuuugucaaaauucauagaacuugccacuuuaaaaagauuaauaaucuguuugcaaaucauauuucaguaaaccugauuuuuaaaaaaucaugauuggaagaaugagagaagucccauuagguaggucuacauguuaggcacuuucuaacagugccuagagaugguuauuucacauauuuuuaauuccuugcaauuugaacauuugaguguauguguguaaacaaccuaauuuugguaaauaacauuuugcauuauuccaaaguauugacacacaucuauauuaaugaaaucuuuauuaaauccaaucaucuuaaucuaaacuuaaccuugaagaguuauugggaaaggauuuugagacagauuaguagauaaaaaaaacuauaauuuagagagguugcaugguuugcuggugcuauuaagcauuguagucagacuaguaaacauauacugggauaacuuaccuuuaaguagaguuagggugacugccccccaagaucacggcccaguguagcaaacuggucuaguaaaagauuaucugcccacaacuggacaguaauuacuuaacaaauaguguauccuucaauagagcaacagaauauuuauucccuagcaauuuauaaggaaguauaccuuugaccugcuccaucuacuagucaucaaaaacuuaguuauauugauuaguacauuuugaagaauugacuauugcucuaaggaaauuggccccaaauuuaaauacuuuacuucuacuuuuaagucuuuuuaaauauauuuuuccuaguaauuuauuucucaguauauuuuacaaaauucuugauggagaagaauuuuaaaacaaaacuaguacuuuacuucaauugguuugagaaacacucauucccaggcauucaaacuaacuaaauaaaaaugacaacugaaagaucuguagccaauguggccuauggcuuuccaguuugcaguucuuccuuuaaauauucuaaacuugagaccuguguaccaagacugcauuauucucaccuuuugcagaacugauguaccuauguuauguuuucaguuuacauugagcucuguggaacauauuguuacauuuaaaauaggacuuuuaaaaaaaauccaguuuauuacauaauacagaguccuuuuaugauaaucuacaggagaaauguuucucacacuuuguuucccggaggagucguacuuauuuuguuacugauuuuauugaaugagccucuuuuuaauggcugcuaggaagcucagugucaacuuucuaucccuaaugacuauggagagacuaugauaugccuuuuuaaauuaagugacuuaauuuaugaauguuguuguuuaauuuuauguuuccaaccuuauucagucaguaauuuuuuucgcauaauacauguuaacuuuuaauaaaguaaaggacacuagaaagaaagacaaguaguaaggaaagaaaagaaaggaaggauuacucaaauaugcuuguauacuacauauuaaauaucugaguaacucuagaguacauuacuucuuuaaauuuuacucuccuagauaccuaguugaaaaauauucuuugaaaauauaacuuugaaaauuuuaauguuaagaauaccugcaguagggggaaauuuaauacuauugucuuuacgugaaaguaggcaguaaaauucacccauauuuccuuuucagaacucccuguucuuaaccagguuauguaaacugggagucccuucauuauuaucucuauccauguggucucacaguguuucaggcuccugauuuaagccuggcccugucuauaggcaggcuguguaaccagagagauaacagcauccuacugagauaauaugcuuuuauuccuaauggcaaccugaggaguagaggaacaguacguguuauuagagcaauuguaagaaaacuucaggccagauuugcauccuguucaacucggcaugacgguuuuugacgguuuuuugauucccggaaagaaguuccuaggcugcuaaccaggaaaacaauccacgcuauuaagaacaacuacaugugguuuccagcucucuacaaugagaguugaaauucuguauaauuaauuacaccuuaugcagauaaaaagaaaggaagcguaaaagcaaaccacucugcuagugaaaguaugaaaaaauauuaaaagcuuauuuguuaucaguaguuucauaaccacugccaagcuuuguucuaagauuuugaauauauuggauugacuuucacugaauaaagaguaauuguaauacuuuucagcuugugagaccuuacaucuaagucucacugagaacuuuuugaucacuaauuaaagcugcuaaacaguuaguguacuucuauugaauagaagcauuuucaugauugaugagacagagccaccauuaaaaugggguacagcaauccacagauagaauaaaauuacuuauaaagggaaaugacuccacauucaauugaaacagcagguccagaaaacauguaagaaacaauuaauuauauaggcugaaaauuguccaaaucccuggaaaacuguccaaggucaguuucccuucacccuaaaauuauuuuccugaggcacauaaaaauuuuauugacauagaccaguuguauaaauagcacagaauauguuagacagcuaauuuuuucaaacuaaacaauuauauagacaagcugucuucuuucauaaauuugucuucugauauaccaaaauauaaauauucauacacacucaaauucaaacacauauuuguucuuauguacauacaaauacaaauuagcaaauauguaaacacacauacaaauacacucacacacaaaugcacauauacauauauaugcuuacauauaaauacacacauucauaaauauauacacaaauacacacacacacauauucauccuaaacuuacuuaaacacccuaaauuaagaaaaaaacccuccaaaauuuaaaaaaaggcauaaagacauuuaacuuaggaagggaaaccauaggacaaacaagaagacagaaaauauaagcccuauacagugcuggauaagcagggucaaacugacuucccauugguagcacuuuuucaguauucucuucuuauuuccaucuuaguucuugaucuucauaucuuuuggcucauuccuccagcacaucacccuucugaugaagcaggcacagaagcagaggcaaccucuguaccaacuugggaagagguagagcuacaucaucauuagaaggaguagaggagcauuuuaucauuauaacuauuacugaaagauaauugccuaugagguuaugguuaagcacuguaacccuauuaccuacuuauacugucccuguuuuauuuagaauuauauccaauaaccaauaugaaaucaaacuggcggagaaaaaaaaagcagaaaaaauaaacaauaaagcaauaccaaaauggaccauaaaguauaauucauguaaggagcaguacauguucuuacauuauuuuuuaaauuauugucuuuauuuaacaauuucuauugaacuaguguguaaauauuucagugcaagauaaaugcccuagauuaggaaaugaaucaaucagcaugaauccauuugagaagcaacggaacagaaugguucuuuaucacacacuuacuacaauaagggcaauuuaaauaugugcuuagaagaccaccaccuacauccuuauacccuaaauuaugccucuccagaccccaaacuuaucccugcaagaccccagagggcuuguuuaacaggugcaaagaaugcuaccaaaguucuuaacuggaggugaaaaaaggaaauuagccaugauuucucuuguuuuucaacuuuuaacuuuguaagaaagaucaguuuuggaacaauggccuauuacaaagcagaagcaugagaauagugguuugggaacuacaagguaucaguuguuuggauaagaggagauaagcaaaugauuuaaauaagagaacauaggcaaauuagcuacaauuuucuaaaagcucugauaaaagagggacaaaaagucaucaauucaauuaauucacuuaaggucaugaaguuacuaaagagaagaaaucuuuauuagaaaaaaugauauaauuaccuucuguaauagauuauguccucuccauaaaaccaaaaugcacuauuacacauaugaggagagggagggagggaaagaggaaaugaggaaaaaagagagaugaagagagaaggacaaagucagagagagagaagagauccuauuuauucugggagcauuacugaauuacuauuauugguaugacaaaaaagugcauaaaugcauugaaaacaaauuauuuacuccccuguuucuuuucuuggaacaguaaaugucacucuauauuuagacuugaauuucacacucuucaucucaucuuccuuugccacccauaaccuuauuuucucuuauaucuuauucaauuuccuuuuaucucuuaauacaugcauacaacacauuuaauuucuuccauuuuuaagagguaaguuuggaaauauuggcccauaguuuugaagaucaauguaauauuuacccaggagaacuucaaaagauaucuuaauuuuaauauuauaauuaaaauauaauaaaauauuauauuuauuauacuaauauaauauuauauuaaaauauaauauuauauuuauuauacuaauaaauauaauuuauuauacuaauaaauauaacauauuuauuauacuaauauaauauaauauuauaauuaaaauauaauauaauuuauuuauuauacuaauauaauauaauacauauaauauauuauauguauuauauuaauauaauauauuauguuuauuauauuaauauaauauaauacauuauguuuauuauauuaauauaauauaauacauuauguuuauuauauuaauauaauauaauacauuauguuuauuauauuaauauaauauaauacauuauguuuauuauauuaauauaauauaauacauuauguuuauuauauuaauauaauauaauacauuauguuuauuauauuaauauaauauaauacaguauuauaauuaaaauauaauauaauauuuaauaauaauauuaugaaaguucucaucugcaaaagaauacuuuugauuuuagauuucuuauauauuuugagccaaaaccuuuauacuucagaaucgagauucuauauaaauacuaaauagcuuaauauuuaaaacauaauuuucauccaagauguucuuuaaaauaauauuugaguuaauuuuguaagguucuaagcagauuuccaugcugcaagaguaacaaauuaugaagaguaaauauauaucugaaauuugcuauuauaauuaaauaaaaccaagagcaauguuaaucugauacauugagucuguucaugguuugcauaaucgugauggugcagaugauuauuagacauaaaugcuaaguaauucacauaaaugacuaucaguagaauuacuugguuaaacuaacuuuuuggguuuuguuucuucccauuuugucaguagggccuuuagcggugguaacuuccccauaacauguacauuuaaucaugauuguuauuaacucaaauauaacauaauguaaauuguuucuuccuuacagaaccuuaaguuucuuucacuggagagcucuucaguucauccaugaagcugagucccagauuaaaaaccauugcugugguuugucuguauuuugguguaucaaagcagacaaaagaaaaggaaagcaccuccaauccaucuuaauaaucaucccaccuuccuuucugcuuucauaugacauuuauuuaaaccaagcuauagcugugcuucucaaaccuuacaguccaugugaaucaccugaagauauuauuaaaaugcagauucuuauucaauagaucuggguugggaugggagauuucuaacaaacucuuaaguaaacuccuacucuggaaaccacacuuugacaagcaagggucuguaaaacuagaaagcuagaggccuuuuaguucauggcucuuaaccaagagccugcgaaucucugggacauuuauccacagguuuuaggauucuaugagucccaagaaauaaaugcaaaauuuuauauguauguggguaugggcauuuuuuuauuuucuggagaguuaacaguuauuagccuuuguaagaggcuuaugaagaccuaauuaaaauaaguggguagugauugaaucagucccauuuuuagaugaguaaacuaaggucuaaggaagcuaaauuaucugcgagguucacagaguuuguuacaaaccuaggaauugcauccagguuucuggugccuaauccaggggcuuugauuguacuagacugucuuucaaacuuugauuugagagaaauaaguguaauaauucaguaaauaaauuuaauaaugaaagaacaaauaagcaagugaacacauucaugcauaugauccuuugaagagaaagcauaagaauauuuggccuggauuaaagaagaaacugaugguauugauauuuaaugacuuugauauggaugaaguuggggaacagcaaauacuggaaaaaggggcagcaaaaauggaauuuaaagauuaacccuugagacuaaucuuuuucuggauaaaacucugcaaaugcuuagucauuagucauuagugugaaaaaaaaauuuuuuugaauguuaaaaaagaaaaaaagacccuuuuuaucuucucugcagagaaauguacuuauaaacaauaucauauuuucauuagccaauuauaccuaauugugaauacaaaauggcacaagcacaaguucuuaaaauaauuacugcagugaugagugaggugaaugugacagugauugauuuguaauaccagugaaaugugcacagaaauacuggcuaagacuuuaagcugggcuaugauucugaagguauuagaaguuuccagacaagugagcuaacuugagccuacuauagacaccugaaacauacaccuaaucccugcaucuucacugcagguguguggugccuugaacagagagugaugcuucggagcguugccacaaggucaauggcuccuaaguaagauguauaagaugacaacagacaacuucagguaaaagaaauacaaaauauguaauuacaacacuuuuaggaaggcaugaguuuccauuuaauuuccaauuauggaaucaaaucagaagaagaguaaaguuuucaaaagagagguucagaacgguugcacauauucaccagagaggaucuucugucguaucugggucagacgaauucacugcaaucuuggaaucugaaacaugaguaauauuagaaaacugaggccaucucaggcuucuauuagcagaacaucuggcuaaccaaaacaagccaaaacccauuuuuaauucuucuucuuugccguuaugcguuaaaacuauaaagugaauuugaaaaagaaugugggagacuaugaggaaaauauaggguaacuuccuuuaaauuuuuucuauuaugcuuuuaaaaaauguuaagaauucagaagaaauuuggcauuucuagaaaagcaguucucuuccagaaugguagcuggggaaaaauauguccaauauguuucccaccagcugccagagauauauuuaaaaugcaaaucugacuagguccaaucuauucuucaacauccaucaaugacuuuuaauugauaucaggauaguguuugaauagcuuuaaauggcuuugaacacuuucuuaaucuaguucuuguuuaugucacaaaucucauuuuucacugguccccaguuucuacuuuaagcuuuggugauacugaccugaaugaccuucuuugcaccaucuacaugaaaauguggcucuucuuuagcuuaugcuuucauucugcacagaauauccucuuuggccugguuaauuaaccaaaaacucaggugucaccucuuccaggaaaacuuccccaaacaaccagccuggaauaaucaagccuccccucaaugcuucaauauuucuaccuuagcacuuaauguauuauucugaaauuauguuagugaaccugcccuucuuucugcauugaauaaucucuaagaguagaugcaugacuuuccuuuugguacuucuaucacuaagcuuagugaugggcacauaauuuacgcucagcagauguuuauucaauugaacugaacaucauucaguuauauauauguauacacacacacccacacacacacguauaugccauuagugaaaaccaagcaauggagugcaauuagugccaacuauguggaaugcaggcaugagacaagagaggaacuucacaguccucagaguauguuuauggugauaaacaacaaucacguucgugcuuacuaccuauacuaccuacucuccauuagcuccucaccaauuuauaaaaaugccuguaaguuucuacugagccuauuauuuugucuucguuuuacacugugcacccgcuaucucauuuuucuucauucugucucuugaacuuggcaaguuuuuucccacuucaggccugugcaugugauuuuuuugugccuggauugcucuucauuuauccaggucucaacucaagcauuaccuccuccucacaggggcuuccucagucaccguaucauaaguagccaaacccguacuuuccuauuauuuauaacaucugaaaaucucucauguugcuuauuaucuaucuucucugcuagcaguaagauagcagaggacagagaccuuaucuaucuuuuucuuuacuaugucuccuucaucuacaagaguccaagcauuuagcaaugagcaauaaguuguguagacguaaugaaaugaauaaauacuuccuuuccaugugggguuuucuuauaaaguguuucuacaagacuuucuuggcuuaaaauauguuagaagcccaugucucuuggacuuuaaauucaaacuauuuuuuuuucugucucuuuccuucucuuucuugcuugcuuuuuuacuuucuuuccuucuuguuucaaguauuuauuaggcucucauuacauguuaaguagcgauaacuaauuuaucauaccauguaugugaccuaugacauuauauaaaauuuuuaaauuucugacuuguucugaauauugaaugcuauauuguuugcagugauuauaagugauugucuuuguuaucccacugccuaaccaagugccagugcuuaguuguuuaaaugguccaucuaguugagaaccauuuagaagaacaaaacacauucuauuugaggcacugaaaauuucaacucaggccuacaauaaauucauuuauuuauccaucaacucacuagugcagucauguggucuaaaaagagcacugcuuauuagcuaguauuccacaagugaaaaggcauaagagugcaaaaccauggugcauuccuagaacuagcaauccucgauauucuuggagaauaaagcuggaaguagaaaagggaaugaagaaguagaaggucaugugacauucagaaggaucagaucaaaaaacaccuuucacgacaggcaauugagccggcauuuuauuuugucggugauccuacucuguaguauccuggcaaucaaguagaggguuggagugacuaaacccagauaccacaguucaaagaaaagagauggggagagcaagaacagugcaguguggauagaggggaaucuauguaaaaagguaccuguuuuggagguagcauuauuagagcuugaaugauggaaugugggcauugaaggccaaggagaaaucuaggaugaaucccuggauuuggcuuagugguaacauucaccaagacacuggaagauggccaaguuuguugaaguugauguuauagcaguuucuuuguacuuggccuuuuuaucacuuuuauuuguuucuacuauuguuuaaaggguuuaaugagagggugggaaaggaagaggaauugaugcacuagaauucucagauuugagccuacaugugucuuuaccugugacugcccgcccccuuuccucaucaucagcugccccaucucuuauuuguucugcuuuucucuaggcugggccagugucccucccgguuuaugccuuuccccaguuuuucucuccugugacccaucuugcaaaacacgacuuuguacauguauuuacacaucagugucuuccccaucuaguagacugccaacuucuugaggacaggguuuauguguccacaaagcagccagcagaaugccugauacacaauaaaauauuuuauauauugaauucuuauuuaaguguucugaagcuaagaaauucagagugauggauuuucuauuacucaaguucuucccuacugugcuugguagaauacaugauuuauaacuuacauguaaauuucauaagcuuuguguaaauaauucaaaauuaaauguaaucuuuuacuguucccugaauguaaacagacaucuacucauauuaagguaaaugauuuuaucuauggauuuccuuccaacaucccauuucuaugcaggaaaauaaugacagucuuuuagagcuacuggcagugugguauggagaaauuuuacaaaaccagcugacugcccuuuaacuggcccugaaauggacuugugaggugauacauuuagcuguucuggacacuaguuuuuccuucauaaaagcauaugucuaagggcauuuccagcuccaaaauucuuugaucuaaguguuuuuauuuucccuuguugaauuucuauuuaggacauuaaacaaucuguugauauaucuacagucaccauuucugccuccuguuaaucccgaugagucuccucuuguuacggccuaaaccuuuuauggaaaaauauuauugaaggguaguguuuuuucuguuauuguucuaauacagaaauaagagaauuacaauuauuauuuguaguaaguuauguagucagcacauuuuuguucucucucauguuuuugcaacuaaugaugcuuuucuccugaacuuuaucaucaaauuguaccaauguuauuuucaaguacuugccucuggaauagaaaccauccuauaacuuucaguuauuuccagacucucugcucaguucacucccccaccaucccgacaucccuagguucauccuggucaggucagugagaacuggaugccaagcugugccugcagucaccagagccucccacagccucugggcaggcaugguuaugucuauaggggcaucaucacaaccagcaacuauggacauggaggcaaguaucagaaacccuaaccuuaaauauaacuaagggaauucccagauaaguguuagaaacaaugucugcaucuuguugcuucguauuuuaacuauuguuuuuucuuggugaacaaguagcagauaguuuuccaguuuuucaauuuuauuauuaaaaauuuaaaacacauggagaauuuaaaagaauuuaaaaugugcccacuaccuaaauucuguaacuaccauuauauuacauuuguucugugcuggaauauacaucuaauuauuccuguaaauucguuuauuaugcauaguaaauugcaguacacuuccccuguauacuccagcaugcauauuauaaacuagagaucaauauuuuacagcuguuuuuuuuaguuauuuaauguagacuugaaagauggauauucuagagaugaaucaaaucuuagauacaaugaagccccaaacccuccuuuuuuggucuuguauuagcccguuggguuuaaguguauuaguccauugaguuuuauagauguauuaacccauugaauucucacaacaccucugugagauacuucccauuauucuguucauuucacacauaagaaaauuagaguuuagagcagguaauuauuaagacuuaauuuauuaagcuuccuuugugccgauaaacuauguacuuagcauuuaaaagcuucuauaauggugguuaucugccaucagucucuggaccaauggguuucuugacuaaauuuuuaugaguguggcaaaauaaaauacauuuuaccuguggugaguauuacauaaauuuagauuugaucaauucacaagauugucguuuauucuuuuuuuuggucucacucugucgcccaggcuggagugcgguggcgcgaucucggcucacugcaagcuccgccucccggguucaugccauucuccugccucagccucccgaguagcugggacuacaggcgcccaccaccacgcccggcuaauuuuuuguauuuuuaguagagacgggguuucaccguguuagccaggauggucuugaucuccugaccucgugauccucucgccucgggucccaaagugcugggauuacaggcgugagccaccgcgcccagacgauuguuguuuauucuaaggguauaacuguuauacauuauuugaugucaaaugacauuguuuuuguuaaguuauaguuacaauagauggcagucauacuuauuuguuugguugguugguuguguuuguuuuacugcucuuacugggaaaaugccaauauuauuuuauuugaacauuuucugucuauaaaauccccaaaucugagaacuguugauuuauacuagaaguacauuauuaagugucuuacacauuuaacuucucauugaagaaaauuaacaaaauuauaauuauuaguuauucaagagcacaauuguugugaaugauuaaucuucuuugaauagcauauuauuuuuuaauaguuggaaagaaugcucccacaggggcuuuuuguaaucucgaaggacguaagucagaccaucuccaaggugccuccucugacacuugacucucuuauauucauauaagucauaggaaaaucaauaucaguaaaauaauaaucuuuuaaaaaccaacacauugcuaucugaucagaucaaaucugaucaacaguugcuagucuuuacaaguucagguuucagccaccuugaaccaucuuguggccuuugacuuuauuugauuuuguuggccuuagcaucacuuuggcucagggucacacuuucaaaaguaaugcuugauuuaaaauauauguaacaguaacuguauuuacauguguauuuggguaagugguugcgagugagaugaaagaacaaaaauaccauaggcauuauaacugacaaaauuuuuguacaugucccacauucaaaaaaauuaauacauauguguacaaaugaaagccuuuauucugggugauuuuuccauuaccuauaauuugccucuaaauugaaagagugauuccuugagcaaagauagcaugaccuaaauaauuguccuuaaaccugacugugauucuucauugaaauuucagaauuuaaucauuuaacuuuuguuggcacaaagagacagaacuaaauagcaaacccauuugcauuuacaauugcucagauuugaggggaaauauuccaaaaauccauauccuuugaaaagcucugccaugccugauaaacuaaaguaaacacaaaacauacaaauaaacaaauuguauuuucuagcagugcugcugaaucaaauauguaacuuauuuucuucuuauauuauuugauaucuguauugacacagaaucuccaaaccagcaaaccaguaauaauugaaacucuuagacuagaaacuggaaucuugauccacaguuuauucugugcuuuuuuuucccccugauuuaaacacagcugaaauuacauuauuuagagucacaaucugugcugucuucauaauaaaaauuauuuuuuauaaauacucuuuuuaauucccuaauuaucauauucaaugagucauaugaauuuuaaguaaucuuuuauuaugcuagguaugagaguacuguauaaauuaaucauuuuaauuaaguaaugaugacaggcuuaguguaagugaauuuacacuguuuauuuuaacauuaauuacugcugauacauacagccuuauauguucuacccaucauauaaauauuuaaaaaugcuugauaugccaggugacugauuucauuugcuaaaguucgauaaaauauggggagucaaucuaauuugggugacagugaaagggguggagauugaccaggcucacugaacaggagaaugucaggauuuagggaguuaaacaugccacagaugaauccuucagcaggacaagaugggccaaauugauugaucugccauuauacugagggggcaaaccaagaggugagaauugaaaagcaaaggcaaauaaugcuggauuaaaaugacugguggaaaugucagagcaggagcuaaagaaccagcaacaaucagaccagaagaaagaaaaguggguauuagagaaaagcaagagcugaaauaagcaaguugaaguauaagggaauaagagaaacucugaaagugccagacaaaauuuggccagacugucauaugcuaucccagcuagauuuuguuuuauguuguuccaugugccacauacaucuaguuucugacauuaucaucuaauauaaccauuuuguugauuccuagauaauuuucaaugacucucuuuauuaaaaaugaauuuuaaaccagacacuuuaaguguuuaaauuaccuaaguaucccaagacugacaaguaagcaguugucauccaagauagcaaauacuauugaaauuugacuggugaggcacaaagcagaggaagugggggaguagccccugcaugugacuguguaguuccuguagagaaaagggugcuuggaugggaaaagcuggggcugaaacucagcuugagaugcaagccaagcuuuguggccuggucacccuggggaaguuaucaccaugcugcaagacuucagaggaggcaucuccuuucguaguuugcccauuccuggcggguacuuuuuugcaguuugccuaaggcagcuuaaugcaguaugggugccucgaggaggaggacagcuaguugaaccucaaagaggccacccagguauaaaaugcaccaugagguaggguauaauuuucagcuuuccaaauacaucaaucugaacuugcuaaagaaaugagaguaaaucaguagauucagcuuuugagcagcucacauucuuucuuuguauguauauauguggcuuaaaagauuccuucagugucuuauuucauguggaauaguauucagaucccuugauaagcucuacagcagugucuuucaaaguuguuuuuuuuuuuuaacuaggacccaaaaggggaaauaauguuuauauaccaugacccaguacacagauaugcacacacacacacacacacacaccccugaagcaaucauuuuaugaaaauuauuuucugaacguaugcaaugcacuuugauuuuucuuauucuuuucuguucuauuucauuuaagaaaauuguugcaugucacugaauugauuucaaggccaacaaauugaucacagaccaauuugaaaaauauuaaccuacaacuccauuuaacaugacucuaagguuuuuggaacuuguugcucccucugccuuaaacuguccauucagauaucucugcaggaaaggcuccuuccuuucuaaguuucuacucaaaugccauugcuucaaagaagcuuggacuuaccacccauccugaagaccuacacccuaacucuauggacaaugauuuucuucacuuauuuguuaacuuguguauuucaugccccuucccacaugugaacauacaagcuuuguaagagaagagagcccaucuucuucacugcugcuccccacaaauucuggcaacauggcaagugauuaaugaagauauauguuuuaucuaucauauauguacaucuguuccaaaauuccaaaauauuauuuuacaguggaaaagaccauuuuuauucaaucugggaaguguugucagcagauuauugugcuuuccucuaaaggaaugcuacauuugaaaaaauuaucagagugacagaaauuaaucauguauuuugaguuuaguggcaaccaaaagaacaucuccuuaauaaugcaauacacccuagugacuagaaaacuuuaucucugaaacuguacacuuucuccuuucuaccaugcuuaaauggcaaauccaagcucuauuuggucuucacuuuucauuaaacagagcagaacccaaguuuuauaugaccugaagcucauaugguuuggagccccauugaagaauaggaaauuacaaauacaacauguccucacagugucaccgaauggaaaugaaaauguuauggagaaaugguaagaaccaguaguguuauccaauuauaguagaaaugccucaguuaugcaaauuuuauaaguaugugugacccucucaggccucucucagaagccacgaaaauagcuauauuuaagcuucauuggcuucacaggacauuugccucugcuucuagguauacauuuaguuacaaaauaguuuucuuuuuccugaaauaaaguacaauuguuacaauuucuguuuucugaguugcaaucuuauuucuuucuucuugagauugcuaacaaauuacuucaauaagaacuguggauauuucacaaaucuuacuucauacacuuaaaaaccaaaauuuugguuuuguuccugagauaguuaauuacauucauuguauauguacuuugugauuuuaguuucagaaaggaaaugcauuucucaauuacagauggcaggagccucacucuccuccauccucccugccuucccuacucuagccccugacaccacuauaagaauaaaacaaggguuacgauagaaaaacaaaaacaaacauagguaauaugugagaaaauauaagaugacuuaagacaggcaacaagaauuaagaaagauuuccugaaaucucuagggcaucaguagaugauuuguagaggauguauuaguuuucuauuccugcuauaacaaauugccagaaacuugguagcuuaaagcaagguaagcuuauuaucuuacaguuaucuaagucagaaguccaacucaggucuuacugggauaaaucaagauguuagcagaguuauaucucuuucuagaagcuuuugaggaaaauuuguuuccuugacuuuucuaucuucuagacgcugccugcauucuuuggcucaugguucuuccuccauuuuucaaagucagcaaguuucauugcccugacccuucuucuauagauacguuccucugaccacagcaaguaaagggucucuauuuuuagagacccaugugauuauauugggcccuccagaaaauccaggauaucacuugaucuuaagguuuuuaacuuaaucauaucugcaaagucucuuuagccauauaagguaacauauucacagcuuucagggauucccacccagacaucuucugggggauggggagguucauucugccugucagaguggguaaguggaaugauaagugcuagggagauaaauuugaugaaaaugagcaguaacauuggaaaucauuacaugccuaccacuguuacucaaugggaaguguuuguagcuugagcuugagaagagaacuuuccuguguaagauguaaggaaggauugacaaagagaagcaagguuuccaaauuggacaaaaggauaaaugguacucccauucaugaaguuggggcuagaaggagagaauaauggagagugaauucauauugucauauugauuuaaguuccuaugauacuuaaugcuacaucugggaggagaugaguguauucucauggaacggaagcgaagaaaagagaucggcaguggaugcuuugauuagcaugugcucacugauucaucaaauguuccuggacacguccuaagugccaguugugggaaaugagagggggggaacugaccaaguacaauuggaacugauucaaagucugauuuuccugaguggugcaucugcaguaaaaccagguguggaagagcaggaaugcuauagucagcuugucugcauuugaauccugauucuacuaccuucuacuuggguaaccuucaggaaauuauuuacucucacugugcuucacucuccuuucuucugggauaguuauaauaauaaaaauguuuucuucauaguuuuguugugaguuccuacauguaaaauuauuugaauagugccugacacauauuaaauaaauacuacuuauaaauaugaaaagacaagggaaaauuauggaauggauccucuugaaguaaggguuugauuggucuaagucagaaaguaauggauaggaagaagaggcggacauagagucaucaaaucaucucuuccuuccaagguuguagccuucugggugcuguccucuggaauccuuaguucucaggcugcuuuucuggagucucuuucuaagaauuaugcaagcuagcaacauucagucuccuggcaugucaaucaucaaaaugccaaaacacaugcugcucacugauaaaauucaguguuuaaauagaagacuaaaaacauuuauacacaauuuacacaucucuuucuaauaaaggaaguauaucuuaguccuguccuucuugaguggguaaacaacucuuucuuacaucuuccacaucuccuaugaggccauccuguuucaaaggcgagggccaagguaaacuaucagagagagguuugaaaagaggugguugguuuuaauacucauccauuuguauuagcaugagaauaaaugagagaucuaccagacucccauguuggccccaaaauuuacagcgucuggagugagaaauacaaauuggacaauaguuuugacuuuuccuccucuuuagacucuguuuugcuuaucuuaauuauuucuuuuguguuuugagcaucucuguuauuuucauucacagaaaagagagaacaagaaauuuggaauaauuauaacaagaugauaaugaaagggugaaguucgugauauaugggauuagcuaacguggacuaaauaguuacuaugugucaggcagcguaaaauaugcuaucugucauuuauuccucauaaucauucuacagggcagauauaauccucaucuuaaaaauuagaaaacugaaaaauaaaauaacccacuuuguagaagugggucuaccagaauucucugcucacaaggcaucucgaaggccaugugcaaacaggguugcaaggaaugggugccuauguucauuucacaucucuccucugcucauaugcaugcuccaucaccacacuagauuucaaaacacacuuuaaaagauauaguuauuaagaauuucaagauggcagcagcagaguauuuaaugaaguguaggacccuucugagagcagggaccugugugaaugcacaggucacacacccaucagucugucucuguguuuaccccaaccuaauuugaguuaaaauucaauaguuuaagauguuaaaaucaccauuuuaaaaauuuugaacagaaauaggguucuguuuaccaucauuccauuuaauuaaaaaugcaaugccuguuuaguuuguaguuuaguuuuucagucaugagcaacugcucucuucauuaucuaacccagugcuuuucaagcgauucuaacagaagaguuguuuuccucucaauucauuaccaacugauauuuuugugaaauacaaaaccacacaguuggauaucuugcucuugucaaauugcuuuaaaaguauuuaaaugccuauccucucuuucugaacuaaucucaaugggacuuggaaauaaauaguuuacauaccacacuuuaaguagcauugaucucagagauauccuaugauugcauuuuaauuauacagauuauuuuuuaauguuaaucucaguaagaaacugcuuagaaagauuaccucagagucuuuuaauucauuuauggaugaugcagggauauguagcugucaagucucuuuuucuuuuucuuuuuacauuacaaugcaguuuacuuaauuuauuuugacaacuacuucuaauuacuuaacguaacacauuauaugguaauaaaaacacuuaauaauguaagaccucauugcuauuucagaucaacugagugaugugugcauauauuguccaggcauuuguggcguggaucaugucucucucucucucuguguguguguguguguguauuggggcaauuucuucagauaaauuuuuggauucuccaaugugaagagauuaaauuccacguggaaugugaaaaaaaugaguaguaaauauugccaauucucagcucugaaaaaaaauggcuaaacauuauuuuagguuacauuauauacuauauauuauaccuaauuuacauaccuggccuuuguggggcaugcuuuuauagggcacuagauuaucaugucucuuuuucauuuuuacccuaugaaauaguaauaaaggauuuuuaaaaacuugauucuugauaauauagauacuguuacaugacugacuugaaauucuuuuugaaaacaauaaaauaggccaggcauggugguuuacauccauaaucucagcauuuagaggcugaggugagaggauugcuugaagccaagaguucaaaaccagcuuggacaacauagugagaccccaacucuaaaaaaaaaugaagaaaauuugcugggcaugguggugugugccugugcucccagcuacucaagagacagaggugggaggauuguuugagcccaggaagucaagauugcaguaagcugagauucugccacugcacuccagccuuggcaacagagcaagaucccaucucuaaaaaaaauuaguaauaaauaaaacuauaaaauaauaguaaaauugguaaacuggaaauuugcaaaucaauauuauauauuaaauaugugauuaaauacaugauuugcaaaccaauauuauauauuaaauacaugaguaaauauaauaaaauauuacauauuaaauacaugauuaaauacaaggaaucuaauuccuuggauuagaauucuggugguaaagagcaagcauccagacccacuugaugucucugaaaaaggacugcugguuuuccacaaucuuugagaauugugguuggauugggaaguauauuaguuccuucuuaagcugcuaugaagaaauacccaagccugggucauuuauauagaaaagagguuuaauugauucacaguucugcauggcuggggaggccucaggaaacuuacaaucaugguggaaggggaagcaagcacauccuucuucacaugauggaaggaaggagaagugcugagcaaaagggggaaaaccccuuauaaaaccaucagaucucaugagaacucacucacuaucaugacaagagcagcauguggguaacugcccccaagacucaauuacuucucacugagucccuuccacaacagguagggauuauggaaauuauaauuccaggugacauuugaguggugacacagucaaaccauaucagaaaguguuacuaaaaagaacugaaaugucuggccaauauugucacucuuucuuuccaugauauuuauucucugcugaguucccugcauuuuauucccuaauucuuucaccccauagcuucuuggaaaaugcaucacaagguuccaaguauuuagcaauuucuguuauucauuaagcacaguuuauuuuccucaacucccaauugauuaagucaaggcagaaagaaauagaaaguuggaaagccaaaucucaugugcucccuaaccuggccagguuguggcucaaagaaaauaggauuaggaaggagaacaucagagaauuuuccaauggaacuaacuuggcuucacuacagauacucagaugucaagugccagaaagauguuggggaaaugacuacacuauaauuaaaaguuucuaguuuuuuggcuauuuuacuaaucaagauacuuuuugaaacauuaagaaaaaaaaucugaaaaaaaaauuugucaacuuuucuucaugaaggugguguggagagaagaauagaagggaaagcuuagaaagcaaguaaauauuuaauaaggucaaaacauuuaaaauauaaaaauaaagucuugaaaauaauauugugucuucaccuuacuguuuuuuuuugucuucauucaaucaccauccagccaugcacaccacaaagcccaaucaucacugaaaauauaccaaaaggaaaguaauuuuaaaauuauuuuuaaugcaaguacugaaucagacuaauuagcaaaccuuuauccuggucuacugagaaagaugucaaaauaauucguauuuucaucacaauaaaauuaaauaauuuuauacuuauucuucaggguuauuuuagauuuuuaggauuuuacaugucuaagaagcauuaaagcaaggcauuuuuuaguucauuuggucauuucacuuacuuuuguaauuuagaaacuuuaaaucuauuguauccaaaauacuauuagaacuaugacuacauuaaauggaagaaggaagucuuucuauuuucaaugaaaaaaaacuccaacaacugaaccugagccugaaccauucaaacuuaagaaaauaaauuuauaggccuggugcaguggcucaugccuguaaucccagcacuuugggaggccgaggcagguggauuaugaggucaggagauggagacccuccuggcuagcacggugaaaacccgucucuacuaaaaauacaaaaaaguuagccgggcaugguggcaagcaccuauagucccagcuacuugggaggcugaggcaggagaauggugugaacccgggaggcguaguuugcagugagccgagaucgcaccacuccacuccagccugggcaacagagcgagacuccaucucuaaauaaauaaauaaauuuauuaacaaacauauuuaaauaaauaaucauugcagcacuggccaaaauaucauguguuauauguuuuuuagcaauuuugcaagguucuuauggaaagcuauucgguauuugcuuggcuaaacuagucagauaaauuguauauaauauuuauuuauaguauuaaauuuuugguuuagggaaauugugaaauuauauuugugaacauaauacuauaugagauauaaaauaaauaaaucagguaaaucacacauacuucuaauuuuuggaucuguuuaaucuugcuaaauaaagcacaggaugucauaagguguugcaauagaguguuguuguggugagugagaugacaagaaaacuaaaucuuccacuguuucaaggucaguuucaucaaaugaccauauuucuuaagguguuuuuggcccagggauuuuguccuuuuaagucaagaugaggggacagauccauucacuccuucaaucaacucuucuuuacuaagucuuuacucugagcuggguauugugcccagugcugggguuauaacaaaaaugaaagagauagauauagguugguccuuauggaccauacaguaugacagcuguuuacuguaguauugggcacuuuuaccccaagaccaaguccacaugcuaguguguaaugugaaauaugcucuauagaauucauuuauucacucauucauguauuuaagucagcaauuuuugaguaacuauuaugauccaaacacucugcuaaaccuuuugacuacaaagauaaaagaaaagaaaaauccuucugcacuuaaaggauuuacagucuaaauaaaagggaaacacacaugaccauuaaaauuaaaaacaaaggauauaaaacaugaauacaaugaauaucauaaugcaauguagcagauagauucaaaugugaaacaauccagcauacuugaaguuggaaguuuaggcagaaauauugauaucagcacauggaagagcccuaaccacauauuaccuuauaaacuuguuugcaguccuaaucccuuuguauuucaguacuucauaugucugaaagagcgagaaaaaaauagugcauauaucacaagguuuaaaagugagcauuaaauguaauaauauagguaauguucuuauaagagugccugacacauauuacauacuaaagaaauauuaguggucauuuucauuuuuauccuuucugauuuuguguuugugauuuccuuuucuucauuagauuuccaaggauucuuuaaauuaauuuucauuauaucaauaauuaugccccuugauuuaguaaugaaauacauuguuuuauugguuauaccaacaaacaggaaaaauacgaagauauuguuuaauauuuccaaauucauuaaauucugcucuuauuuaauacuguauuuuuccuucugauuaauugauuuauaaauuaugaguggucugcuuagugcauugauuuuucauucuuauuuaauaaugaaaacauuuaauguuacacauuugccuuugcauauagcuuuagugaugugauauaauuuugaugugcagcauccuucugcucaguaauuuaugaauacaugugacuauacuuuuaauuuuuauuugacccaauaacuaggauaauaauuuaaaucucgaguuaauggcuguuugggguuuguuuuuuuucuuuacguuuuuccuguuugaaaaccauuaaguuaauuucaaauuuuaguguaucuuugucaaagauuauauuuaguauaugcaauaucugcuuugguaauuuauuuagauuuuaaaaaaaucuucucuuuuuuuccuuuuuuuuuaacuuuauuguucaaggguaaaugugcaggcuuguuaccuagguaaacaugcaucauggggguuuguuguaccgguuguuucuuuaugguguggucuguuuucaguuacacagacuauagauaauuguuuuuuguuuucguuuuuguuuuuguuuucuauuucuuuuucuuuuuuuuuuuuuuuccuagagauaggguucugccauguuggccaggauagucucaaacuccaggccucaagugaucugccugccuuggccucccacagugcugggauuaaaggugugagccacugacccuggccggacucuagacauuugaaaagaaauuuaccacucuauuacauaaaguuuaguguacaguuauucuauuucuaauauaauuuauuauuugucuucuauguugaaacaauuuaucaaaauaucaaaauaauauuugaaguaguauaucaaagucuugcauuuuagucuugcauuugaagucuucuucuauuucuaucuagcuuaaguucuacuuuuaaaaaagaauuuauauuuuagauauguugaguuucugcugcuacuugaaguuucaugcuuguuauaccuucguuauauauucucuuuuucugcauaaaaugacaauuuguaucuaauuuaaugcuuucugccuuggacucuaucuugucuaagacuaaaauaaugaucaauaucugcuuucaacuuuucaaauacccacauauccuuauuucccauugagugggguagaaaaagacaaauagaaucugguuagucucuauggcaaagucauacauaugagaucuagaaacauuuuucuuuugccaagggcauuaaaauggcagguggagaaucaguacuacaaacaggcauaucugcuuuuaguuuucuuuuauuaauuguuuauguaacuuauacuagacugcucaugaucaauaaaacaugcaggaaguuacaagaccuuuuuccaugacuaucacuaauucagucaggguauuaguagugaagaagaaaacacaaucucaauauaagcaaauauaccuaguauccaacaaaauaagcucucagcugggugugguggcaugugccuguagucccagguacuugcgaggaugaagcaggaggaucgcuugagcccaggaguucgaguaggcagagcuaugaucgcaccacauccagcccggaugacaaagcgagacuccaucuuuaaaggaaaaaauaaaaaaaaaaaccuaagcuuuuaaaauuagucaucuaaugaaccacugaauacgauaauuaugucuuacauauuuacaauauacacucucugacuuaacgauggucugacuugggauuuuuaaauuuaagauggcauaaaggcacaugcauucaguagaaaccguacugcaaguacccacacaacaauuuuaguuuucacuguuaguguucaauaacuuacaugagauauccaauacuuuauuauaaaauaggcauuguguuagaugauuuugccuacucuaggcuaauaaaaguguucuggcaaagcaagcuagaauguuugguagguuaguuguuuaaaugcauuuuuaaaucaugacauuuucaauuuauaaaggguuuauugggacauaaucccaucagaaauuaagggacaucuguauguaauucuuaauuguggauaauaauaauaaaagagagguuggauagaugaaaacagcuacauuucauguuuuacuaucaaccuuuuauuuuucucaugcuucaauaccuagaagagugguaaaauauugcaguuugagugucuacuucuuuauuuuauaucuaacauuaggaagugcuaaaguguggaaaaccagacaauucuggaaugcagagggaggagagaaagcuccaguaagcuacaugcuucagacauaggcacugaauaauaaagaaacagaaagaaauauagaaacugaauugcuaaggcacuuuuauugccacuccuaagaaacucaacauuaucagcaguaguaauggccaucauuuauacauguugauuuuauaaacuuauuuuuuuuaaaguucuaaauugcucucucuccacucccuaaagcuggauuaaaaccuauugcuuccaaaugcugaauuaaggaaauucugugccacaauuuuugcuacagaaaauuagugugagcacagaacgaagagcaaucuuauaugcauaggagccugcuguuggagaaagcucaauaagagacaucaggagguuuggcuucuuuucagaggacuuaggaaguuuugauaccuaaaugauauaacauaagacuaacuuuugaaguaagugcuaaaacuauuuauauauacuagacaauuuucucaagauuuguccuuuuugucucuuagacucucacuaaaacuccgucaucaaguuguaauucacacauguagacaagccuucagccucuccaaacauuuuuaaaaucuguaaauucaaaacauuuaaaaagaagacacaugaucucaucuggacugcugcuugaucuuguuugauauucuucagcacucuacuuuuuauaacgggucaauagcagacgggcgguaacugaucuccuuauuucagagcugaaaacacaaggcacuuugcguugggugcaguucuauucuguuaugcuacucccguuugucaguagguaaaaacuuuucccauuccccagaaggcaguacuucuaugaauaguugcuuuagacaagcauucauuguucaaaggguuugauuccucacugagcaaaagcuacagcauuauaaagaugccaguugaaauuuuuuuaagcuugaauuuuuuaaagcuagaaaggaacccucacuguuggggaagucaugaaagaaaaccccuuuucacaagcccuggaacaaguggauuaagagaguaagaguaaaagugcaaagacugggaaccuggcuuuauuccaaaaaaaaaaaaaaaaaagccagaaaaaagccacaguuagaaguaauugaacacuuuggaaaucccuuugaagaccuaaugcaguagaauuuuuugaaaugaauaaaagcuaaaugcauaauaauuucagguaaaaaaauacaaacgaauguuugaagaaccaaauaauaaauuuauaaauguuuaacgcagcgggaccuagcaguaccaaccuuugauaauguaugguaagcauuagcaauguuguuacuuggaaaagacaaauuaaaaaccuggcaaucuuaccucauguuguuuuguacuuuguauacuuggcuugguuuauagugaugauauuaucuguacugauuauacuuguucaguagaauuuuguacacuugcaaauggaauuuuuagacacaagaaacaagguacaaaaauugccuaacuacaaaaauuucucccucuuuuauauugggacuaaugauauguuaaacaaucugauguaucacuuuagaaaaacaguaauggcaguugcauuugccaggaaaauguuacaauagauuuuagcucucuuaauagaacauaaaauauuaguuuuuaauaucuugcuauaugugguguuuuuaaauaaaaaggcauagaaaucauugauauuugaagaauguugauauaaaauaaucuguguggaggauaauguagguugugaacuaaaacggaaaaagccccaagaguguauaucacacuaaagaagaguguauuuucugcuaaauggaguauagaauguugugcauuuaguacauaggacauaugcuugcaauccuccccuaaauaucccagugguuucuuugugcaaguuuucuuuagacucauuucuccaucuugaucugugcugacuccacgugaggucagucagagaauaauguuaguccaaccacuugugugcacaccugcauacacacauaccagaaaguuaauguuguuuuacuuuaaagcagugauuuuacucuggaccauguguauguggcagaaggaugauagugacuuguacauaagcaucuacagaggaggaauaacugauauguaugguggaguuugacagaauccuggaucaggaaaaauaacaaucuuaagguuggaggagauuuuuaaaaucaucuugaccagcuauccauuucauuacaucauuccucacucugaggcucauuucuaacugguguuaccuuggaagaugacuaauuuuuagugcuuguuuugaauuuaguuuguggaaugauuucucagcuugccccauaauaucuacucuguacagaaaaauguuaucccuuuuucuuugcaaagugugaauauaaagcaaugaggcuguuuuucuuuuaugagucauauccggucucugaaaacaguuccuaaauuggaguugccaaaauauuucaugucauggaagcaugguuagaauaggcuuaucaaggugaauuuucugaaugguauuucaguacuuauuuuuauagucucauagcucuauaaucacauguugaaugggauuuuaauacuaaaaaagaggauacauaaaaacacauugugucuauuaucugcauagaacaaucgccuacuuucuuuauuaauagaucuuauuuugugaaagcuacaccuuacaaaauuuuaucuuguucucaccuaauuaucuaaacacaaggaaugauccugcucugaauuaaaccuuuccauuuagugucaaacugaacagaugcaaacucacuuauggggagccauccuuuggaaauaaacucuuuaauucaaaaaauaucuaauauuagaauauuccacagaauaugaacaccuacuuaaauucauuucgaguaccaaagaauauuucaguaauaacauuuacauacuaaauuaaacuuaauuauacagcauaaaacauuuauaaccauuaaauacagaacaauuauuuugaauuguuaagugcuuccaacaucauugacauaauacauuuuuugaaauaaugauguaaccauuuaaguaaauuuuuauauuuuauucacauuaaaguuuaucuguaacauuaagcauaacuuuuuucuuuucucucucucuuuuuuuuuuugacauggagucucucucugucacccaggcuggagcacaguugcgcuaucugagcucacugcaaccucugccucccaggcucaagcaauucuccugccucagccuccccaguagcugggguuacaggugcccaccaccacacccagcuaauuuuuguauuuuuuuguagagacagguuuucaccauguuagccaggcuguucucaaacuccuaaccucaagugaucugccugccugggccucccaaagugcugggauuacaggcgugagccauggcaccuggccagcauacuuaaccuuuacagaggcauuuuuagcuggacauuuacagcauuuaaaggauggaauucaauuaauaaaaaagacuuuuuauaacauugaaacagugaguuuaagagaguaaaucuguugccauuuuaguuaguuuugacaaagcaaauauuauaaauggccaaauacauaagccuguuauuacacauuaaaauguauccuauauuuaaugagcauuaaaauugaaguuuacuaguaauuccaugggauauuauuaugaaguuauaagaauaggagagaacuuauaguuuauuucugucucauuuuaggaucuuccuauuauggcacaugaauuuuaaucgacuuuauaauggugucauugaagcagagucuaugauauuaucauucuaguauuuaacuacaucuccccuuaagaaugauuuuaucacccauuauucuuuaaaccucucaagauacuucuuaggcucuguucucucuggaguuguguaaauucuaauaaucauaacauauauuauuaucuuagaagucauuaagucuucucuucuuuauuuguuuuuaguauuccuaguuucucauggguauaguuuuacaaacgcuuucauucuuuguaucaguuuucauuucauauuugccuuucccaaaaaugcaucaaacugcuuccuuuuuuauuuucuuguuucccaugggguugguaaacuccuucuuaaaaccuuacaguagacuuaugcaaagucucauggaauuuuuaaugcuuuuuauauuuuuuucugauuuuauuuuguuaaacugaucuccacuaugauucuaagaucuuuuuccucuuagacucauguagcugcccaucuaagccuuguaaguccuguucuucauucaaguggugucuagcuacuuuucauuguuagcauuauuuauacuguaauucuuuccucucuggugcuaauuacccaaucacaauaaucaucagcaaacucagaaagcucuuaaucucuccuguuuuauguagagggauucucccagaguacuucuuuccugaggaggcuuaagagaaaaacugaaccaaugccacuacugacuuacagaaaacagaagcagaauuacauauuauuuugucuuaucugauccauacuuuggaagucaauucgaucuuuaccauucccauggauuggcuuaauuaacaauauuuuauuuuauaacuauaccaggguuuguauaguauaugauacuauucaaagaaauaccuaaugcagaugacggguugaugggugcagcaaagcaccauggcacguauauaccuauguagcaaaccugcauguucugcauguguaucucagaacuuaaacuguaauaaugaaaaaaagaaaaaaaucugaaaauauauauaaaauauuuaaagcuagaaaguaacaaauagaaaucaaaauaguaauauaauuauuaaaacuauaggaaggaaaaagauauaggaaguaaaugagugaacuaaaucuuuacucucuauagcugagagucaaccaaugauauucaaguugauaaaccaagaaaauaucaguaaaaucauguuauuuggaguuaucuauguaaauaauugaaugagaaaacaaacauuuaaccucuggaaaacuuguuuaggaaugcaaaagaacagagaagggaacuuugcuuuuuguuuuaugucauucucuaauauuauguuuuuuuccccaugcauguguaucuauugacauuuuuagauaaauaugauagauagauaaauagauauauagauaauaggaagggagggaggauaggauggagagaggaaaaccuacauaccuaggguuuaacacugcauagugaaauuucagaagauuuuuuucuucuuuauaccuuuuuguauggcuuggauauuuuacaaugaguagguaauguuuuuauaaaaauaagaggaaaauaaacuguuuccccuuuguaaaaaaagaaaaucuuaaauuaaaacaaagaucaacaacaaaacaacaacaaaacaacaaaaagaucaaaaacaacaaaaaagugccuucaguuaaaugaucucuuuuaauacuggagagaaaaagaguuaaaguagcuggccuauaauccauucacuuacuuucugaggaaacagaaauggggguguugcuggaaugauguggagcagggaauuugguguaauuuccuugugaaaagauaaugacuaaaccuccucguaaaugaacuaauaguauuagaagaaaaagauaccuuaucuaugaaauacucuuagcaggauguuccugguuuaagguugcuuauaaaacaucaauccagaaucuguggauuuauggaaaaugagaaauauaaaagcuggcugacaauuuaggguguauuaggccauucuugccuugcuauaaacaccagaggcuggguaauucuuaagaaaauagguuuaauuggcucacgguucuguauguuuuacaggaaguauggugccaacaucugcucagcuucuggggaggccucaggaagcuuacaaucauggcagaaggcaaagggggaacaagcgcaucacauggcaaaagcaggaacaagggagagaguauggggggcacacuuuacaacaaucagaucucaugugaacucagagugaaagcucgguuauuaccaagggaauagcucaagccauucaggggcauucgggggcaugauccagacaccucccaccaggacccaccuccaacacuggggauuacauuucaacaugagauuuaggcacagacaaauauccuaacucuaucaugggguaugaaauguaaauauuuaauaacuuaugcuucacuguuuugugagauagaugaaggcaaugaagcauugcagggucauggauggauaaaguuacuggaucuagugaguacauaaagugggaagcaaaaaguuuuaucuuuggagacguaauuuggugaaggauccugaagaugccaccuauacccugcgcaccaggcagaugcaccaaaguaucucagccaauuucauugagauucagacuggcaaggagcuuaugguaaagucuuuauaauugaauuaaaaacuuaaguaauuguuucuguuauuuaaacucacuggaaaagcuucaaaaugagacaaugauuugaaugaaccaguagucucuugguuacacuauuagggauaauagauauccccaucgaucuagaacuuauaaugucacaauugcuaccaaaguucacaggacaguuaguguaaggaaauccagaacuacucacauugggguagaacaauuaccucauuuuugcuagcucaggauuaaccauuaguggauaaguugcuuguucacacuggcuuucugugauaaagaacucauccugcaccuauuauuaauguuauuaccaugguauucaaccaauagucucauaucuucaucagaaacuuguuaccuaugaguuuaguacugagacccagccugggucucccugcugagaaggagaacugaaugaggggcauagagaguauaguaauggaucauguggaaaaugauguguuuucuuugagcauucaucaccccauacuggcaauguacaaagagaaugugacugacuugcaggugcauaguaaagacagcaaagaaaaaaaugagggggcugauggcgucauuagagcaaggagcucuuagagucuucucauucccaugggagaacuuggcacaaaaccucuacuuggaaguaacuuuucuuuggcucccagcacacacacacugaucuacauugaaaaaaauacaaacauaaaaguagcucuuauauagaaaaguggguggaucuuuaaucaguuugauuuguccucuauucuuggcuuauuuguaaguagcuucuauucaaaccauucuuuaucuuuaucuuucaccuuaauacacacacaugcaugcaugugcacacacacgcaaacacacauacacacaccauucaauuuucuccccaccucagccugcauuagcuauucuagaacugaaugucgaagaaaucuguugagaaagcugcugugcuagccaaagcaaugaagaauuauuuuauguguaugaagaaauauuguagcauagaaaaguacaucucaaaauauguucuuagauugcuacaacacaauacucuaaacaguaaaaaugaaaauucccuugcuucacuccacauuugggguagggaccaagaaaucuauauuuuuaguacauguuccaugugaauuuuaagaacaaugauuaguagaaagaacacuagauuagauguuucuggaagaguuacuagugucacgucguaacucuucuucuuccugucuagguagacuuggccaaauuauaaaaauauucugagacuuaguuuccuuauuguaagauaaggcaauuaaacugaauucccaugguggggcagucaaggucgaacuaauaaaauucacugucuaguuguucaguaugaauguuuugaaaugaacuagccauacaaacaaugcucucuuaaggauuugccuuucaauuuuuccucuccuugcaugcucugagaagccuccuguagccacaggagcaagaacacuuggaaaaaauauguuuauugagaagauugccaaugguuacaaauuccuggcaacuugcucaguucucuaaguaauuggccauguggcuacuccaucuaauaugaugggaugugaccaguauguuaauaaguacaauauuguucuaucucuuuaagcuccaagucugugaacuuucucgggaauuuauaugcaauuugaagaaaugugaauuaaaaaaaauuguuagcauuugcuuuguuuuucauaacauuuccuccuuugggauauguauguagacaacagcuacaaaacugcuauagaucuauuacuuugaauuuuuaauuacaagcuauaugccuaauauacuuuauuagaaaguuugguccucuaugacauaaauaacaaaauugauaggaaauucucagugaaaauacuuaacaguuaugaucugcaagauaacagaaaggaauagauuguugucgcaagauaaugguugcugacugugagauaagugucaaggcaaagucauuccaaagucuggccauuuaucaaaaaugaacauugaagaaaaguaggauacauuuaucaagcaacuguuuuaguacaaacauuuuauuuuucuuuuccuagcuaaucuaugauuuagaugcugucauuucacuugccagguauuugugcagcuaaaugacucaggucaccacugcauuguuuagaguuacacaacccugauuuuugagugguuauuguguuuaucccaauaacuaccuuauaguaaggaaauaguuaagaaaguuaauugauugggcucuguuuuaguuucuuuuuucuuucuauuuagaauuuugcuuauucucaucuguuucuuuaaagugauuuaguaugguucacauuaaaaugcacauuuaauacauuuguauaucaauauaauauugauauaggauagaaauuuaaauaaaaaucuagaacuaaggggaaugauaaucagaauuauuuuauuauaagcauuaugauucuaacaaguauacugauugcucuacacauuguccucugugacagauguggcuuauuuaaccacaaguaugauauuaucauuugguacugacagggcuauugucauccgaagccauuuauuccugucaccacucauaaauuacuguaaaaaagaggccacuguucuccuaauuuaacauguucuuccacauuccaaccaugauggugauuuuguaauccauuugucuucuuaaagcaauaggaccauaggccaacuuccucaaauggaaagcaagcccccaauaauuaguaagcugauagaguacauaaaaaucuuuguauaacucauacaaauauauguacuuuauuuccagaacuacuugggaaaggcauuacuugcggaauagacauaguaaagauuuuccucguucuccucccugaauauucagagaaacugugugugguauaccucuuccagaaucuugccuaauuccuggaucuugcacacucaauuuuuucaguuguaggagaggcugaauuuuuaaaaaugaacaucauggacccuaaaauaugguuuaccuaaaagcuuuauauucuucauuacuuucuuaauucauucauguguucagccaaaacuuauugaauagcugccaugugcagaguauuguauauuguuaagguuaaaaaauauagaucaauaaggcaugaccucuccauugaggaauuccuagcuuaaaggauauugauauauauguauacauauauauauauuuauauauuuauuaggcuauggauacauaaacucauuaggcuaugaauauauauauauaugaauauauacauauauguuguauacgcacauacucauguuuagguaauaauaaguaaucauuacaacugggaacauauguuugagguaggguugaggggcaagugaagaauguccagaaacuuaauacaacuuuagaauauaaaagaccuuguguacuuugucaagaaguuugaauuuuauccuguaugaaacagaaagauuuuaaacagaaaacagaagugcuuuaaacauaggaaugacggagucacaccugaucguaucagaggcaucaugaaagcauaaaauauuggaagugggaagucuuugcuacacuuuaaauaagaguuagugguugcuugaaaaagcaaaggggaguagaggugaugagaagggcauugaguaugcaagagaccagauugacaggucuugguaaauuauuuagggauauaagaggaaaaaaugacucaaggaugacucugaugcuuuuagcuuuuagcuuggaaguauagaauugugguuggaaguauagaauugugguuguguuucuuuuuuaaaaaagaaaaaaagaaccaacuucguguggagacuauaaagcuaguuuuucuaccuuuuauuuuaucaguauguccuugggcaauuuccucaaauuuugugccuaaauauucuuacuuauaaaauauguaauacguauguuuacuucauaggauuguugugaugauuaaugaguuaguacauguaaagcucuuaaaauggugucuggaguauaauagguguugaaugaauguuucuuuuuuauuauuacuauaaugucacuauuaucauacaucauuuuuaucauuauaauuaugcauuaucugaauuaaugaauuccaacagaaaagaugauuuugaagaaaauauaaugaauccaacuuuggauuaaucauuuuagucauccagauagaagugacaaguuugaaaugcaguucuggaaagaggggacagcuaguguauauauuuggaaaucaaccauguacaggucauauuugaggccaugaaauagcuuggcuugcccaagaggaaaguauaagaaaagaaaaaaagacaguaauauugagaaacaaaacaauccuccuagaaauaacaauacuuaaggaaugaguagaagaugguccucguaguagucugaagaucagagauauacuagaagaccaugcaaagacgggugaguuaaccaaaaauacccaauaugaagaugaagaaaacugcauugucaaauucuauaauaauaguaugacucagccuaaagaauguuaguuggaauucuacaaauaauuguuaugaaugaagcaauuaauuugauaauugagacaucauuggugacauagcaaacuauuuuuauccuuccucuaucgcauugauuagcaucugaauaaauugaaaaauaaaugugagacuuaaagcaguuuaaguaguguuagguaugaacuucagauuucagugggcuaagcuguuacuagagaaacgaggaaaguuaugcuuugguaaaaauauaauuguagauaauaucuucucuuaaaaugaguuauaugccaccuaaacuugcuauccuucaugccauugugaaaauaguguuuguaaauuuuguccaugggcugaggaaagaagcuacccauauauggagaaccuaagaaaaugaacuggagaaaaaaagaaguaaaauugugaagucagauaaacugucuggaaacaagcauguuaaaauccaaagacuuuuuguacgcagauaauaaccaauuaaaaauauaaagaaaauaggauucuauuuacagaaacaaauguaaaauaugauaguuaagaaucauugaccgggcgcaguggcuuacgccugucauuccagcacuuugggaggccgaggcuggcggaucacgaggucagaaguucaagacuagccuggccaacauagugaaaccccaucucuacuaaaaauacaaaaauuagcugggcaugguggcacgugccuguaaucccagcuacucgggaggcacaggcaggagcauugcuugaaccgggacgcugguggcggagguugcagugagccgagaucgcgccacugaacuccagccugggcuacagagcaugacuccaucucaaaaaaaaaaaaguaaagacaagaaaagaaucaucuuaccaagaaaugaaugagaucuacaauauuuugcugggcuuaauggaaugaguaaucagauugccaaaugagaagauuggaaaaaaucuuagugacaagauuuuuaaaaauauaguuaauuuaauuuuaauaaaaaucucaauagaauaccuuuaggaaauuuaaaaaucaauuuuaaaauucagagaagugaauaauuuuugguaagauaauuucaaggaagauuaguaaguagcuaaacagaacaaacuauuauuuuuuuauuuuuuuauuuuuuauuuuauuuuuuugagauggagucucaaggcucugucgcccaggcuggagugcaguggugcgaucuuggcucacugcaacauccaccucccagguucaagcgauucuccaaccucagccucccuaguagccgaacuacaggcgcgcgccaccaugcccagcuaauuuuuuuguauuuuuaguagagaugggguuucgccguguuagccaggauggucucaauaucuggaccucguaacuuacccuccucggccucucaaagugcugggauuacaggcgugagccaccgcacccagcuaacagagcaaauuauuaaaacacagcuaaaaaaacacacaaaauaauuaaaacagagaucaaagaaaaaaauauaaugggcacaauucaugaauaaauuauaaauuauucauuauuuuacaaacaauagugaaugaauuacagaauauuuaacuuccuuaauaauaaaaauaugcaaacaaaaagcacuugagaaauauuaucuuaccuuguugaugagcugauaagugaggggacaccuauccuaguauguuugauaaaaauaauuacauacuuaaaauguuuacauucuuugucccagaauugauauuucugugaagcuauuugaacaacauugaaauacagaaaaaagacauuuauuuaaauacauuuauuaaagcauuauuuguaaucacaaaauauugggaaccuuauaaaugucccacaaaaugagaaaaguuaacuauggcaaaccauauuauguaauacuauacaagccuuaaaauuguaauuaugccuguaauuccagcacuuugggaggccaagguggcaggaucgcuugagcucaggaguacgagaccagccugggcaacacggggaaacuccaucucuacagaaaauacaaaaaguuagcugggcaugguguggcacaccuguagucccagcaacuugggaggcugaagugggaggauugcuugagccuggggagcagagguuacagugagccgagauugugccacugcacuccagccugagcgacagaggaaaaccccaucucaaaaaaaaauuaauuaauuaauuuaauuaaguuagaauuacauggaaaaucauuauuauaaaauuuugaauaaaaacuugaaugugaaaauauguaugcaguuuaacuuacaaaccagaauguauauguauauguauaauauauccuagauucucuuucaaucauuuuucucuugggaucugaauuaugcauugcuuugcuaaggaugcaguaaucuaaauagaaacauugaagcauauguaaguaggggcuuaucagauagauguuagucuucucgcuuaaauuuagcauauauauuuaauauuacugcaugacaaaauaaauaugagcacucucaaaaugaguugaugaaaagugacauuaaaacaaucucagucuaucaagguagcuaaugcauauuggauaaaaauucuuugaaaucuaauuuugcauuuuaugaacaaauugaaaguaaagaaauuucagauguaguagaggacuuuuuagaauuaggauggaauucugacagcagaugugucugcaguuggaaauugacugcaggucagaggugcuguucugcagcagcagucauuaaaacagcuccuguaagugaggaaguauguggggcuaucucugggagcaauuuaccucagauaggauuuguucuaguugucugguaagggauaguauguucugggagguaguuauuauggagaggauaaagcugaaaaauaugaugcaaaaauuaagaauuuauaacaauguuuacacauuugcccagauauaauaacuauuaauuuucugccucuauuauucauucugauuaaugaucacagauaaaauaauucuggaaguaaaaaaauugguuugcccauggcaaaucaauuauuuuaaaaaugaagcuuaaaugucguuuuagugaagaguauaaagagcaaugggcugcaaaucugaauaccuggaagcuauggcaguuuaaccauuacuacaucaacaaaggagcaagacucacggcauuuuuaaaaauugucacuaagaucucuucuaucccuaaacaucuaugaccaaaauuuuaacaacagccaaucaauaauuauauaaaugauaauaguuaauauuuaaaauuaaaauuuaaguuuuuuuuucuuuuguagagacaggguuccacuauguuacccaggcuggucucaaacuccugggcucaagcaaugcucucaucucagcuucccaaaguacuuggauuauaggcgugagccaccacacccagcccaauaauaguuaauuuuauuuauugugacuauuaaacuagauguggugcaaaaugcucucuaugaauuauucuuuuuaauacuugcaaugacuucaugaaauacauucuauaggcuggguuccuaggcaauauaguaagaccuuaucucuauuuaagaagaaaagaaaagaaauagguucuauuauagacuccauuucuuaaugagaaacuagggguuuagagauguuaauuaacuugcugaggucauauagcugcaaguagcagagucaagauucaaacccaauugacuauaaaucccagacucagaaccacuacacuacccucucuccauaucucuuaucuuauuucguaccaccuuauuucuaagcagucagagcauaggaaugacugauuauaaauauggaaaaugugcauuaaaaacacuaaugauguaaaaaauuguaucuuucuccuauuauucucugcaucacuuuguagauugcaucacaaauauaucuuugucaaauacacugaaagagcauuuuuuuccucucuauauacucacuugucggaaucuuuaaaaacaaaacaagggagaggaucauguuuaaaauuacuauuccauaaaauuacuaguccauaaugauguccacaauucacuaagcuuggcacguaccucuaugggguaugcacaugguuauuuuuauaaugccuuuguguuccaugaauuuuugccuuauucagauagaaaaaggcaacuuuuuuuucuaucugaauaaugaaguucacugguuaauucauuagugaaagaagauuuuuuaaaguuugucauuuugugcuauauuuuaacugaaguacuuugauguuaauaaaaauugcacaaacauagcuauguaaaguuuauaguuacucuaagcaugaguaaauguggcuaauggauacuuucuaguauauugagcagauaguaauuaugcaccauacauaaagccuuauuugacaggcauaugucagagccagcauauguagggcacuggaguuacagagaagaagcagacacuccuccuaccuuuaggagucuuuccaucuagcuggagagauacacaugaacaaacaaucagaaaacagaacaaaugcucugacuugcaaugugagcacagggaacaccacguuauuucuaccuggauauagugggaggauggaaaucagaugucucacagagaagaagagauuugaacugucauuagaagaaacauuggccaggugugguggcucaugcccguaaucucagcacuuuggggggccaagacagguggaucacaaggucagguguuugagaccagccuggucaauauggugaaaccucaucucuacuaaaaauacaaaaauuagccaggcguggugacacaccccuguagucccagcuacucgggaggcugaggcagaauagucgcuugaacccaggaggcugagguugcagugagcugagauuaugccacugcacuccagcuugggagacagagugagacuccgucucaaaaaaaaaaaaaaaaagcauugaaaagauaaaggaugguauuacugauaaacaugcaacgcaaguaaaggccuaaaggccagugaguguguaguauucaauaggauauaggauaagcaggucuaaauaucaagagugaggucagguugagaaauggauugaacauuaucaguaucuugcuauuaauuaaaaucuuugcacagcaugagaagcagagcuagaagaauagaggcuugaaagggcgauggggaacagaaacauuaaaggcgcgagaugcuaaugaggggcccaagauggugcuuuaacaaauuguuucccuccuuauaaauuguucuauauccagugcugccucucauuagcuguguaaccuuguacaacccucauccugacacaacaucugucaucuguggaaugaagaaagacucauucauucauucccaacuugaauccccacagguaguaauggaguuuucaaacuaaacuaaaauuccauuuagauuuucaguauuacaaaauaacaguauaacuacggcuuguuuacugauuuaaaaucuuuuaaaauuuagggccugcaauuaaaauaauaaaaaauaucuacuagugagaagguugcaaaccauuagcccagaugauuccaguucuaaaaaccuguuauuuuauuaucucaccgaauauuagcaguaguugguuuuuaacauaaaauuuguacugcaccaaacaauauccacaguguccccaucccugagaaugcagccugccuggcagcugcacguggccuauuagcacagccguuuacauaaaauuugaugaugucuguuuucuuugguuuguuaaaaaauaaaacacagcauuuacaagcagagcuagaagaauagggucuugcaaugacuuucuucccagucauuucuugggaagaaagcaaaugguauaaugaaaguaauauugaguuuggacaugaauuuccugaagaagccaaguuuauuaauauauaguuaggagucagauuuuuguuuaauaauaaggcucuuggaagaaacuaaaauuagucuucuggcaugucccuuuucuucuuuguuaaagggauaggaucauaacugcucucacuucauacuucauggacauuuccuaaagaauauuuuggagucucauuguucuuuugaacauuagguucaaaaauaaggucauuuaaaagcaauauggucaccuauauaacuauaguuuuuagaagaaaaauuaccuuuaucucuaaaacuuugcuguuacaaucaaauauugucacuguauaaaauauaggcaauaaaguaauuagaugguuuuaguuuuaauuuaauuauuguuuuuuuuaagagacagggucucauucugucucccaggcuggagugcugugguaugaacacagcucacuucauccuggaacuccuggguucaagugaucuuucugccucagccuccugaguagcaaggacugcaagcucacgccaccauggccagcgaauuuuuuuuuuuuaauucuuuguagagacagaggucucacuguguugcccaggcucauuagaaacuccuggccucaagcaacccuuccaccuuggccucccaaagcacugggauuacaggcaugagccagcacacugggccugauuuuaguuuuuaggcaauacaccuauguauuauauagaugugugugugcguguguguguagguguguguguguauuucugcuuugucaguuacuagcagaaagcuacuauagcacauaaaucagaaauacaacaaaaaguuuguuguguuaggagccaaguuugaaacuaauaauagugaagacuuuaaacaguaggagaaaaaucaaaguuucacauucccuuugcauacaucagaaacaaagccuucgaccaggguuugauaccaagaaaacuugagaaaccauggaauccuaaauuuuaauuuuguaccauuucauauuuagcaucuguaagaaaaugauggaaauuuugugcuucagaaaugaaucucacuuuccugacaaauauauauguauauauacuaguucuucuucuugcaaaagcagguuugacauauauacaaacucaaguuacuuauguauaacuuuuuauuuccuuaacuuuuaauaauucauucauuucauuauauuuugaaaggaaaauuauacggacuuggaucuucuuauaauaugaauguauaacugaaucuaauggaaauuaguacacauuuuaaaccuuuagauguuuaaaacugccugucuuauucaggcuagugcuucaucagcugaaauuaguaucagccgauuccuuaaauuuuaugucaacuuaaguucacugaccgauuugacaaugggucaaugaaagaggccuguaggauucuaaaguuuaauacauacauaaguaaaagaaugacauuucuuuuccccucguacauguuuugcaguagguauuaacaaauauuuauauccccaaauagccuguuguuagagugggcuuuguucuuccaccucuuaaaacauaccagaaaggauaguuacacaagcugcauuguccagacuaugucaccagccuauuauuuacuauaaauaaugaaaugacugggcaaguggucugaagugagcugugacucagggcagucaguuucucuguggguaacauauccauggaauucagaaauagcccagauuuucaggcccuuucuuuaggagcugauacuacauaaagaaugcuugcauguuugcauuuucuacaccaaaugguacuuuauaacuugaugucaagauuuaaggaaauauaggaagacuauuuugggcugggauauaaaggaggaaauauuaauagugauuauuaagauaucuuuacacaauguuaaggacugcaaguucacuugauagacagccuugcugguaaucugggaauuaccugagggcuuucaaguggcuauugaauuaauuuauauugcuuugugaauauaaauugcagccuuccuucauccaaggagacaaauauccacaugcuuuuugaguuuucaccuaaaauauuuaggcccauuaaaauaauuuauuuagcauuucgccaugugagauaaaacugacaaagccaucugauuucuuucauuugaaaauggaacugcugagaacaacauauauacuuggcauuggcuucauaaguauaaaguaaauaauuuaaauuauugucaauguauuauacuguuugauauauagaaauauaaauauuaaacuccuaaugaaauucaaaguuaacauaggcauguuguaacacuguuuuauguuugcaguguuauuuccucugggcaguugacauguuucuaagaguaguuauuuaguucucaaauauaccacaugaacugcucggcugcaaauguuguuggccuuguuuuacaaacuggaacacuuuuuugaaguuuauauaucagauaaacaaauagacuguaauaaggaaacuuugauuauuaguucacugauggcucucuucauuauuuuaugaauaugcaaaauuuuuaucagagcaauaugcucaaaagcauaaaaccauuauauaauacaaaaagucuaguaaaggaacacuuccauucccuccccagcccuugccuucccccagauugacaccucagagacacaauacucacaaauacacaaaugcagacaugguucugguauaauuuucuuaugaugcugugacuucauuaaucaaugcuauuguuguuuuugacuuuguguuaugguaaugagguuaggauccucacaguugcucccccaccaacacacacacauacacaucccuuuuacccaaucucauaaacuaagaauauuagaaacuuuagucaguuuauauauuauuaggauuguguagguacucauuuuugaucuaaauucucuacuauucuuucuuauacaacuucauguuguucuuggaguuaauaauuucuuuuucuuuauuaaugugcaugguuuucuacguaacuguuccuauuuuuccauaguuuauccaaacuaucaaaagccuuuuaauguaauuuuuaaaaacucaaaauuaucugguaaucuaucggcuucuucccccuccucucaccuuguaaaaucuccugcuggagcucuccacccuuuuuccaucuggauugauuguucuuuagucucagcaagcagugaucauucuguagauucccuacagcucuuuguuggcuggauuauuguuuucugaguucucuuucuggguuuucucucuugcuuuuuuggagcauauccuacaauaacgucugaaagaacacaugaaaauacacuuuggagucuuuaugugauaucaacuuuaaucuauccucauucuaaccucacacucaacuaauaauguagucaaugcuuaauagccaguguuuugugguuaagaauauuccuuugguuguuccuuuuuaugugaucugccuccacaucaacuuuauagucuccauuauuugcucuuuaucccuagcguuccgaaauuucaaggugcugcacacuguaagaguuucuuuacaacguuacuuucuuagguauucagugagcacuugcagucaugaucuuaguuauuuuguucguguuuauuaaaauaauuuuuaacuuguuuccucuguguucuauuuccgggaugcauaugaaugagauguuggaccuucagaauugacucuacuuguuuuaauuuuuucauuacaacuuucucccuuucaauuuuuucuacauuccgggagauuuccucaacuguguuuuucaaauuuucuacuggaauuuuaauuuugguuauauuuccaugagcuuuuucuugcucucuggcugcucuggcuucauauaauucugcuuuuguuucagagauacaucuucuuuuauagcucagauauucaauacaccuuuccucuuaugaaccuucuuacagugugcuugcuuugaucucuuucuuucauauuagucuucuuuuuuuuuuuuuuuuuuuuuuuuuuuuuugagacggagccucgcucugucccacaggcuggagugcaguggcgcgaucuuggcucacugcaagcuccgccuccuggauucgcgccauucuccugccucagccucccgaguagcugggacuacaggcacaugccacuacgcccggcuaauuuucuguauuuuuaguagagacaggguuucaccguguuagccaggauggucucugucuccugaccucgugaugagcccgacucggccucccaaagugcugggauuacaggccugagccaccgcacccggcccauauuagagucuuaaccaaauuuuucaugaucguuaauuaggcauucauaauuaaacaaaggucaaacaaaacuaauugaagcucuuuaugcauuaggugcaauuugcuagauauauuucauuuaccgugauuaaucagugaguuggucuuuuuucauugggagacaucaauauuuaggcuuuugcuucuccuugccccugccgccaaccauucuguuucugaaaagaagacuccuuaaucuucuuauuuaaacauauauuccuguggcuagaguuuugggcucaaagagucccaccauuucauuuucagauccuugcugccuuccuguauuuggcucugaucugcacuuuauuucuuuacuccucuucauacgugcccauguucagaggcaccauguuuuaauuucucuugaaaauagauauucaagauuuuuucccuguacauuuucaaagguggggaagggagacuaggaaacaccagauuuauaugcauuccuucgaccaaccuuccauuuucaacaacuuuaaauuuccacaacacucagugccuucaaauacugagcuuuuuggacaccacagcuauauugacuaguuucuugucacucucccucucucuagguauuuagguggcaucugaagucaguuacuacucucgaaguuaagucaguuacuauucuuucauuugcuuucugauuccuccugaaauuguugaaaucuuucaggugcugauauuccucucuguuucccauuccccuugaguauuuaaagacauauuauuccuuuacagucauuuugguaagguuguugaaaggcaagaaaauaaaugcaugagauuaauauaucauuuuuaauggaauauuguuuuauuagucuucucgauauuggcaucaccaguuugucuucuaauguaugagacaaaauguuucugaggacauuuaggauaauaauccuauuguucuacaauauguuucuaguguaaaaaacaucaccuccaucagaaaaagcaacauaaucggaacugaaaacuuucauauuuuuuaauaguuuugugaaaaaaauaagaacucuacuacaauguuagcuaucaaaguccauuggcaggacaaugauguauuuuaauagcauaggaaaaacuacuugcuaaauuuaauaaacucuaagaaaauaaaaguuuacuaggggaaaauaaaaauggauauagcuuuaaaaaaauggaaaacaauaaugauucucaccaaaaauauugucuuugccuuuacaacaauguaucugacaauauuauugcuuuguacuugaagaaguagaauaaacucaggacauuaaauaucaaaagaaauacaaauucauauauauuugugacuuugcacuuuuuaagaaguuauauuugaacaaaucaugaugaauaaaauauucaucaaaccaguauucaacauuuuauuuuugcuaguuucuaugaucuauuucucaguaguucucacaaauaaagcuuaauuguguuucuaaaaaaaaagccagaaagaaugacauaauaauuuuuucaaugguuauuuguaagaggauauaaaaguguagcuauaaauaacuucuuuaauaauugucuagaaucuaggacuuauuuuaguagacuuuacauaagaggagugaagagaucaauaaaaugaaauuuuaagguacauuuuucuaugccuuaggcaauuuagugaaagaagaaagaacugaagugaagcaaagacgaaaaugucuuugccuacuuauuaaauguauguauacucugccuauuucaaaacugaauuugaaguaagguauuacaaauaaaacacuauauugggaaaauuaugauaaaaauaagguauuuaaauguuccaaugaugauuaaaauguaaauaacucauuuauucaaacuuuaauauuugaaaaaucaugucuugaccauguaccuucuuccauuucaauccacaguccuuccuaaaguggucauauccaguuccaugguuuaaaaugaaugccaucuguaugccauuugugccuaaauuuguaucaucagccuugguauaucuccuuauuucaaaaugcauauaucuaacugucaacuugagauguucuuggguaugucuauuauacaucucaaaaauggcaaguccagauucgaacucuuauuucauugguaaacauauuucuuauuugaagaauuagcaacaacauguacccuguuuauugaaagcacaaucuugagauuaauuuauaauaucacauuuucauucauuaugcacaugcaacacaucauaaaaucuuaccagcaauaacaccaaaaauuguuugaaaucugucuauucucuccaucuccauugcuaaaauccuauucacacuaggauuuauuuuuacuaguuauaauaucuguaaaauauuucaugaaagaaacauaaaaaguauauguaaaguuuaaggaauauuuuucaaugaauauuuaacaucauaaauaaaacaauaucaauaauuuugaggcuccuuaaaugcuaauuaaauugccauccauuucuugcaaugauucacauguucuucauuuucuuacuuuuuaaaaaguauucuuucacacacaaacacacacccuucuuggauaauacauuuuuuaguuuugauugucuuugaauuuuucuuaaaugaaguaguauuguauauauuuuucugcaauuuacuccuuucucuccacaucuugauuguagauucaccuaugcugauacgucuauuuguaguucauuuguuuuuauuguucuacauuaggcaauugucuuacuaucuuacaauguauauauaaauucuaauauggguaaauauuugaauggcuuccaagaugaugguugugguuuuuugauguuucauuguuguccuucuggauuaaaaacaaugcuacuacaaacauucugguaauagucuauuguaaguaugugcgagagguucuacaaaguacauauuuagaguagaagaacaaaguugagauuuccacauguucaaaugcaauagauuaugccaaacuauuaaguguuugugcugauuuacacucacauuagcaauaguugaacauuacacuuucuccauucccucaccaauacucauuauugucucugacuuuuaauuuuuguccgucuguggaguauaaggaggcaucuuuuuguuauuauaaauuuuuguuuuccugauugcuaaugcaguugagcaauuuuucuuuacuuaauggcuguuuauauuuccuuuccucugaaauguacauuuggucauuuaaacauaauuuuauugauuguuuuguaauuauugaucuggagaaauucuguauucucaacacuauagucauuuguuuaauccacuuuuauaaauaccuucuuccaguucaggucuugacuuuuuacucuuuuuauggcauauucaguuaauaaaauauuuauuuuaaguaaauauaucaauauuuuccuuuugaguuuggauuuuuuuuauuauucuuuagcagaaauuuuucaacccuugaagugcggugauauuuuucuauauuguccucuaaagcuuuuaaaauuugccuuucacauugaaauauuuaauaccucuuaaaacaagcuuugaaaaugacacauguagagauuuacuuucacuuuuuuuuucaaacaauauccagaucccggcaccuuaaauaguauacuauuuccugaugaucagcaguauaacaaauagagagauuccauacaugagugggucuauuuuaaaacuauuucugccauuggcuauuugccuauuccaaauaccacauugucugaauuauauaacaauagcuucauaauaugucuuugauguuuuguauagcaaauuucuucaucugauacuugagucuuggcuaguguugucccuuauuuagcagagagucuuggcuaguguugucccuuuauucuucuauaugcauuuuaaaaauuaguuuucaauuuucuuaaaaucuuuaaacaauuacauugaaccuaucuacuauuuuuuggagaaauugcaucguuaauauauucagccuuuccacucaaaaacauguuauacuucuccaacucuaacuuacuggggauuucuuuaaugucuuuuaguaaauuguuaucauuuucucaagaaagagcuuugugcauuggguuuaccuacuuauuuguuuauuuguuucuagauacuuuauguucuuggcuacauuaaccauaagggauauauuuucugguugcuucauuuagaaaugagaguucuucaaaaauuuuuuuagcuggaaaaugacaguagcuuuuuaacuggguucucuguuuuacuuuugucucccuauaguccauucuccuuacuaucacacacugaacauuuuauauuuccuuauucuuugauguguuugugaccuauccuuucucaccagaauucaguuuucuaagaguagaaacuuuguguuuucuuaucaacacugaaucaccagugucuaaaacaaagugggcacuuaaaaaacuugaaugaaugaaugaagaggugagucacauguauuaauauuucugaauguguaagucaagauaagggcucugucuuucucacaaauagauagauuguauuggcuaauaauuaaucagcauaggccaaaauuuuggaguugcaaaacaaagacuauuuauaaguagcagauaauauuaaaaggacugcuguccauuuacuuauucuauucuguucucuggaugcauugacuuacaaguuaucauugaacauagcauagaaugauauuguugaucacaggucaccuaguucuaccuuucauccaauguucuagccucucuauugcaucuuucuugagugccagcuuucuugaguguuaagaguuccacuuaaaccccuucagcagcuggcaucacacccucuucucagauuuccauuccauugucaaguacaguucgucauacugaacuaagcucugcuucucuugaguuaccauuuauugaucugagcuuugacugccagauccuccacauuaaaaagaaauaaauaaaaaagaaauucacccucuuuuagcauaauaacccuucaaauauuuuaaguacugcguucgauauaauagcauuucucuuauuuaaucuaagcaucuguuuauuuucaugcauguauucuuucaucuauucuugaugacuauuucuugagugucuuccagacuauuucuugagugucuuccuugugucaagcauagaaaaggugaacauuaauaauuugagaaaacauuccuucucacaugucauuauaugauaacucccugaguuaggucuuaaccuuucagaauguacuugucaauugaguagauauuuaguugagauuuggggcgucuucuuaauucuagccauaacaaugaacuauuuuuaacaagaaggcgcuuaggaacuuugaaaauuaaaacagagagagagauagacuaaagugacuuaucacacuaaaagucagacugucuagaagaucauaucucuuuauuuccuuuuaacaacuaaaauaauuuuaaguugauucuccaaagaauuccaucaaagagaagaucuuaaauuuccuggaaagaccaucuggcacuuuuuauaaguguuauguuguuuuuuaagcuacagaaagcgcucuaagaagaaagcauuuugggauaaaaacuaaaacaaaaaauuucaguuuucaauuuugucccaaaucacucuugucaauuacaaauauauaucuaaauaucccagguuuaucucuaauucuauuaaagcuagagcuuaaaugacuuaccuuaaaguugacugguaguuuuucagagugugaaguuaauuuucucacacacacguuugugacugacugugcgaauacucaguuauuagcaaauuagcaacacaguaaaugugucucauagaaauuagacuaaggggacuagcuguauaugagccauaaaaccuauaaaucuuguggacaagaucuugacauacaaauuagaaauagaaauuauuuugaagccuuggauacugauaguugcauuacuuagcacacuauggucuucagucccaacuucucauuacugauucccauuuguaugucuucacucuccacagacauuuacucuaauguuugauauacaucccuguuuauauauauaacccuugcaaaauauacuauguuucgugugugucuauuauuuaauuauuuuauauaaaggauauuaugaugcaccaagugucauaaaguauuguuuuguucaguuucuuguuuuacugaauaauuucuauccacauugcuaaauguauguauuucccaguuugacuauuugaaaggacuuaucaggcuccacagaacauauucgcauaaggcuuuuauuuaaauuuuuuuaaaaauacaguacagcaaaagaaaaaguguauaagcaaacauuagagauuccaaagauaugccauguacagggcacuauuucuggcauagcucaaaggaugucuuaguccauuugggcugcuacaacaaaauagcauacuguguagcuuauaaacaauaagaauguauuucuuaugguucaggaggcuaagaauuucuagaucaagaugccagcagaguugaugucuauaaucuauaagggcccucuucccucauagauggcagcuucuaacugcguccuugcauggugaaagagacuagcuagcucuuuguggucucuuuuauaagggcacuaaugauauucccaagcguagagcacucacaaucuaaucaccuuuccaagaccgcaccuucuaauaccauuaucuugaaguuuaggauuucaacauuuuuggaggacacaaacauucaaacuauggcaaaauauaaguucccugggaagccuuucuuugucuuuuuggcuaaauaaacaagccagguuugucaaaccccaguggacuagaugcagucauaaggaaaaaaacuuacccuggagguucucaacacaucauaaauucaacuucccuuaucuuggccaagggucaaaugcaaacacucaaugcccuggaaauauagaguuuuucagcauaguuauaaauuaauucuaucuccacaauguacucuacuucauugcuucuaauugcuuuauaguaguucaugccuugcaucccucaaguauuauuuagucguuccucuggaaauggauacccagcuuuccaacugacacaaacaacauuguuauguuuauugguaaauauccucuugugggccuauaugaaaguuucucugugaaaauuggauguaaaauuacuuauucaucaguaggacaauuguauaauuuauccuccacacuaaacuaauuuuaagaauggaagaggguauuauuaauaauuaugccaugacaacaucaugaaccagagccuggguaaaccaaggcauagaguacucugaaucacaggcugcacauauucacguuaacacuaaccagacuuuucuccagaccgcauaaauguaccugucuacacacuuuauugccaacacuuuguguuuucagauuuccaauuuugaaauuugacaugugcaguguuccuuccguuugcauuuauauccacauauuugcuagcuaugcagucuaccuuucuuuuaauuucugauucaaagcuuugguuuauuuuuccugcuuaucaauuuguugucagcuuuacaccuagcaguuauuuuccuucaguuuguccccuauucauuaacuuugucuuuuaccagaaauucuuaauuuugauauagugaaucaacucauuucucaucuuuaaauuauacuauauguaaugcuuaagaaauacuuccccaucuuaaagucacaaagauauucuccuguauuuuccuucuuaaagucacaaagauauucuccuauauuuucuuccauuagcuguaugauuuucccuuucauaaucaggaauauacuggacuuuaauuuuguaaucaauaugaaauaggaacccaaguuuauuuuuuucuucauaucaaaaaucuggcuuugaccacagaguucuugccuuuguguguaauccuuaaucuuaacuaagaacucauuaucuaccaugcaccuuugcauuuucucaguuaguuaauauuuuccacugcuuggccucucuuuuuuguccucacacuaaaggaagauacugucugaacuaagguauuaaaaggcacaggaugauaucaggacccugcugucacagagaauagguuuccugcaauucaggagugugcagccugccaauuuucgguuagcaccugugccuccuauauagucaguggaacacaugccaucucaacacauggggaucagcaaggagacaaacguuacgcauaugggugaagaccaguucuuagcuuuuguucuuccuguuguacuuguuuuuaaaaaucuagaccugguuuuuagauaaagaaaaugacauucuuacagagccaaaaaggaaauucaagaguugccuuauuuuggauuauuggaauauuuuuguuaucucuuuuaucucuauuauuggcuuauuaccuaaaguuauuuguugguguugcuuucagauuugugguguauauuuuuaacuuaucauagucuaccuccaaguaacauagcacucuacauaugucaugcaaacacugcaacaguagguuuauauuuuccccacaaauuuuuuuuuuuuuuuuuuuuuuugagacagacucucacucuguuaccaggcuggagugcaguggcaugaucucagcucacugcaaccucugccuccuggguucaagcaauuauccugccucagccuccugaguagcuaggacuacaggcgcgugccacaaugcccagcuaauuuuuguaguuuuaguagagacgggguuucaccauguuggucaggauggucucgaucucuugaccucaugauccgcccaccucggccucccaaagugcuggaauuacaugcgugagccaccacguccggccuuccccacaaaucuuugugcuauuaucauacauuuuaccucuaaauauguuacguagaaguuguaaaccccauaauauaguuuuuaguuuugcucuaaacaguaaauguucugauauagagaaaacacuuuuucugcuuuuaaccacauguuuaccauuuccagugcuuaucacucuuuggcauagauccauguuuccacaaggaucauuucuucugaagggcuuccuuuaacauaucugguaauagaggccugcuaauguuuauuagcucuuguaugugucugagaaagucuuuauuuuucaaagacauuuucacuggcuaugcaauucuguuuuucaguacuuuaaugauguuucccugcugucguuuggcuuccauuguuucugaugagaaauaugcugucauucuuaucuuuauuuccuauauuacauaauaugucuucuucuuuggcugcuuugagaaauaucuaauguaaaugacaaguugauggaugcagcaaaccaacaaggcacauguauagcuauguaacaaaccuccacguugugcacauguacccuagaacuuaaaguauaauaaaacauaaaaaauauaaauauaaaauaaaaaaauaaaauguucuuauuucauuuuuaaagcaauuuuauuaugauaugcugugguauaguuuccuaaugcuucuugugcuuggaguuuacugaacuucuugguucuuuaaauuuauagcuuucaucaaauuugaacaauuuuaaacuuuuguuuauuuaaacacuuuugucuucuuucucccaauuuuuaggacuccuauuauuaccuguaugugguuugacauuuccccauagcuguaugauucucuguuuguuuguuuugugugugugugugugugugugugugugugugugugugcgugcgcgcgcgugcuccauauuggauaguuucuauuguauuaucaucaguuucacuagucugucucugcagggucuaauaugugguuaauuucauuuauuguauuucuuaauuucauaaauuauaguuuuauauuuagaauugaaaaugagucuuucaaaaauacucuucaugucccagaccuuuugcuaccuucuuguagucuauaucuaaguauugcuuaacugcuuauuuuuccaauuccuugcaugacuggcuauuuuuuaaaugaaugucauauauugugaauuuuaccuugauggauccugguuauuuuuguguaucucuaaaauuuuuuagcuuuguuauugggcacagcuaaguuacuuauaaacagcuuugaccauuuccuuuugaggacuguuuuugguuuuauuagguaaaaucagagcagccuuaauucaaggauuaauuuugaucccauuacucuucuacauacucuucuugauguuccaugaauuaugagaauuguuuacucucuuugaucggaauacaaacuauaacuauuccuggccauaugugagaucugaaggguugcuccuuuucuucauuuugguaguuuuguuucaucaugguuaguuuucauacacacauuugcugauuaauacucagcuaaauagccaaggagauucuucugcauauaucuagagacuuacuguggaacuaucuggauacuuuccccugagaauucuacccugcuagccuccuugaguuccuaacauuugucuucucaacucuggcaggcaaucaggcuccaccuggugucccuuucccugagcugcagccuaaaaucuccaaccugucaggaaucuggggaaguuauagggcuuguuugcaucuccuuucucaaagaacgugugcugccagacaaccaaccuuuaaaauuguuguuugauguauuugcuuuccuacuucuucuuguuauugucacagcuagaagguagaucugauccauauuccugcauugugaccaaaaaguacaacaauaaucugaguuacuaacaguauacaucgaucucaccccagaguaagauggggagcugaacuaagcuuucagcauauugacaggaggcaugaacgccuuucuauccaauaacuuguauugaaauacugcccuaccaacacaaagaaguaaccaggcuaugaguggagaaaaaaggaaucauaacagcgcuuuuaagcuauaaaaguguggccucuaaauccacaauacccauauggcauugcauuauuagugcaagguaaguacaguuuaagguagaaauaauuuuuauguauaaugacgaauauuugguaaucacagaaagaacaaugcacuaggacaauaaaucaaacauaagccuguauaauucugaaaagaaccugaaaacaugguuguauuauaggaagacuugacaaaaauacaaagauaugaggagauuuuaacacacuucuauaaaauuaugaaaaaccccccaaauuaauaaguuugaacaauacaaguaccaauggacauauagagugcuuacggcccauaagaaagaguuaacauuauuuucaagcauguguauaugaaagauacauacaauuuuuugggggaugaaccaaaaagauaguaucaauaaauuucaaaaauuagcaucuuguauauacuuuuucugaacacagucaauaaaaaaguacuuuuggaaauaaauuuguaaagucaauuguuuaugaauuaaggaagaaaucacaguagagauuuaaaauauuuuuugugagauauuaauuuuugaaaaaaauucuugauguaguuaaaacaauacuuauagacuacaauuuauauauuuuaaaaguagaugaaaguguucaauuuuauaagcaacaggaaauaauuauaucaacucauaauuauaucaacucaaauuuuacuauuuauauaguaaaauaaaacugaaauuuaaaaacuaaaauaaaacauauauuugacaugaucaucaagacaaaaacugaugcuaaguaaaagauacacaucucugguaagauugagcagaaaggaaaaggaaaagcaaaauaaacaauauuaagaaugaaaaagcgaugcaacuauagucauaacagaucaacuuuaaaucacagagacaguaugaaauagacaauuauuaaaaaaaaguuacuacaauaauagucauacacaccccaacagacacacucauuggucauauuuguauguaauuuaaacaccuaaaguaaaaagauguuaauuuauuauaagauauugaauuaaaauaaaugcaggaguccauaggauuacacaaacaaagggaaaguaugagagaaagggaagcauuuaaaauuugaaugccgcuaacaaaaguagaagaaauuuguaauaucuaaugcaauaguaauugauucaggcaagaaucaucaauaaauguuaaagccauugagaauauauucugguggggaggaggcuauuuaccccaucucaaauaucacccugcagauuacuuuuuaauugcaaugggaaauauguacacugacaucuuauagaucacuuucuuaagcaagugauguaacuucaccaacugaaggagagccugacauuauuugacucucaugcaaauaaaaaaccaaauaguucaaagcguuauuuacguauucuucccauaaauguuuaaccuaaauuuaaccaugagaagguuaaauacugaauuugaaauauuuuacaaaauaaauuagaauauuauuuucuaaaaauucaauuuuucagaaaccaaaggaaggaagaacucauaaauucauugggacccuucuguauuaaagaagacuaaugagucaauaacaacgcaugaaucuucauuaucauaucuuggaucauaaaagaaaucaguuuuaucuuagacacaagugaaaauauugcauaugagccccauauuaugugauaugcaauuaucauugccuuuauggguaugacaaugguauugcagucagguagaggaaugcccuuuuucuaagaacauuuugaaauauauagcugagaaaugucauaauacuugcaauguauuuucagauaguuaaggagagaaacggacugagugagaaagagagagagugagagcacaaaucuguggcaaaauguuaacaauugaaacuaguugaaggguuuguaggugaucuuugcaauacugcugcaaucuccucaucaauuuggaaauuuuccauuuaaaaaguugguaaggaggggcuuugccaaguccagaugguauuacaagcaaguuuuauugaaucuuuaaggauuuugagcgagaaaauauuuucagaaauaaaguuuccauacuaauuuuauaaugugagcauaaucuugaaacucuauuagaucaggacaguuugagaaauucaaauuuuaguauacuacuaucaacauagauacaaaaaugauauuugauaaaauauugucaaauuacaaccaauagugcaauuaaaaauaguauacuaugacaaaguaggguguaucccaaauggacaauaauacuuuaacaguaaaaaauugauugaucuauuuaucagauuaauagauuagagaaaaaccuuguaaucaacgaaaauuuccagaauauuuugacaauaucgaucuaaacagcagguaaaaugaaugaauuagagcuguauaaaucuuuaugggaauaucccugaaacauaauacugagugcaccagucaauuggagaaugauacuuauccuaugauacacuugugugaaauucaaaaauaaagaaaaaucuauauuauguauucugauagauauauucacaacaaguauauuaaaaaagaauguugagaguauauucccuaaauaaaauauuauaauggcuuccuauaacuccuaagauuaauaucagauucuuuacuacagacucuaggaaucugcaucaucugauuuuugcugacauuucuagaauggucaaauauuauacuucuucuagcugucugcuccagcuucaccugacuucuucauucauacacuugaaugugucuugucacaacucacaaucgagacuuugcauaugucauuuccucuuucuggaguauuuuagcucuauucuuccucuuaaauaacuuaucuuucagcucucaucccauauucaggagaugcgaggucaaauuccgucauuuuucuuuauaacauuucauaccauucuuucccuuuucuuuuuuuggaaacagggucuugcucugucucccagacuggaaugcaguggcacaaucacagcucaaccuccugggcuaaaacaauccucccaccucaaccuccugaguaguuaggacuucaggugcaugccaccaugccuggcuaauuaaaaaauuuuaaaaaaaucauagagacagagucuugcuauguuucccaggcuggucucaaaguccugggcucaagcaauccuccugccuuggccuccuaaaguauugaaauuacaggcaugagccaccuuacccagccucuauuccuuccuuugagagcacuauuucaguuguuauuucucauugacuuaugagguuuugugauuaguaucuauccucccauuaggcuuguucuccccacauaaaaucagauauggcaucuauuuugcuaagcaucauaccccuaguaccuugcacaguucuugacacauuaaaggugccuaccaaauauuuacuaaauuggugaaugaauuggcaaagucguuucuuucauaggauucucuuauuuugaucaugauccuguugaaauagcuuucucuugauaauuccacacuuucauuuaucuuuucccugugacuaaugcaguuugaugugguuugggcaucucuaccugagugacaggauauagauacuaugauugacaguauccucuagaaguaugggcauugaagcauuuaagaccagaggaaagggauaugcuaaucuuggcaauauauaucaacauauguuaagaaauuacauugaagaguuaauaaauuaaauuguauuaagaaguagaauauuuaacagaaaauaucccugcaacaaaaauuagaauuuaaauauguauuucuccaugcccauauuauuuaugagcaaauaaucaucacuuuuccaggcauaaaaauggccucaaaguuauugcaugaauauggauccacauacacacacaaaaugaacuuuuaaaauauuaccaagaaccuuacacacaccaucuucaucuguguaauaguccuucagaggaagguauacauuacuguuacaauguuuacaaaugaauaaauuaagggacagaggaguugaaaaacuuuccccagguuauacagcagcagagucaaaaauaaaauccacaucuguaugacuacugaacccuaauuuggugcauugcgagccaaggauaugaaaguuuugcugaaauuaaugaggcuggaauguauaugucauguuuuaaucuaagucaguguuucuucaaauuugaugcugcucugugaaagauuccaaaaucaaacaaguuuuggauacgcugcaugucauauucaauaguccucccuuauuugugguuucaguuaccugugguccucagugaucugaaaagauuacaugaaaaauuccagaaauaaacaacucacagguuuuaaauugugugcuguucugaguagcaugaugaaaucucaugccaucccuuugucuaguguauucaugcuguguuggucauuuuguagcuagcuggcuugguuaucagaccuugucacaguaucucagugcuuauguucaaguaaccuuucuuuuacuuaauaauggccccaaagcacaaggaugcuggcuauuuggauauggcaaagagaacacauaaagcacuuucuuuaaugaaaaagugaaaguucuguacuaaauaaggaaauuuaaaaaaucguaugcugagguugcaaccuaugaugagaaugacucugcuauccaugaaauugugaagaaggaaaaaguaauucaugcagagcauauauuggguugguacuaucagugguuucaggaauccauuggggucuuggaauguaucucucauggauaaguagaaacuacuguacucaaaaaguucugacaauguuuuuuaauaaagaaauagcuuuuuuauugcuuaacccagcacuucuaaaaacauaccugaauagggaagcuauucuuggaaacuuccaggcuagagggaacuacaaaguuuuuuucuucauuuuuuuuucuaaugcaaaccuguguccuaggaagacaaguuuuuguuguugucauuguuguuguuauuucaauagguuuuuggggaacaggugguguuugguuacaugaauaaauucuuuagcggugauuucugagauuuuggugcacccaucuccugagcaguguacacgguacccaaaguguagcacaauuuugauagcacuccauguccuuucucaccucaugcuucugcucaggcucuucuuuuggccuggaacaccuacguccucuucgugauaugugguaaauucuuauuuacacacuaguuuaaaugucacaucaucugugaagccaucuauuaacccuucaaucacaugcccauauauacagaauaagcacuaaugagcuauaauuucauaaaauaaugugaaugaucccucaccuuuaaagagcaucuccuauguuuaaacccagcucuaaacauugcaaaucucauuucuuaauacuuacaauaauuacuuauuauuaucuaauuucccuccaguucacauaucaguucucagauucucuuuccaggaaacuccucuauggagaugauuacauugccugauugacuccuuuccucaacuuucgcuugaauacauucaacuaggcuugccccaccauucaccauagcuuuuccugucuaacauaccaacagcugcuacauuaaugaauucagacaaaguaucaguccucauuuauuuaaauuaucagcagcauuugacaaaguuagucccuuuuuagaaguucaaacccauucuucacuuuucuuucaggaugcugucauuucugguuugcuuuguacaucacuggcaauuuuuuuuaugguuuacuuugccgguucuucucaucuuuacaauuucuauauguuguccugccccagccuuuggccaguaauuccauuggugauuucaucaaauuucauguugggcauuauggcuaagaggacagaccuuugcaccaggcugucuggcuuugaauuacagcucaacuaguuuguuagauguguaaccaugggcuagcgaucuaucucuaccuuucuaugucuaccucucuuuuaccucaucgguaaaaauagggauuauagcaguaccucagucauagaacuguugucauauuacaugaugugauguuuguaaagagcauaauguccagcaauauauguuuuugcugauauuaccuauaaucuaaugacucauaaaaccuaucuagcugggauuucugcuacaaacuugugaaucauauauccaacuaccuauacaaugucucuacuuggaagucuaauauauaucucaaauuuauuauauauagaauggaaagucuuaucaucacucuuaaaccaggcaagcuuaguaaauggcaacuacauccaguugcagaugcaaaaagacucggaugcuuccuugauuccuuucucucagaccaucaauccaucugucaaaucuagauuguucugaauugaaguuuuccagaaucuugcuacuucucaccucaaucauucuaauccaaccccccaggaucccucaucucaauaauuguacuaguuuacugccuuucuguggacuauauucaacauagcagagugguuauuuuaaaauauaagucagcucauaucucuccucugcuucuaggcuucugugacuuuuuaccucacugauuaaaaucuggaguucuuacacagguuuauaagaauuuaccuaaucugucccaucacucccuuaaucuaucuaaucuugucuacaaguuucacuucuuuaaguccacucucacugcucugguccccucacagguccugugggaaucuagacaugguuuucucucagccuccuugugcuugccauuccucugucuaguguguuagugucuaaggcaugugugugugugugugugugugucuuauucuuucagaucuuuacuuaaaauucaccuucccaaggccuuugccuacucuauugaaaauugcaacuccacucuaccccagccccuuuuucuccuuacuuuuuucacuggagcucaaaaugaucuagcacaauaugguuuuuauucguuucuuguuuuuucaacucuuccuuccagaacauaagcucaaugaggggaggaauuuuuauuucaucuguucacugaauaucucugguguuagagcacccagcacauauuaggcacuuaagcaacagucauagaaugaauuccuucccauaagggauaaagaaagugaagcucacagagacaaaucauuuuccacgacuauccaaaauuuacccaagggauccaaagucaaagcacagaauuagaagacacaggucagcaucuaggcuacacauacugaaggaauauguaauucauagaagauaauaauagaauagccaaaugcauacucuucuucucacuagaagggauuucccugagaaaaggagcaguuuuagucgucuuuauaacccuggcaccuaauauagugugggaaucacagcagcagcggugugcuggagccagcuccccaagcucagaagaguggguugugugcucucuuccaauccugcuuuuugcgacauauguagguagcuuggaauuggccuuacugagaauauuuacaccauggaaauuagcaaacaagucaggguuuauuaaauauguaccugaaaagcacugcaaagaagauaguuaaaaauauauauauuguuguaugagugaaugaauucaugaguaaaauguaugagguagauauuauagucugaggcaucuuuuagcauacagaugcuguagauaaggugaaaacguaaaaacuguugaucgauaacuuucaaugaacauuacaaaaacaaacaauaacaaauaaaaucuuugauauaggacauaguucaauuucuuacuccaugagcucuauuuagauagagcucucugucuucccuaugggauaauaaaaaauacggcucaaauuuccuccuaaguauaguaacccacauaauguauauucacuuuguauuuuaucauuaugugucugugaauauacauaauuuuuccacuagacaaguccuucuuaaauauuuuuaaaucaucauuuauuuuaagaaagucaccuucauauaaaaaggcaaagauacaaaaaaauaugcauacaauuuccagaggagcacagaccuucaaaauaccgugccacccuugcucccaccccaaccaacaggcuccagguuaagaacucugcacuugaaguagaggauucuagggucaggcuauuugucuaaguuauugccuauucccagcaugugucugacauacugacacuuaaaaaaagaaaacaaagaaaaaaaaauaagacuugcagauugaauaaauggauggaaugaauaguuauuuuaguugcuucuuagaucuucucuuucccuaaacaccuccaauuuugucaacuacuuuuuauaaagcaugauuuucagaaccuauaacuucuggaucucccuccucugacacucaauguucuugauuuuggagaaagucaaacuacugccacauucccccaaacucaaauacagaguuauuguuguaguuuaagauucaaguaauguuccaggcaacauuucuuuaaucacucacgauccacagugaucuuucauuuagcuaaaacucuagauucuuuucaccuaaaagacuauagcuagcuccuucuaucauucuauugcccuaguggacuuuuaaauuuaacuccauauuuuuaccauuaaauuccauugucaguuucagccacuguucuagccugugaagcucuuuggaaauuacauaacauaguugucccaguuagagucauucccaaauguauucaauaugucuuaugugucaucaaauaguucauuaaaaauuacuuuaagaauaauagaagccagggaccuccugcaguuuuacagugagccauuaaucaauacuguuugguaggaaagaucuaucaccuacagauucaacaaacugcuuaacuauucaacccacauuuauucauccuauccacaaggaaaucuuaggaaauuucaaaugugcuguugaaauccaggggauuuagaugaggcaugguacugucuguuacuguaacuuuucccugagauacuguuguauacaccuccuuugugcucucauaaaauuuugugcaugucucugucauagucuuuaccaaaauguacccuaauuuucuuuugcaucugucuucucaaguacugugaaguccuugaagaauuaaucugugcauccuuuaucucuguauuaucagaaccuuauguguaauaguuaauaaauauuugucaaacagaugaguaaauaauaggagucucauauuuuaccuuaggaugugaaaaucuguauaaaguucacaauuuucucuggacuuauucuaggaagcaaaucacuaaagaugauucacaacaauuugggagaacagaggagccauuucauuucuuugugccucacuuacaacauucuuacuauuuuaacuuuaugcacauauggaaugugugacuugauuuuauaacagaaagacauuuuuauccuucuuaagcuaaaacuguacaugcuauucugauuauuucuguuuuccuccuuuuaugcuaaaacuguacaugcuauuaugauuauuucuguuuuccuccuuuauauguaaccuuuuguauuucuuuuuaaaaggucagaaacaguaucucauuaacacuucagaaaaauaguugccaauguuuccauucauagaccucauacuuggagugucuccuuuaaaauuauaugaaaaugauaaaaugccacaaaaucacaguguuccugaauauuuaugcaaucuucuauauaaaauuuacuucagacuuucugcugcuugccugauaguaauaaauuuauuaguguauuuagaauauaaaaugucaucauuuuaugccugccuuuugauggccagacacucaucaauuuuuuuccaaagccagauuucuauaaggagacacucaucgauaaaauauccaguguuccugcacagagguugaguaauuaguuucuaccacagacugaaaaacucaauguauggagaacaaaauaaccuuguacauuaugugcaaucuuuauuaauugaacuuuaagcuagcucuugagauuuuuaugcagucugcaacaaaaaggucaauggaauggcaaugaauccucuuguauuuauuaguucauuuugcaaaugcuaacauugggugagaauugauucgauuuguuugugauccaguaccaaagggguauuauucauuaagauuuacauggaaaauaacauacccaagggaaaucagaaggaacauuugcaauagcaauggucuuacuagagguugaccaugauuuucauuucacaccauuucuuaaaauuaucaaaaaguguccucaaaggaauuauuacuuggaauuuaacacacacacacaccaacacacacacacacacacacacacacacacacacacacacacacacauauaauauuuaaaaugcuguucuaggcuccaaaguuacaacauaaauaaaacagucaauguccucaaaaaucucacaaucuaaugagaaaacagaaauuugagaauucauucauuauaguacaagguaaaguaaaggaaauacuuugaugucaauaugaaauuaucuaugggaguacagaggauuuaaagaugaaacuuuauaaagugagaaagauuucacuuuugucuuagaugauuagaagaauuucacauguuuuaauagagauauuaaucaaaagccaaaauauggacaagaacucuggagauagcuaaagaaauuuacaauuuugggaaauggagaacagagcuguaugacugagguauggugaggagugaugaucgauaagccaagaagugaagacgcagguuagaauuugaagaacccccuuucuuuuccauguuaaguugucagguagugagguacuacugaacaguuugaccuuuggaauggguugaguuaaaccugagugucuauguuuuagaaaguuaucauuugugacaacacaccguuguaaaaucuguaguuuuccuaauauaugugaagauacucuuggcugugacaauguauuaaaaggaagggaaagauacauuaaaaguuagaauuaggacuuaguguuugaaugaaaauggaaguuuaggaggcaucaggauuaaagacggcaucaagauuucuacuuaguacauugcauacauguguaaucaagugugaauuauuaaacaaaacuagauacuucauaucucguuauguaacuacuacuuaauauuuuuaaccuaaguguucuuaauucugcaaagaauucuaaauuuaaaaugccuaaguaaucuuuuucaguucaugcaaauauauaugugugggcauguuugugugggugucuuguuuuacuaaaauaucuucaagaauaauguuugagggaaaaaaauauuaagaacauaaaaaugggccaggugcgguggcucaugcccauaaucccagcacuuugggaggccaagguggguggaucaccugaggucaggaguucaagaccagccuggccaacaugaugaaaccccaucucuacuaaaaauacaaaaacuuagccagauguguugugggggcuggggggugccuguaaucccagcuacucaggaggcugaggcaggagaaucaccugaaccugggaggugaaggcugcagugagcugagauggcacuacugcacuccagccugggcaaacaagagugaaacugucuuaaaaaaaaaagaacauaaaaauguacauuuuacccucauguucaauuauuucauuaaggaggucacaaguuuccuccuugaggaggcggggaaaucuucauucuuuuacauacuccaauucuggagacaagauuucauuauguugcccaggcuggagugcaguggugcaaucacagcucacugcaaccuugaccucuugggcuccagcuauccucccaucucagccuccucaguagcuggaaugacagguaugcaccaccacgcccagcuauuuuuuuuuuuuuuuuacuagagacaaggucuugcuaugcugcacaggcucauauucucccuuucuaccuggucaaugucaccaggaauuuauaucauuuuauccuaugauuauuagaauauguuuauauaugaagauauauuuaauaguuacuuauuucauuugauaucacauauggauauguaugcacguguguguaaaaauauguguguaaagucucaaaaaauaaucagagguuauuucaauaaaacacaauaaaacuuuccugauuugucaugacaauuguaugcagauauaaacuuucuaauaucacaucuuuauauggaaguagguaacaauguuauugagagaucguuguuuauuucuuaaaaauuaugugcgcuaauguaaauguucauauguagauguagguauuuaaaagauggcauauauuauaaacauauuuauuacaaugacaaguaagaacaauauaucagaaauuuuacauauaaauacagcacuaaauuuaccugaguuuaaaaaaaaaagauuauuaggucauugccauuaauuuaaaauaauaauuauguuuuguuuuuacugagauaauuuucuaauucuuacuuccuuuuccuuuuauuugaguccuuggaucuguaauugccuugaauuuuuuuggccaauaaaauuuucaugucaggugcuucucuaagagguguuauaaauuuuuucucucaaagcugacccaaaugggccaugaguucacuuuugagacacauuuugcuacaauacagucaucuugucuuagaguuauauguguaaacagccuuaagccuauaacuuuacuuaaaaucacauaugauucauuggauuugaaguucaagcuucuuaauuuucuuuuuuuaaucagcuuuuucagguugaaaaaucuuaagcuccagauguaguugaguuugauacccacaucaaauaucauguagaaauugcguguuuuaccccuguauaccaaauuugaaaagaaaacaucuucccauuauaccagagagaauaguuuaaacuuaguuuccucucaugcaucaugcuacacuggaaugugugacaugcugugccaauagacauuacauauggaaacaggagagaacuuugaagagcugacagaaggcuagagugacuaaagcagacuguacaaagccaagagagugguaggcagguccagacuuccuuggucuugggcuaugggaaaauagcagucagaaauagacuuucaggacuucagcaucagcuaagugaauaaggaauggccaaaugcuugaauggggaguaggggaggagaccagugcauauuucaacaauauuaucaugugacagcauuauuuaagaugauuuuaaguucagucagggcaaauacacacacacaaacauauacgcgcguguguguauaugcauauguauguauuuucuagacacuuuccuucuuccucuuuguccuaaauuuccaucucucaggugaacagaauucuuauucugccuucuuuauauucaagaacucaacacuacagcaucccaccguuaccucaacuacucuccuuacccaaauuaaaguuaaaucuaugaggaguguguuaauuuccuaaggcugccauaauaaauaaccacaaacuggguggcuucaaacaacaaacauuuauucuuucacaauucuggaggcuagaaguccaaacugaaggugucgauagugucaggcuuucuccgauggcuccaaaaagaaucauuucuugcucccucuaucuucuggugguugcuagcaaguuucuugguuuguggcagcuuaacuacaaucucuguuucuucuuuaauagacuucuuucugugagucugugugucuccaaagcucucucauaucaccagucauuggauuuagggccuaacccuguccagugugauuuucaucuuuuucuuuccaucuuuucuuuauugacguauauuugauggaugaaaauuguauaaauaagauauacagcaugcuuuugauauacauauacauaguaaaauaauuacuauaauaaaguuaauugguggauccaucuuaacuugauugcacuggcaaaugauguauuucccaauaaggucccauucacagguaccagggguuaagacuucaacaugucuuuuaggggugccauaauucaaugcacaacaggcggcuaaucucagcuaaguguuuagaaggacaaccacauuaucugauuaaaucaauuuacauaaaagucagaauaacacugccuuucuaaagaaguuuauaacacaaauguacugaauaauguacacacuguuaaggguaagagcauuccuaguaacugcuuucuauccagagcuuucaacuuuccaccuucaguaaacucaaggccaagguuauauuucucuacccauuugccagaguagaucagcuacgaaaugaaaaggauacuuaagcagaaaauuuagguuguguauguuauuuccuuuuucuuuaguaauguuuucacuuuuagaguaaauauuuuaauauuauuugaccaaauuauaugaaaaauggcuugauacuuuauuuuaauuuucccauguuaagaugaauuuagaucugcauauuugccauacaugguccauauaugaaggauagauauaaaauauaugaaggacauugaugaaaaauguuggcaguagaaaacuacccaaguguaaauuauuuuuuuuguuuuguuuguuuguuugagacggagucucgcccugucgcccaggcuggagugcaguggugugaucucggcucaccgcaaucuccgcuuuccagguucaugccauucuccugccucagccucccgaguagcugggauuacaggcgccugccaucacgcccggcacauuuuuuguguuuucaguagagacggaguuucaccaucuugcccaggcugaucuugaauuccugaccucgugaucuacccgccucagccucccaaagugcugggauuacaggcaugagccaccgcgccuggccacacaaguguaaauuauuuuguguaguuuucuacacaaaauagaaggcagguacagauuuuuuggcagguacagauuuuauuuuuuccaaaauacauucuaaguguuuauuagaagaacaaauaagaacaaagauaaagagucaucucgaggcuucguaucaggcaaucuggguucuuccgugcuuacuuagagucagauuuauucauagugguggaaugcucacgccucuaaggaauaaguucagaagaaugugguacuuuuauuuaggcuauuaaaauccugaaauucaaguuuuaaaaugauucaaaaggagauaaaucuguuuuaaaacaaaaugcauuucuuuguaugcagugagucagaguacugcuuugugguaaauugccuuauguucugaacaauauaauguauuucauuuuuaauaacucaguuuauuuguaaaccauguauuauuaacacauagcucaaacuauuguauuuaauauagaaauugcaguuaaaauuggaguggacucuuuuucuuucccagaacauucauuguuugaggagaauuuaacaaggcauuuugauuuuuaaaaaucccucaucaguguaagcacaccuuuaaaauaaaaaucauauuauucuaaauucaauugccauagcauaaaauagcuauuuaauauuuuugcuaggacuaguaugucuucuuuguugauuacaaaauacauacuaugcuaaauuuuaucauuugauuauugauuucccaagagccuuuugucuaaaugaaaagcugugucuuaaguuuucuaauuaaaauuuauagugauagaauuauuuuucaugcaguuaauuuauacucaagaagaguuuuaacaguuauuuaaauaaugauaaguuucuauaguuuuuuuauucaguuguuuugaacacucuggagcugaucuguuauuuuucacagcaugauucccaaacaucugcaacaaauuccucuaaaaauuaggaacauuguuagauauggaaauucaggaucuuacccguaccuauuaucagcaucucuggaaauauacuucauaaauaucuguuucuaauaagccauuagaugauucuuaugccuauuaaauuuuaagaacccaguguuaaagagaacaaaccaguguauccuaacuuuucugacauuagugaucucuagacuuuguaguacauugggauaaccuguucaaugaaugucagcuucuuguagaagaagucauccaggggucaggaaagagagaaagccugaacugccucuuacuaccccuagaguucuggaguucugggagccugacugaagauagcaggcagcauguauggagcuaugucaaugagaaugagcccaagauaaaucaucacaauccaucaacccuuccuuccuuccuuccuuccuuccuuccuucaucuucuuaaugcuuccucuauuuuugucagaagaauugggagggaggguuauugggagaagagcaacagcauaucaaaacccugcuuuaucuuaucuugacgucauuuaacacucuuaaaaauaugugcuuuuaaaaggaaguauucaauuuuuuucuuguuauugccauagacaaaaaauuaauaaagggguaugaagugucaccaacugucugacccuggccuacuuucccaaucccaguuccaagaggcauguacuucuuggugggugugacuguuauacaaucuuuggcugacuuuaccucuuaucuccuaucuucagauccuucuuccugggaggauuuuaacauguaagaugaggaauuaaaacaccaucugaauaaguaugaagugcauugcagucuuuggaagcaacaugcagaacuuaacccaaaccuuauucuauccaucagaagcucccaggcuacugacuggucugucucucccaggccuguuacaagaaaagucauggcuuaucauucaucgguuuaauuauuccaagacccccuuagagcuagagaaaugaagagauggagugcuuaaacuugauugauuugauugaaagacacaaaguaucaaaccauuuuucagacauaugucucagugaaauuaaaaaauaaaaaaauucauuuugguuuaaaccagaauuugguaaacuacagcacuuuauguaugucugccuucauauuacaaaagcagagugaagcugaugcaacauaaauuguauaauauaugcguaccuauaggacaucuuugaauuugccuccuggccuacaaugccuaaaauguuuaccauauggaucucuagggcauagcuuugcuaaccucuggucuaaaugaaaacauucaugauuuauuuucuccagcaucugaaggcaaaauaugcauccaccguauuccauaaaaaauuauucauacaugucuuaaaacuugcauauuuuauuuucuaacccccagcauaagacaaccauaaauguguaggaacaacagccuuagccccaacaaccacaacagcaccuaacauaauagggauuccauaaauguuuugauuaaauaagucuuuaaaaauauauguacauucugcauuuuauuuacgauauacugucucucuauuuuagaacaaauuucauuuucuccaaucuuugaauaaaauagaugcuuuaggaagaauguacaaggagauuucuaguacugcuuaaagcucaggagaagaagcucaagaauuuguccugaagugugcaaguuuuaaaagaacaaagcagcuuucccuuccccgaaauacauguugaaaauauuucuaucgauaaaguauauguauaaauuuggacaaaucuaugucaaacaucuauuauaaccauuacuaaucuguauuccaagcauaaguguauuuuaaguucuuaagacauugauguuugucaaugguccuaaguguuacuaauucugucgccuccagcaacucagcauguagaacagacuauaucauucaaggcuagccuucuacagaacauccaacccuguucaacucacgaggaucuacauccuauucacuuuaacuauagagucaagacagaucauucaagugagcuaagugagagagaaggaauaagaagaaagcacaacccuugaaagauuucagauaaugaaaauaaacaagagcuguagaaguaaguacaaaucaugcacgucucucauggccacuuuuuuuuuuuuuuugucagauauugcaaagcuauggaccuggggagaugaccuuuaaaucaucuagcucagaauuuguuccacaauaaaaagcuuaagaaauguccauuauuucccucccuucuucucauucauucucacuuggcuuuguucuuuucagucuaggauucuuauucauauuucuaccuaauguaaagagccaaccaacauuuuuuggacugugaggggaaaauuuucuuuuccauguacauuuaugaaaaagaaauuauuuagagccaaaucaucccauguuguaugcaagaggcagacacaucacaccaagaaugagacucuggaaucaaucugucuggguuccaguccagcuguaccacuuacaagcugaaugaccuuggacaaauugcuuaaccucucugugcaucacauuucucaucucuaaaacuggaauaguacuacuucauaagcucguugacaggacugaaugagaacauauauguauagaacccuuaaaauugugccuguauauagugaacacucuuuuaucacuacguguuauuauuauuagcguuaaugagaaucaagcucucagcaugacccagggguucuccagcucaccuucacugccuugugcaugucuuccauuacacucucuaccacucuguuccacagaggccaauaugauauuaguccuaaaaugacauuauccuuguuaugcuuaucuuugcucaugcugaagugccuugucguuauucaguauucacuuugcauaaccuauuuuccauuaagcuuccaccuugcaaaauagaaugccacuacauuguacccgaagccagacacacacacaccguucauuuguacacacacaguucauuuguacacacacaguucauuucucuuuuuccccuuccacuucuagauugugaagauuucaagggcagagagagaguguuaggaacccuuauggccauaaccccuaccaacucucuguuacauagaagacauuuagaaaauguauguugaauuaaaaaaagcuuaaagaccagucauaaaauuuugauuucauaaaauucuacuuaaaguauagccacaggauuuggcuccaugaccucuuuuggcagcaaugcucacuuauuaucauaaacagcacauaguacuugucauuauuuuucaaaauucaauguccuuuaaugucaucuggucagcugaauuaagaagcuugcuucuauuaauggaauucaguuuucaauauaucugagguguuucuaacaacaccauucagaguucucugaagcuucuuuuuaaauaaauaaugcuccauuuggucauuucuuuguucuuuuauauuuauagauuguauaguguuuuucuuaaucauuugcacuaacuuuaauucaacagcaacugaaaacaauuauauaaaacuagugugucuccauauucuucaucuuuggugaauuuuuccccaaauuuacuaaaguaucuugcauaaagaucuauauuuuauuauuuaaacugacccuucucuacaaaaaaauuacucaacaaugauucaaaaaugaugacucaaugaugcauuuguguuugugaaaugaccauacuaaugaauuggauuuaauacuuuauucaaauauaucaaauguauugcaaauccaaacacuuauuuccaccaaaccuaacaaccaccauugucucucaauucaaggacaguaauagccuuugaacuggcuacugcuuccaggcuugccccucuauugucaacagaacaguugaagugaucauuuaaaauuguauucagaucaugcuaguuccaagccaaaaccuucucguauccauugcacuauaaagucuaacucuuuacaauggccuuugaggcccaucaagaccugcugcugccuggcugucuuacccuuccccucacacccagagcacuaugggugugaggggaacuauagcuacagguauacugggguguuuuucuuuuuuguuugaacaugcagugcuuguuacugucgugggacuuugcacuuugugucuacucuccuuguaaugcuagaucuugaauauaaggcugagucauugucuucaacucauacaugaccuccuucaugaaaucuuccuuuucuggcugcuucucuucagugggccuuuccaucaggugcuggcaacucucagucaguucuuucucagcucugucucuucuaauggccuugcuaauucagccugcccuugaucuuggugcucagauuccucagagucucuacuacuuuucucuucugacaucugguuaaagcugcgagccucauaaacguuuuuggcugagccauuuugcucauagaaggcccauuuaucccccucaacuuauuauccauauugcaugauagcuaaaggaaacuugggauugcaaagugaaucugucaugccacagggccuccuugacugcuacuugggauccacauguuagcuugggauuacucagcacaguaauguccuccaaaacuugaaagcaaaaacccugagcauccccucaacuuaauuaagaauuucaaaagauacauccccuagaggauuggccucgacaagcugggaagaaaaaacaagagcgguggcagccacuuuucucuaccauugagcucuuucucuccaccuauucuggcauuucucaaaagaaugccugaaggcuuuuuuccuauugugcauuuuuuaaggguaucauucuguugccaaggcuggagugcaguggcaugaucaucuauaaccucaaacuccugggcucaagcaaucuucccacaucagcuuccugaguagcugggacuacagguaugcacaaaugugccuauuuauuuauuuauuuauuuauuuuuuguagaaacagggucuaauuauguuagccaaacuggucuugaacuccugcccuuaagagguccuccugccugggccucccaaaguacugggauuacaggcaugagcgacugugcuuggccuguucuuucuacaugauuugaaacuccuuuauacaaaauuccaugcaaacccagucauuuauauuuguuggcaaacauugagaugaaaaguaaaaacacuuagugaaucaucuuaauguuucaucuuuaaguuacuaagcaucugggucuuggcaaaacauccaaauaauaaacucacccaucaagccuggucuugauauagaggaagaaacugaagggcuuucuaaagacugauguuaaacuauacauuaaaauaaugcuuuaaauaacagaaauugagugucucuuucccaccucuaccccacggcaggcagaugccuuaucauuguaggcagaaagacauguagaaaagcaaaagagaaaaacguacuaucauuauuugacuggcuuggacacaaauauagggaauggagaaaaugauuuucucccuauacauaauagaaaaagggagauagagauaauaaaaacuaaguucaaauaaaucauuaucaacaaaaguaaucaaaagaguagcucaauuacuuaagugugauuuauucagcaugcugagccauuaaauuauaaccaugauuugggaaacacacacacacacacacacacacacacacacacacacacacacaaaucugaguuaccaaauagauaaaagaacucaggccacuuccuggcccucauuauuugcucucauucuagaaauaauucuaaauccuugauuuuucugacuucucagccaaggucuuuuugaaagcaccgaaucagauguuggaugguaaaaacaaaaacaagaaaacacugguacaaugaauucaaauguugugacagcaaauaguaauauauauauguauauaugacagauguuugggagccaauauauauggaugucuaugccucuucucuaguuuuuauuuagugauuauuuugaucuuuuaugugcagaauuauaaccaauacacugcauacuuuauaugcaauauuguguuugugguuuuacucauuuaacaauccuaagacagcuauacacaguuucaacaaagaaauucauuuacucuauaaagcauuuuauuauuuuuucuaauugggacuucuaauaguauugaaaguagauaguuaagcagaauagucuuacaaacaacauccggaagccaugugcaagugaagauuguaauaagaaagaggagacacuuugaagucagguuuggauuugacccacggcuaccaauaccucccagcuucuuaauauguaccaguuaucugaguuaucagaaccuuuuaaaaugaggaaacuaaaaccuaccuuacaauaaugcuuucauaauuauaugacaaucacacacacccacaaaaacacuaaacaaauguuacaaaauauagacaaauuucuucauuuacaaugucuuaugcauuugagaaaaagaacaauuaggugauauuugacuuuuuaaagacaagacagauccauuucuucauacuuguauuaucuuuaaauguguuugaauccaauaucaaaauauaagggugaaaagguacuaaauucaguggaaaauuaaauuauuuuucuuucaagcauaguccaaggcuauguagaaauccacaaagaaaucagauugaauuuuguuuuaaaaucuacugcuuuaggaaagaaaaaaaaugcaaguguuugagggacauaaaaucagaacauaacguuguuugugugugugcgcaagcgugugugcauggguguauguaaugagaacaagaugcuuaacaaguauuuucgguuaguucuaaguguaagaagccccuugggucuguccuauagcaaaaaugcauuuuuuugacgggauaagcuuauguaacauacuucugguggcauuaucuuaaagagaaaacugaaucugcccuuuauaauacuuuaaguuauuccauaguuuaaagauauuuguucuugauugggcaaaacauccaaauaauagcauuuaccucuguuuauauuaaucauguauguuggcugacacacaucaccauuaaaaugacagauguuuaggcaaaucaucgaauuauuugaucuuuauauuucuaagcauucagauaguuguauacauccagaugauuuagcaacuuuuuuuguuuguuuuuuugugacaugggcacaauuuauucuguaaaugggaaacuuuaaauauauuugauuaucgagauaucuuauacucacuuucuuagaguuucaacuauaaccuagaacauucauucuuuuuaaugauauuucccuuauuauauauuguaaccauuuaacuauucaauaacuuuuuuuugagacagagucuugcucugucacugaggcuggagugcaguggugugaucucggaucauugcaacuuccauuuccgagguucaagcgauucuccugccucagccuccccaguagcuggaauuacaagugccugcuaccacacccagcuaauuuuuguauuuuuaguagagacgggguuucaccauguuggccaagcuggucuugaacuccugaccucaagugauucacccgucucggccucccaaagugcugggaguacaggcaugagacauugcgcccgaccaucaauaacauuuuuguaaaauuuaacagaaaucgggcugggugcgguggcucacgccuguaaucccagcacuuugggaggccgaggcgggcggaucacgucaggagaucaagaccauccuggcuaacacggugaaaccccaccucuacuaaaaauacaaaaaaaauuagccgggcgugguggcgggcgccuguagucccagcuacucaggaggcugaggccggagaaugucgugaaccagggaggcggugcuugcaguaagccgagaucaugccacugcacuccagccugggccacagagcgagacuccaucucaaaaaaaaaaaaaaaaaauuuaacagaaaucacaaauagauaucaacaaagaacacaauaauacagaaagauuuauguuuuuagcaugcauuauuucuuuuggauuucuuuugguuaucuagcuacauauagaguacauccagugcauuuaacuaacauacuacuuuauuucucuuucucaucagauuuagaauguaauaacucaaggauuugauaauacagugaaguaguauaacaacugucuacgugcuucccaugauauguucucuauauuguaaguauauauuuacuuucucaaucuagcuugauugugggagaaauguguucacuuagaacuuauagaugauuuauauuguuucagaaaauuuugaacuaaaacucauccaaguuacagaauaauuucagaagguuagcuucuaugaggagaucuuuuauaaacuuaguuuuaacauucuaucaaaguuaaaguuaaaaauaauuuucugucaugguagguaggauaauacauccaucaugucuaaucauauuuuaaaauaaaucuuacaguuaauaaucuuaaaauuucuauauucuuuuguuuccuagaaaaaaguaaaaaaaauuagacauggaaaauuuuauguucucaauauaauuugcaaucuaauuuugaauuuuggucaauuucuuuuuauauuaguuaucuuuugaaaauggguuuuaauuugggguagauaaugccuguaccaauaaaucauucuuacauaugaauauaagaauauauuuacuauauauauucauauauguaauuuauuuaauaaguuaaauaaaaaaagaaaaguagucuuuguacagauaugaaccucuuacuguucauuucacaugauuaaaaaauaaggaaggagguagaauucugggauacugugcuuuguuuuugaguuaagaaauacuacaaagcaauaaguguuacucaugucaaugagaaagaaauaaaacagcccaaucccuuuuccuuggaugaaagcaagcuauggacuggagcccaucaugaaucaguagugucccuacaauuuaaggcauguuuagggugucaggagaugcuguucccuaacaacaccuaauaccgucagaccuagaaucgcuucucaagccuuacucucuauucucuccagcacuuguuuugcugaagcuccugucugagaauauaaagcugucagagaauugcagguggugguggauagguuauuaacaucccuguuucagaacucugaaugcauugugacacaaaauaugauuuaauacauauuuuauagcagugcuaucuaauaaaacuauaaugugaacugcauauguuauuuaaauuuuucucauggccacauuuuuuaaaaaguaaaaauaagcaggugaaaugagucuuaaugauauauuuuauuuauuuagcccuguacauuccaaauauaguuauuuuaacauaugacuaauguaaagaaaagaaugagacaauuugcauucuuuuuuucucacuaaguccuugaaauccaguguguacuuauagcacaucucaauucagauacuaaaguuuuguugaauauacuugaucuauacuuagacuucauaaaauuuacaguuggaaaaguagauucacaaacccaaauuguccuacaaacauuuaaaaguguuccaauaacuaaaucaagugucaguuuuuaaauuuaaauugauaaucaucucaucaaugacacuagcuguauuucaagugcucagcugucucauguggcugguaguuuccauacuggaaacucugcuccaggugaccgcugauauaaugcuucgguucugcuaccuaaugaauuuugaaggccaacuucagaccacaucaaaggagcacaugacuuuaaaauuucaaugacagaaaaagucaaacccuaaacuuauuacuuaaaauggauuuuuacagaaccccauguuuaugagaaauuauagagaagaaaauauaccaaauguguacuucuaagcuauauacauguuggaauuugggggcuuuuuguuugcuuccauguacuugcuuuguuguaacuaaaggaauuugcugaucacagcccuccucauuacaaugaguaaaucaauagaaaaaaaaucuaacauuuaaaaaaauuguuccaucaaacacauucuuaaaagaaugaaaauauaggcaucagacuuguaaaucauguaucugauaaaagauuuguauccauaauauauaaaaaacucuuaaaacguaauaagaaaguaaaucuaauuuuccugguaaaauaucugagcuuuaccaaagaagauguauggaugacuaauaagaauaugagaagauguucacuaaggagauacaaaugaaagccacaguaagaugccagaacauaccuguuaaaaaugaauaaaugaauuaaaaaucuaacaauaucaaauauucauaagcaugcagagccacagagacugucauucauuacuuucauuacuguuggcaauucaaaaugguacagucacuuuggaauguacaaguuuccuaugaaguuaaaugcuuacuuaauauaugauccagugaucccauucauaaguauuuacccaagugaauugaaaaacauuuuugacacaaaaaaacaauaugggaauauuuacagaaaauuugauuucaauugccaaaauguggaaauaacuaauauguugucuucagcugguaaaugaaugaacagacugugguaaaucuauaaaggggaauacuauucaaauauuuuuaaaaggaaaguauugauuuaugcauaucauggaugaacguuuuagugcaucuugcuaagugaaagaagggaagcccaaaugacugcauauuuaagauauauaauucaauguaucuuaaauucugaaaaagccaaaacauagagaugggaagcagaucagugguugcccaaguuagagauauauugaguuggaguuauaagagggcugacuacaaaaucauugauuacaugaggaaauuuuaaagggggguggaacuguccguggugcugaaaaaauuacugugcucaucaaaacccauagaacuguacaacacaaugaguaaauucugcagcaugcacauuaaaaaaagaaagaaagaaaacaaauaggauguauuaucccaaaaugggguggaaacagugacaagugaaccuaaccaucuuacaaauguaauauauaaacuuacugaaggugaugcagucaaaggaucuagccuauauuuuggaaaacaguauuuugaaaggacaaaaucugcaaagaaugaggcuaacucuaaaaagaacuauacauagacauuguauuuuaguugauuuuuuucaaaggagugcagguuagcaauuaugaaaguacuuugcauguauauuaggguggaaugcauaaguaaauaaauuauagauauugggagauagguuucacauugcuagagaaagaaguuauaaucagcaaggagagauggcuaaaauuaaccuugcguugcuagaugagagauguagauauuaauuugugaaucuauuuuuauuuuaaaauacauagauacagaaaugggucuacacacauaacauuuauuagcucuaucuacugaaaagcucuagaagcagugauaccacauuagcaauuagcaugccucaugcccaaauuuuaguuucaugcucaguuuagagguuucuguauauacaucauaaugcuucaaucuuagagugagcauggaauguaggaaauucaaauagaauucuuuauuuaaacacaagaaaagucucugagaauuuaagugacuugccuaggaucagcaguuuguaaaggauggagcaucuacauagaacaaucuuacuucauucuuaaucuuaacuuguaccacaucaagaagucuacacgauauggaaauauucuuauuuguuaaauuauuuguuuucaauuuccagaaauaaucaagcucuuucucuuaauuuaaauaaaauucuggcaaauuuuauaucauuaaaaaacuauuauucacauuuaaauucaaaauuuuuaccugaaaugucuguuuccuguugagcuucaaagucccaucuagaggccaggcaugguggcucacuccuguaaucccaucacauugggaggcucaggcaagcaaaucacuugaggucaagaguucaugaccagccuggccaacacaaugaaaacccaucucuacugaaaauacaaaaaucagcuggugugguggugcacaccuguagucccagcuacugggaaggcugaggcaggagaaucgcuugagcaugggaguuggagguugcagugagccaagauugcaccacugcaguccagccugggcaagagaguaagagucugucucaaaaaaaaaaaaaaaaaaaguccuacuggacugggaaaucauuauugcuaauuuauuucuguuauauuggacacacauaugcuuucacuuuaaggaaauccuaugcaagaaccaaaaaaaaaagaacuacaaaauauagucaugcacugcauaacauugcaggcaaugauugaccacauguacaucaguggucccauuagauuauaauagagcuaaacaauucuuaucuccuaauaacuuuguagccaucagaacuuaguagcacacaacucacauguuugugaugaugcugguguaaacaaacuuauugcacuuccaguuguauaaaaguguaguacauacuguacaauuacauaaggugcauaacaaugauaauaaacaauuauguuauaguuuauguauuuacuauauuuuaucauuauuuagaguguacuucuacuaauuuaaaaaacuuaauuauuaaacagccucagacaggucuuucaggagguauuccagaagaagggauuguuaucauaggagaugacagguccaugcacguuauugccccugaagaccucccagugagacaagauauggagguagaagacagugauauugaugaucuucacccuguguagaccuaggcuaagguguggguuuguaucuuaguuuuuacaaauuuaaaagguaaaauaaaaaacaaaaauauuuaaaaauaggaaaaaagcuuauagaauaaggauuaaagaaagaaauuauuuuguacagcuauacaauguguuuguguuuuaagcuguguuauuaugaaaaaacucaaagacuuaaaaaauauuuuuuaagucuauaaaguaaaaaaguuacaauaagcuaauauuaaauuacugaagacagaaaaaccuuuuuauagguuuaauauagcauuuguacaguguuuauaaagucuaccguaguguacaguaauguccuaggcuuucacauccacucaccacucacucacugacucacccagugcaacuuccaguccugcaagcuccauucaugguaagugcuuuauacagguguacgauuuuuuaucuuguauacaguauuuuuacuguaccuuuucuauguuuagauauacaaauaccauuguguuaaaauuuccuaaagcauucaguauaguaacaugcuauaaguuuguagccuagaaacaauagccuaaguguguagcaggcaauaccaucuagguuuguguaaguccacucucugauguuugcacaacaaugaaaucaccuaacaucacauuucucagaacauaucuccaucuuuaagugacacaugacuguauauaaaguguuuuuuacuucaaaauaauuaugucucacaaaagcauucaucauguauuuucuuaaauaacaauguucccugcugcaauuuuguuagauuuauacauaguaucucagaggaaauaaagucauuuuauaaagccaagcuaaccugccauccuuuccuuuaauaccuucaucacuaugcccaucugcugcaauuuuuauaaguaagugugaucucauaauccacacaguuuuaauaugaagaaaauuuauagcauacucuuacuaaucaauaaaucaagcuuucucccuauugcuuuccaaucacaaugaugacuucuaagggagcuuauuuuauuagguaauuugaaaauacuuuacuaggcuauuugaggaacuucuugaauaugaggggguuauuaacaauaaaagaagauacacccaauagagaaacaauuucuauaccuucaaauaauaguauaguagguauaggaggcaaaugcaaaaucagugugauccauuauauauuuaacccucauuuguuaucuguuacaauacauaaauauguuuugaaaagaauauuaucaaaucuauuugaauuuucuaccauauuuaauguucagaauucucauuauuuuauuuuuuucugauuuaaaguccuucuaccaucguagaagucuauuuuauuuguuuuguuugcuuguuuuguuuuuguuuaaaagacuauucagaagaguuccuuuuuauaagacccacuuuuucuuuuuucuuucuuuuuuuuuuuuuuuuuuugagauggagucucucuguguugcccagacuggagugcaguggugcgaucucggcccaaugcaaacuccgccuccuggguucacgccauucuccugccucagcacccccaguagcugggacuacaggcguccgccaccacgcccagcuaauuuuuuuuuaauuuuuuuuuuaauuuuaguagagacgggguuucaccauguuagcuaggauggucucgaucuccugaccucgugauccgcccgccucggccucccaaagugaugggauuacaggcgugaaccaccgugccugggcaagaccaccuuuuuuuuuuuuuuuuuuuuuuuuuuuuucuguacuaagacuuucuacuauucugccuggugaauaacagguacuuaaaauauuugcaguuuugacuucuaaacaaaauaacauuaagcacauuuuuuuuuucaguuaauuuuaggaguaauugggguagccuggaagaaaucacuuaugggagaugcuccagagcuccacuguuugugaugaccauucaauaugcaacauaaaaugagucuugguggugucucaaaucuuucuccuccacaaggagaaguagauggaguauagauggaugcacggguggauagaguaggacaaauagauggaaaaauaguuggauuuuucuuacacauaccguccaauaucuuccauaccauggacaguauuuuauccuuacuuguuucuaggaccuaaggaacauaguugguaauacagaauccuguggaacuccaauaauuucagagaaaauugaggauacaguauuuuuacccucugcaccuggaagaacuuacugcuuuauuuugguaacuaaaaaauuaacauuaauuuacuuuugccuugauaguagggucaaaaucaaugucuauggaagacuaccuauaauagugacuacuuuaaauucuuuucucuucuuaucccuuauaaugauauauccuuacuuucaacaugcagauauaagcaguucuaagucuaugcuucaaauuacaugcucuggggaaagaauuaguaaacaaagaugucaagaaaaucugaauuuauuauuuucaaauuguucuuaaguuuuauuuuuagagacuaucauuuccuuauagcuacucuacaaagagacaagaaaacacuucacagugaacuagccccccuaggaaaaacacuguggagugaauauuuauguuaucaaguaguuagaauaaguagaggcagauaaaaauacccuaaacuuuuauuuaaaaccaugcauauuaaccccgugggcuuucuugcuauccuuauaaagucaauuaucgcucuauagguuuuugauuuuuaauuucaguuuauuuuaaacuauauuguaucucuucauauuaaaaaauuaaucuucucuuuuacuuuguauguuccaccauuccuuuuuaauucaugucacuuuuguacucuaaacacaguaggaugcuaauuuaaaauuugugaccuuaaauucaugucauuuaaaucccccaaaugaauauaaugauucauccacuuuuguguuugaaauauaaucugccuuaaaauaaaucucuauguugcuaaaggguaaaaccuaguauaugccucuugauuuuaugagagcacaagaucaaaucuucauuauauuuagagcuuacacugaagauggaaagcugcuuuauaugauaaagugagagaaacuuaucaguaagucuucaagcaggagaagaugagaugcgcuggguagccaagagaauuuuaguaaagugauggucuguguucaauauuagcuugugcacuuugcuaugauauaacagcucuccaucuaaaacuucugcuaacauugcaugagccuuauaugaaauuuuaggggaaauuaaagagacucaguuucacauccaggucaaagcaaucagagaaaaaggaacauuuaugguaguuaacacaugaauagaauuuggaaaucucuagugcagaaguccaggacccuaaguaaucaggagugucuagaaccccuuuaauucucagaaaucuuauggggcauuggaauuuccaauacaauauuggauggguggcuggaacucucaaaugcagaaacuacacuuuagguuacuuuucuuauuacacaaacauuaaagcaauauuuaaaaggucaauccagucagaauccaaccaccacagaaauucacagaauuauuugccuauguuuccuuuuauuucuaauccguauguacacauaauuuuacaugguauaguuauaauuuuguuuugauuuuguaaucagugucaaaucauaaacauuuuaacauguucauuuuuuguaggugcccuuauaaugacuauuugccuaacccuuuucuuaucuuggguauuggauuguacuugaguuuucauauauauauaaauaacacuucaauuuaaauauuugucaaauauuuugcuuucaucaaauaaaaaauggaaauaaaaacaagcuuauggccggguacgguggcucacgccuguaauuccagcacuuugggaggccgaggccgguggaucacgaggucaggagaucgagaccauccugccuaacacggugaaaccccgucucuacuaaaaauacaaaaaaauagcugggcguggcuagcugggcaugguggcgggcgccuguagucccagccacucgggaggcugaggcagaagaauggcgugaacccagaagggggagcuugcagugagccgagaucgcgccaauccgcuccagccuaggagacagccgcgagacucagucucaaaaaaaaaaaaaaaaaaaaaaaaaaaaaaaaaaaaaagcuuauauuguagagcuauugugaggauuaaaugcaaaaaaaugcauaacaaagauuaugcauagugucaauuuggaccaauuucuagaaucuaauuauugaccaaaggauaugacuauauauucuuucugaggcuguugaacgaauuacuaacuuccagaguguucagcuggcaaaauaauaaaaacuggcugucaauaucuuaaacaaaaaaacccaaugcugaagugaucacuuauuuuaaaaagggcaaaauauaauugucaggcacagucucucagagcagggaagacugcuaauauuauagagggcuuugaggaagaguguaauucaguuacugguugacuuccagaggcguaaguguauugacgucauuuguagaacuaugguucuucaggugagaauuccuuugauuaaucaacuuccagaaguguguucuuugaagugagucuuuuucugauuaacugacuuuaggaaguuaggguuauaacuauuugguugacuugcaaaugcauguucacugagaggcagagccauuaauucuucaacuuuguguaaaaucaguucugauaguuucuggaacugucauugauuaagcaguuuuaaaaccacuucuggugacuacuugcuaccauagcuacagaaaaauaucaaucauuuccuaggagcguggggacauuuuauucuccagcuauaguugaaauaacuuaugagaaaaaaaucacagaggaaaugauggaaaaugccaagggcuuuucaugaggaagagggggaaauaacuagaaacuuguuuuuaaugcaaucuucugcuugagaaauacugugucaguauccaacagugaaacagauguggaaagguaguacccauugaaaagaggaguagaacuaggauggaaagguaagcacauuuuauguaaguuaguuaaauugcuaaagaaaacuuauuuccuauuuuauugucaagaaauuauauaauuacacauuuugugggaucacaaaugucugcuuauuaaacauuuuaguucauaaggcugcuuuucuuuuuuucuuuuuucuuuuuuuuuuuuuuuugagacagaguuuggcucugucgcccaggcuggagugcaguggcacaaucucagcucacugcaagcuccgccucccggguucacaccauucuccugccucagucuccugaguagcuggaacuaaaggcgccugccaccacgaccggcuaauuuuucuauuuuuaguagagacaggguuucaccaaguuagccaggauggucucgauccucugaccuugugaucagcccaccucggccucccaaagugcugggauuacaggcgugagccacugugccugaccaaggcugcuuuucucuaaauccaugcuuacauagauuagugauuaucuuuaauuuuuauuuuuguuuuuuuguuucauuuuuuugcauuuucucucucuuuaauauaaauuguguucuuacuugcuuauauuccauucuagaauggcuucuagucuccucccagaagucugacccugccaguucuaaauuuuuuucugacucucauccuccugaauuuugcucuccuccauagucaacaauuuuguacgccuccuuuucuuuuuuuaaaugacauucaguuucugaaauauuggcuucucucauuauacuuccacccccauucuuccaccaugcaaaaaauaacucuuccucucucuucuuuuggcuaaacuuuccaaaaagauguauaauuuuuuauuuuugaaaaauguguuagugacauucguccugguuaacuuauuccaaauaaugucucuaucuugcauucugucuuacuguucuacaaccuauuccagcaccaucaacagaugacucauuucagccugaccucaugaaaagagcuugcauucuagguucagacagaauaacaagagacuccuauuuuuaccauuugcuggcugauguaaucuuacaugaguaauuuaagcuauaggggucucaccuccuuuaucuguaaaauaggaauucuaguacaugggaugguaaugaugauguaaagaaaucauguauagaaaacauauaaauagcauacucuuucuacccaggaggagcuacauaauuguuaaaucuuguguuuauuucuuauuaucucuuacuauguugacuguucuuccaaauugcauaaccaaaagauccaugaggccuaaugucaaaagcucaaugucuuugucgucuuaugaggcaagucaguuuaucuuaucuuguucauuuagggauaagaauaauuccuucucuaccuuaauuacauuguggcaauggcaaauugaaaugugauauugauuacagaaguacuuaaucauuauaauaacaauaacuguuagcauuuuaaaaucugguauugucuauguguaagucacugugucggcacuuaauaaauguaagcucagucuuuacaauuaucuaacagggauuaauauuauuucuaauguuuaugugaggaaacuacagcucggcaagaugaagucguugggucaaggauacauagguaggagggaacagggcuagaauugaagucuucugaaccuccaccugcacccucagagccccaugcaacagugaauaaucaaaugcauucaguuuccuuucauuaaaaaugcuacuuggccacugcuugaaccaugauccauuacuacccagcucauuuucaaaggaucuuguuaacucuccuaaaagcauuuuagagcuagauccugccuucguuuauuuucauuauagcugcuuucuuuucuaugucauuaauucaugcuucucuuuuguaauuuuacugucagguucuccaccaagugcucuagggaauuaaaaacacaugcacacaauauuuaagcuuuucagcgagugaagguugaccucaauuccuguuuuuccucccucuuugugcugucuucaggguugauaugccucccuccucuucuacccccaauagugcuuaagccucucucaugucggcgcagguuaaaacucguccacagccucuguauguuucauuagucuguuuuacauugcuguaaaggacuaccugagauaggguaauugaugaagaaaagaaauuuaugguacggcaggcuguacaagaaccauggcaccaguaucugcucagcuucuggugaggucucaggaagcuuuuauucauggaggaaggcaaggagagccagugugucacauggcaaaacagggagcaagcaagaagaaagggugcugggcuguuuuaaacaaccagcucuagagcaagaagucacacauuacugccaggaaggcaccaaacaguucaugagagaucugcccccauaaccaaaacaccucccuucaggccccgccuccaacaagaugucauucuuugcuucccuaaaguucuuaggucuucaaagcacucacucaacaaagcagaaaacuauuuauaccauaguuuugcuauucuguagauccaggacauauugcaaauuaucaauuacaugcaaugaguuguuagacuucagugcauuuuaaggcaaaggauucucugccucugcgucagacuaagagauugaguuggucuuuauauacacagguuuguaaauucaaacuacacuuuaauucauguuauuuacuauuauaaacauacuuauuucaccuaaauacuuucaauggagguagaggcaauaucauuucuguauucuuuaacuucccuguggagauuauagcauggccaggcagugaaugagaaauauaaagugaugauuaaaauggaaaugagccaucuguaauaauauuaaauaauugagcagaaaauuucaaucuaagugucaaggcuuaucaaccaaaauaauucauggaaaacuauuauuaagaaugguuucagguuauuauuugucugaggauuaauaauuucuuuuguuaaaaacuacuguuuuuuuaaacauuuauuggagguccagggguacacgugcagguuuguuagauagguaaauugcaugucucagggguuugauggacagauuauuucuuuaccuaaguaauaagcagaguauccaauagguaguuuuucaauccucacccuccuccuaucuuccacccucaaguaggccccaguggcuggcuuuuguucccuucuuuguguacauguguacucaguguuuagcucccacuuauaaguaagaauacaugauacuuaguuucuuguuuuugcauuaguuucuuaggacaauagcuuucaauuccauccauguugcugcgaaguauguaaucucauucuuuuuuauggcugcauaguauuccauguugcauauguaccacauuuucuuuauccauucuaucauugaugagcuuuuagguuuauuccgugucuuugguauugugaauagugcugcagugaacauaccugcgcaugugucuuuaugguagaauuauuuaucuuuguuuaguuauauauccaguaaugggauugcugggcuuaaugguaauuuuaaguucuuugagaaauccccaaacugcuuucaauaauggcugaacuaauuuacauuuccaucagcaguguauaaguguucuuucuccucaaccuugccagcaucuguuauuuuuugacuuuuuaauaguagccauucugauugguaugagaugguaucucauggugguuuuaauuugcauuucucuaaugugauguugagcauuuuuucauaugcuuauuggccauguguaugucuucuuuugaaaagucuauguucauguccuuugcccacuuuuaaagggguuguuuauuuuuugccuguuaauuuguuuaaguucuuauagauucuggauauuagaccuuuaucagauaaauacuuuuuaaauauuuuucuccuauucuauagauuuuauguuuacucuguugauaguuucuuuugcuguguagaagcucuuuauuuuaauuagauuccacuugucaauuuuugaaacuacucuuuuaaaaaagaaaauuguaaagagcuuuuuaagccaaauuuaacaagcaauaaacuuuuaaaauuaacagauucaacuaccuaauuaucaaaacuucaguauaacaaaaaaagauacuauaaacaaaauuaauuuugucuuuaaauuuaaaaaucugggagaaaauguuccccccaaaauuagacaaaggcuuaauuuuguaauauguaaagaguguucacaaauuaauuauccaaaaugccauaauaaaagaggcaaauaaaguaugaauagucauuucacaaaggaaauaaaaauuaucccaauaaagacaauaauguccaaccuuaccaauuaauuaccugacaaaugcaauuuuguggucuaaugggacacuuuuucauuuguacuguauuaaauaguucauaacauucaucguuauuaaguguuguggaaaauuugauuccaggugaagcaaguuggacccuuuuggauaacauacugguauguucauaaauuugguaauacuuacaaaaauuuuaaaaacauauauuguuugacccaguaauucuaccugugguaauuuauucaucaaaaacacuuguaugcaccacuaagaagccuucaccaaaauguuuauugcaaauuuagaaugacaaaguauuaaaaauaaucaaaauguccaucaauaggagaaaaguaaaauauauaauaauauauucuuaccaaucagugcuaagcaaccauugaaaauaacuuggugaauauauaaagacagauuaaaauaucaaacuaaagggccaggcacaguggcucacaccuguaauaccagcacuuugaaaggcugaguaggaaggaucucuugagcccaggaguucaagaucagccugcgcaacauggugaaacaucuccacaaaaaaauacaaauagccaccgggugugguggcucaugccuguaauuccagcacuuugggaggccgaggcgggcggaucacaaggucaggagaucgagaccaucuuggcuaacacggugaaacccugucucuacuaaaaauacaaaaaaaaaaaaaaauagcugggcgugguggcgggcgccuguagucccagcuacuggggaggcugaggcaggagaauggcaugaaccugggaggcggagcuugcagugagccgagaucacgccacugcacuccagccugggcgagagaaugagacucugucucaaaaaaaaaaaaaaaaaaaaaaaaaaaacaaacaaccagccaugguggcaugugccuguggucccagcuauccgggaggcagaggugggagaaggucaccuaagcccagaaaguucgaggcuucgaggcugaaguaaguugcaauugugccacugcacuccaacuugggugacagagugagacccugucucaaaaaauaaaaauaaaaaauaaaacagcuucaaacuauucacuauaaaaagcaagucucagaauaaaauaaacagaagagucucaauuuucucuuaaaaaucauauauauguauaaauauaucuaaauauauacaaauguguauaaaguuuugaaaaaguucuaaaaggauauaugacacacugaaacaaaagugguuaccucuuggggaagagaauggguugaaagaguggcaauugguauuaauuugguauuuaguauuaaaauuugguauuaauuauuuuauauacacuugaauuauuuacauuuuaauaauaaaaauauauucuucuauuacuuucauaguucuuauaagucaugcaaauacagguaguauaacugaagugaguaaauguuuucagaaaagauuugaugaauuaucagucaauuagugauaguguucugaagggugggcauuuuugaacauuuuuccuguuaugccuugaauuuuuuaauuaaauuucaaaaaaauuaauuuuaccacaguuguagggcuuagcuuuggcuagaaucaaaauuuuauauaaauuacacgucaguuggaaacaaauaaucagaaccuccucaauaaaauaacauugggaggugggagaggggguacgaaucucagcaugguuuuugggagauaaauuuuuuaacuuuauauuugaaaaguacuuuuuacuugacaaguaaaaagaaaaagaaucuuagacaaggcaguaugagaaaaauuaauuuuaaaaauaaauuuaagaaaggaaaauaaguuaaaauuugacuuucucugcuaugagagauaguuguuauguaauuuuauaaauauuauaagaaacuucaccugucuucauguauuaaauaagaugaaguaaaaauguaaccuggugugaaugcuaaugucacauuaauaaugccauuaguuauauucucuccccaccaucaucuugaaugucucagugacacaauaacaugggcuccauuuagugcuuuaaaaauuaaauuaacucccauccuuuuuugaaaauaucucucuaaaaagcagagacauuguucuuggacauuaaagaaauucuguagauuaacugcaauucaugagccugagugaaacuuucaagcacuuugaucauugcuauaauuaugaauacccaaccuguuuuuacauauuauuuuuaaagguuacaaaaguaauucuuuuuccuccuucaagauaauacaguaaaauuuguuuucuuugacacaauuuuaauugaacuacauacacauguuuuccaacuuaguuuggcaauagaaaaagugaucauuauucuucugacucauucuaaaacucuuacaauguacgaggaaacucuuggagcuuugcuuuucucuuuacuguggcagugcaaacuuauugcuugcuacucugcagcuauuucugaacucaaguuauuuuagaaauucuucaaaauuuaacauuuucuccugauccuuuuugaggaaucaguacaccauaguggucgucccugcuuauaagacgggguuaauaauauuaccaccuacacuguugguuugagaaugacacaagaugguguguauuuguuaugugcaggacccacuaccuggcuuguauggaggagcccuuucuaaauaaguacugcuagcauuauuuuuucuucuaugaguuccuauuucucuuuuacucuaaauuaucaucacaauaggcuauacauuauuuauuuuccaaaauaaauguuaugguaacuaccugcaugaagaaaagugaaaaaaaauagaacauauuaugaaugacuauuucugaaaauucaacuaucuagcauuguacaaauaacaccuugacgaguagcuugauuuuucucauuuucaacuuauuuuuucuuuccuucucuuuccauauuuauauuguaagugguugccagcacugaccaaugcaguuauccagacuacaaauguaguguugucauacuccuccaaacacacacauacacacgaacacacacaccuuuguuucaaaucgucaaccuuaaucauaauuguuuaagcaaaaggaggaaugcaggcuacaaaucccuaucucugagaagaaaguuuuauagacagcuuauucgcauucuacugcuucuagaccuucagaggaaauaugugcuuguuccauaaccucagaaugcuuuagggaaucccagcuuccacguucauucagugauucuucugggagucauucucauaaguaccccaaagaaauugagauugagaaaagauuuccuauaacuuugcagacauuauggaaaccaaaagaaguauccuuuuuuucuucaccugguauacaacaaauuuauugccucuucucaaauaaguaaaccauuucucuaacauguggagaggaauuagggaaggggaggugaucuaaaauuuacuaaauugccuaaaacaugucaguaaauuacaagaguuauuuuuccuaucaucacaguucuaugaagaggauauuauagucuucauuucucauaugaacgagucucagagaaguuaaagauuuuccugagucccagcaugaaaugcagaagaugcaaauggugccauuuaucaauugcauuucuuccugucucucuacaaaaugcccacguuacccaugauacauuguuuuuucucauccuaacauuuacaucacuagauauuggaacaaaaucaaaagucauuuguuuuugauauuauuuguuuuuuuaauaaaugcuaauacuuuaugggagauaggaauucuuuuccacuccaugaaacuuuuuauuaguacucaacaucauuccagaaaacugaccgaaaaacaaagguugaaagaacauaugugucugcuguuccauuucuaaaaggcuuuauaagcugcuccugaaaaugaucaaaaugucaguguuucugcccccaguagaacgcauccucucugguuucagcugcagguuagucauuacuguguguaagcaugcauuccacagcagaaucaugaggguuuggauaauagaggaagguuaauuagacuguaguaaguacauaauauagaggaauauuuuucuucacaaaaaagcugaaaauugucccuggacugacaccaaaagagaaagggcgacaauuuugggggacuuguuagcacuaagcuacauacauuuugccagacauuuauagguacucaacuuuauuaugcuuucuuauguucuguuuuuggugauuuagacacauucauucuuuauaugagaaaauauuuuauaauguguuuugauauacuguaauguaauuugugcuaaaauguaaaaagcauauaacaguuccuauaagcuuuccuaaaacauuuaugaaguauaauugcccaagcaaaaaaacuauuugcagacuuuuagucuaacauucaaagcaaauacacaaaaagcauauuauucuguucacuucagaggacuuuauguaucuauagccauuuauuuauuuauuuauuuauuauuucaauagguuuuggggaacagaugguguuugguuacauggauauguucuuuaguggugguuucugagaucuuguugcauccaucaccugaguaguguacaccguacccaauguguagucuuuuaucccucaucccccucccacccuuucccuggaguccccagggcacuuuuuuaaaaauaauaauaacaacaauauucuugucuuuuagggaagguauggaccauuuguaugcguguguacuggguaauaauauaaaauguauuucuuacugugggucuaaacuaaaugucauugccaaaaaaggaaaaaaauagcccuagaaagguggaacuuuuaagaaauuuuccauaaccagaagccacuucuguggugcuucacuuacaucacugaaagcagcuaggaguagaauacagggaugaaguaaaaccaaaaaaaggaaaacagcagagaaaucauugugaacaucugaguaaucaauugguuauuuuuugaauaauaagacagaucuuauaauucagcuaauaaauauuggguucagaccucagcucuacaacugguugguuagggaacccugaccaaaauuauuuaaccacacuagguuccacauucucaucuauaaaaugaggaugaaacuacccucugucuccucaggcaguuaauuaaauuaagguguguaauucauacauugaacuuacugccacacauggaauaaauuuucaguaauuguaaacuauucgguuaaccccucuccuggagggauuacaaaguguuaauuuacagacuaaccuaaaguguuuuuguuuugcauguuuguauaguauacuuugcuaaaauuacuugcuaaauuaguagacucucaaguaaauaauaaauuuugcuuuuuaucuucaaagauauauuauuuauuuguaaggucuuaugauuuucuaacuaucgaauaaggauaguuucacuuuguuuaauguuuuacuauaggauguuaauaguuaagguaaguaggcauaauuuuuuuaaugauuucaaagagauauccuuaaguacuucuuuuuuugacuccuaaguauagaagcccacaaaauaugaugacaagguuuucagacacaugaguuugggaaugaguuaaaugagaaaaauaaagagaagauaugugaacaaauagaaaaaaauuaauaaaauaguuuucuguuguagaauuaauacauguucauuauaaaaauuuagguaauagccaaagauaaauagaauaauauuacuauuuagauguauauguuucaaaugcauuugcugugcacauauacagcuaauaacauuuuuuucacaaaaugaaaucauaccauacauaauuuuauaacuuccuuuuguccugugacuauaucauggauguuuucuaugucaacacauauaagucaauaauacuguuuuuaagagcaguauaauauuccauucuuuguuuggaucauaauuuuuuaaccaauuacuuauucaggaacauuuaucuaauaucugauauuuagaaauugcaaacaaugcucuauuguuuuauaaaacucucuguguccuucuccaaauauuucaauaugauaaauuucuccuucaguucauaaaaguaaucaccaauuacugaaugcuauuugacaauuauaguguuaaaauuuuauauacacuauuucaugggacuauuacaauaauuauuacaauaaucccacgaaacagauacaucauuaacuacauuuuaccaaauagugcaacugaaaauuaauaaaguugaauaauuuuccaaaaguccacagaaagcaggaauuauaaccaggaacaacugauuccaaaacucauguguauaaccacuacacuauacuacuucucucguguaguauaguuugaauauuuuaauuuuuuauuagucuuacuuaguuuccagauaauuuaaauuauuuuuugauaaauaauagaaauucuacuuugcaggaccaacuucaauguauuuguccucggucccccaugaauugucuaauauguaaacuugucaaguagcugcaugacacauucaaauuaccuggcauuucaaaaaggugcagguugcuguauugcuucauugcaaaguuaaggaguaacauguugcuuggaaagaaaauuacucuuucaaugacuuuauugaaugucacauaauaugaaugggagacaauguggaagauaaauuaucauguguauuauggaugauauuuuuuucuauacaaucuuacaaaagcugagguguguauaguauaaucaaauguuaguauauguacaguacauacuuaucuauaaacacacacauacaugagggacauuugguucaccaaaaauuugugccaguagagguauuucuuuaguuacugcuuauuauuauuuugaacaauauuguagccucagacaauguccuauuggaauuagaaaugaaugagcacuacuuauugggcccaagagaaagguguuaaagaaggaauggcaagguuugcaccuuagugccaauacucaaacugcuuuaggcuggaaaccaguuggccagccaauuuaauuauucuucaccaugauucaacauaaaaggaaauaaugagcauugggaauauaauaauauuauggaugcuaaguauacugcauaaagacaugcacagcaaaugcaaaacugccaguuucaggaaaaaaaagguaccgggggagaaagaagugggaggggaguugcuguucaauggguauaaaguuucuguuguagaagacgaaugaguucuaaauauuugguguacaacauugugcuaauagugaacaaauacuguauuguguacuuaaaaauuugauaaagguuagaucuuauuacauguucuuaccacaauuuuuuaaaaauauaaaguagaaggaauggugcuuuugaaauaagaaagugggaagcaaacauuucuuuccaagaccaacacugucaucucugugauuucaaguggcuuucucaagcagcauaucuuagugauauauucgauaucuaguauagccugaaucaauuacccauugccaaagaaaugacuuuucugagaugaagguaauagacuuccuuagcaagaucaaaaggaaaucauguaaaagagcugauggcuuauagauugacuuuuuccaauccuuaaugauugccuuuaucuccuacuugccugagaaauauauugaugggguaucagugggcauauuuuaaaaucacauccauauauugcauuagaucauuaagaaaugcauuugaggaaaaugucaccaagaguaauuagaaagucauuugucuugacuuccucauacuugagugaguagaauaauuuaaccuuuuagcuuugagcaugauauguugauaugugauggggcaccaaaaguuagauucaaugagaaauaucucaguauucaaaacuaucuaaagagguucugaaugcuuccugaaaaucuugacagauacaauuaaaaguuuugacuuaauuuuacuaagaaaugaacucauuaugcuuaggucagauauaaacagcaucauccuucuugcaguuaugagcuaauuuaugcuuauuauauuuuaucuuuauauuuuaguuauaauaaacauuuuaauguaccuaacauuggcaauccuuuugaauacuauguauccauugagugaucagcagauacagaaagacuuauaucaugcuuaggaauaucuucuucacagcauuuguauguuaucacaaugcuuuuuaugcacagaagagagcaaauuuuauuccaaagaaauguagucauaagugugguaaagcucuguguuugagaggguagcagcauugugggauuuaaaacaauagcagaaaaaaaauaauugcgaggcuacucucaaaccaaaugccauucucaaacaaauuucacaaauaacaaauuugauauaacuuuuaguaucccuuaagaauaucaacuuuuaaugacuuaugaaucagacuugauauuuacagcaugcagacugcauucccccaaauagaauaggauacgagaaaauggaaaccuuuagacagaauuuauaaaucuuugacauuuaccuuuucuugucuuccauauacauaucaaauaaaaauuuagauucaugguuaucugagaucugucagcaaauauuuaucaagaacuuauuaauuccaggcauauuaugaggugcuguaaggcauggaaaccaugagacacaacagugaaguguuuuaaaaagcaaaagaaugggagccuaccaaaagaaaaaaauaugagccaaccaaaagagcccccaauggccaauuuugaguaacgcauaaaggaguaauuugauaaacaaaauaaauauugcaguauuauauuauacuccaguguagagaaugaauauccaugagugcauaguuauauaaauaaaugauuaaauacauaaaugagggagaaaggcagaugugucauacagaagaauucccaacaaguuauguggauacuucacccucaaguagaagcauaaauuccaaguccauaauugugagcugcacauaauaaccuccucccaaauaguacaguauagaaauggagaaaaagaggaacuuuacaguggagaaaccugauaaacauugccucagcaaggugauaacacuuaacaucaagagugguaaguuguauuaacagccaauaauaacuugauaugaugugaugagaaugacauuucaccucuuuuuuucuagcaacacaaaacagagggaaaaagaaaaacuaagaaaauaaguaaaaaagaaaauaugaauaaaauauuggguuuagugaauaauaauauauuaauauugacucauuaguuuugaugaaagaaccauaguaauauaagaaguuaaaaauagagggaacuggauuuggaacauacaacaacuuucucuacucucucuguaaauuuccuguacaucuaaaacuauucugaaauuaagaguuuauuuaaaaguuacauauuaagguaugccugaagguuuagucuaagagggcauauggaacaucccacuuaugacuaaaaguaggcaaaccugucucuaaugugcuuauaacugcucaucuguugaauugcuggauuguuccauguuuauuauuuugauggacauuguacauacucucccauauucauauugcuucuuucagugacaagcuacuaaaaggcauaaacccuaguucugaguuacucaugcccucucuugauuaaaaaauagggcagcaaugguuuuccaagacagagcuggguuuucuauaucuuuggagaaaaugacuuuguaaacaaagaaagaggaauuguaagucuuuggaugaaugagucaggaugaucuuagcaaagguaagggcaauuuuugcuugguuuuuauuguuuacucuuucuuuuaugcacuucuauuuuuuucuuuguuuuacuguaaaaauagaucaggacgcugacaaagaaaaauuauggcuuuccaaaaaaggauaugugcaggaauauucuugaauaaaagagcacaagcaccuauguguuccuugcuuuuuuuuuuuuuuugacacuucaauuuugcagggaaagugaaauuaaaaauggcacuucuucaugcaaaaaagagagcaaaagcucuuagcacagaugguuagcaacaagguugaggacacaauuaacagucugaaauuauaucaucguauagucugucagcaacuucgaagcugggcagcagcauccaggacuuaauuggcuuuauuaauaaggcauccuuucauuuccuuucugucuaacucuuaugucacuugucaccauaacagauuuuuuuuaaguaucugcaaaugaauuugaucccaaaagcuuaucuuuucugcagcauguguuauuucuuuuaaaauagaaguuucucuugaacuucuacuuaaacuuaguauggagcuuucagguaaaacucucaaacaaaaaguguuugacaccagcaaggcagagaucacccuuuuggaaaaauauaucaacuacuuauugauugccuuaaauacagauaaugcaaaucucaauuuaaucuccauguuuuaaaaaaaaugaccagcagauagaaauuaacauuacagguguauauugguccauuuucauacugcuaugaagaaacaccagagacuggguaauuuauaaggagaaagcaaguuaguuacuuccuagauaaaauggggguacaggcauuguguaaauauaccuguuccaagugggagaaaauggccaaaaugaagggccugcaggccccaugcaauucugaaauucaacagggcagucaaaucuuaaagcuucgaaagaccuccuuugacuccaugucucaaauccaggucauacugaugcaagaggugaguucccacggucuugggaagcucugccccugugucuuugcaggguacagaucccuccuggcuguuuucaugcucugguguugagugccugcagcuuuuccagccacauggugcaagcuguuuguauaucuauuauucugcagucuggaggacgguggccuccuucucacagcuccacuaggcagugccccaguggggacacucuguguggggguucucaccccacauuuuccuucugcaucauccuagcagaggcucuccaugacccuccgccccugcggcaaacuucugccuggacauccaggcauuuccauacauccucugaaaucuaguuggagguucccaacccucaauucuugacuucugugcacccacaggcucaacaccauguguaagcugccaagguuuggagcuugcacccucugaagcaacagccugaguuguacaguggccccuuuuaaccauggcuggagcugaagcagcugagaugcagggggcaccauguccugaggcugcauagaguggggccuccaugccugugauuggaggggggcugcugugaaggucucugacaugcccugaagacauuuuguccauugucuuggugauuaauauuuggcuucucauuacuuaugcaaauuuauacagcuagcuugaauuucuacccccaaaaugggguuuucuuuucuaucacauuaucaggcugcaaauuuuucaaacuuuuauacucuacuuccucuugcaugcuuugccaccuagaaauuucuuccuccagauacccuaaauuaucucucuuaaguucaaaguuuuacagaucuguagagcaggggcaaaauaccaccaguaucuuugcauagcaagaaugaccuuuacuccaguucccaacgaguuccucaucuccauaugacaccaccgcagccuggacuuuacuguccauaucacuauucagcauuuuggccaaagccauuuaagucucuaggaagucucaaacuuucccacaucuuacugucuucugagccuuccaagucuauaggacguuacaaacuuuccaacaucuuccugucuucuucugagaccuccaaacuauuccaaccucugccuguugcccaguuccaaagucgcuuccacauuuucagguaucuuuauagcagcaccuguagcaguaaacugguaccaauuuacuguauuaguccauuuucacacugcuaugaagaaauaccugagacggggcaauuuauaaagaaaaagagguuuaauugacuuacaguuccacauggcuggggaggccuuacaaacauggcagaaggugaaggaggagcaaaggcacaucuuacaugguggcaggcaaaagaacguaugcaagagaacugcccuuuauaaaaccaucagaucucaugagacuuauuugcugucacaagaacaacacaggaaaacccauccuuaugauucaauuaccucaguuaccuccuacugcaucccccucaugacaugcugagauuaugaucuacucucaccacugagaauauucauauucuucaaucauaauguucaaauaucuaaaguaugucaugcauuacauaccuaaaaucuucacagaaaugcaguuacauuugaaugauaaacauuuguuuuauguuauauugaccuuagaacuagguaauaauuaaaacaaacacuucaguuucuggguuguaaagaggaguuuugauagaauauucaauuuuugcuaaauauagccagacaugggauuguuuucauuucuuugacuaaaauuaaugagauuuuugaaauuaucucaaaggcauuauguuugugacaaguuaucuauaacacaauauggaagcuauccuuuaaugauaaguuucuucugaaauguauuuuuauuacuguuuuuauacuuuuacaauauuaaucuuaaugauaaaaucuagacagaauauauaggcuuuuguaucauuuuuccaaaguuuggaauacuacuaguuaucagagauuuuuauuagcuauucuaugaauaaagaaaaagcauuccacaaucaaauaaguuucagaaauguuuccuauuacaguccucucuguaucuuucuauuagcacacaaaaugguuugguaaguccuguaaaaaagacucugaaucaggugagaugcaggagaaugaaaagccucaagggagaaugaggaaauuaaagcaagaaaguggagggguccagggggaucagagaagcugggguuuaggucaaaagagaggaagguggagcagcauagcagucuaaggcugaacagaaaggagaaggcagauauucacagacgcuugcacuuuguguaaugagcuagaacagugggaauagaaaauauaaugaauuaacucacuucaaaauuuuaaagagaacucaagaauuauguugcaagcugagaauccagggauugugggagaucuggggaaugugacagugauaagucaguccuugcuagggcuuaucccacuggcacaguacuacuucuccagauucuggcuguugccuuugagauuuuccuagcuaagguuugccuacuuuucuugacuacaguuuaaaauuucucucuucuugucugcuguguacucaucuuccaauucuaauuuuaucucuucuccauuuuacaucccagccuucugaagugauuacuuaguccaaacacaccuauaaaauauguguauauuggugaaaauacauuuuaauggcaguaucaggaguaagaccaacagcuuacacacugggauguuuugcucgugaauauugcuaagaaacuguacaauucuuuuaaaaccuaauaauuucagagguugaacaggguauagaaauauggcaaagaaaaucaaucccauuuaaauuuucuaguccuaaggcaaauuucuagguccugaaguucaucaguacagcugcuuuuuguauuaacaagcgauaagugauacuaaagauaagaguaaucucauaucuugagaaauacucaauuuuauuccuucuggcuauaaauggaaaaaaaaaugaagcacaauccaguuaugaauacuggucugggccagcagaggucugggcuaugucagugucagaucuaaagugguaacuggagagacaaagcuggugcaucuugccaaaagugaacaagaggccaaauaccagaagaucuauaaaagaagaaaaugaucagaauccggacagacuucaaugaagugcuauucaaagguucaucauuaacuaagauagcacaacuaagugaaucugauccuacaucagaggcugucucuucacucucuuuugugugugucccacccccaccugagaaguucauuuuuuucuguaugcagaucuauuaugaggucaguauugcagguuguuaacaaaauuuucagagagaaauagcgaauagaaggaucaugauauauuauuuuguuuaugcuuaaaaauauuuuuuaaauuauaaggaguaguauuuauauacaaacacuuuuggacacugcauuuuaugcuaauauagguuucuuauuuuuuuaacccaagaaagagcauauaguggagaauauacauaggauuaucaagauuuuauuauaauuauaaaauaaagucauagcaacauauaauuuuaaaaacuauuuuuauguagauuauaucauggguaucuucauaaaagccugugguuuugauaagguagauauuuugucuacauuucagaaauaaagagaaauaaaaucuuagugaacuuuaggguugcuguggucugaauguuugcgccccucucaaaauuccuacguugaaaaccucaucaccaauacuauacaauuagguagaagaggugauuaggucaggaggguggaacccuuguuacugguauuagagcccuuauaaaagaagcucuaaagagcugccucaccccuuucugccaugugaugacacagugagaagauggcccucaccagauaccuaaucuguuggcaccuugaucuuggacuucccugcuuccaaaauaaugagacauaaauuuugguuguuucuaagacauucaguucuugguguuuguuacacaguccgaaaggacuaagacaagaguuuuuugcuuaguggcauaacucaucaaugucauggcuagauagcagauaguucauaugguuccuuccuucauucauuccuucuuuccuuuuuuccuuccauccuuccuuucuuucaucuccuccuccuucuuucucucucuccuuuccucccauccccucccuuuucuccuuuccuucuucuuauuuuuaauauacccuuuccccauaucucaacccccaauuauuagaaauaccacauccucaauacauguguguuaggcacagggucauuuggaacuguuuacuaccaguauuuguccaaaaagauuauuuuaaaauauaaaaauauaaaaucguuggguggauugaaauuuuagauaagauggcugagucacuguuuguuugcacagagguaagugggaauguacuaucuugaaagaagcuaggagggagucauauaacagaggauagagaaaugcccauuuaaauaauuuaagcagauugcccuugcuuauuccacaccacccaacugcuuuuaauuuuuaccacuuggaaauagguaaugcugguuguguacuuagaaagccccaauucagcaagugaagagauaagucuucccagauaaaauagugaacuguaccccuuaaucccugugcucuuccucuccaaacuggcucuccuguuuacccugcucuuguucagaacucucucuuggauauguuuucucgacauggaggcuucagcugcacacacucauauacguagaguaaugcaaacuuguuuguuauaucaucugugacuccugcuuuugggggaaguuaguuucuaaauccuuuuucuuccuuagugauuuuuuuuuccaauuaguugaacgaaugaugguauuuguuugcagcuuccaguguugcccauaaagaagaguaguuauucauuuagggaaauugcuugaucagugcuaugcagggccauuauaucuucuuugugcugguaggagaaaagagugauauucuagauugaaacaacuggaaaaacagauugcugaauuaggagugaagauauaauuagaugcacccuacaauaauuggauagaauugaaagcauuuaagucuguacauaaucaaauauugccuggaaaugcuacagcaucuucauuuuaugcuaaacagauuuuuauggaagggcuauaaaggaggaaaucugcuugcuaauuugauuaaaaacaccauggaucuccgugauuucagcuauuaagauuccaaaugggaggaggcuaauuauaaaagaaaauaagaaauugauuucaucuuuaagaucuauuaucaaacauugcauaguuuaaguggaauuauucauaacaaagaugcacuucaauaauugcucuaagaauagauauauucuuaguuccauuuuaaacugaaaggaaucuaaagaaaaaacaacacuguauaaucaguauuuaugggagagguauuuuauuaaccacauaagcccauuuuacugaaaagaaaacaaauuaaaagaauaucacuugcugaaaacuauccucaaacacagauauguagugucucauaacuuaagaacuguauucauucucuguuuauacuauuuaauuucuguauuauaucauagcuauuaguagacacauccuuuuugucuuauuauuauuauucuuuauuauuuauuuauuuguuuguuuguuugagauggagucuugcucugucacccaggcuggagugcaguggcacgaucucggcucacugcaagcuccaucuccuggguucacgccauucuccugccuuagccuccugaguagcugggacuacaggugcccgcugccaaucccagauaauuuuuuuguauuuuuaguagaaacgggguuucaccguguuagcuaggauggucucgaucuccugaccgugauccgcccgccucggccucccaaagugcugggauuacaggauugagccacugugcccagucuugucuuauuauuuauucauccauuaaacagacauuacugagcagcuacuauguagcagccaguguuucaggcacagaggauacagcagagaaugaaggagacaaaauuuccuaccaucaagaaucuugcauucuguuuggaaagggguaaaguaaaagauaaauaaguaugauguauaguguguuggauaguaaugaaugcuaaagaagauaaauaugaaguggaaggguaagauuauuuuugagagaauggucaaagaaggccucauuguggaaacuugaguaaagauuugaaugaagugaaggagcugaccaugcugauaucuuaagaaagccuccagacagaugugcaaaggccugaggcaggcugcgcacggcuuguuggggcaacagcaagaaaugauguugauagaguacaucuaggcaggggcuggggagaaggccuucacagguuguaggucacgaggucucaguaaggauuuugauuucuauuuuaauuuauuuuauuucuuugcauuucauuuuuuugagguaaggucucacucugucauccaggcuggcaugaccacugcucacugcagccucaaccucccagguugagguccuccuaccucagcuucccaaguaucugggacuacaggcauaugacaccauccccacuaauuauuuguagagauagucucauuauguugccagggcuggucucgaacuccugggcuccagggaccccaccuaaaccucccagaguguugggauuauaggcaugagcuaccacacugggccagauuuugacuccaaagugagaugggaaggagugguagcacugaacagaagagacaugaucuaccuuauuuuaucagacaugagcuucucaacugcaggggcuacucugggccaugcagcuuuguaaaaaugaucuaagugauauccuauucuaucuacugggcugcagauagcugaagaacauuucuaucuacuuuauaauuuaguacacagucaauccuggaaaguauuuauuaaugaugcugguuaccuuuuaaacacaaaauuuaaaaugugggccuaauuuaaacauaaaaauaaaaaauguucaaacgacaaaggaaaaucugagggguuauaucuuuuuagucuaguuuaaaugccuguacuucccaggaauuuaauaauuugguaaguuaaaaaaaacuuuuuauucaucaugcauaugguaaauguuauuugcuuuuccuuuuuagaacuacauuuaaagagaaauaaauuaauucuggagugccacuuugucacagaaagaaggcaaagggauaucuccaaauuucuaguuuauguaccuucucauucuuuuccauguuaccagaaaacaguauuacuacuuggugaaaguuuuguuuuauuguaaaaugguaaaaugcaguuuaaauuuauuucaaaagaugaauccaggagccagcugaauaugcucaugggucugcucaagccaagguuuuauugcugcuaauugacaagcccaauuguacaacaccaaauuuggaacugaaaauucccugucuuugaauagcuguaauuuaaucaagcuugcuuuagcuccuuuauuauaucauaaugaaauauaaaauaccuuacacacaaaugcuucucuuucagaaauuaaauagaaagcaaagauuuaacaggccaagaguaacaaucagugcaaacacaauuaccuucucacauacaggauaaagcaacucucccccuuuuugucauccaauaucauaguagcacgaucuuuucucccuaccuguccaauuuuuuuuuuauuuuucuuuuuuuuuuuuucuugagauggagucucacucugucgcccaggcuggagugcaguggccugauuucggcucacugcaaccuccaccuuccggguucaagcgauucuccugccucagcuuccgaguagcugggauuacaggugcacgccaccauacccggcuaauuuuugcauuuuuaguggauggaguagggugggguuucaccguauuggccaggcuggucuggaacuccugacuucaggugauccgccugccucagccucccaaaaugcugggauuauaggcaugagccacugcaccuggucccaaauuuucauuauccucauguuuguccuaaagcaaaagaaaaagaugagcaacuguggaaaaugaaaauaccaaagcuugguguguuuucugagaaaacuuaagcuucaggauacuuauaacuguaguuauuaaacccaaagagagaaguaagucuucuucauauaucuagaagcaaugugaacauuugccacuaguaggaucuagagugaagauuucuuaacucuucauccuuucugugcuaauugaaugaugaagacccuaggaguuuuucaaaaaaucucauacagagugcuaacacaucaguugaugacauccagccaugacggauucaggcuugcauaaauaaucugcaggaguucuuugaauauaucacagccacacuagauaaaagaugaucugggacuacgauauaguuaauauuucagaaaaaaaagugcauuugauauguuucugcaucagagauaaagguaaaagaaccaccgaacaugggauaaagaguaccgaagcgaaaauuaguuuuagaaacacuacaaagcaaagacuuuaaaagcaacuuuuauguuggaaagaaaaaaaaaauauugaaacugggcagcccaugugcaauuaauugaaguccaguccuuccuuaaaaacgcuuucuaacacaccaaauaucucacaaagcugauggugacuaaaagucuuuccaacaguuuagugcaauagacuuaucacuaagcuuggaauguaaaaaucuaaguucuagcugauuaaaugaucuugaguaauuagcacucagggucucagauuccaaccuacagaauaggaaauugggucuagaaagauugccaaagucccuccuaucuccacaacuauuugauucuaacagcuccacguagcucuggggaauuuaaucaucaagcaaguuucuccauuaagguggauaauuaaaaugagggaguacucuguaaugcaucaaaacagauucagauugcuggcuuuuucaaauuuacaguuucgcuuucaguaaaaauuacaugguauaaucagucgagcuguggaaaugggcucugaaggcuauugauuccugaguucuugauacuuucauugacccuaucaaaacacuuaaauguuccaaagccuggaguggcccuggagaagcccaaguuguaacaauuuuguacugccugagguuuauauuacuccagagaguauguauuuuguaauaggguugaaaagacaguaaaauuuuuaaaaaguggccacuccuauaguaguguagauacaugaacauuuaaccaaauguauugccuuuauucugagucuguacaugcgcagaaaucccagcaaaauguucucuaacuagucuuaugugacccuggcuuaaaaugugggcuguuagacuuuuaacuacuugaggccaggcacagugguucacauuugcaaucccagcacuuugggaggcagaggugggcagaucaccugaggucaggaguucgagaccagcuuggccaauauggugaaaccuugucucuaacuaaaaauacaaaaauuagccagguguggugccaugugccuguaaucccagcuacucaggaggcugaggcaggagaacugcuugaacucgggaaguggagguugcagugagccgugagccaagauucugccacuguaccgcagccugggcaacacagugagacuccaaaaaaaaaaaaauuuuuuuugaacuacuugaaaauaauagacugcuuuuauuauguacagagucaguauuccaugcaauuuuguugaauuaaauuuaauucuucuaucaccagagagcauuuuuuuuaaaugaagaacaugauuacuaauuuagaugacauguaaccaaguuuaaggcagacaaaaaaaaaagucucuauuagaaacuacaauggaacauuauggggauaaaaugaaaauauuaacuuaaaauucauuccuccaucccuuuuagcccaaaugagugaauaauuuuaaaaccugaaacaaauguuuucucaguauaacccuucuagagaaguacugcaauuucacuaaaucacagaacucccauugccuuagaucaggaguguguauauuaucagcaucaaacaaaacucaauuauuuguaauugucagcagagcugagaauaaaccuuauugaagcaugaacacugugagaaaaaauauaucugugcauuccaucaaaagcaagcauuucuuugccugaauuuuuaaaaauuguuuuauuuauaauuauuguagauauauaauaguuguacauauuuauguauaugugauguuuggauacaguauacaguguguaaugaucaaaucaggguaauugagguauccaucaccuuaagcuuuuaucauuucuuuguguuaggaacauuucaauuccacucuuuuaguuauuuugaaauauacaauaaguuauuguuaacuauagucacccuauugugccaccaaacacuagauuuuacucuaucuaauuguauuuucauacucauuaacccuccccucuuuaccccccuucuccauuacccuucccagccugugguaaccaucauucuauucucuauaauuuguaauaauuauacuucuagagcaaaagauaaacucugccuaccugggucuugauucucuuaggacggauaagucauguccaagaauagaauacaaaaagagaaaauggugucaguaguaugguguuauacuggugugcuauacuaaauggugucuguuucagguaaaaugacauuagaauucagaaugaaggagugauuccagcuggagcaauuaggaaucagggaagucauuguaaacaaaguggcauuuuugauagaccuggacuuuaaaauauggaaauuagugcagagcgugaugaauccagcauuccgaggaaaaaggaaaaggagaaggaggugugaggcaccaacugaaaagaggacuugaucuuccugagccucuagugugugaaagagaacaaugggcugugaggggcuagauggugcaaagcuuuggaggccugaugugcacuuuaaucaucaggcuuggaccagguacagaggguuuuaagaaggagaaugacagaaccagagcugugcuuuuggagauuuauucuggcagcaguguguaggauggauugaaggaggugaugccagcucaggcucaacaauuucuuaaaguggagaaaaggcacaguugcaguagagacuaauccacgugccacuaaaaauugcccuguguuccaucugcagcaccaaugugaagacuguucaccucuuuccagaauaccguggaucugugaacaguuaaaaccuauuacaugagcuguguggagcugaccugauaggaauaauuauaaugaaagguuuauaucauucccuaggacuggggguaagggcaauauaacacucuaacacuccuacuuuguuccuguuuuagcuuuugaaguuuuauaauagcaaguuacuugauuugucuugagauuugagcuguaucacugauauaagcuuucuaauuaucuuuaucaacguggcuacggcaaggaaaagugugauuccacaauuuagauuugcagauaccaaauagaaugcuaauugauacuuuggaaauaugauuuucaaacuuagcagaguggguaacaccaagaaaaauguuuuaaccugaagucauuuugaaggcuaaaauacacuuuaaauuuaaacugaaagggaaagugaggagaacccugcuugaggcuuuaauucuuugauuaaacuugauaguggguuaucuuuaggguaacuucuacuucaauaugagccucauuccaugggccaggccauuauaauuauguauaauagaauuuuuuuuccaaaauacauuacaauaucugaagaagauaaucacauuguaacagagagaaaugaaaaucugucaaagagaaugaagaaauuauacuugccuuucuuguccuuggugccuaaagugaaaugaaauuguuuuccuguuaucaggccaaaugcagacauacuuuaagggaccagccuucuuuaaagauuuuaucagguagagacaucaguucugccuuccuccuugcuucagggcacugcaaauggcuucagaguacaucuauaugcuaguucacuggaaggaaucguuguuccaaaguuuugcagaacaaaacuccccuaaauucucaagagaccaguuccacaaagcugugagcugaguuuuguuauauucagauucacuauccauaucucucaugagcucugaguuucagcuacgauauuuugaaccuaaggaauacuuuacccuuucuuuuucuccaggaagcaacgauccaguauaaaaggaguuauauaaucaagacauaacugugagcuuugaaacuauuuuaaucaccagagccugcuucuuaccauaaaacgauuucucaagcuccauaauuugggauagaaaacaauagcaaucuugaagaaauaccaggaaggacauuagagagaugaaguagagaagcauucaaaaugggaucagaggaugcaucuauucacagguccaccugaugccagggcuuguagaaaaaaauuuagagauauauuuagagccauugaaacuguucccauuuuuacauagggagagaucagcauuauauuuugagaaaccauagggaaggagccugucuuuuaaagucuggugcuacccaggauucugucuuugaucauaggcuuaucuaaugggucauaucuuacucugucauaguuuuuaccuauuacacgcuguauaugcugguaacauccaagucuaaaaauccagcccagacauaaucccugagguucagauuugaagaucuguguaaugaccuagauuuauauguggauaucgcucccacaggcaucuggcacccacccugucuucuagaguaccccucauagcacuccuuguauugaguucuaagugcuuaugucacugccuaucucuuccacuggaccaaaaguacugggaaggucagggugaggucuguuuuguucauaauuaaaagccuugcuccugguacacggcaacugcucaauaaauauuuuuugaauaaaugaaucauuggaguggggcuugaaaaaucuggauaauuauaauuuuauaaaauguccuuuuaacacaaucugcucuccagccccuaccauuuaagauaaagggacugcauuaggacuuacuuaagugccugucuacuuagggucacagcacacugauucucuauguagucauuuuggacuaugauuuguuguaagacuuugccuacgaauauucugccaaguacaaauaauuuaauacgauugaccauucaguugauaaaguuguaaauagauaauuauugcuuuucagaagaaaguugcuaaaaaugcauauauauucaaagcaauaccugagaagcauaacauaaaaagcguuugcauucccacgaacacgguucaguuaaagcugagcuuugccucacagaggauaggcaaacugcaucugggaaccuuccaggaaaacuacagaaauccaauuaggaacaguccuaaauggacucagaauguuuagguaugauagagaaaccaguaauucuucucaucaguaaaaguaaugaagugccuuuaaaaacauccuuccauuucuccugcuuaauaaguagauauaaaauugggguacuuacaaaaaguauuuaauugucauagguaguuggcaagacaaauuuuuaagaauccaaauuugguaaagaaauacauauaaacaacuuuugaagagcaucagaaauugaacagccuaucagaccaucugggacuguauucccuucaucucaucuggaugugcucugugccccucccugagccagcugcuucauuuuucccuauccucuuguccuuaaaaucacaaaaggacauuacacauuaacugaugccuugcacuaauuuauauuugggggauauuggaaaaacuaacacuucuucuaagugugcaggauucucuugaguagacaaugugagaaaaaguuacaaauacuuuucaggucucuucccaaguaugaaauugagaaauauucugaaaaaucagagucagacugauuuugguuagaaaauacaaauccuaugauuucugcuacaaugguaucugaaucaagauaaugaccauuaagucucagaccuuuacaaaggucuucagucaggcgagacaaaaacauuaauuuguuaaaugagacuaugggaaauacuaccaaccuccugagaucucucauuuaucacuuugucaugaaucucaccucuccaguuuccuuacaguuuucaauuauggaugcuagaaucacugcugucauuuaaaaaaauuagaaugucuuuauuucuuuauaccauuugcauuuuaauuuccugccccuuucagagacauuucuuuugcuaaguaauggccagcagccaaucucaaucuggagaggaaaugauuaaaaucuuaauucuccuggagggggagcuacuauauuuaucuuuuguuucuggauuugaucaucagacuguauguuucugccacauuaaccucauuuuagcaguaguuuucaauaugagugagaggaaaaaguagaagagauguuuucaauccaaugguuaaucuguuugacacaacauuugcuuccucauaaugggugaugauaguuuauauuacucuuuaaaucagagcucaacacauguuuauaguaucaaauuaauaauauucacugugcuccuuaaaguuggauauuagcaaaagugauagaaauacaugagcacagaguagcaaaaucauuuucacaaauggugaucuguuaaugcugaguuuuuaguucuucuuauucccuuuagucauuuauauagucaaauuaucuggucuaauuuuauuuuuaaaaauuaugauuuuucuuagacuccaacaguaauauaaaagcaaacaaacaguacuuaguuacuuuuuacuuguuaguugaaaauuauaaggcauaaaaguaaacauguuuuuacuuuuuuguaaaguaagauugugugagacagaauguacaucuuaaacucucucaaggaaaguaaauguauuaauuuaagaguucagagguuaguggacucuggguauagucugaucaagucacucaguuuuuuacaauucuacuggcucuuuuauauuccaugaaaagcuucauucugugacuuaacuuuuuuugugccugcaaacagugauugcauuuguaaguaucacaucuuccuauaauauuguccaauuauaaaaagaaugucuuagauuaaguaaaaagauaacuaccuuuuuaccaauagucaaaaauuuuuggcuucaucuuguuugaaccaaaguauuucaugugaacacuucugaaccaaucaauguaacugacaacuccuguauaugcagauuggaagauaggcauaggcaguggauuagguuucauggacuggggucaguccuucaaagugcuugcugcugugcaauaggagaggggcacagcacgugcugaggaggcaaugacagucccugcaguuacccaaacuuucuuaacauuucagguggcucucaaaucacaaaagcauucucucuagcucacagaaaaaugacccccaaucagcagagcaaagauucucucaauucuacagcagucaagguuuacuucccuauaaugccugccuuuuuuugaaugcucuuagcaagcuuuauagcaauuuuaaaaucugauucuuugaaauccagaaaguuacuaauugggaguuagaagggguaaaaaaaacgcucagugucaaaagauuuauuguaaaaggucuuucuugucuuuuugggaggggagagaguguuauggucugaaauguguucucaaauucaugucgaagucccaaucuccaguauguuuuuggagauaaggucuuuaaagaagugauuagguuaaaauaaggccuuuaguguuuggcccuaaucuaaaaugacugaugucccuauaagaaaagcaagagcuggagaucgagacuauccuggcuaacauggugaaaccccgucucuacuaaaaauacaaaaaauuagcugggcgugguggcaggugccuguaguccuagcugcuugggaggcugaggaaggagaauggugugaaccugggaggcggagcuugcagugagccgagaucgugccacugcacuccagccugggcgacagagugagacuccguuuaaaaaaaaaaaaaggaaagaaagaaaaagaaaagaaagaaaagaaaagcaagagcuaccagaggugagagcacacaaaggaaugaccaagugaagaggcagcaauagggcagccaucugcaagccaagaaagagucucagaaggaccuaacccuccugaccccuugaucuuggacuuccagccucuagaacugugaggaaauaaauuucugcugcuuaaucuacccaguuugugguauuuuguuauggcaucccuagcaaacuaauacagaauggugguuuguuugcuuuuuguuaacuuuucuuuuggagguuauaaaaccaacugcuucuuccaacauuuuaauuuaggguuuuguugcaguaggagacuuuauuucauagaaguaauaguuauuuugcugauguucaaaggaugcuucugguacucggugagguugaugcauuucucuucaccagugaagucuaaugcuauaggaaaguuuucaaauuucacacuggucccuguaauuuuccuuccaacuggcaaauacuuugaggaugacagcugugagccagugcaacuaucaccauggucuguuucuaauuuuuuuguugguguuuaugaacacaacuuuuccccuuggagccuuugguucauugcuggugaugaaggauuuuaucuccuuagcucaucuaggucuggguucuugucuugucucaugaccaggaaaaaucaggcacguggacacucgaagagugaguggaguagaauguauuaagugaaaaggaaagcucucagcaaaaaggggcauccugaaagcagguugccaguuuuccuucgcaguacaagggcuuauauauauauaagcugauggagcuggguucccuauuuguauaaggcauaaauuccagguggcucugccccauucccccuagcgugcauguggacccuuaaucuucuccgggcauguuuaggcaagccugcuguacaaguucccuuaucugcacaaaauaucugguguaggcacuuguggguuaggucggauguuuuccagggacccuucccuuacugucugccuaaagcaagcuggcuaacuccuuucacugguuuugaagguuuuuguuguuauuuuucuaagcacucuuuucauuuuauuucaccauaaauccaguucuuacaagguauaaaugaaauaucuccuuuuuaaugugugcugagguuuggaacucaaauguacaaauuaugacugccuauacauaaaaaacagaagcauguuaccaugaaaugaaauaaugggcagacaauguuaguuugaaauguucuuuuuccccuccauuccuauuaaauuuguguugguucuuuguuagaugaaagagaaagaaauaaagugcaaugcuuuugccuaaaagccuauccccaaaggaauugaguuaacuguaccuagccccagagaaagacaugaaacuaugacuggcuaaaaaggcuaacuaagauguguguuuuucuaggauuucuucuuauauucuuugagucuauguaauaugaucaguaccuucacuuucguuuucucuuguaauuaugaaacgagugugacaauucugcccaugacaccucagagucuguuaccaaagucacugaaaacaucacaaaggaggaccuugagcuccucagaauauguuaaauaaguauuaaaugcgguaaacuguaaagauucucugucuuuucauaaucuuuuuauuauuuuggugaguuuaguuuuguguuuuuccuuuggaagagaaugccuaauaaaaugaguugaggaauguacacugaguuagagugaacaauacuccuggauuugggaguguuuauuuuaguuauaaagaaaguuccaguuuagaauuuauucuagacaaauaaugacauuugaaggcaaccaugguuuuaaugguucucugaaucaagcaaaagcaauguaggaaaauuuaaacaucuaacccucagaaaugccaaugaagacuauaaaacuaauucaguuaaugauuucaaaaucuuauuugacauguuuuauaaaacaggaauaaaaccauuccucaguaggaacuacucaguccugcaauuauaauuugaaucaauaucauauuaauauagagcaacacugccuugcauuuuuuucucuguugauucaaaaaucacuugucuucaaaucuacuccugucuguucuuuagagacaggcucauuuuugcuuaaagauaugaugcaaaugaaaggaauacauuuguaaaaaugugauuucucuagcuccuuauuuuuucucuaacucuauaauuuuacuuguaaauaucaauuauauuauccagucuuaaagaaucacuaauagaacaagcauuauuagaaaagauaauuagauaaggccucaacaaugaugacuuuuaauuagcacuuuugcaauaugauguucugaagaaaauaugauuagugguuacuauaauguuuacaaugucauuuaccugaacuuuacauuugugucauuuuuguagauaaauaaagggacacacucucaaagacuccauuucugauuuuuauauuuuuaaaacaaggugaugguuuaauggucuuuaauucauuucauaucauaauggacagaugguggacaaggauuuuccccacugugcagguguaugauguuaaaccaauaaacacuauacaaaguaaguuaaauuuucuauaauauauaugauauguguguauguauguguguguauuuccugagacuuacuaagauauuuuauuaagacaaguuauucuucaggagcauuuuagaaaugugaaauauuaauccauuugaauuuaugauuugacaaggggaguuauuaacuucuuucagauggaaaccguuuugcaacagggcaaaacagauuggucccuaauuucuuaaucacuucuuuggugauucgaaggacagacacucauuaaucagcucucagauaagaaacuugcucuguuguuuuaaugaucaaguauucuggagagacuuaaagaaucuccaaccaucucuuccgcuuccauaauauuagauuuguugcuucaucccccaaauugcccaugacuuucuucuauaaaauaaaugacuaaaauugaaacucuugcuucuuuuuccugaaucaaccucuuaggcuugaauccucagaacuuuaacaucauuuguuaaauuauuuuuaagcacuugcuugcagauuuucugcugcguccguguuguugaugggauugauguugaucaauguaaagguaaaggucaauguucagguaaaugacauuguaaacauuauaguaaccacuaaucauauuuucuucagaacaucauauugcaaaagugcuguuuaaaagucaucacuguugaggccuuaucuaauuaucuuuucuaauaaugcuucuucuauuagugauucuuaaagacuggauaauauaauugauauuuacaaguaaaauuuuagaguuagagaaaauaaagagcuacagaaaucguauuuuuacaaauguauuccuuucauuugcaucauaucuuuaagcaaaaaugagccugucucuaaagaaaagacaggaguagaugugaagacaagugauuuuugaaucaacagagaaaaaaauguugaucccaucaacaacagggaugcaggaauugauguugaucccucugaaugaugauauacuauuaaguugagccaaagaacaaaaaauuaagagcaucuuuucucuauaacuuccuuccaaaaaucaaagaaugaaauaagacaugagaaauuagaacauaaauuauuaagauggguucuacaagaccaaauguauugguagaccuagaugucuguaaaaugauuuaaaaauguguaauuuguagaaauaucuccccaaauaagcuuucagaaccaggcuaauuacacugacuaaaucuuuuugacuuguuuucuuucacucacauaaggucugccuaugguguuucaaagcccccuucaugcuuucaacuguuucugcuggagccaggauccaaguuccauucauuuagcucccauuuuaguccuuagaaugguauuuaauaacuguuaaaaaugauugaaugaaucaagcacuauaauuuuauauaugucucauaucaacaggauucuaaacacguugauuauuuuagcaguagauguaauaaacugucuugauaaacugcaucacugauccaugcuuuauuagugacaaaguuaaccaugucaacuuuuaguuauggccacagcuacuuucugcuauucuacuuuauauucauugauuauaccuugaauauaauuuuucauuagcuuaaauuuauauuaucaacgaaacaagaaauuaauuaggcugacagauaaaaucagaggauagaagaauuaucaggacacuuguuaguuacauuaagauaaaacguuuuagacuuuugcccauacagacauuuugguugagcuuuuaaaaauacugccauucccuguguuuccaacuuaaagauggcucaaaccuuaaaccacuaauuuaauuuuuggcacacugaauaaaaacugggaauuccgaaaucugugccaaugaugguauuguggcucugaugaagagucaggggaaagaguggggaggaaacugugaguaaaguucucaaaugcccaaucauuucagcaccucauaauuugugcugaugaaaaauaccacaguuaugcugcccgaguuugcagaauaaauagcuuugauuuccauuacuauccauguuucuauuugaauaacaaagacuugcuuuaccugauuugaagaauagucacucuggucaaucuggugaaacaauugguaaguguaguugacauaauaugcaugaacgcuuuuuaaaaaguaagugcuauaaagacucaaggaauuauuuauuaaauuguuauauauaaugauaaaaacuuauccaacuugaagauucauuaaauuguuccaaauaagucaaaaaauguggaaaagagaagcuaauaauagauauugaugacuuucacaaauucgcuaucauagauaacuagcucuuaucuauggaaauaggcuuuggugauaacauggaaaaaugaaaaugcagaucuauguaugaauuaauuuugauaaaaauauaaucuuuuuacaaagcaaaauuaucacauuuggauuuuucucuacuauuucuuauuauguacuuaaaguaguagaaauaacaauaaugagaaggugcuaaugauuaagagagagaguaugggugacggacagaaauaaugaaagacaauauucuguuuuuaaacuaugauuuugaaaacgugaauuguaauuacuggauaacauccaucuacuucuauaggguaaauuaagauggguuauauuccuuaguagaggaaaaucuagauucauuuuguaacacaagaguagaaacaguaauuggcacaagaccaagcucaaggaaaagacuuuauagcuagaaauuugcuaucaucugaauguuuauaucugccccaaauuuauaugucaaaacuuaaucccaaaugugaugauauuaagagguggggucauuggugggugauuagaucaugaguacagagcucuccuggaugggauaagugcccuuauaaaauaggcucaaggaacaucauuggccccuuccaccaugagccgauacaguuagaagauguccucuuugaggaacaggcgcuccucagacaccaaaucugccagcaccuuaaucuuggacuuuccagccuucagagcugugagaaauaaauauuuguuguuuaugagccacacaguuuauuauauguuguuguaacagccugacugaacuaagacagaaacauagauacagauaaauauagauauagguagagacagauagauagauagauaaccaaguugauuuugacaucuuuugaagaauuuaaauaguuucaguguuagaggugacugccugaauguggaugugaauaucuacagaccacacaaauacuuacgggaucuaaaauacaguuucacacuuuuaacuauccucugaauuuacauuuucuguucaauaaaagcuguauuauacauuaugcagauauuuaaaucaguaccuauaacuucugcauuauuaauaugugaaugccagauauccaaaaaaauacauccacuucacuuugccuuuuaccaugggaugugaaaaagugauaaucaccauuccaagaauuucuacuaguggauuuugacuucuuuccucuuuguauuucaguuugggaaauuucuaaugacauaucuucaaacucauugauucuuucuuuaucuguguccagucuacugaugaacucaucaaaggcauuuuugcauuucuguuacagugguuuugaucuuuaccauuuccucuuuauuccuucuuagcacuuucauuuuucugcuuaaauuuuucaucuguucuugcguguuuuccauagagcccuuaacauauucaucauuguuauuuuaaauucugucuguuaauuccaaaaccugugucauaucugagucuaguucugaugcgugcuuuuucucuucaaaacauguuauuuuguuguugcuuuuuagcauuccucuuauuuuauugauauuuuuacuugagauguaaucauuguacauauuuaugaaauacagcauaauauuucaguagguaugucaugugucaaaucaggguaauuagcauaucuaucacuucaaauacacacucauaauuuccuuguguuggaaacauucaaaauccucucuucuagguauuggaaaauauacuaaauuauuguuaccuauaguuaaccuacagacuaugaaugccagcacuuauacuuccccaucuaacuguaaccuuacccuuuccagucucuaguaacuacuauucuacuccuuuguaauuuuuuguugaaagccagaaggaguguaucaguugaaaugaacugaaguaaauaggcccuaaaaauaaucuaacuccuagccagacuaacauaaaaccacacauuaauguuuaaugauuguuauaguaguauaugucagagaccaacguuaacuaguguccuuguuuugucuccacuguuguuuuugugcuuccuuaacaauucuuccuuaaauagagccuacaucuggcauucuuugcguuguaauucacugcugucauacuggagcccuuuuggccugccauuaauguguacgugguagagagguauucuuuaaucuuaugauuaggucauucaggaaggcuagaagauguuagggaaugccuuuccuguaggccagauaaggcugagguaaagucuuuucccuugcaguggaggccuuugucauggagauugcuccagguguauuucacaaagguuauuuuccucucccucucucagagccuggagaggauuuuggcucuucauugugagauucauuuggaaaucccaagaaaaugugagagguccuccaagacugcauccuuuacaaguuucucacucucauccuaguucacaaucagcuucaacaauucaugaaaguuacuaauuuaaauguuccuaccaguuucuggcucaaagaaaagugauuaauuacaaguuguucuucuguuuccuuguuucaaagacagcaguaacuacuuccaagcucuuuuuuuuuuuuuuugaaaacgagagucuugcuauguuuaccaguguuaaagcaaacuaaauauggccugagaaggacuccauacuucuauauuugaguuauugcggaugaacuguaaccuagcuuaauaggcagacaagauugaaaaucuaacuuaagaguaugugccuguaacaguagcugagcugagccuuggccaaucccaguggccauacuucaaccacucauagacugcuaaguguucaaacuguguucaaauaaggcaaacaccaaccuguaaccaauacagcuguuucuguaccucaccgccgauuuccuuuuuuuugucuauaaauuaguucugaccaugaagcaucucuggagucucacucaaucugcugugauucuggggguugccugauuugugaaucauucauugcucaauuaaacuccuuuaaauuuaauuuggcugaaguuucucuuuuaacaccagaccucaaguauuccucccuuuucagccucuuaaguagcuaggauuacaggcacaagccacugugcccagcuaagcacuuuacauuuuguagcuaaaaccagaauuuccauauguggcuauuuaaauuuaaauuguaaaccaaaaaguaccugagacaaaucucgaucaauuuaggaguuuauuuugccaagguuaauaacaugccugugacacaaccucaggagauccugacaauauaugcccaagguggucaagcuacaguuuggcuuuauacauuuuagggagacauaugacaucaaucaauacauguaaaaugugcuuugguucaggaugcagaaccucagugcaacucuauguuggggauggggguuggcccuccaggucuuagguguauucaaagauuuucugaauagcaauuggaugaaagaguuucucuaaagaccuggaaucaauagaagggaguuucuggguuaagauaaacaguuuuggagauccagguucuuuuuuuuuuuuuuuuuuuuugagacggagucuugcucucuuucgcccaggccggagugcaguggcgcgaucucagcucacugcaaccuccgccuccuggguucacgccauucuccugccucagccuccugaguagcugggacuacaggcgccugccaccgcucccggcuaauuuuuuguauuuguagcagagaugggguuucaccguguuagccaggauggucucaaccuccugaccucgugauccacccaccuuggccucccaaagugcuaggauuacaggcgugagccacauuauuccagguagcaggcuucagaaagaauagacuguaaaagcuucuuaucagaccugaagagucugcucugucagucuuaagaucgcaguuuuaauguuaauguuggucagcuaugcccaaauuccaaagaaaggaaggcaaaaugaggcaugucugaccacucauucccaucauggccugaacucguguuucugguuuauuuuagaauguccuuguccaagaggagggauccauucaguugguuggggaggcuuagaauuuuauuuuugguuuccaaaacuauguaaaguuaaguaaaauuuaaaaguuuguuucuuggucacacuagccauauuucagauguucaauagccauguauggcuagugguuucuguaugagacagugguuucuguaugaacauuuccaucauuacaggaauuucuauuagucagagaugggcuagaggaauucucuaaagaaaucucauggggcaacuagaaucacaagacaaaaugggucaguauaaaguaagaucuuuuagagugauguaagucuuugucucagauucacuaaaugaugagagaaaauucacaauagaggauaacuagaguugacucacaggcugggaguggugguucacaccuguaaucccagcacuuugggaggcugaggccagcggaucaccugaggucaggaguucgagaccagccugacaaacauggagaaaccccgucucuacuaaaaauacaaaauuagccggucgugauggugggcaccuguaaucccagcuauucgggaggcugaggcaggggaauugcuugaaccagggagguggaaguugcagugagccaagaucacaccacugcacuccagccugggugacagagcgagacuccaucucaaaaagaaaaaaaaagagucgauucacaauagucuucaguuauaaagauaaaaagugaucucuccuuuauuauagcaauuagcccuagguuaaaaaaaaaaaaaagacccaacccaaugcaaagaccuuuauauuuucauaauauagcuaaagccaaacuuggauuuucugcaagugacugucacuugugcauuuaaaacuugagucucgcucugucaucugucacccaggcuggaaugcaguggcgugaucucggcucacugcaaccuccaccucccaggcucaagccauucuugugccucagccuccgaaauagcugggauuacaggugugcaccaccaugccugguuaauuuuuguauuuuuagucgagacggaguuuugccauguugcccaggcuggucuuggacucuugaccucaagugauccaccagccucaaccucccagagugcugggauuacaggugugaggcaccacacuuggccuuguuuuuauauuauucuguauauuuuuccugucagacaaaggucugagaauuagcuacuaaaauucuagcuucggcuugugguuuugaguguguaaaaaaaucccccaaggacauauggugauucagccccaggaauuauuuaauuucaaaagcauauaaucuaaaauaaaaguaaaaauuuuuaaaacaaaagagagagagagagcacacacacaauucacuugcuucagaaacaauaaaaaaaaaagaaaaugagaucuucuguacuuuuaauauuaaagaacgucauauaagugucaggcuuaauggcugaaaucuuucagguaauuauacugccaggacaguuaaauaugauaauguaauguuagaccugagaagcauaguaauguuggcauagucuauacauugucaguuguucaaacauuaucuuacuaguguaauacagcaguuaaaaauaucuuuuuauuuuuuucuuaauaauguuauauauaacuguauuuaaaaaugccaauaugcugcucugaguuccucacaggagccacaaguuuuuacuuugaacaaucuguuuuuuaaauugaagguuaaaauuagagguuuaccauuuugccuuugaucuuuuacuuuuaucagaaaguaagcgccauuaauucuggaaugccauugguugaagaaaauaaaauauuuccuauacuuuuuuuaaaaugugacauuuggacaaaaugugauacuuauuaguaagaggcaauaaauguaugucgcacuacauaguugccccucaguaucccuuggggcuugguuuaaggaucucccacugauauaaaaaucuaugcaugcucaagagucuguuguaaaaugguauaguuuuugucauuguauacauuguacuauuuguauauaaccccugcacauccucccauacucuuuaaaucaucuuuagauuacuuaucauacccaacaccauguaaaugcuaugugaauaguugucauacugcaucauuuagggaauaaugauaaggaaaaaaaguuuguagauguucauucaguacagaugcauuuuuuaaaaaauauucucaauccacugucaguugaauccauggaugcaaaaccauggauacaggggguugacuguacauuaacuuuguaacuuuuuacucucugauuaaaugcuuucauuacugagacuuccuaaaauaaauuccugaaaauguaaaaugguuauuuuaaguuugagagaagcaauguaauuaagaauaauuuaaagucuauuucugggacuggaaguuauuggaugugauccuuaaucccuaauaagcaacuauguaucuucaaauauugaaaauugaaaauaauaauaaagaucuugaaaaugucuaaaucaaaugccuuggccaaccugauggcaaauauguguagaaaucaauaaagccaauaaugagcaaagaugcaaagaaggaaacaacaguaauaucauaagaucucccuccacuugcagcaucacaagguggagggguaauauggaaauugcaaauauagcuaauguuuauuaaucauuuacacguaccaggcaccaaacuaauuauucauucauucacucaacaaacauuuaugaagcacuuacugugugccagaaaaugucuagacaugugggacacuucagaugagcaaagcagacaaggauuucuguccucuuguaguuucuauuuuaguagaagccacauaaauaaguaaauaaugaugucaaaaguacuaaggauaauaaaaagaguagaguaaggaauucagagggugccaaguagaggagacuaguugcaacuugaaaucuaugggccucauugagaagguaacuuuugaacaaaagugugggagagaagagugcuccagguagagacaauagcuuguacgugaccuaggguggagagugcuacugugcucaagaugcuacauggaagccacuguggccauaaacgaguggccagggaacugggggaaaagagaaugaagaagaggucagagaagucacugaaggcgagacuauaaauauaaguugaagauagagccaacuguauuuccugcuaauuggauacacacgcaagagaaggaguggaguccaccauauaucccaagauuauagcuugagcaacugaaaggaugaaauugccaucagguaagauagagaaagaaacaaguggagaagacuggguagaacauugaauuucaauuuuucuuuuaucugaaaauaaauuugagauuugaugagcuuuauuugaugauuuuucaugaauuugagaugucugugggaaguccaaauggaaggaucaagcaggcaucuucauauaugagucuagaguucaggagugaucugcucuggagauacauaauugguaacuuugcacauauauguggaacaaaauugggugugugaaccagguacuaaggucugggacaccugaaccuugacugauaaagaagaaugggaguuaccaagaacggagcagagaaagagugaucagaaagggagaaaacuaagagaagguggcaucuugaccuaagagcagaaaguauaugaaggacaagggaagaaagcaaucacaucaaacaccauucguaaguaaaggaagagugaauaagaugaagacugagaauugaccauuaaacuugggaaauagaagaguuucaugaaguagcaagggaaaauggcugauuagaagguauguaauaggaauagaaguagaaaaagugaagaaagugaacauguagacaauuaguucagagaguuuugcugcaaagugaaauacaagaguaaaucaguagauggcagggaaguggagucaagagaaguuugaugacuuauuuuaagaugagagauaucuuuguauugugaugggaauaaucccacagaaagugaaaaaaauaaaugauaacagaagggggcucaauauuuuuuaauagucaagaggugaugggacuuacuguacaaaucaaggaauuggcucucauaggaauaaagcuuauccuaccuaucgcaacaggcaggaaagcauggcauauggguacagaugcugcuaggucugaacagaagggaguagaagcauauauguggaauaaaaguggguugacguucuguucuuuacauauaucauuagcagucaacaugcccagcaacuggggaaaccaaugaguaccaaggcgcugaaggagggagcugggugaugcccuacacuguccacuacagugacuuaccaaguagugaguaacuaaucugcugaugggcaauuuaauauugccuacagaaauucugaugaauaugaagcaaauacgcugauauuaauucuaacuucaaaguaagcugggcugaugauuucaguuguauuuuacauucauuucccaauuaaauacaguaaaauaaugucauuaucauggaggauaagguuauuugagaguucagugaaaucuugcaaauaaagaacucagcauaguuauggcacauaguaaguacucaaugaaucucagguauaaguuaaaugaaacaaucauaauucucagaaaguaacaauuuauuuuucauuauugcuagguguggagggagugguuuuguugcuaauaguguuuuguuuuuauauugggggaggucucgacugaagaucagaauuagacuuaucucucaggaaaaaguuuuauuuauuggugauguguauaaucauuuuaaauguaagucuuucgcucuuuagguuuuuuaaaaucaaagaacuauucuaaaguacuucggcaguauaauuaagccuuuguuucucucuuauucaaaucucuuuuaaaugcucuguguuuaccaaauuucucucuuuugcuccuuaaaauuguuuauuauuuugacucauuuggcgaaauuuaaagaaauaauuuuucuccuuuugaaaagaaagguaaauuaauuucuuauggcaaagaugagugagagguuaauuuugccaaccaaagaaauuuggagaaaacuugagugagugauuucuuucauuagccugugaacagguuauuuauuucacauguaauuauaaaacaaguaauucugaauaaaaccaacccugaaaacaaauaggacucauuugcaguucuaacugaauuagauacugaaaaaugcuugcauucugauauguuuugaaaagucuaaugaaauuauaaauauaauauuucagagaaggaaaugugcagagacagcauaacaagaagcucaauuucacuuugccauucgaaacuuuucuuaccuauaaguuggugaugugaaauaauucaggaaaauugaguuucaacccaaauaucaugagguugcuaaguauauguaguuuauaaugugcacaguaggucaaaucgauauugugauccuuagaguuaaauguuuuauuggauaaaugcagaaacccaaguuugacucuaacagaaguuuaaaauaaguuauaaauaagauuuaauguuaacagcagggauuuuuucuaaccauaaacugaaaaauauacccauauuaauaaguuaggauuauguacaacaauauaucaaaaucaaacuguccuuuuuuuucuuccaaaagaauagccaaugaacuaguuagagcuaguuaaaucagaauaaaaucccuuucacacacacacacacacacacacacacaauugaauaguaauaaaauaagaaaauaauguuacugucacuuagaaucauugccuucuagguugaaaacaaugguuuuccuaugauaucuucauaaguuaauacaaaucaauaaaguauauaauaaugacaaaagaaccacuguccugguauuagaaagaaauaucuuuuucuaacucuccauucauacaacauauuuuaaacccuggagaaugggacauuuggggauugugcucugagucaaguagaaauucaaagaaaauuccagugauaaaacaaacugucccacuuucucuaaguuacucauaacagugauuuaguacauaaaugaaguaacugucuacacuuuugaggacaacauguaguucacucauucugcuuuuuucccccuuucuuucccuacauucucacuguuucagcuguaguacuuuugaaagcagggucugagacaaagacuugauugccaaucauuuggaggagcauacaauccuaagaaacagaagugcagaacagggcaagugaaaaugaaaaggggcaauaacugauuccagaaugcauuuucaaguuggcaaccaaacaggugacugagacucaagcccauggcacauucugaggaggcuucagagcuguuuuccuggaggaugaaagaugaaagcauuuaucugucaguuccaacccgcauuuggaugagagugacuccucagacauuaacugcccugcucuucuggguugcucaugcaugaguacguugcaggagcucaauaauguucuucacucaaggcaguaagcaguuggcuuguagcccaagaaaaggcacuguuggguuccaacugccacagcuaguggagggcugaauggaggccaucacaccacauaaacaggggcuggaguucccaguaaggcuuagagaauggugaaaugggacacaauaguugucugagacgcucuuccuccucuuguaaucuagacuccuucaagcuccuccacuuauggcucacaaacauuuugcuuuuguugcuccgugcauaccaaggugauuuuaucucaaugcaugacucuuauuuuucuggagcaggauaaaaacaaaauagugauaucuuuaaccuaaaguauguaaaaauucuaaauagcagcuuuagaaagggcccaugcagcaaaacuuugaauccuucuaccuuauucaagacuuuccaucaccucaugggauuucuacucuugguucccuucauucauccuaacccuaacccuuaaguuagucaaguguccugaaacaccauccuacccgcaucuugaauuaccuagcagaauaaagaauuugucuaauauguaagaccuuuuaugguucacuacuguuuugcaauucuuaugguagaauguauuuccuccaaacaucagugucuuaguucaggcugcuguaacaaauuaucauagacugggagacuuaaaccacagaaauuuauuucuaagaguuccaggggcuggaaguucaagaucagggugugagcuuguucagguucuggugaaggaucucuucuguuuguauccucacaugguggaaagaguuccugggauccuuaucacaaggcacuaauucuauuuaugggagagggggcuucauucucaggaccuaaugaauuccccaaaucccaaccuccuaauaccaaaacacugggggucaggauuucaacauauaaauuugggagagcgggacacaaacauucaguccauuguaaucugcgugagcuaacuugaaugaaaaauuucuuuuaacauuuuuguuggaaacauugacauuuacaaccauauacauuuuucauaucauuuuauuuuugccaaaaugcuuaguaaugauucuacaugggucugaauacaauuucaggugauuguuguuacaucuuuuuggaaaucauugcuaccacacuugagagauguuuaguuuauuagauacuugaccccuguaaauuuuugccccuuucuaggaaauuagggucuuaguagaguguggguuucuacaucauaccaccaguguuuagagauugcugccaaaagucaagacaaggaggaaaggaagcccguuauugaaaaaaaaaacuggacaaacacuaaaaguuuaaggcugacgaguagcagcaaacaaacagguucuucaucaaaacaaaagauugucugcacaauacauugacaaacaugcacaaaauucucauuuguccaaaaagauuggcacuuuggaggacaaaauaaagagauagguucucaaucuugaagggagcacuuuauacucugaggacauaagagagccauguacaaacauuuacauaacuuagaauuaggugugaagguucccuguaccauugaaaaaauuuuaaaaacagaaacauuuuuauaaggcuggagucaaaaugaaugguuuuauggauuuagaggaagacuuguagaaaaugggaggugugaauuugggcugguggaaaaggccagaaaaugcauuucuugugaggaauaguacaugaguaauuacacagacacacauuauucuguccagucacaauggcauuuuuccauuucccugaguuccucucugcugauuuuucuucagauauuugaggugcuggcucccacuugucauuuaagucuugccuuaagaaugccugugucaucuuacuuauguagacacuagucucucuguagaauuaugccuuauuuuauuuuccucaaaggacuugccuuaacugauauugucuuguuuacuuucuuguguuuauuuugucugccauucuccacuaaaauguuagcuacaugagagaagagaacuuuuccaucuuuaccugcuguucaacagcaauuugaacaguacucaacauaaaguucacgacugaucauauuucuuggauaaguuggagaauguaucacacaucgucauaugaccuugccucuuccauggcaagaauugggccuucaguauguucuuuucucacucucucuauuaacuagagguuuccuugauucauauucuuuuuucauuuaaacucuauucaacaaaaaaaagaaaaaacuggugacuauuuuaucagauaaaauacucuuacaucugucuuauaaagguaagaauuuggcaagaugaaacaucuugucuuuuauauuuacaauaugcuaaauaugauaauucaaaauguauuauggacauuuaaaauaaaaaucacacaaauuuuuuuucucuaauacugucuaucuccuaagaucugcugcuaucuucuuacagcuuugcuaaaagaguuuugaauuuuaaauuaaaugugacagccauauuguugucauuaaaauuuucuauuaaaaaaccauuuugcauaacaaaauaguuaauaauuuauuuguguugauuguuuuuuaguuuuuauaaaaaggaaugugaaauuuuauuauaugaaucaagauuaagaaaaauacaagaaguauuuaggacuucuaaaaugaggaauuugcuccagugguugagacaggaaauaugcaauccuguggcccaguaauuccuucauggguuuugcagucacagaccacuucaagcccuacuuuagaaauucacaagcaacacuuuaaagagaugugauuaaauaaauacaaacuuuucaccacuccuguaaaaugacucaaaauuaauguccuaacaauuccagcuuuguauuuaagggcagcacauuauuauagagauguuaaagaaacuuagauuauuauuaaagaaaugugaacugaggauuacuaauaacuguuuucaagcauauaaaaagugcuguaaaaaugguugaccagauguuuuccaucuacauggggacagaaucaaauuaaaugauggcaaauuauaauaagaaagaaguaaauuacaccuaaaaauaaaaaaacauccccacuggauaagauuauagauuggcacagucaucuuucaccaguuaaguacagcaauacuugcaggcagagaaugaagagacaauaccuaccaggauuuuucuucuggcagaaauagacacaggggucucuaaauaagaggcucacuauuaccacgauaacaaaauacacacauuauggucuuguuuucccccaguucaucauugugcuuuuauuuggaaccaggaaaagaaacaauaaagugaacugagaaagugugacuagguuagaaagguugaagaagauggaaauaaaugaaggaagauaagaaugcacaguuaggaaguaaauaauaguaaacucaaagacuuuuucaauacauaacaguucugaaguccuaaacugaugaccuagaaaacaucacaaaccaaagcuccuugaaauucaaugcaauccauuucauauaugugcauuuagaaaaaaucaucagauucuaaagcauucaucuaucccaaagggguggcugacuucaaaaaguuucaggaucuuagacuaaacauugcuguggacuaaauaauaguguugcuauuccgaucacgauuuuaccuuaauaauuaggcauuagcuagauugaagacuuuuuuuuuuuuuccuggagcuggacugagaaaauguccucagcaagauaucaagugucuuucaagaacuauuuaaagcuaaaggaauaucuuguggcucccaguuaccagacauuacaguuuaggagagaaauguuggagcucauuaaagagaaagaaacagugcuucuccaaguccauggccccgucaccugcuucuccuucccaguagaacauuuagcucugucuuuacugaguaaagguaaggcuuuguauuuuuguuuccuaucugucucauuccaucuuuuaucucaacaaaauacauccccaauacuacauugucugcuaauaaauguguaagcuauauggucacuuugaaagaaacagagaaaaauuaauggucucgaugcuaaauauauaaaucaaauaccaaauauuauaccuauucgguggcuagcugugauacuuauguaaauacaaaugccauggggcaccuaguuuaauguagauuuaauaggcauguacauugaaaauauagaguuucuuguuuaaaacuacucugcccuucuaccugagccucaaauauuaugaaaaaauaaguaaaugaaugcacauuacacuuuaaaauaaauuuuaccuggugcuauaaaccagcgauugcaaacuuucuauagggggccagagagcaaauauuuuaggcuaugugggccauucagucuguaaugguuaauuuuagaugucaacuuaaugagauuaagggauacccagauagaugguaaagcauuguuucuggggaugucuguuuugaggguguuuucagaagagacuggcuuuucaucaauggauucaguaaggaagaucugcucucaccaacgugacugggcacuaacaaauuugcugagggcccagacagaacaaaaagcagaggaaagaagaauucacucucucucucucccuucuggagcugagacauucagcuucuccugcuuuuggacaucagaacuccaggaucuccagccuucagacuccagggcuugcgccccuucccucucuaccuucagccuuggaccgagaguuacauggcccacucccugguucucaggcuuugcacuuggaccgagccacacuauugguuucccugguucuccagccuguggaccucauacugugggauuucagcccuccauaaucacauaagccaacuccucuaguuaauccccuccuauuuauaucucucuacauuuauaaaauauguauuugaaauauuuuauaucauauaauauacaaugauauauaauauauguuauauuuauauauauccuauugguucuguuucuaugggaaacccuaauaugcagucuauguugcaacuacucaacucugucauuguagcacaaaagcagucauagacaauguagaaaaggguaaaucuggcuguuuuccaguaaaauauuauuuaaaaauuaggcagcagcuggauuuggccaccaggcuuauaguuugcugacuguggauuuaaacaguuccuuugggaaauuuugcuuuuucauucgcccagauauucucuccuuucaccuauuuuucuugcccaguugaaauucaagagaaugaguagaggcaucuucucaucugcuaaccucagggccaugcuuccuggcuccuugcuucuggcuugcccugcuggcuuugguucugcggccgggauaauuuguaaucugggacucuccaggaagggcacuauguggagcugccuggcugucuugguucuccucagcuccuuuggcgcuaugacuuuucaggggucuggcugugacugccgcuuagucuuaggcucugcaggucccacagcuacuucaucacauuauggcaauccccucugacaagcuuuccagcugcaucuacaucccacccauacuauacauaaaacaagggcaauuuggagaacugucucaagaucucaggugucugacuauacuguuggcucuucccaugguuugugagaggccacuucuaucuccuuuaaauauuacccuaaauuaugugauacuccucacuuagaucaaacccagagaacuucccucaauccuaaaucuugauauguuuaaaagcauuaaaauuuuuuucucuaaaaacaauugaguuuguaucuuuuacuauaugucagaaggugaaaauuacagucuucuuucucuucuuaguccuucucuaauaaaucugaauuuacuuauccuacccacccccaagguaaaauagaugacaagccagcuaggauaaaggucaugcauugagaaaguucagaaaggaaaauaauguaguuacauguuauguuaaauuuccccuacaacaguccuccuagauagguauuguuauacucaucuagaaaugaaaaaauuaagguucacagaauuugcuaaauaaagcuugaccaccugcuauauaaaaaaacagaaaaccuaucuguuucugacuacacuccuaauucucauucaaccacaauuccuggaagacaggaaguuaacuccugguaaagagcaugguuuguguuccagccccaaagccuccaaauaaaugaacuucucuccaccuuugcauggaaucacugggauuaaaugagguaaguauaguaacagcuaucuuucauccagccccuggguaagucaggcaguuucuaaacauuuagauauauuaucucauuuaauucucaaaacaauccuauaagguauuaaaauuauuaucauuuuuuuacuuaauguuacuaagguccucaauauagagucugccacauaguaaaugcuuaguaagaacuaguuauucuuaaaauuauuacucuuccauuagaauuacaccaaccaauaauauuuauacagacaucuuuuuccccagagcagaagcagucuuugauaggcagccuuuguuugcucauacugugaggaacucccauucuuaaaaggacuaaaagagcaucacacuuaagaacaaauucugggguccaccuacacugccauucuccucagcucccaugaugccagacuuugcugggugcagaggcccagaacauaauggcaguguuggaagcaggaaaaagauaggaaaggauguguaccaggauggccaagacaagccacugggucaauucaauauccaggcacgauuuuucccuuuugaauuuacauuuguuuaaguuuuaauccuaacccacuugaugaauucaauuugaauucauuuugaauucuuaauaucacaacguauuuccucauuuuaugaaaaggggagacacuguauuauggaagaagucuuggcccagaagcuaauauaugugguuugucauuucuauugugccacuaaauaugugauauuagcacuaaucgaaauuuuauguaucuauuugaaaauacaaucaaacuauauaauaaggcuauaagacuagauguucauaaagauaccucccagagaaaaauugucuuuugaauauuuucuauuguccucggcucaaaugcuaaugagucucuucgucuuuagucaacauaagacuugaaauuguuuccauuggcaaccaccucacaauuauuaguuaaagagaaaccagcucuaggcuuugaauaauccaucauuuuuagaauuauuuauggguuucaauuccucauuugauuuucuuuuuaacugaaauauaaauggaaggaauaugaacuguaguaucuaagggucuucuuuaccuaucauuauguuaaucauuuaauauaauaaacacagagauauccacuucccaucucccuuuugcacugugccaauauuugcuucacaucagcauucacuauuugcaauccauaaaaucacauggugaaaaaaaauauguccuuuuucuuuaaggaucucauuaauacuuugauuucacaguuaucaacuacaaaaaaaaacaccuuuuguaguuucugucauuuugggauuucgaaagaaucugggucuuauuuuauaccacaagaagcagaaaccucauucucucaaugcaaugaaauuguuauagcuguaaauauauaguuauugggaucuuagguauagucaucccguauuguauaugaccauagaagauucguccuucuucauuccaaacaaaccaagaaaaaaacuaucagguuagaauguuugauugaacuuucaugcauucauuuuuuauauuuauuuguucaauacauauuuacucauuuaguagauauuuaugucucccguguaccagaaauugugcuaaguacaaagaauagaaagucaaaacaaauuugguucaugccuccauggagcuuaugguuuaauaggggagaaacacaggcaaaucaauuauagugucauuauaaugcaagugcuaugucaaagagaugcacagcagcuaugggagcacagaggaggaacaucuuucuuacuaagacaaaaucuuucaaagguauuuauuauucaacaggauuuauauguuacuuuaacaauuuuuuuugcuuaugcauuauuuaagagggauacuauucaaaacacuauguuacauaaauacaugaacuuaaaaauauuuagugaacauuuguuauaugcaaaguuuugguuaaguuaccuugcuggcugaaagaaaagauggaauucuuauacauaagaacaauaaaaauuaagaaaaugauaaugagugaaaaucacuuauucccaaagagaacaccugaaaaaaaauauguuuucagaaauugaaggucaaagaggggcaaaguacaucagagaaaaugaguuucuuaaucucguacagccagauuugccuacugaacacacagcuuaugacaaaauaauugugcaguaauuacucuaaaagaugagacaaaaucaaguuaaaauggagcaaauugccuuuugcauuguggccaaugacaauuagugacacauucaugcuguaaaauaccacuuucuuuuugugagaggugaccuauugcucgaugguuaaguaacuagguuacuucauggaaaaucuucugcaauccugucucucagaggaaaugcaaaguuuauuauugcuacugcuuugguggcaauuucauauucaauaaugaaacaaguauacaucuuaagucaugcaaguguaagugcaacaauuuuucccggucauguuuacugaguguuugcuauguccagggacuaucccagguuacuuacauguaucaauucauuuuacaugcacaaaucuagcauaguggcauuuuucucaguuuuuagaugaauaacugagacauggaagguuggggauguugcccaaaaguuucacagagagccagauguagauccaugauuugaaaccaggcaugcuguguccagaguaaguguugucagacagaauaaugugccaugugccccacauaguccagaaaccaguggauggucuuccuguuuacauuuuuuaaauguaagugaaggguuuuuugguuuuauuauuauuuuuaauuaacauauaauaauguacauauuuauggaguacagugugauauuuuaacacaugcauacuuuuguaucaauucaccaaccuuuggcuaucccccugccaccaacacucuccuaccucuaguaaccacuauucugcucucugcuucuguaagaacaacuuucuuagcuucuacauaugaaugagaacauacaguauuuaucuuuuggugcccaacuuaugucacuuaaugucuuccaagcucagaauuuguucuuuucuauggcuaaacaguauucuauuguguauauuuucuuuauccauucauuuguugauggacgcuuagguuaauucuauaucuugguuauuguaaauaaaaaugaaauuuuucuugaugacuuaagcaaaugcucccaacuuacuguuaaguaaaagaaaaaaaaaagaaaagcaggagaaaagagaucuuuaccuacugguucucauuacuguuuuuaaaaauaacauacauaguuagucauugaaaguagauagguaaauauauaguuaagauaaggaaauagaucuauacaguaaaggcuagaaauuguuauuaauucugugaguugaaguauagacugcuuucauuuacuuauguguguauuuucaaaaucguauacaauaaacauuaaguuaauauaaaaaucacauugucauaucagacucacuucaaugaaagacuguguccaguaucaagcuuuaccuguaguuuaaggauccaaucaaugaagaggcaagaagagaucuaaaacauccuacuagcuuccacagcccucuuuuucacauuagaacacauagucucugguugagaauaauagaagucuacaaugucaccuuacccaauaggaagcauuuauguuauaaggcaucuccauuuuauuuuuuuucuucauaguucuuuuuuaauuuuuuuuucauagguuauugggggaacaggugguguuugguuacaugaguaaguuauuuagugaugauuugugagauuuuggugcacaaaucaccaagcaguauacacugcacccuauuuguagucuuuuaucccucuccuuucucccugaguacccaaaguccauugugucauucauaugccuuugcauccucauauuuuagcucccacuuaugagugagaacauacaauguuugguuuuccacuccugaguuacuucacuaagaauaauagucucaaaucucaucuagguuucugcggaugucauuauuuuauuccuuuuuagggcugaguaguauuccaccguauauauaacccacaguuucuuuauccacuccuugauugaugggcauuuaggcugguuccacauuuuugcaauugugaauugugcuacuauaaacauucaugugcaaguaucuuuuuuguauaacaacuacuuuuuucuggauagauacccgguagugggauugcuggaucaaaugguaguccuacuuuuaguucuuuaaggaaucuccacacuguuugccauagugguuguacuaguuuacauucccaccagcacuguagaaguguuuccuguucaccacauccacaccaacaucuauuaguuuuugauuuuuugauuauggacauucuugcaggaguaaggguaucaccuugugguuuugauuugcauuuccuugauuauuagugauguugagcauuuuuucauauguuuauuggacauuuguauauuucuuuugagaauugucuaguaauguccuuagcccacuuuuugauggaauuguuuuuuucuugcuaauuuguuugaguucaucuuagauucuguauauuuguccuuugucagauguauagauugugaagauguucgcuuauucuguggguugucuguuuacucugcugacuauuccuuuucccaugcaaaaggucuuuaauuuaauuaagucccagcuauuuaucuuugguuuuauugcauuugcuuuuggguucucggucaugaaauccuugccuaagccaaugucuagaggucuuuuccaauguuaucuucuugaauuuuuauaguuucaggucuuagauuuaaguccuugauccaucuugaacucagguuuaagcccuugauccaucuuguguauagcaagagaugaggauccaguuucauucuccuacauguggcuagccaauuaucccagcaccauuuguggaauaggguguccuuuccucacuuuauguuuuuguuugcuuugucgaagaucaguuggcuuguaaguauuuggguuuauuucuggguucucuauucuguucccuuggucuaugugccuauuuuuaaaccaguaccaggcuguucuggugacuauugccuuauaguauacauugaaaucagguaaugugaugccuccagauuuguucuuuuugcuuagucuugcuuccgcuaugcagacucuuuuuuggauucauaugaauuuuaggauuuuuuuucuaguucugugaagaauaaugguggcauuuuaaugggaauugcauugaauuuuuaaauuguuuuuggcaguaugguuauuuucacaauauugauucuacccauccaugagcacgggauguguuuccauuuguuuguguugucuaugauuucuuucagcaauguuuuguaguuuuccuuguagagguauuucaccuccuugguuagguauauuccuaaguauuucauuuuuuuuauuuuuuggcagcuauuguaaaagugcugaguucaugauuugauucuuagauuggucauuguuggugcauaggagagcuacugauuuguguccauuaauuuugcaucuggaaacuuugcugaauucuuuuaucaguuuuagaagcauucuggaggagucuuuaggguuuucuagguauguaaucauauaaucagcaaacagugacaguuggacuuccucuuuaucuauuuggacgcccuuuauuucuuucuccugucugauuggucugagacuuccaguacuauguugaggagaagcggugagagugggcauccuugucuuguuccaguucucagagggaaugcuuucaauuuuuccccauucaguauuacauuggcuguggguuugucauagauggcuuuuauuacauugugguauguccccucuauguugauuuuguugagaguuuuaaucauaaagggaugcuagauuuuguggaaugcuuuuucugugucuauugagaugaucaugugacuuuuguuuuuaauucuguuuauguguuguaucacauuuauuaacuugcauauguuaaaccaucccugcaucccugguaugaaaccuacuugauuaugguggauuaucuuuuugcuguguuauuggauucaguuagcuaauauuuuguuaaggaauuuugcaucuauguucuucagggauaucgggcuguaguuuucuuuuuuuguuauauccuuuccugguuuugguauuagggugauacuggcuucauagaaugauuuagggaggauucccucuuucucuaucuuguggaauagucucaauaggauuggugccaauucuucuuuucaugucugguagauuucagcugugacuccaucugguccuggacuuuguuuuguuguugguaauuuuuuauuauuaccauuucaaucucacugcuuguuuuuggucuguucaggguaucuaauucuuccugauuuaagcuaggaggguuguaucuuuacaggaauuuauccaucuccucuagcuuuucuaguuuaugcauguaaagaaguuccuaguagcuuugaaugaucuuuuguguuucugugguguaaguuguaacaucucucauuuuguuucugacugagcucauuuggauuuuucuuucuucuugguuaaucuugcuaauggucuaucaauuuuauuuaucuuuucaaagaaccaguuuuuuguuuuauauaucuuuuguuuuuuuguuuguuugucucuuucaauuucuuuuaguucugcucugaucuugguuauuuccuuucuucuucuggguuuggguuugguuuguuauuguuucucuaguuccuugaggugugaccuuagauuuacuguuugugcucuuuagauuuuucaguguaggcguuuagagcuaugaacuuuccucuuaaugcugccuuugcuguaucccagagguuuuugauacauugugucacuauugucguucaguucaaacaacuuuuaaauuuccaucuugauuucauuguugaccugaugauuauucaagagcagguuauuuaauuucuauuuauuugcaugguuuugaagguuccuucuggaguugauuuccaguuuuauucugcuguggucugagagagaagcaucucuauuuuauacuuaagauuguuguauagcuuaugugacauucccuagugagccaugucucauaaauccaucaaaguuuagguuuguuuacaguaagcaauucuaaaucaagaacacauuucucaaaguagcucauagauagaaaugcuuuuuuuuuaagcaaacguucuuagucuguugcccugaggacccaguuguuauguuaacaaggagauuagaccaggccaccaaccuuccuuccccacucccuaggggaauccccugauaaucaaaagaagucacaggcuagcugcuuuaacuccuuccuccucaacaauauuuuuagaauuuuuuuuuuuaacagaaggaaugaaaggcgggaauaacacucaagccaucguguuuguuuugaauuggaggaaagcaagaccaacaucauuuauaauagugaaugcuucauuauaauaauacagaaaaugauauaagccuaaacaaugaaguaacaauagcaaggagagagggaaugagauuuaauaaauaucacagcauuucaauggacucaauauaguaauugacuagauguaggauuuaggcaguugaagaaauaaauaaugauuuccagucagagccuuaggcagguauaugaauaauguggcuauuuguggccacagagaaaacagaggagcaaugugugggaagauggagguucuuuaauagaagauaagagaacuucgauuuuauuuaaacucugauagaaaacaaccagugaaaacauagaaauggaugauguagcaaaaauauagaauaaucugcagaaugagguaacuuuacccauuuagauuucagaauuuaaugaggagggaucagccuuagaugugaggacagaugucuuuuccacucuggugggagggaaaaaagcaagaauguucucuuugauguauucucuucuaguggccuccauuuuuucuauuguguucacaaaauauggaacuuucuucugaguauuuagcaacuugguaaacuaaauauucacaagauuguuuauuaggaaugaaaucagagcaaaauauaagaugacccuugaggauguuccuuucagacuauggagaaagaaauggagccaaaaaauuucccgauauaagaaaaauccuccccuccaagguucgagaaauuugucucucuaagauuagugauuucucuuucuuggauauuuacuucuaaacucugccuuuccaccuuuuuucuaauaacaucauuuuccaaaaaguauguuaauuaguucauuuucagauuacucagaugcaagcugauuaaacuugccuuuuuuucuaaaaaucucuuuacuuuucucauaaucuauacuuuuaucauauuauuucuuaggcuguugacaucuuuguggcuuauuuuuucuauuucaguucuuacuaguuuguucucuuauuguaaauugaacuugaaguuucagagcuccuaauuaaccacagugauacauuuuuauuuaaucccagcaaagcuggugcuaauuaguuucccaugagcucaaaagaugaucagccugcaaaauuuggucugaugcagaaacuguugucauagcaaugccccaucuaagguaauacucucucuuugacuccugcagccuucuucuuaguauguuaacgucccugauaugcacgaugguguuuguuuuguaacuguguauuaggguucucagagaaacagaaccaacaguaaagagauuuaucauauauauagaauacauauaaaagaaauuuaucuguauagaaagagauuuauuauaagguauuggcucacacgauuaugacagcuaaaaaguuucacaaucugcugucugcaaccuggagccccacaaaagcugggagugguuugaaggccugaaacccagacaaccaauggugucaauuccauuucagaucuaagggcugagaaccaggaaaccugaggacagaagauccaugcuccaguucaaccagucaggcagacagcaaguucagccuuucucuaccuuuuuacuuuauuaaggccuuaaaauggguugaaugaugucuacccacauuagggagggcuaucugcuuuacucaguccgccaauuuaagugcuaaucuuuuccagaaacacucucacagacacacccagaaagaauguuuaaccauucauccaggcaucccauggcccaagcaaguuaacacauaaaauuaaccaucacaaacuggaagagcaagaauuuuauguaaacauaauagcaaaagauuagaccagguuaccagccaagccuaauguuagaaaaaaggguguaggaaagagucaaggaggauaaagcaguugguuucccauggauucucuauccugcccuguaaacuggacuaaagccucuaucauuagcagauagaggaccagaaauuaagggaaauguucuggaagagaugcugugaguguuucacugaauucaaagccacugaaaccagcaagaaaguuugauucagauagucaguuuuccaacugcaacauaaagccagacuggcaacugcagaguuagaggucaaggaaccacugaauuugggauucugggcccacacauccaauagggaggagcagaaaugagcuugcaucagacagauucucagacuaguggcagccaaaugauaaagggcaaguagggugggugcagacuguaauuccuagaaaaguuuggaauccauauaaaacuccuguggucuuuuacagaaacaacuggggaaagaaaagaaauuuucagugguaagaucaacgaaggaucaaacuaucacaauauagucaguuaauaucugaccuuauauaguagcuugaugagauccagggaauuuggauuauaaaaauauacagggagggaauucuuuauuuuguuuuaagugauuaaaauaaauauuuuaaaauuaucaacugaugguguuguguggaaaacucugggacauaagugaaauguuuacuuacauucuuucuuaucucuccccuuauuguuuuuaggcaacuugguuuuuugagguuaguuaauuuugaaagcugacucaacaaagcagcacauaaggaauuuaucugaaagagaaugugccuaggaggggauacaacuaucacagaggccuuggaucagcaauuaaugcaucauuaauccuugauguuccuugaauuucuucauaaacaccccaauaauaaaacaaaucuagauuccuucacuguucugauucaccuuucuacacucuccugauggcacgugaccacuguuccuggccguuggcuuccagaaagagaacagacagggaaguguuggugaaucuaguuuguucuaauuaacaaugacuccagggaaauauauaucauaaaauaaauuuucauucauauaauucauagaagucuuugcaacuguuaacuggaaucuucauuuucucucucuuuuguguguguguguauguauauauauaauuuuuagagaugggaccugacuuguugcccaggcuagagugcaguggcacaaucguagcucacugcagccucgaacuccuggauucaagcaauuuuucugucucagccuccugaguagcaagcaauccugccuuggccuuccaaagugcugggauuacaggcaugagccacugcacucaguugucaacauuuauucuuaaagcaauacgugugaccugaggcagaaagauguacaccaguuuccucaucuggaaaaacugauguaauucuaacccauauuucaucugguugugagauuuaaaggaauuauuaccugcaaaaugcuuggaaccaugcuuggcauauagaaagaaauauauauauauguguguguguguguguguuuaaacacaugcacauauauuuuucauuuaacaaauauauauuauuugauauauauauauauauuuguuaaaugaacaguaagaaauacauuuuuccugaaaauuaaaugguaaaauuuauauaaaaaucuuagucuggugguuuaaacauuggaaaugcugaaugguuguuagcuccuuggucagucauaacacauacguugagagcaagaauaugacaaguaugauuuaggcacuagggacuggaaucugaguaaaaacgcccaaucuuugccuuaugagccugguuacaauugaacagagaugacaacauuaaucguauacucacacaaaucuagguaaacuugauacuguggcaaaugcugugcaaaaaugacacgugguacuauaaaauguguacuugggguuuugauuuaguguguugggggaagguugggagacuguucggggaagguugggagacugucaggaacuuuucacaagcuacugccaguagaacugagagcuaaaaagugaaaaggaauauaucaguaaagagaggagggaaucugcuccagggagaggugagggcugguggagcagcucugugagagggacaagcauggugauggagggaaugcaacauuggcaugugcugagacuggugacaaaagcuguguccccaucauccagggcuccuuaagcuacaugaagacuuuuaacauuuuuuuuuuuuaucuuauaagcaauuggaauucaucaacagcccuaaaacagaaugguaauaugugaucugugguuugaaacaucacgcuauuggaggaauccccaaauuuuaguguacaucuaauguugacagugggguguuaaagucucccauuauuauugugugggagucuaagucucuuuguaggucucuaaggacuugcuuuaugaaucugggugcuccuguauugggugcauauguauuuaggauaguuagcucuucuuguugaauugaucccuuuaccauuauauaauggccuucuuugucucuuuugaucuuuguugguuuaaagucuguuuuaucagagacuaggauugcaaccccugccuuuuuuuguuuuccauuugcuugguagaucuuccuucaucccuuuauuuugagccuaugugugucucugcaagugagauggggcuccggaauacagcacacucaugggucuugacucuuuauccauuuuaccagucugugucuuuuaauuggagcauuuagcccauuuacauuuaaaguuaauauuguuauguguaaauuugauccugucauuaugauguuagcugguuauuuugcucauuaguugaugcaguuucuuccuagcaucaauggucuuuacaauauggcauguuuuugcagugguugguaccgguuguuccuuuccauauuuauugcuucuuucaggagcucuuguagggcaggccugguggugacaaaaucucucagcauuugcuugucuauaaaggauuuuauuucuccuucacuuaugaagcuuaguuuggcuggacaugaaauucuggguugaaaauucuuuucuuuaagaauguugaauauuggcccccacucucuucuggcuuguagaguuucugccaagagaucagcuguuagucagaucggcuuccuuuuguggguaacccgaccuuucucucuggcugcccuuaacauuuuuuccuucauuucaacuuuggugaaucugauaauuaugugucuuggaguugcucuucuugaggaguaucuuuguggcauucucuguauuuccugaauuugaauguuggccugccuugcuagguuggggaaguucuccuggauaauacccugcagauuguuuuccaacuugguuccauucuccccaucacuuucacguauaccaaucagauguagauuuggucuuuccacauagucccauauuucuuggaggcuuuguucguuucuuuuuauucuuuuuucucuaaacuucucuucucacuucauuucauucauuugaucuucaaucacugguacccuuucuuccaguugaucaaaucagcuacugaagcuugugcaugcaucacauaauucuugugccaugguuuuccgcuccaucagguccuuuaaggacuucucuacacugguuauucuaguuagccauucauuuaaucuuuuuucaaggcuuuuagcuucuuugcgauggguucaaacuuucuccuuuagcucagagaaguuugaucaucugaagccuucuucucucaacuugucaaagucauucuuuguccagcuuuguucucucgcugaugaggagcugcguuccuuugaagggggagaggcacucugauuuuuagaauuuucagcuuuucugcucuguuuuuuccccaucuuugugguuuucucuaccuuuggucuuugaugauggugacauacagaugggguuuugguguggauguccuuucuguucuccuucuaacagucaagacccucagcugcauguguguuggaguuugcuggagguccacucuagacccuuuuugccuggguaucagcaguggaagcucucagaaggcaagauauaacuaagaucagagcagaacugaaggaaauagagacacaaaaaacccuucaaaaaaucaaugaauccaggagcuaguuuuuuugaaaagaucaacaaaauugauagaccacuagcaagacuaauaaagaagaaaagagagaagaaucaaauagacgcaauaaaaaauguuaaaggggauaccaccacugaucccacagaaauacaaacuacaaucagagaaugcuauaaacaccucuaugcaaauaaacuagaaaaucuagaagaaauggauaaauuccuggacacauacacccucccaagaguaaaccaggaagaaguggaauaccugaauagaccaauagcaggcucugaaauugaggcaauaauuaauagcuuaccaacuaaaaaaaguccaggaccagaaggcuucacagccgaauucuaucagagguacaaggaggagcugguaccauuccuucugcaacuauuccaaucaauagaaaaagagggaauccucccuaacucauuuuauuuugguguuauccugauaccaaagccuggcagagacacaacagaaaaagaacaucgauggaaaaauccucaauaaaauacuggcaaaccgaauccagcagcacaucaaaaagcuuaucuaacaugaccaagucggcuucaucccugggaugcaaggcugguucaacauacacaaaucaauaaacauaauccagcauauaaacagaaccaaagacaaaaaccacaugauuaucucaauagaugcagaaaaggccuuugacaaaauucaacagcccuucaugcaaaaaacucucaauaaauuagguauucaguggacguaucucaaaauaauaagagcuauuuaugacaaacccacagccaacaucacacugaaugggcaaaaacuggaagcauucccuuugaaaacuggcacaagacagagaugcccucucucaccacuccuauucaacauaguguuagaaguucuggucagggcaaucaggcaggagaaagaaauaaaggguauucaauuaggaaaagaggaagucaaauugucacuguuugcagaugacaugauuguauauuuagaaaaccccaucaucucaaccuaaaaucuccuuaagcugauagcaacuucagcaaagucucaggauacaaaaucaaugugcaaaaaucacaagcauuccuauacaccaauaacugacaaacagagagcgaaaucaugagugaacucccauucacaauugcuucaaacagaauaaaauaccuaggaauccaacuuacgagggaugugaaggaccucuucaaggacaacuacaaaccacugcuugacgaaauaaaagaggacacaaacaaauggaagaacauucgaugcucauggacaggaagaaucaauaucgugaaaauggccauacuguccaagguaauuuauagauucaaugccaucccugucaagcuaccaaugacuuucuucacagaguuggaaaaaacuacuuuaaaguucauauggaaccaaaaaagagccugcaucaccaagucaauccuaagccaaaagaacaaagcuggaggcaucacacuaccugacuucaaacuauaauacaaggcuacaguaaacaaaacagcaugguacugguaccaaaacagagauauagaccaauggaauagaacagagcccuccgaaauaaugcugcauaucuacaacuaucuaaucuuugacaaaccugacaaaaacaagcaauggggaaaggauucccuauuuaauaaauggugcugggaaaacuggcuagccauaugaagaaaccugaaacgggaucccuuccuuacacuuuauacaaaaauuaauucaagauggauuaaagacuuaaauguuagaccuaaaaccauaaaaacccuagaagaaaaccuagacaauaccauucaggacauaggcaugggcaaggacuucaugucuaaaacaccaaaagcaauggcaacaaaagccaaaauagacaaaugggaucuaauuaaacuaaagagcuucugcacagccaaagaaacuaccaucagagugaacaggcaaccuaaagaaugggaaaauuuuuugcaaucuacucaucugacaaagggcuaauauccagaaucuacaaagaacucaaucaaauuuacaagaaaaaaacaaacaaccccaucagaaagugggcgaaggaugugaacagacacuucucaaaagaagacauuuaugcagccaaaaaacagaugaaaaaaugcucaucaucacuggccaucagagaaaugcaaaucaaaacaacaaugagauaccaucucacaccaguuagaauggcaaucaugaaaaaaucaggaaacaacaagugcuggcgaggauguggagaaauaggaacacuuuuacacuguuggugggacuguaaacuaguucaaccguuguggaagacaguguggcgauuccucaaggaucuagaacuggaaauaccauuugaccuggcaauccuguuacuggguuuauaccgaaaggauuauaaaucaugcugcuauaaagacacaugcacauguauguuuauuguggcacuauucacaauagcaaagacuuggaaccaacccaaauguugaucaaugauagacuggauuaagagaauguggcacauauacaccauggaauacuaugcagccauaaaaaaggaugaguucauguccuuuguagggacauggaugaaguuggaaaccaucauucucagcgaacuaucgcaagggcgaaaaaccaaacacugcauguucucacucauaggugggaauugaacaaugagaacacuuggauacaggaaggggaacaucacacaccagggccuguaguagugucaggggagaggggagggauagcauuaggagauauaccuaauguaaaugacaaguuaaugggugcagcacaccaacauggcacauguguacauagguaacaaaccugcauguugugcacauguacccuagaacuuaaaguauaauaauaaaaaauaaaauuuaguguacgucagaacuacuuggagggcucgccaaagcauguugcuaggccucuuuccaaaguuucugauuucauaugucuggguucugguagaagaauuugccuuucuaacaggaucccagauguugcugaugcugcugaucuagugccauccuuugaggacuacugaucuacucuacugugaacaaauugaaaggaucaaaagggagcacuagguggaccacuuagaaagaaauguccgucuuccauacaagaauugauagacauuugaccuagggaaauggagagaagucuacuaauauaaggaauauuuaggagguaaaauuggcaggagucgaugcuagguuagguguggauaugaaggaaaagacgaugucaagaugucacuggguuaguugcccuaccuuaucaucuagaaugaagacauucucauuuauaaaguccaaaaggcuaguaaucuaucagcccaaaaugagaguuuuggauuuuuuuuuuuuuuaaucuguuggcugcaagggacuaaaccugacaauaaucacagaagugcuggugcugacagcuaaguuauaaaagacugcuggccucaaagggugcuggaaagcuuguucugaaaaaaugccagcaaggcaccuccuggcccugucugugguauuucccaaaggcacguggagcaugagccagguuacauuugggcucagugucagaucucauggcucuagccacagcugaagccaguaaauagagcuucuaaaguuaauaaagacagugaugaaggacuagugauugaguagagaggagagagagcagaugaaagaucaaacuaaaagaggcuaaucccugaauuuguaaagaaaauuucgaagagagagacaguagaaggugcccaaaauaaagaaauuugcaguacaggaaaagcgguaguuggcagcucucuugccaguagaaacaaacgucugaggcaaaaaugaaggaagaagaaagaauuuuaaaaagacaugcauuggacugucuaaagacaaacccacugcagaaaugaaucagggauuuauuauuaccagagagaguucugaggaauauuuaggaaaaguguuggugaucaaaauuggugucauuugguggcaacuuccucagggcuugaggaaauaaaacaaaggcuuacccuuggaaauaccagggauuauauauaaggaucuuugagaaagguucacaaacacaaauuuuauagcauuccggagaucaaccagugucuucgugccaaaaaguaaagggcauuuuucccaaaggcaagaggcauuuggcucagaauuuaauggagaaaauugugggaacuuagaggaggaaugcccauuagagagguucaauagaauuugaaguuucaagggaauuuuugaaagcgcagugaugaauauauaaaguuuuauaggacuuugagacagaauauaauuugguguauaauagcuaaagcguaaagcuuuuguuuuuaaucuugcacguguucuuagcauaaaaauuguagccaggaguaaaagcaaaauaaaacaauaaccaaaaaaaacuaaaaagauaagccacccaauuuaaauuauaagcauucauguaguauucagauuuuugcagaauccuguacuaauacuaugauagugaagaucacaaugauuauauggggagcaaauuauucuuugaaccugcauaaacagauuacuaauaguugagaaucagauaacaccaauggcuuauauaaaauaaagagauuucuuuguauuuuuaagaauuuacauauaguguuguugugggguguuuuggcuuauuugaaaauacagauaauuauggauauauuuugaaggauucaagauacauacuuuggauccuggaauauuaggggaagaagacggggaagcgauugccagugugggaauagagagguggugaucucuuuccuccccaucauaagggucauggccagcaacccucuaacaaagacagauuaauagaagaauagucuaauauaauagauggauuaauuuaaaaauuaauaacagcauaagaaacuuauuugaucauagcuuuaugcuacaugggagccuucagaauuaagacucgaagacuuaaggugaacuauucauuuuuaugcuugggauuaaugaagaauggacagucauauggaaaugugauugggcaaaaaugaucugaccuaauaauaauaaacaaaggagggacgggcgcaguggcucacgccuguaacccuggcacuuugggagguugaggcgggcagaucaugaggucaggagaucgcgaucaucccagccaacauggugaaaccccaucucuacuaaaaauacaaaaauuagcuggucguggugguguguaccuguaaucccagcuacuugggaggcugaggcaggagaaucguuugaacccggaaggcagagguuacagugagcugacaucacaccacugcacuccggccuggugacagagugagacuccaucucaaaaaaauaaaauaaaauaaaauaacaaaggggagaaauccagcaagaccagucuguuaagauucuucuuggcuucucuuuagcauuccuuccuucugguaagaggcaagaucuucucuggaaugcaggucuuaugaccuacaaucaaauaagguaggucagaaaauuucauggccaguucuuacacggaaagaugggugaaaguuguaguaauauuuuuagguuuuauuaguggccuuggaggaaaaggguucuuguuucuaugacugccuugggaaagagggauucuaguuucuacugcuugcuuuaggagauaaugaguggugaaagacaggagagcaguagaaagucagacagaaacuuuguuucugaggcugcuucugaggccuuugcuaacuuguagcucucuugccaguagaaacaaaugucugaggcaaaaaugaaagaagaaaaaagaauuuuaaaaagacaugcguuggacugucuaaagagaaacccacugcagaaaugaaucagggacuuauuauuaccagagagaguucugaggaauauuuaggaaaagugcuggugaucaaaauuggugucauuugguggcaacuuccucagggcuugaggaaauaaaacaaaggcuuacccuuggaaauaccagggauuauaucuaaggaucuuugagaaagguucacaaacacaaauuuuauagcauuccagagaucaaccagugucuucaugccaaaaguaaauggcauuucucccaaauucacccuucaauuugucagugauucauuucuugucuuuggaguugguaugaauuuaucuugaagauccacagguugaucuaaaguucuguucaaauggucuauguauuucacauauuuuuaccagcuaucaaaaaaucucauuaggaaugguuuaauaguacacauacacaaaaaaauaguaaauguacuauacagugacugucaaauguccugauccaacaaguccuaauggcauaagggaaaaucucuuccaaccccaacauccugcuaaugauguugggauaggggagguggguugaagagguagguaguggcugcaaucugggaauaaugccccaagucacaaauuacaagcucagcuauccuguuccaucuccacauuuuaagcaaguauugaacuuuguucuauagcaugcuccuguuucuuuccauuuaaaauaaggauucaauaccuaccuccaccaaaaaucaaaacuuacaguaggacugccucuccaugagggagccuccuguucuccuuaguuacacauuuuucucccuaauaccuugauauguaucugugguuggagaauuacaacucuaaucuuuuucuauuucaaguuaucuuccauucuuuaacauucaguagaguguucuuuuuuuuuccuuuuuuuuuauuauuauuguacuuuaaguuuuaggguacaugugcacaaugugcagguuaguuacauauguauacaugugccaugcugcugcgcugcacccacuaacucgucaucuagcauuagguauaucucccaaugcuaucccucccaccuccccccaccccacaacaguccccagagugugauguuccccuuccuuucuccauguguucucauuguucaauucccaucuaugagugagaauaugcaguguuugguuuuuuguucuugcaauaguuuacugagaaugaugauuuccaauuucauucaugucccuacaaaggacaugaacucauccuuuuuuauggcugcauaguauuccaugguguauaugugccacauuuucuuaauccagucuaucauuguuggacauuuggguugguuccaagucuuugcuauugcgaauaaugccgcaauaaacauacgugugcaugugucuuuauagcagcaugauuuacaguccuuuggguauauacccaguaaugcgauggcugggucaaaugguauuucuaguuccagaucccugaggaaucgccacacugacuuccacaaugguugaacuaguuuacagucccaccagcaguguaaaaguguuccuauuucuccacauccucuccagcaccuguuguuuccugacuuuuuaaugauugccauucuaacuggugugagaugguaucucauugugguuuugauuugcauuucucugauggucagugauggugagcauuuuuucauguguuuuuuggcugcauaaaugucuucuuuugagaagugucuguucguguccaguagaguguucuuaaagaacgacuggagguaaucucuuaacagaaaauugaaucaugcauaccaagucuuguuaagcagcacuuuuaacccagauucuguuauuuuuuaugguaaagucuuuaaguuacauucucucauaguacuugaaacuacuaaaaauaauugaaaagguuuaauuauccuauuuacuguuacaauuugcuuugugcuauauguuuauugcuaucucuggugagcuauaguaacacugcugcagguguuuuuaaaauagguaguauugauuaucaguauaagacauguuaaguauccaacugaauuuuagucaugaggaauaggugaaaaggauucugucaaggagaugucaauuuggccccaagaggcaaacuuuuuuugacaguuccguacaaaguagagguuacugaguaacugccccuauuauuuaguaacugacccugacagcacugaaaaauugaggggagggggugagcagagaguuaagaaggauaaccucaaguuauauaaaauauccaggaagcaugaaaacuggaaaccacacaguagaagaaacgucguuucugucuagugaucaauuccucguuuggcuaaugagagagagagagagacugagacauggaacuaaaauguucuggauagaugcuaacuuugagacaaaacagagaggcaaaacugggagauuuugcucuucuagugguaggaauagccauaugccaauuuuaaugggaguaauuccauagagagcuccaugcuaaaugcacagaggaagaaacaaaguacguauucauucauucacauuuggcuaauuuuuguauaucugguuaccuaccaagcacaguacuuguacauaguugagaugcagcaauucacccauuuauucauaugagacauacagcauuuauuaagcaucuacuacauucuggugauaaggauacagcagugaagaaaacaaagccccucacaaagcuuacauucugguaucacuaaaaugauugcauauucuggcugcaaccuggggaaucagugaucuaaaauguuaauuaucaagugcccagauucuaaagccagguggccugggcuugaaaaguauuuugugccauuaacucucugugugguuuuggacaagucacuuaaucauuuugggccucaguuucuuuaucaauaaaauggggauauaaugaguuaauagguguguguguguauaaguuaauauaagugcucagaucaguguuugacacuaauaagugccauauauaugugucagauacccuuguuaaaagaaauuaaucuaaauucaacucaucguuaaauaguucuuaauuacagaauaaaagguagagaccagggaaaucaagacaacaaaacuugagauaccaauagcaaauggauuauucacguuuguauuauuuguucaaaguagauuacagaaggaaagagagagcacaauccagugguuaagcugguuacuuguaucuguggccugcaauuuccucaucugugaagggaugagaaaagguguccuuuuuagggguucuagaaggauuaaaggaaaugauguguguaaaaugcuuggcacaaggccuggcuaagggugagcauuuauuaaaugguggcuauuucauuuauaaccugauuauauugaacugacaucauuuauuuaaugguuuuugccauugcauuucaguucaaaaaggauuuaaggaaacuuuuaaucagaguauuucuaaaaacauuaaacauuggucucacaggaagaaaacacugcaacagucagucaaaucauucauauuaaaaguuaauguuuuuccaaugaaaagagacccuuucaguaagguuuuucagucuguaaguucuggagucuagauggaauugagagauuguccaauuaaauuuauacuuaggaucaaaugcaacuaaacuuccauaaacguacucuugaaucacaucacgaucuauuucuaauauuuauuauugcugaauuuuuguauuuuugcaucuguguucauaagcacaaaugacuuuuuuuuuuuaaacaaagucauaucuugcuuggguaacaagauuauaauugaccucaugagcuaagcuucuuucuuaauuuuuguauuuuccaaaauaauuuuuaaaaaagguggaugguauuccuaauuuauugaauuguugauaucauaggaaaaccauuuagaccuaguauuugccuuuaguuguuguuguuuaugaauuccauuucuuuaacuguuaacugcugaaucagaauuuuucuuucacaaauauugguauuucuguauuuguacaaaaauacaacuauuuagucauauuucaaauuuuucaacauaaaauuacucaaaauaguuacuucaauuuuuaucuaugcuaaaucaacaauuauuugcuauuuuugguauuacauuugaauuucuuuuuucuucauuauucuugccuaaaguuugaguauuuucaaauauugugacauuauuacucauuucaaauuucuggcccuuaccuuaacauuuuuccuucuuauuuuuuuagcauuuuaccauuuuucuuuguauagcuucuugaguugaccgauuuguuaauuuucugaaaugugugcaaagcuauaauuuccuucuguuuaaauauacaacaaaauuuggcuuguagaaccuucagugucauuuaaugucauuuaauucugaauaacugaaauuuccuucauaauucuuuccugauuuucucuguauuccaaggauugauuaauaauuuagcaccuagacauauuugauauguaucuuuuguuuucauuuucuuauugacuauagaacugaaaccaacuuugacaggaagcugcaaucucugauuccaauaccuuaguucugggagugaucuagaaugcaguguccaaaaucuuuggacucacagucaagcuuugcuacucagagagucucauaugcuuuaagaaaaacuacauagcaaaagaaggugcuuuuuuuaauguucacauauauuuagguaauuaaaugaaggauaauuucucccguuuuuuggaaggaaacaucuaauguuucuaugcuaguuucugucaaaauuucaaaauacuuuaaugagucugaaauuuauaggccauauuauuuucguaagagaagcaacaugaauuucaaaugacccgugagaauuuuaucaauaaacaguuuuugcaaauauauuuuuguguucauagccauaaagaggcaugaaugccgaagagaaaaaaacuugaaaacacuuuuuucuuuaaaaaaaaagccuucacucaucuuuuuagccacaaucugcuaaaauucaugacaucaaaguuguucuucaugaaauauagcccuuuuuugagaauuuguuuauuuuuauaauaccgauaucaucuuaauacaaagaaaaacuuuuuuaaagcccuuaggcuauguaagugagaacguuuuuccaaugcaaauagaacauuugauuauuacaucuugguagauauuggauguacuaacaaauuauuaaaaguaaacaaagaaaacuguaagaaaaauauauaaauaaaaacaaaacacugugaguuuugaauuuauaaaauuugccugaguguacuuguuuuuuaaaaauguaucaaaucaagaguugccauuuuuuuaccagaugauuauacuaaugcauuugcaaacugugaagguaaauuuauaacgagaaaaacaaaaacauaacguuuuuaaaaacaguuuaguuuucuaacgaauuccaucugaaccacaaaguuaugguacagucucaauaugcgaguaaauaagugauuauaucaacugggagauguucacaaaucugaugugguuacaaaauacuaaaaauuuuagucauggcuuuagcgaugacagucuagguugugccacuuuucuacaagcaaauaaaaguagaacaguuaaggauagcauugaaaaaaacguuacuugguuugaagauaugcugguacuuuuagaagaguuuuugggaaacuuccuuuugaaagcuguuucuuggcuuugaggaaaguucuguuucucucaaugguuugauaacacugaaaaggaaaaugcaguugauuacuacuuguuuaucucauauuuaugauuuuaaauauaucuccaauauauuuaugauuuucucuucauucccaccgcuaccuccccuucugucuuucucuauuucguaggaaaaauuaugacaucaacauccaaaggaauucuucgcccauuuuuaauugucugcauuauccugggcuguuucauggcaugucuucucauuuacaucaaaccuaccaacagcuggaucuucaguccaauggaaucagccagcucugugcugaaaaugaaaaacuucuuuuccaccaaaacugauuauuuuaaugaaacuacuauucugguguggguguggccauuugggcagaccuuugaccuuacauccugccaagcaauguucaacauccaaggaugccaucucacaacggaccguucacuguacaacaaaucccaugcaguucugauccaucaccgagacaucaguugggaucugacaaauuuaccucagcaagcuaggccacccuuccagaaauggauuuggaugaauuuggaaucaccaacucacacuccccaaaagaguggcauugagcacuuguuuaaccugacucugacuuaccgccgugauucagauauccaagugccuuauggcuucuugacgguaagcacaaaucccuucguguuugaagugccaagcaaagagaaauuggugugcuggguugugaguaacuggaacccugagcaugccagagucaaguauuacaaugagcuaagcaaaagcauugaaauccauaccuacgggcaagcauuuggagaauaugucaaugauaaaaauuugauuccuaccauaucuacuuguaaauuuuaucuuuccuuugaaaauucaauccacaaggauuacaucacggaaaagcuauacaaugcuuuucuggcuggcucuguaccuguuguucugggaccaucuagggaaaacuaugagaauuauauuccagcagauucauucauucauguggaagauuauaacucucccagugagcuagcaaaguaucugaaggaagucgacaaaaacaauaaguuauaccuuaguuacuuuaacuggaggaaggauuucacuguaaaucuuccacgauuuugggaaucacaugcauguuuggcuugcgaucaugugaaaaggcaucaagaauauaagucuguugguaauuuagagaaaugguuuuggaauuaaaauuuuucaucacuugcacacuugauaaauauuuugaugagauaucauccaaguauugaggauaagaagagaugcaacauacuacuuuugugucacaauuuauuuuuaucacccucucuaggguaacguguauauuuugguggagauuuuuaaaagcucagcaugagcaaucauuccauucgguuuuaaauuauccuguauauaccuaauuaugugcacuggagaguaauuuauucuucauuaucauuuguaaacauuguuuuuucacauuuuuguaguuguccauaauguaagcuugugguuugauuauuguuuccacacugaucagcuguuuaaucuauuugggaaaugaagaugcacaucuuaaaguaugaaaaauuuucacuaaguauuacaaugucuaguuccaacuuugcauacuauaacagaggaagaacauguugcgauugaauucuaaccucuuugacuccgaagaugaaugaaguguauaacugucucuauuugaucuauuuuuuuuaccuguuuaucacauuugugaaggugaaauuauucauggagugaauaagaaagauaugaagcagaacuguucuauucgggaagcuauuagacuucucauuuauuuucauuaagcugauuugcagcuacuuauucucauggucuuaaauuaaauuauucaaguauuuuuaaauauccaauuuguugugauuuucagcaccugggaaguaaucccaauaauacuuuagaaaaucuaagacaguucuuucugcuacugaugacacucauugucauaauaaaacaaauaauuuccucaaauaacaaagaaaaaugauaccuauaaauauauuuauaaauggugucauuuaugaacaauguuuaauuauguaucaauuuaagauuuuuuucugaagcccuaauauuuaaaauggucuuauuuuaccauauggauauaagauuuggcucauaaugaugagcccuaucauuugauuugaguucuaucauuuaagagagccuaaauaaaauuaucaucaagguauuaaauauaagacguuaaauauaauaaaguggggauauauagaaaacacacaguguuagcacacaguaagaucucaaugcacauuuguuggaugaauaaauaaaugcaauugaauucccagaaaaaugauuguuucaaggaagugacaguucuacuuuagaaguacuaauuggagaugacuuuuauaucccauuuugguaauuauucauacauagcacauaugaccaugauguucagggcuuuauagaaccaaauaaaccuaccauuacaugaaaauuuugaagaguauauuccugaacuugcagcugccuauagcauucuccuccauaaggcuagaggagagcuggauauaagcagagaucguaggugaaaaaagaugggccauuaaggauucuucaaggaaaacauuccucaaaaugaucuuuagugccuuuauuccuuucaggccaauaauccacccaaaaauuagaauguucugagacauccauuugggucuauuugugacuuauucguauuacaaauugacaucagcaaaauucaaaaagaauucaguaaaaagggcauagauccagcuauccagacuaucuugugagagaauaagcucaccccagcaccagaaagauuugagcagaggaauauuccuguaaugaauagaggauuguuugauucucagguauauuucuuaagccaagauugaaugcagugucaggcacugccuuaacacccacagagauaagaugaacaagguacuaucacugccuaaaaugagcuuacaauuaaguggauagacauauaaaagcuuccuuucaauucagccugagacuguuuauaugcaugugcuacuccgaaugacguuuguaugggucaaugcugauuuaauggggaaaaaaaguagaaaauuuccccaauugcuuagcuguuugacauguuucugagcugcaaacuuugucaacucuuuugacccaacauauuauucucuccguauuaucucuucuaaccacaaugcauuaagaaauaauauuuuuauguggauguccuccucaauaaguaaagaucuccauccauauuuaauuaauugguaagacagucaaauucauacauuuacauuuacuuugucaaauuuuuuggucuauaaaaagcauagagaucuaaagaggauacacugcuaacaaguuuagaaagcaccugcuuuuuuuuauuauuauuauuuuugugauagagucuugcucugucgcccaggccggagugcaguggugcagucucggcucacugcaaccucggccucccagguucaagugauucuccuguaucagccucccgaguagcuaggauuacaggcguguaccacuaugccuggcuaguuuuuguauuuuuaguagagauggguuucacuguguuggccaggcuggucuugaacuccugaccucaaaugauccacuugccucagccucccaaagugcugggauuacagguaugagccacugugucuggcccaccuguuuuuuuugaaggcagaaaaacauucaauauuaaaagcauucaauauuauuucaaccugccuuggcucuagugaauguucaugauuugaaagaacugaaagaccuaaaggcagugucucuauuguugacuacaaauguaggcucuuuguuggacuaugacuauaaucacacacugauaauaugacgcaaguagaggcaguacuacuaaguaucuagcaggugcuuugaaaccccauuacuaagucccagaagacuguuuccuaaauuugaaguggaagaauuaaaugacucaauggaacccuuuagcuguggguccauugaugugugaguuuuagagcuggaaggaauuauaauuuuguuguuuauaauugcuauaauauagaaauuauaauugcuuuucuuucuacuuaugaguuaacuagauccagagauauuuauucaagacacacauucacacacacauacacacacacacacacacaccccacagcuagugacaauaguuaagauuuggauuuaaggauccuaucuuucuuuaucccacuuucuuuucaaucgcauucauaacuuauuauagaauuaugucucaauuuuuacaaaugugaaugucuuauugguauuuuuagggccuauagaaugguacaccucauguagaagaacuucgacuuuugaagguauacaauaaauaaaacaucaaacuuguuagcauucguucugguuuaaauauuuuaggaguugaguucagcagaaggaaaugggcuaucacuacauuuaagugaaauacaacccucaagaaaguguaugguucacagccacuccuuuaauaaauccuguggguugcaauucuuuguaagaaacucaugaaaaagauauauugauucaacaaaauugguuugcuguugauuauacaaaccaauaauuaugccuagaauuaaauuguggacacaaaaaagggaacagaccauuuaaaauguuuuauuucaaaauaucgaaaagcuauuaccuucaauacucuaaauauuuaaauauuaauuauuguagacaucaguaagaauaaauaaauguuaaucauuauagaccuuacuaauaagaauauauacugaauuguccacauccagaguauuacacccugaacaagaaagacaugagagccugacagucauauauauuaugacagcuguauaucugacaauaugaaguagaaacugaaaaaaaaaaucaucuuagugggaaacaaauacaugcuuaaaauuguuauauuuacuguaaaacuccugauaaucuuagauugugcagaaauguuucuuauuuugaggggcuuagaaagcucagcgcauuugauguauaaagcaacagaauauuuaggaauuauuugcggaggcuuuaaauucuuaccuccaauuggagguuaaauauuaaaagaauaggaaacuaugccucugauauuuuuuuugucagccuauuuuuaaacuagauuccaugagucuuaagguaauauccuagaauuuuuuuuuugcgugaauuaaaguuaccacaaauuucagguccuuaccuuaugacuguguuugaucauaucuuugaguucccuugaacucugaucucauuuugagaaacauuuugagaaacuucuuaacaauuacaaucgagcuguuaaauauaacaaacaucagaaucuaaaggauaagcacagugccuaauguacaggagggucauaucaaauacuuguugaauaaauacaugaaugugauaagugguccuguaaaauauuuuuuaagaguagugacaauguuuauugguaccaauuggagaugauauuuuauauuuauuuuguuaguuugucaccuggaugcaaaaggaaggcauuuuaauuccuuucuaucuuacaacauuguaaagcaucaaaagaaguaacaucucaagaaagauuagaaaggauuuggaucacguuaacauucuaugcaaauauuaguaacauaucaacuguuucuaaaaggaaagaaaauuaguauuuaaggagaguauaaagugcgagcacugugaagggcagauaucuauuaccaaaccacauggagagaaauauagucucucuccuaacuucauuccauuguauugcaaucagucaauuaaggugauuuuuuuuuucuggaugucucaaucuagagauuuuguagcauuuugcaaauggguaugcuucacuacuauccacaguguucuccccuuuaguaauucauauugaauauauccauauucauaugcauuuuauaaaacaguuaacagaaucuaaauaagauauagccggcuaaaucuggaaugugagugcuacccuagguuauuaguucaacaaacuaauuuugagagagccacuuaaccucucuggaccuuguuuguaagcuuucuucuagcacuauuacucuuaucuaagaucgaaauugauauaugcaugaaauuccuaauggaauuucaauguccaucucaaaguaauuuuuuaggauauuccauacagauuuccuucucauuucucuguguagauauuuaaaguaugaaauugauuauuuaaacuaauauguggaaagaaccuaauccagagcuuggaauauagaaagugcucaauuaacugacauuccuccuguauuuccucccuccccuuaguugucuaugacuuuugaacucacugcucacugacaucuuaauugccugcagaaaaaucaaucauauuuuaggcauuauuuugaaauauuuuagaguuuucuguacuauucaaacucuuauuacaaaaaucuaaagauauuuauugaugcaaaaaauuuagggagucauuggaaauaccugaggcaaucccaggcuaacaauaaaauagcauaauuuuaaguaagcuagauugaguucauuugaacauuuaguuauuuuuuagcucauaguuaacauauguccaugcauuugauuuacuuuaaaaauauuuuauuuaaaaauaaccucucaaacaccaguugcuuucugucaguuuuacucaaagcaugcuuccuaggucaccugaccuagaaucaccagaaguguuaacaauaccgauuucugggcuuugagccaugaaauuagaauuucuucaaauaauccaugcccccccgucacccaaaaaaagagcaugcuuuuaauacauuuccaaaauuauccuguuucugcuauaacuggugaaccauccuguccuaaacuagcaguucucaaacaugcauaugccuuugaaacuuccuagaucaucuacauaaaaaucauuugaaauauuguuaauaauacacagcuucugaaucucugggugugagaugggaccaggaaucuuauuuuaaaaaucuccccagaugguucugguguccugcuaguuuugagguuuucaucccaccuguuuagauggguaguauucuauuaaauaugagguauuaccuuucuuuaguucaccuggaaucuucuuaaauauaucgguaaaguauucuacuucaaaauccaagacauuuuguauaccuaauuauuucacacaagagcguggaacucaccagucuugugacuuggggcagguuauuuauagucuccagacacuuuuuccaguugcgaguugcuuauaguaguucgcgaaccugaaugcacauuagaaccaucuggagaggcuuuaaaauugcagauguccaaaccccaccuccagagagcugaucuauuuaguuugaggaagagcccagaagucuaacagguguaaauguuccacagguaauacuaaugcaggcauaccucaggaaaucaccaguucucgucuuggaggaacuauuaggaaaauaaaagauuauauaucuugaaaaaaaucucuaauuugcuuucuagguucuaacugcauguuuauauuuugcaacaggaaagacuggucuagacaauuacuaggauauaugcuucugugaucugcuuuucuauuguauguguuuaagagaccacauucuuggguuccaaagucuccuugucugauagguaauuugcaauugagauauggcaaagaauuguagcauccaaauuuuugacaacuacagauuuagaauugaauccaaggucugccauucacuagcuaugugcaaguuacucaacuucucuuauccucagauuuugcagcuguaaagcagagguagcauauuucugagaaauuauauucaggugacuagauauguguucaaguguuaucuuuuauucuuauaaaagauaauugugaggaauccagugcuauuuucacaauuuuaauucuaaaacucugaagacauuaaacaggcaguuuguaggaaucauugaaauuuuauacaagccgaaggaacaacauucagcaaaacggaaacaaauaaauacagcauggaagcauauauucauguuucccauaauuacuaaguuacggaaggggugugaggagcuggcagugguggugaauaggcauuguuugcauuacuaaauauauauaccauuucuuaagauaauuggaacucaagcaguccuaauuuucucucccuguuaugagcaaucaguaaauuuguagucaauuuaacuuauuaucaguugguauagcgcaugucacagaauaggauagcaagaagauucucagagaucauuuucugguaaagaaaaaggccuagcaauauuuaacaguuugacuuaauccaucacuucagcugguccacuaguuuugacacaggacuaguuaaugauuuguuaggaagucuccaucuacucuuaaacuaauuuaaaaaaaagcuaaaaguugcuuuuaauauguuaggguauaacuucaauaaacaggaguauuuaucuagugguucagaaauaaaauaauuguuagccagccugugauuaaggcuaccauaauugcauaauaaauagcuuugacgugaauaaucucaguuguucaaguguacaaauuuaaagcuguacuauguuagaauaaaaaaguaggcucaaggaaaauuucuauuuuucuauaugaaaaagagaaugauauucaaaauaguauuuuuaaguaguuucuaauuguguuccuuuaaagaguauuagaaaugucuguuaugucaguaacauuagaaaacuucaaaaacugauuuauuuuucugaguucucuggaaaccaaacaauuuugaauuaguuguguaaguaaaguaaguuaaguuauagcuugcuggaauuuuauuguggaaaacaaauauagauuuuaucugaaaaauuuuaagggccaauucuacagaaaguuaugcuaacaugcuaacuuuccacacauggcugcauuccauuuugauuaaugaggguucaggaaauagaaaggcagucucugcagaagcaguauccaaaggcuaaauuaacaacccaggacuaccacucauuaugugagaaauaugggccagaguuacaauaucacaucuccagucucagauuggccucauuagccaccuucaguuccuuaaaugagauaauccugaagaugccauccuuguccaaggugagauugccagaggauaugagcucaucuaggauggaauacaugucuccagggacuguaaugagaucaggcuuuucauuuacugguuuucugccucaagaguccuuaagcaaaugaagauuaucugauugucuauguaaaccuggaaguagucuacuuuuuagauaaaagauaaucuaucuugaauauuucauaugugauuuuaaaauaauuaaucaaaaaacaaagacuaucauauuugagaacaagauuuuacuuagaagggaaaaaaaagaacuuucagcuuaaucgggguuaagggaguaauugugacaauauaaaauggcauuguuauagaaucccuaaaagguaaauaauguaugagaugaagguaggaaguaaugugugcuugcagaaaugcaacuggucaaaauuacuugaaugaaauuguugagguuaaacaucuucauuauaauaauaugucuuauucugauuccaagacaauacgaauguagagaagagauuuuuaaauggaaaaaguaaggagcuaacaagucuguaccuagauucaaguucacaaagcggcaaaaaggagaaaagugucaacaagaaacaagaagaggaguaguaaacuaaggaucaaagcccaaguuccaguuuucacaaucugcuguauaauucacuaacauuucugagccauagauuuuuaaucuguaaaaggagugugauggacuguacauuagaaguaccugagaagcucuuaauaaaucuugaugaauugguuagaaauucuaauuuaauuagccuggcacagugcacaaacugccauauauucgugcagauguuuucuucuuuucuuacugcgcauuuccauguggccaugucacuacaagggguggggaagaaguuaauguguaauugcuucaggagcucugaauaaaagguugcugaagcaaaauacugcaaugaaguucugaaaaugaagaguuaggacuuuacaugauuucucuugccucauucccucaagaaugcacauauagacacacauaugccaauaucuuuuuuauguaguucaaguauaacuuugaauaaaaugacuuacauucaaggaaggucaaaacuauuauucugaaacaaaaugugacaauucuagccauuaugugaauuguaagggucaguaauccauaaauuauuuggaugguaauuguauguuuuauuaaugugauguaauuuugcacuauuguauugucauauuuaaucaaacucuuaaaaauacccugaaacauaaugccaaauguacaguuuauagguucguguuauuucugauaagaauuuaauugcauugugcuaauaguuguuuauugcuauuaacuuucuguguauguauuauugcgaugcagacccaauaggguuauuuuaagcacacuaauuagucaucuggauuuuuauagauaaaaucacauguugaucagaaaucauuuuucuacuuauuuuuuuguagaguauuuuuccacacuugaaaaaaacaugauuauuuuauaucaaacaucaacuuuucuuuaaaucuuauuuuaguagcuaaugcauguuugaaauaagauguguuagaaauuauaugacuauauuaagguuguguuuauauuaggugaaaaauugcaugcaauuggugaaucaugcagcuuuggggacauuuacacugccacucacacacaggcucugucucaauccguaugcaugauucacguccuuucaaaagucccuuuucaacauuugguaaagugaaaauguuauucauagugcuaaugagccaauaaacaaugcugcguuucuuuuuucuaacugcagcauauugugguaaauuuucucccaaaacuuuauuuuuggaguuauuguuggcaauaaauacaacaaauuauuuguuggcaagugauacaauuuacuguauaacaacuuaauaguacaaagcaugaagaugugaaaauaucaucuuaaccaguuucauucuaugaacauaauauucuggcagcuuuuucuauaacugagaaugguauaucuuuuuauacacugccuaaaucaguacuacugccagucaccugaggucaggucugcacaacacuaaauugggcaauaacauagaacaucuaggcagucuugacagucaaccaguguaaucacuaggggaagaaaaaguaggccuacccuuuuacuuauuaacuuaaguaauaaaaauuguauaaaaauaugaauguuggcugcagaggagccuuuacaugcagauaauuugaagcagucuuugaaaauaacaaaaauuauuccauuuaaugaaggguuuguuuuguuuagcuuuucucuuuuauucagaaaacauaccugugcuuuugaaagggcuuaaucccaaacagguaauauguguggaucaaucaucucuccucccaugaaauuaaucauucaugguaauauauuaaggcuggaacguagcucuuagugacuuaaaacaugacaguaagcauuuacacuguuggaagguaauuucauugcuauguuauuaaaaugaugggaauccuauuuauacauuuauuuauuuauuuauuuacagaagauugguuccuuccaguucaauuuaacagcuucagugaaguuaguauaaugauaagaaaaauugacuguagcuauuauuccaagugaaaaucaugcagcugaguccugcugcauccugggagcaaagcauuaauucaaaugaggaguagucaguccuagcacuguagacgccgacuuuaccaaccaagauaguguaugugugugacauucagcuaacauugaucuaggcacuuaguuugcuaccacauuguucccuucauugauugaaacuguaaauaacauaacacuuuaaggcagcuaagcaaauauuuuaauaagccaugaaaggcaagaugccagagaaaaucuguauauucagcuauuuggagaacucguguuuuccacaaauuaaacuggagaugucauuugaaauuuucuucccuuaaacaugcugucacaacauggauuccuucucauggaugucuuucuaggcuuauaaauauauggugugauugcuauaauuuugugaaauuuuauucagcaauuaauagugauuucagcaauauguacuaagauuccaaggcagaaauaaauguauaaaggauuugagccuguauguguaagaagaaacucucucuucagucauauuuccuaaauucaguguaaguaccucgcugauuuagcacuggaguuauuccuugaauguguaaauaaugauguucuauucugaccuaaugaauuccuguaaugugaauauuuaaaauaaaagaauucaauuuaaaugua

SEQ ID NO: 191353 - RNA, 176212 nt, Homo sapiens
cgccuuuccugcgggcguaguugcuggcugcucgggcacugggaccucggcggcuuggggacgcuggccgcgaaguagggagcgcagguggccgcucggggugagggcccugggucauggagcacuucuugcuggagguggcagccgcgccgcugcgguuaaucgcagccaagaacgagaagagccgcagugaguugggcagguucuuggccaagcagguaagacgugaagggagagggaaagcgccggaacgacugggucgccccacuaguaagcuuccugcgcucccccgccgauacucgccgcuuuaaguggggaguggugcagccucaggucaagcuggcccccuccugugggcuggcgcaggucguggagguuuccgagcguguuugaggcgauuggaaggagucuuuuguuuuuaucugggggagccuuccaguacccuucccaucgccucucaccccuaugcaagcgcuuuggcugcuuguggcagagguggccuucccaaaggaaugugguuuguuuuucugaaauugagguugcguuucugccguuuugacaaguguacguaucaccuaagugugcguagugcagccacuccuguuaguuuggggaaccaucgacaaauacugauugcauuccugcugugcguaaggaacgguguggcgcugugagaaaguggauagauaaauucguuacgaucucugccaugagggaaauuugcaucuguuuuuggagacaguucguaaacacuuacaacagcugaaguacagagcaagacagcucauacucacuguaacuaacuauacaaauuauaagguuaauuagaguuuucugggaaauaggucuucgggcuuuuaagaaccuucucauugacuccuucuaucugaguugaagacacuuuuuuuuuuuuuuugagacggagucucgcugugucgccaggcuggagugcaguggcgcgaucucggcuuacugcacccuccgccucccggguucaggcgauucuccugccucacccucucaguagcugggauuacaggcgagcgccaccaugccuagcuacuuuuuguauuuuuaguagagacgggguuucaccauguuggccaggauggucucgaucucuugaccucgugauccacccgccucagccucccaaagugcugggauuacaggcgugagccacgggacaggugaguguggucccagguacuugggucccagguguggcuaauuaaaaaaaaaauuuuuuuuuuguaguuguaaggucccccuuuguugccccgacuggucuggaaccccugggcucaagugaucaucccgccuuggccucccaaagugcagggauuguaggagugagccaccguguccggccuaaauuuuuuuuuuuuuuuuuuuuuuuuuuugagacggaggcacgcucugucguccagacuggagugcaauggcccacccucucagcucacugcaaccuccgccucucgaguucaagcgauucuucugucucaaccucccgaguaacugggauuacaggcgugcgccaccaugccuggcuaauauuuuguauuuuuaguagagacaggguuucacugugugggucaggcuggucucaaaccccugaucucaggugauccacccgccuuggccuccuaaagugcugggauuacaggcaugagccacagcgcccugcccugaaguauuuuuuuugauguaucucaagcccaauuguucuggggaguggggccaauuuugcucccagggacaaaucuggagaccuuuaugguuaucacaacuauucauuaugggggugcuacuagcaucuagugcaucaaggccagggacgcugcuaagcauucuguuauguaugggacaaccccuuacaacaguuauccgucguaaauggcaguggugcaaaauuaagaaagaaacccugccccagacugguuguuuacuuucugcucagggcuugcuauuucagcaacacuaaacugccugcaaugaccacagguuguuacccucuacuauuguugacuggagucaccucccguuguuaaugucuguuguuauugucugggccauuccuugcuguuacuugccucauugacuuugcauuuccuuuccuuagaaggcuacaucucucuucuaugcccugcucaguuaacuuguuuguucuggaagacugcuuuugaaauggucuuccccaggaagacuuuucugacuuuacccuuuccucuuccucuuaaucuuuguuucaacuaacugauucucaguaguugauugagaguauguccagagaaggggauuguguagcuguaguguccaauacagugucugauaugcaguaggcaguaaauguuuauugacuguauuaacagauuaagguacucccaaauugugauacuuuugucaaugaaaagugucaaacucuaaaauauucuaagagauuuauucugagcuaaaugugagugaccauggcucaugacacagccccaggagauccugagaaaaugugcccaagguggucgggcuacagcuugguuuuauacauuuuagggagaccuaagccaucacucaguacauguaagauguacauugauuuggucuggaaagcugggacaacucgaagggugaggggggcggucuuccaagucacagguggauucaaagauuugcugacuggcaauugggugagaguucauuuaaaucccuggaaucaguagaauggagugucuagguuaagauagggguguggaggcugggcacaguggcacgcgccuguaaucccagcacuuugggaggcugaggcggguggaucacaagcucaggagaucgacaucauucuggcuaacauggugaaacccugucuuuacuaaaaauaugaaaaauuagcugggcaugguggcgggcaccuguagucccagcuacucagguggcugaggcaggagaauggcgugaacccgggagguggaacuugcagugagcugagaucgcaccacugcacuccagcgugggugacagagcgagacucugucucaaaaaaaaaaaaaaaaaaagauagggguguggagaccaagguucauauuaugcaaaugaagccuccagguaacagguuucagagagaacagauugcaaauguuucuuuuuuuaaaauuuuuauuauuuuuuaaagagauaggaucuugcuuuguuguccaggcuggucuagaacuccuaggcucaagugauccaccuaccucagccucccaaagugcugggauuauaagccuagccuguaaaugauuuuuuuuuuucccccaaaugcagucuccucacccccgccccuagacggagauggagucuugcucugucacccaggcuggacugcagcggcgcgaucucaacucacugcaaccucugcccccuggguucaagcaguucuccugccucagccucucgaguagccgggauuacaggcaccugccacugcgccuggcuaauuuuuguauuuuuaguagagacgggguuucaccauguuagccaggcuggucucgaacuccugaccucaggugauccacccgcgucggccucccaaaguccugggauuacaggugugagccgcugcgcccagccacaaaacagucuuuauuaugagaaagcaguguuaucuagucuuuauuauaagaaagcaaugcuaucugguuucuuucuaauaaaauaaaagcaguuuucuuaaauaauuuacaaagggcagaaauugcucuugaacagggcuaccccuccuggcacacccacagugcucugccuugaacauauaaauagguaccugugagcccaggguuuaagccuggaacuaucuccuaugccuuccuccaggucccugguagggaaagcagggaugagaguggugcccccaagggccuuggcacuggaaacacagugggcgagugacucuguggaugacuccccaaaaaccaagcaccugguuugaguucagagcucucaaacaucugaugccagcucuucacauuguagaugaagcaaauaccaggcucaaggucaaguauacgaugcauuacuaaacccaagaguccccuuggggaguagaaggaacaauucuccccaccucugcaagaucuccccaagacacucucaggcuguggcaggcagucacugauggguccagauguggcuggagcaggggggcucugggcuccuugcuagucaggucuuuguuagcaguggcccagggguacugaugacuccugggagcuuccgccaggaagcucauggggaagcacagacauucugggguacgaagccuugguggucagacagggcuuguuuccugcagggcacuuccucagucaugaaugagagugucauuucaccacucucuuccgccauaauggcuucauccagcucuugggacagcuucuggagaugccgaauuccugcuccccauaggugcuaggucacuaucagaugcgcugggagagcagaggagcucugucaaggaguaggggcucuggaaggcagucucccgccuccacugccguagaggguaggcacgugagccuguccagguagagagguggugaugcacaggggucuguagcugaguggucaggggcagcuccauacagcugaauccucuucuggcucaggcugugaguuggggagacacugcucucccuuuuguaccccuuucuuccuccuccuggccuucaccugggucuccaccagacacuuggugcuacuuuggcaggacuccuggauucucugugacauggcacccagggugcucuuagcugagcgagcugcagccuggagucucuuacugcccugacccugguuucuagggguuucuaggagguaccuguccggagguugagguugacggcucuuaggggcagccuucuuuggaacugucugcacagagaacccagggcccuggcggagaucucccaauggcuaaccauaggcugccgcuccuugcuguccagcggcugcuccuggugcuggagagaucuccggugcauggaggcccucgcauccugccacugagaaaccaucugucuggccaagagucuacucugcccacuagaccucaacacccccaacaugugccugaagccgagcacuguaaauguuaaauguuucuuauaagacuuaaagagacaacuuugcagggccauuucaaaauuugucaaagcuauauauuuugggccagauguggugguucaugccugucaucacagcacuguuggaggcugagggaggaggauuguuuggacccaggaguuugagaccagcuugggcaacauagcagagagacucugucucuaccaaaaaaaaaaaaaaaaggagggggauuaaagaacaccugaaauacuucuuucaggguuugcugucugucauauuuguaucuuauugcuacuaguaaucuguuuugucaguccuaaggucucuguuuuaauguuaaugcugguuagcugugccagaauucugaagggaagagaguauaaugaggcgugucugaccacccauucccagcauggccugaacuaguguuucagguuuacuuuagaaugcacuugacugaauggagaaggauucaccuucauucaguugguugggggggcuuagaauuuuauuuuugguuuaugcuuucuuuuuuauuuuuuaagacaggaucuggagagcaguagccuugacauccuagguucaacugaucaucuuacuuuaggacccuccccauccccuccaguagcuggaacuauaggcaugccaccgcgucuggcuaauuuuuuuuuuuuuuuuuuuaaaucuuagguagaaacaaggucuugcuguguugccuaggcuggucucaaacuccugggcucaagcaguccucccaccuuggccacccaaaaugcuggaauuacaggcauacuuacuuaguuuuggcagaacauagcuuuaacuuucaguguuuuaagcaaaugaugagagugaugaugcuuuaaugcuuccccugcccgaaacagugucuccuuuuauugccugggcuagcguacagugaucauagcucacuucagccuugaccuccugggcucaaaugguccucccaccucauccuucugaguagcugggacaacaggugcacaauaccaugccuggcuaauuucuuucuuuuuuguuuuuuuuuuuuuuuuugagacagagucugcucugucacccaggcuggagugcaauggcaugaucuuggcucacuucaaccuccgccuccuggguucaagcaauucuccuguuucagccucccaaguagcugggauuacaggcaccuggcaccaugcccagcuaauuuuuuguauuuuuaguagagaugggguuuugccauguuggccaggcugcuuuugaacuccugaacucaggugauccuccugccucggucucccgaagugcugggauuacaggcaugagccacggcgcccagccuugccuggcuaauuucuaaaaaaaauuuuguggccgggcacgauggcucaggccuguaccagcacuuugggaggccgaggugggcagaucaccugugguugggaguucgagaccagccugaccaacauggagaaaccccuucucuacuaaagauacgaaauuagccgggcgugguggcgcaugccuauaaucccagcuacuggggaggcugaggcaggagaaucucuugaaccugggaggcagagguuguggugagccgagaucgcgccauugcacuccagccugggcaacaacaaugaaacuccgucucaaaaaaaaaaaaaaauuuuuguagagauggggagucucacuuuguugcccaggcuggucuugaacucuugggcucaagcuauccucccaccuuggccuaccaaaguguugggauugcagguaggagccaccgcacccagccuaauugcuuagguuuuauagaguaguuuaggaauuguuucucuuuagcugaaaauacacauuucagccgauacauguaauuauaaauaauaacacugagguuauccuuuuaauuaacucugcuuugagaagggcuaacugaucaguuagcaguugccuuauccuuuuaauuaacucugcuuugagaagggcuaacugaucaguuagcaguugaauaugacaguguaguaauuucauuacucaaaacaguaaaaacucaauauguuaagcauacagacauacaaauaugaagacuuuuuuuccuuuucuauuuuuguuggcuaauuauugggaaauugaugaauuuuguuauagcaaaggaacggaauugguuaguauuuuuggugggaagagaagagcugagccaccuuaaaaauauuuuuuccuggccgggugcaguggcugagcucagacaaucuaccugccucggccucccaaagugcugggauuauaggugugaguaaccacacccggccaauaaaaauguuuuuucuuggcugggcgcgguggcucacgccuguaaucccagcacuuuagggggccaaggugggcgaaucacgaggucaggaguuugagaccagccuggccaacauagugaaaccccgucucuacuaaaaauacaaaaauuagccgggugugguggcgcaugccuguaaucccagcuacucgggaggcugaggcaggagaauugcuugaacccggaaggcggagguugcaugaaccgagaucagggcacugcacuccagccagggcaauagagcgagacuccaucucagaaaaaaaaaaaaaguuuuuucuuguauuuguuaaguaaucaguauucuucagcuuuccucauacuugcuuguaucccagcuaccuaaauaaaacccauuuaagcuucacagaauguuaagagaagugagaaaauacaaagguguagccaggaggaaugcaguccuuucccuuuuccagugggucccagucucccaagaagaaaggcaggauuuccuaagaauguuaugggaguaaucacagguuuaagaaguaaauccuggcugguugcgguggcucacaccuauaaucccagcacuuugggaggcugaggugggcagaucacgaggucaagauauugagaccauccuggccaauauggugaaaccccaucucuacuaaaaauacaaaaauuagcugggcgugguggcacacuccuguagucccagcuacuugggaggcuguggcaggagaauugguugaacugaacccgagagggacgcggaggucacagugagccgacaucguaccacugcacuccagccuggcgacagagugagacccuaucuuaaaaaaaaaaaauaaaaagaaguaaauccuuuaacauucauuguccuguuuuuauuuccuacaauagcaagccagcugacauggucaaagaugcuuugauuagcaagaccccugggcuuacagaaggagaaaacugauuauguaguuuuccuauaacccccacccacccgcuagauacuuacagguauccuagccuagcugaucccuuuucuugcaggccuggcauuuacccuuucauggguuuuaguaaaacauuuauaauuuuuuaaaacuucauuaacuaguaguauucaugcagaauacuaggagaauucaggaaagcaccacccauauuguggguuaaauugugucugucaaaaauauacuuagaaguccuagucuauaauaccugaaugugacccuauuuggaaaugaggucuuugcagauguaauaaagucaggaugagauaauuagauagggccuuaaucaauaugacuguuucucuuucgcccaggcuugagugcaguggugcaaucucagcucauugcaaccuccgccucuuugguucaagcaauucuccugccucagcagcugggauuacaggugugugccaccaugcccagcuaauuuuuguauuuuuaguagagaugugguuucacuauauuggccaggcuggucucuaacucccgaccucaagugaucuguccaccucagccuccgagagugcuggaauuacagccgugagccaccacacccagcacaauaugacuguucuuaugaggagagaaagacauaaagggaagauggccauguggcgaugacagaaauacauauuggagugauaaaucugugagacaaggaacagcagggauugaugaugacaaccagaagcuaggaagaggcaaggaaggauucuccccuauagguuucaaaggaauauggccuugcugacacccugaucuuggacuuccaaacuuuagaauugugagacaacacauuucuguuuuuuuaauuuguuuuuuguuuuguuuuguguuuuugagacagagucucacucuguugcccaggcuagaguacaguggcacgaucucgguucacugcacccucugcuucccggguucaagcgauucuccugccucagccuuccugguagcugggacuacaggcacccgccaccauacccggcuaauuuuuguauuuuuaguagagacgggguuucaccguauugcucaggcuggucucgaacuccugaccucaggugauccacccaccucagccucccaaaaugcugggauuacaggcgugagccacuauacccggccuuguuuuuuuuuaagucaguuugugguauuuuguuaugacagcuccaggaaauuaauacauguaagaaaaacauucagucagggacugcccauauuaauauuuugauauauaaucuuccaaacuuaauuuuuuuuuuuuuuuuuuuuuuuuuuuuuuuuuagugaaacggagucucacucuguugccuaggcugggguauagugguacaaucauggcucacugcagccucuaccuuccaggcucaggugauuucccccaacucuagccucaugaguaguagggacuacaggcauacaccaccaagccuggcuaauuuuuuauuuuauuuuauuuuauuuuauuuuauuuuauuuuauuuuauuuuauuuauuuauuuugagagggagucuugcucuggcacccaggcuugagugcaguggcagaaucguggcuuacugcaaccucugcuuccuggguucaagcgauucuccugccucagccucccgaguagcugggacuacagguauaugccauaaugcccggcuaauuuuugugccuuuaguagagaugggguuucgcuauguuggucaggcugaucuugaauuccugaccucaaguaauccacccgccuuggccucccaaaguucugggauuacaagagugagccacugcacccagccaagccuggcuaacuuuuguauuauuuguagagaugggguucugccauguugcccaggcuggucucaaacuccugggcucaagugaucugccugccuuggccucccaaagugcugagauuacaggugugaaccacuauguucagucuuguauauauagucuuuucucuauaaaucugggaagauaaaauaaaaaguuuuaaauauauaugaagcuaugcaaacagugcuguaaaagagucaaauauacauacuucuuuuuuuuuuuuuuuuuuuuuuuugagacagugucucaccugucacccaggcuggagugcaggggcacgaucucagcucacugcacccucaaccuuccgggcucaagugcuucugccgccucagccucccugguagcugggauuacaggcucccaccaccauguccggcuaauuuuuguauuuuuaguagagaugggguuucagcauguuucucaggcuggucucaaacuccugagcuuaggugauccuccugccucggccucccaaagugcugggauuacaggcaugagccaccgugcccagccaaauacauauacuuuuguucaugauagaauaacugguacuggauuagcucuguugccaaaacaacuagaaaaagaggaaaaaauccauaugaaaaacguucaaacauuggaugaaagguagguagcauaggauuggaauuccuaaaaaugggaaacaaggugagcccuagaaugauuccagcugucuaccuggaaucacuuauaggacugacucagaggaagaacgaaguucagcaguggugguccuacugagcugagaagacagagcucagaguuggggcgguaguuggaauaugcugggaaggguguuggaauggagggaacagcucuagggauauggggucuggugaguacuggcugaauguaaagcugugucuucuuagggaaauuucgugagcuaugcaaagaauaacuacuggaguuuuucuguguaggagauguucaacuccuacuaguuggaguggaacgaccaaguugaauacuggcauaauuaguguggaacccagaagggccacacucuagggcuaaaucagcccucaaaggccuuucuagaccaauacuaacaaaacuuaaaaacaagucuugaaaggaucaagcugaccuacaagcugauuaacugccugcuagaacaaaggaagagagcaaaaucuagacacaucuacaacguucagcauccgauuaaaaaaguacuagauauaggaaaaggaaaaugguggcucauugccaggagaaaagucagucacugcaacagaccccaaaauaauaaagauauuuaaauuaauaaacaaggacuuuaaaaagugauuauauaaugauaugaauguucgggaaaaaaaaaaagaaaaaagugauuauaggcugggccaagaggaaccacuugaggccaggaguuugugaucagucugagccugggcaacaaagugagauccugucacucucaaaaacauaaaaaaauaguaauuauaugugcagggacuugaaguuucggaaacauaaacauaaugagagaaauuuaagcuaugaaaaaaaacaagugaaaccaaaaaauaccaucuuagcaaugaauauuuuacuggauaggccucauugaagauuagacaguucacaagaaacgaacauugaauuacaagauacggcaauagaaauuaucuaggcuuaaacagacagggugggaaaaagccagaauaaaaaugcuucagugaucugugaggcauuaucaacuagucuacuguauguguaauuggaauuacaggaggagggagagaagagaaacaguagaaauauaaaaagauaaucucaaaauuucuaaaguuggugaaaaauaauucacagaucccaaaaacucauaaucuuaaaucugauaaacacaaaaccacaccaagccacaucaugaucaaguugcuagaaacaaguaauaaauaacaucuuaaaaauugccagaaaaaaagacacuuuacuuguagaggagcaaagauaaaaaugacugcugacuucuuaacagaaacaacacaaugaaacaucuuucaaaaugcugagaaaaaccauaaacccccuugcgugguggcgcaugccuguaaucccagcacuuugggggcuuagguagguggaucucuugagcccaggaguucgagaccagccugggcaaugugcugaaacccugacuguaguaaaaauacagaaauuagccaggcaugguagugugugccuguagucccagcuacuuggcaggaugaggcaggaggaucccuugagucugggaagucgaggcugcagugagcugauaucaaagaacuccagccugggugacagagggaaacccugucuccaaaaaaauaaaauaaaaaacaaaacaauguuugcuuaagacaggauuuuguauguaaaaagucuuaagaaaucuucaaaauaaagaauuucauaagaucacaggauaccaggucaauguauaaaaaugaguuauauuuuuauauuuaagauuauuggggaaugaaauuuauauuuuauguauuuuauuuuuaagagagucucauucuguuacccaggcuggagugcagugggcacgaucauggcuuagugcagccucgaacuccuaggcugugaggugauccucuccucacucuccagaguagcugggacuguagaugcacaccgucaccagcuaauuaaaaaaaaaaaaauuuuuuaauuaagcuuuuuuuaaaaauuuuuuuauugagguggagucucacucuaucuguugcccgggcuggagugcaguggugcauucucaguucacugcaaccuccgccuccuggguucaagccguuuuccugccccagccucccaaguagcugggauuacagacacacaccagcacaccuggcuaauuuuuuguauuucuaguagagacaaaguuucaccauguuggucaggcuggucucaaacuccugaccucaagugauccaccacccucugccucccaaagugcuggguuuauaggcgugagccaccacuccuggccacaccagcuaauuuuuaauuuauuuuuauuuuuuugaagagauggcaucuuaccacauugcccagguuggucucgaacuccuggccucaagugaucaucucaccuuggccucccaaaguaccaccaugucugaccaguuuucuuuggauauguuucuuuccucugcaauguaacuuacuuuauuauuuaaaaaauggggccgggcacaguggcucacaccuguaaucccagcacuuugagaggccaaggcaggaggauugcuugagcucaggaguuugagaucagccugggcaacauagugagacccccaugucuacaaaaauaaaauaaucagcugggcgugguggcacacaccuguaauccuagcuacuuaggggacucaguugggaggauugcuugagcuugggagggugcgccugcagugagcugugauuuuaccacuguacuucagucugggcgacagaccaagaccuugucucaaaagaaaaaaaaaagguaucuuuagagggcuuguuuaugcggacaugcagcaguugaaaaugugagauuuugcuccuauguaucaugaccaaaucuguuaaauuucuuugccuccauuuuuauggaauccuucaguuaaccuccuauaaaggacagaacuaagacugauagaaauuguuucaagguaacauuuuucccuaaucagugcuuugaucagaaucaaauguuuucaugagagaaugcucuguaauuggaagacuuuguaagagcucagguguaaggugacuuucugggugauaauuuuggcaaaacucguuaaauuuugcguaugacauuuaugcuguguucaagguacacuuauauaggugacuagggugagccuccuccucauccuuuuuuuguuguggggggagacagggcuuuaacuguuugucacccaggcuggagugcaguggcaugaucucagcucacugcaaccucgaccucccaggcugaagcuauccucccacuucagccaccugaggagcugagacuacaggcgcaugccaccaagccuggcuaauuuuucuauuuuuuguagcgaugggguuucaccauguuguccaggcuggucuugaacucgucggcuuaagggaucugucugcuucggccuuccaaaguggugggauuacaagcaugagccaccacaccuggccuggggugaaacuucuuaggauaaacugauagcaugggacuugcaaggucaaagggcauguccccauuuuaaaccugauguuacauugcugggcagaaacgguugugcagaccuguauacacacuagcaauauaaugccuuuuauacaguuuucaguuuuccuuuguaugcuuaccugcauucugaacccgggcacuagaauuuuuuuuuuuuuuuuuuuuuuuuugagacggagucucgcugucgcccaggcuagagugcaguggcacgaucucggcucacuacaggcuccgccucccgggguucacaccauucuacugccucagccucccgaguagcugggacuacaggcgccugccaccucgcccagcuaauuuuuuuuguauuuuuaguagagacaggguuucaccauguuacaagccaggauggucucgaucuccugaccucgugauccgccugccucggccucccaaagugcugggauuacaggcgugagccacugcgcccggccuagaauuuuguauuuuauuucaucuuccguaucaaaguguugcugucuacuuuggaucuguuuuuuguuuauuuauuagaggcugaugccuugaucagcuugauagggauauccucauucacucccaggaauuaauuuuuuaccucuguccuuuccugaagaguuggaaguuuugucuacuaacugcagaauucauuuuuuucuucaagaguuaaaggagcugggggaauuuugggguuuugaauucccuggagauuguugaaaccccagcacauagauuauuuuucagauaagucguguagcuuuuaaauggaauccagguauuagucccuguaccucaaacuccaguguacugaaacuuauuuguaacagccuuuauauuaaauuaacucugauccuccauugcaaaaaauuuccacgauauuuuauaauagaaucucacuuaugaagucuggaaauuggacauuuuaguuccaacccaggacucgucucugcuuuucuacagcagugcaaaugaauauuauuuacauaaauauuuugggccaggcaugguggcucacgccuguaaucccagcacuuugugaggcugaggcuguuggaucaccucuggccaggaguucgagaccagccuagccaacauggugaaacccugucucuacuaaaacaaaacaaaucaaaacaaaaauuagccuggugugguggugggugccuguaaucccagcuacucaugggaggcugaggcaugagaaucgcuugaaccugggauguugcagugagccaaaaucgugccacugcacuccagccugggagauggagcaggacucugucuccaaaaaaaaaaaaaaaaaaaaaaagaaaagaaaagaaaaggccgggcgcgguggcucacgccuguaaucucagcacuuugggaggcugaggcgggcggaucacgaggucaggagaucgagaccauccuggcuaacauggugaaaccccgucucuacuaaaaauauaaaaaauuagccggguaugguggcgggcgccuguagucccagcuacuugggcggcucgggcaggagaauggcaugaacccgggagguggagcuugcagugagcugagauugcaccacugcacuugcuccugggcgacagagcgagacugugucucaaaaaaaaaaaaaaagugaaagauguuuuguuuugccuuucucagguguggacaccucaagaucgccaguguguccugaguaccuuagcacaguugcuuuuggauaaggacuguacugugcugguuggucgccagcuucgcccucuccuuuuggauuugcuggaaaggaaugccgaagccauuaaagcuggaggccaaaucaaccaugaucugcaugaacggcuaugugugucgaugagcaaacucauugguaaccauccugauguccucccgugaguagcaauuuuauuauucgcauuucuccuugaggugauagaaccugcugucuccugggauguaagggagucugagcugagaagguaaaacggaaauacagaaaggagagagauaaauaguauuguuuuauaaaaagagucacagcagaauccauuuauccagcucaguucagugagcauuuacuagguuucucuuaaaucuuggccaucagaacagaccuggaaagauggccaggauauguccccagugcucucaaggauuguaucauguggcaagacaugcauauacagcggaguaaaugagguuuaacugaggcucuuacagcauccaccucuaaugggaaagauuccuugcuuguuagagcagcugaaggaguggauuagaagagcuauaguaucccuuccaaauucuauaaaucuaucugaauuaguauacuaagagcuguguuagagcuggauuuuaaugugacuuuuaaagagauaguaaaauauaguuuugaggaauaaucaaaagagacagcaaaacugagugucagggguuuuuaaauugaaaagauuuuuaaaacuuucacuguaaaaaugauuaauauucuguguaccaauaggacauuucuuucuucucuucuuuuuuuuuugugagauggagucccacucuaucaccaggcuagagugcaguggcaugaccucugcucacugcaaccucugccucccuccuggguucaacugauucuccugccucagccuccugaguagcugggacuacaggcgcgcacaccaccacgcccagcuaauuuuuguauuuuuaguagagacgggguuucaccauguuggccaggauggucucaaucucuugaccucgugaucugcccgccucgaccucccaaaguguugggauuacaggcgugagccacugugcccggccaacagaacauuucuuauauccaguguuuuauuuauuagucuucaucaaugcaauaaauacacuuuggcuuucuuggaaguaugauaucuagucugguccuuuaaugaggaaauaggaaaugaagacuugggggaaaacacuguuggucugagcuuuucuaaaagggguugagaaaaaaauggaccugguuuaauggaacuagaaaauauacagccaaguaaagaucgggacucugagaacguuccuggcuuucucuauucugauaugucaguuagguaucaaaguucugucucauaaaaaauuauccaguuuuuuccuugcuuucucuucaccuugauuaaacuugugcucccaaauccccucagcuauagcuuuggagacaguuucagaaaguuagaauuacacguuauguguugauuauuuucuuuuuuuuuuuucuuuuugaagcagucucacucuguugcccaggcuggagugcaguggcacgaucucaccuuacugcaaccucuuucuccuggguucaagugauucucaugccuuagccuccugaguagcugggacuacagaugcacaucacuacaccuggcuaauucuuuuuuuuuuuuuucugagacagggucugacuuugucgcccagucuggagugcaguggcacaaucuuggcucauugcagccucugccucccgguucaagugauucucccgccaucacacuccacuaauuuuuguguuguguuuuguuuuguuuuuuuuuugagacggagucucacucugucaccuaggcuggagugcaguggcauggucuuggcucacuguaaccucugccucccagguuaagcgauucucccaccucagccccccaaguagcugggacuacaggugcgugccaccacaccuggcuaauuuuuguauuuuuaguagagaugggauuucacuauguuggccaggcugaucuugaacuccugaccucgugaucugccuaccucgaccucccagauugcugggauuauagguguaagccacugcgccuggccuaacuuuuguauuuuuugggguuuucaccaugcuguccaggccagucuugaacuccuggccucaagugaucugccugccucggccucccaaagugcugggauuacaggcgugagccuggccuaguuuuuguacuuuuaguguggaugggguuucaccauguuggccaggcuggucuugaauuccugaccucgggugaucugcccgccuuggccucccaaagugcugggauuacagacaugagccaccacacccagagauuauuuccuuuaauguuauaucagaguguaaccuuauuucuaaguuuuaccuaugcugacuugaccagcgccugcugugaaucaugucugcaauacacagaaguauccuggacuaguaaagaagaaaaaaacaguuccuuuuucucuacauuugcagaacacuucacuucuaacaccagaugugugacuuuuuaccuauaucuaucaauucucugacgucaguuugguacccugcaauucaguucaacucugagacugucuaucuggguuuaguacagaccccacagguuaaagauucagucccacaagaguaucucaucauuccuccccugcacacccccucucuagacaccaaucucaagucuagguuaucauauaugccucugaccaaaaggcuaucaaucagagacuuccuugacucaccucuucagguuugauuauuugcuaaaauagcucacagaacucaggaaaacaguuucuuuacuagauuacaaguguauuagaaaaggauacaacucaggaagagccaguuagaagagaugcacaggacaagguaugggggagggggacaguaagcaucuaugcuccccaccagcugcaguacccucucagcaccuccauuuguuuaccacccugaaagcucucagaaccccauuuauuuuuguugucguuguuuguuuuuuuugagauggaguuucgcuguuguugcucaggcuggagugcaguggugcaaucuuggcucauggcaaccuccgccucccagguucacgugauucuccugccucagccuccugaauagcugggauuacaggcaugugccaccaugccuggcuaauuuuguauuuuuaguagagacgggguuucuccauguuggucaggcuggucucgaacucccgaucucaggugaucugcccuccuaggccucccaaaguccugggauuacaggugugagccaccgugcccggccuguuuuuccuuuuuuuuucuuuuuaauuggauauuucauuaggaagacaugauuuauuauaucuuugaccauuggagaucaucuuaaccuuuauccccuuucuccucucuggcaguugggcugaaaguuuuaacuuuauuaucacuugguugguucuccuggcaaccaaccagugccccccacuccuuagggacuuucccauugucaccucauuaacauaaacucaggugugauugaaaggggguugaauaacaaaagaauagcucuuacugcaucggaaauuacaauuccuggagcucuguccuggaaccagauugaaaacuaaacauauaucacaaauaagcucaaguuuuuaacaaaauuuaaguuucauucuuaaaaauguguauacacuuuuucccguugugguaggaaaaugcauaaaacugaucaccuuuacuauuucuuuucuuuuuuucuuuggagauggaauuucguucuuguuauccaggcuggaaugcaaugguguggucuuggcucacugcaacuucugccucccagguucaagugauucuccugccucagccuccgaaguagcugggaucacaggcaugugccaccacaccuggcuaauuuuguauuuuuaguagagguggggauuucaccauguuggccaggcuggucuugaacuccugaccuuaggugauccacccgccucggccucccaguguugggauugcaggcgugagccacugcgcccggcccaacuuuacuauuucuaagugugcaguuuauuuggauugcauuuuagcuuaauuucuugguuacaguuuugcaucugcugcuaguuugugcugggcacgugccccacaucagugcugucugucuuuugauugguaagagcaauagugggugggcccagucacagccuuuaugaagaauagcagauggauuguugugguggagcaugcacuuucuuuucaaagacaugguccauguguaagguaccguauuuggccagucaugcggccauacagcagaaugagggaccaaaauaguugcuguuacacauuuuaguuaaaaacuguaucuagaaaugccuuaaagguaacaucuuguauuuguuuuuagacuuuucuuccucuccaagaacuacuuuauucucacuguaucccugugaggagaauaauguccuaauaguauaauaccuauuuuccuuuuucuucuuuuagucccagaagugauauauucaaauaacauucaacaauacagaaugguaggaagcuaaagguccucuccacccugaaaucauacccuccaaagauagcugguauuaauauuuugguauguuuucucccaaaugucuuuucucuugcacacaucagaguauacacacaaguacauugauaugcacgcauuuuaaauauggcuuuauugggauaguuuauauaaaaguguacaguucagugguuuuuaguauuuucaucaauauaugcagucaucacuacagucaauuguauuuauuuuuuguuuauuuuuagcuugcgcuaaauuauuuucaaaaauuuuaacuuuuaggcauuuucuuauaaaaacuugcuacucauacauaaacuaauaugaacuuaaaauucaucauagauuuguuucacuuuuuuuuuuuugagauggaguuucacucuuguugcccgggccggaaugcaguggugcaaucuuggcucaccgcaaccuccgccucccagguucaagugauucuccugccucagccucccgaguagcuaggaucaccaccacucauggcuaauuuugucuuuuuaguagagacgggguuucuccauguugguaggcuggucucgaacucccaaccucaggugauccaccugucucggccucuuaaagugcugggauuacaggcgugagccacugcgccuggccuacuucacuuuuuaacuugacuuucuuucuuuuuuuuuuuuuuuuuuuuugagacagagucucgcucugucgcccaggcuggagugcaguggcacgaucucggcucacugcaagcuccgccucccggguucacgccauucuccugccucagccuccugaguagcugggacuacaggugccugccaccacgccuggcuaauuuuuuuuguauuuuuaguagagaugggguuucaccguguuagccaggauggucucgaucuccugaccucgugauccacuugccucggccucccaaaauucugggauuacaggcgugagccaccacgccuggccgacuuucuaauaaaucuuuagcuucucuucuuuuggcugcuguguaaggagauccucuuucacuuggauuguuuaagagcaucauucauuaaugagcaucucauacuuucccuuuauuggcaguaggccuuagaccugguauugaugcugccuucuguuuugucauuuuuaauucaaacccaccucuguaauagccaccacugaaggcagauuuugguagacuuugaaaaacuuguuuuacuugaggcuucauaugcuucauggcuugcaaaacauaauggccuacgaaucccauggcagcaaaucaguccaacugcuacuacuguacuggccacagcuccagcugggcuccccugccuccaccaggaacgugaaucaucccagcccagggguugcagccaacaaccacauaccuuuaucagagagcaacacagccgccgaccacaagaacagaacccgcuacaguccauuuuugagcauuuguacacaauuuuuuaagauagaauuuuuuuuuuuuuuuuuuuuugagauggagucuugcucugucgccaggcuggagugcaguggcgugaucuuggcucacugcaaccucugccuccuucccagguucaagcgauucuccugccucagccuucuggguagcugggacuacaggcgugugccaccacgcccagcuaauuuuuguauuuuuaguagagacgggguuucaccauguuggccaggauggucucgaucucuugaccuugugauccaccucccuuggccucccaaagugcugggauuacaggcgugagccaccucacccaaccagaaauuuuuguguuguuguugagauggaguuucacucuuguugcccaugcuggagugcaauggugcugucuuggcucacugcaaccuucgccucccagguucaagcgauucuucugccucagccuccugaguagcugggauuacaggcuugcauaaccacgccuggcuaauuuuguauuuuuaguagagaugggguuucuccauguuggucaggcuggucucgaacucccgaccucaggugauccacccgccucagccucccaaagugcugggauuacaggugugagccacugcgcccagcccagaaauuuuuauaaaauuaaaaacaaacaucuaaugcaugcuaauuauuuuuuaauacuuaauuuagagccauuuuaggcucacagcaaaauugagaggaagguacagagauuucucauauacacacuguacccacacauccauagccucgccauuaucagcaucucccgucagaguagugcauuuguuaacauugaugagccuacucaaauuccaccugauuacauuaagguucauuaggauuaguguuaauucuucuuuuaauguuugguagaauucccuaguguaaucaucuagcuuuucucuagugcagucugggcuuuucuuugguaggagguuuuugauuacugacuaaaucuccuuacuaguuacuuauuggucuguacauauuuuccauuucuuuauaauguucaaaguguuugguuuuuuuuuuuguuuuuuuuuuuuuuuuuuuuuuuuuugagacagaguuuugcucuugucgcccaggcuggagugcaauggcgcgaucuuggcucacuauaaccuccgugucucgggcucaagugauucuccugccucagccuccugaguagcugggauuacaggcaugcaccaccacaccuggcuaauuuuguguuuuuaguagagacggaguuucaccauguuggccaggcuggucuugaacuccuuaccuaaagugaucugccuaccucagccucccaaagugcugggauuucaggugugagccacugugccuggccauguucaaaguuuuaauaauauuuuuuauuuccauggcauugguuauauaauaugaugucccccccaccuuuauuguuuguuuguuuugagacggaaucucacugugucgcccaggccugagagcaguggugcgaucucggcucacugcaaccuccgcuucccggguucaagcgauucucccgccucgacgucccgaauagcugggauuacaggcaugagccaccaccaugcccggcuaauuuuguauuuuuaguagagaugggguuucaccauauugguccagcugucuagaacuccugaccucaggugaucugcccgccucagccuccgaaagugcugggauuacgggugugagccaccacacccagcccugucuuuuauuucugauuuuaguuuauuugaaucuuuuuuuucuuaaucuagcgaaggguuugcaguucauuuacuuauuuugagacaaggucuugcucugucauccaggcuggaaugcaguggcaccuucauaguucauuguaaccuggaaccuggcaaaugaucuuccagcuucaggcuccugaauaggcuucaggcuccaccauaccccacuaauuuuuuuuuuuucuguaggaacaaggucucacuauguugcccaggcuugucgucuucauucauuaagguguaacuuaagcaucucuucuugauucuccccagauucaguugacucguguguguaugucucuuagcguuucuaaaaguggcugucuuccuuacuagacagcaaacuccucaagaagaguaucuauuugguuuugaaucccaguuauuaaacuacaguaucuggcucauagaacugaauaaauguuuguuggaaaugagugccuuuuccguuguaaacacuuacauuaaguaccccccgauuuuguagguaauuacuuuagauuuuuguauccucuuagucagaauuaucucaugccauuguccugguuccugaaauugaacaggauacaauuuuacgacuaaguagauucagcauucauuccccuauguucucagacccuugggaguucuguuuugugguuuggucagaguagagaauugcguucuaugauauucccaccaaucaaugaaaauauagauacuccuuuuugaaaauagcuuaaguugaaaaugcauuuaauacucugauaaaccuauuacaaagcagaaaaauuaaguccaaccauuguuaaguuggggaugucuguauucuuuguguuugaagguuugcccugagauauuucaaggacacauccccagucuuucaaagacuuuuccuagagaguucagaugcuaauccaguacgcuauggacguaggaggaugaagcuccgggaccuaauggaagcagccuucaaguuucugcagcaggagcagucuguguuccgggagcucugggacuggagugugugugucccucuccucagaagccaugacaccuugguucgcuggugcguagcuguuagacuuuuuugcacuucuaguguggggaugguacagggcauguguggaguugugugugucaggagggaaaggaaaccauuuaaaauuuguuauuuuuguucuuguggcuuuugggguuuuacuuccuuucuuuaaucaugugucauugcagaggaaaaugagaugauaugaauggaguuucaccuuuuucauguuccaucaaguaaauccauugugccugauuuguauuuucuguucuuaaauguguuguaauaauugagauuuccuuuucuaguguucaguuggcuaguggauuuuauuuauucuuuauuaucaacugcagauaaacugaauuuacauacuuucuuuuucccuagguauacagccaauugucuugcuuugguuaccuguaugaaugaagagcacaaguuaucauuucuuaagaagauauuuaauagugaugaauugauccauuucagguugagguaagcaggaaccuucguggaggucuugcuauagcauuucuuuuuuuuuuuucuuuucugggggugacaggccagaggugacugcaggucuugcgauagcauuucugagugguaagguaauugacgagacucuccuuucucucagguuauuagaagaggcccaguugcaggacuuggagaaggccuugguuuuggccaauccagaagucucccuuuggcguaagcagaaggagcugcaguacuuacagggacaucuuguuucgucugaccucuccccuagggugacagcuguuugugguguggugcugccugggcagcugccagccccuggagagcugguauguugguaucaguaggggguguguccccuucccccuacuaaacacugagugugcucugucuuuggcuggguucuauguaccaggugugagcuaaauuuaguuuguuaaauugcugcuucauuuuuggaaguuaaaaagaaauucaucuugggcuuuuccccugauauucccacuguucuuguuuuuauuuuuuguuaauuuuuuaaauuguagagacggggucucacuauguugucugugcugaucuggaacuccuggacucaagggaucaugccaccucagucucccaaaguguugggauuacaggcgugagccacugcacccagccugucccuguuuaauaugaaauuagaaacuaaugguuccugugugaugccuuuaacuugcgcggagcuguuccguauaucuucuuguuugcuugcugcaaaaacugugugaaguucuguagcacauguuacgauccuauguugauguaauucaaaggcagaauuacuugcuggagacccuuggacugcucuguggcaaagacaggccuaggucuagagaugacucccagcagccucuucuuucagaacuaucucauuguagagaguccaguaucuagugaacuuccucucucccauaugcaacaagcuucuuuccacgaauggcuugagaccauacuugaacaggcuugcagaucauaagucuggcacuagugggagccagucucuuuuuccauagcagucuucagucaguugucacuuugucugauggucaggcuguagugcaagugcaguggcagaaccucggcucacugcaaccuccccccucccagguucaagugauucuucugccucagccuccugaguagcugggauuacaggugccugccaccaugccuggcuaauuuuuuguauuuuuaguagagacggaauuucacuauguuggccagccuggucucgaaugccugaccucgugacccccugccucagcgugagccacuacacccaggccacccacuuuucuucuuggaauaaguucugggucauuucuugaacccaucaguuggguucuggucaguaguaguaaaaaaaaaaaaaaauuaaaauguaauauacauauaggaaaaugcacauugucauaaguguagucagugauuauucauaaacuucauauaaauaacaccaaacacccaguacuuccaaagcucuuuguguuuuuuucuaguugugaagacccguccccuucccuccucccucuuuaccccccacguauccuguaaccaguaucccaaccuagauuauguuuagggcauuaggauuuuaacauagggaaggauucugguuagaauggaccugcuguuguuuagcaguggggacccuggggccaaagcgcaggguagaguugcggugcagccugccugcuaaauuuaugagaggacaacccugaggaaaguucaagagcuuccagcucugaauuucucauuuaauccucacguauuuuuagggaaccagccauauuugagaacuuacuaccccuuuaagguuauaaaucauuccccuuuucccccauguauauuggaugcauuguuauuauuaaacacauuuaaggccaggcgcaguggcucacgcuuguaaucccagcacuuugggaggccgaggcgggcagaucacgaggucaggagaucgagaccauccuggcuaacauggugaaaccccgucucuacuaaaaauacaaaaaaauuagccgggcuugguggcaggcaccuguagucccagcuacucgggaggcugaggcaggagaauggcuugaacccgggaggcggagcuuucagugagccgagaucgugccacugcacuccagagugagacucugucucaaaaaaaaaaaaaaaaaaaaaauuaaaaguuuugauacaacauuuaccauguuaacauuuuuuacuuuacacguuaguucacauuuuuuguagagacagagucucacuauguugcccagccuagucuugaacucuuaaccucaagccauccucccuccucagccucccaaagugcugggauuacagguguaagccaccacaucugacugagaauguuuuugucuuacaaagcugaaauucuuucucauuaaacuuacuggguguguuuuaauauucuuuuuuacuuuuuguuacagaaaaugucgcacauauuccaaaguagaaagaaugguauagugaauacccauggaccugauagaccuggguauucaauaauuaucaauuacauuucauuuauauuucugcaugacuaccucacauuauauuacuuagaagcaaauaccaggcaucauaguauuuuauaugaaaauauuucaguauauaucucuaaaggaggcaaacuuuaaaaaucccugcuauuguuauuauaccuaaaaaaaaauuacaacauaagauauccucucaguguccauauuucccugauugucuucuaaauguauuguguauauuugugaucuuagaugggaaauccuagaauauggggaaaggaauaaaagaaaaauccaacaguaauagaugagguuugcucuucccuaccuuugugcaucagcuuuuuuggcuacuuaaacuuuggaagauuuucuuacauuugccaacaaauucugauucccuacuucccauggaauacccccaccaucccucacccccaauaaaaauggaaagaaaaaaaaaucagauccuugcuuuauuuuuauuuuuauuuauuuauuuauuuugaggcggaguuucacucuuguugcccagcuggagugcaguggcacgaucuuggcccacugcaaccuccgccuucuggguucaagugauucuucagccuuagcuucccgaguagcugggauuacaggcauaugccaccauguccagcuaauguuuuuguaauuucaguagagaugguguuucaccacguuggccaggcuggucucgaacuccugacuucaggugauccaccugccuuggcuucacaaagugcugguauuacaggcuugagccaccacaccuggcccuuugcuuuauuuuuaaaaauuuauuuauuuuucuagagucggggucucugugucacccaggcuggagugcaguggugugaucauggcuuacuauccuugaacuccugggaugaaaugauacugccaccucagcacuuccaguagcugagacuaugggcaugggccacaaugcccaugagaucuuuagaugacauaccuguuguuauuauaguuuugguacuacuaauuuacuuacagagguuuguguaagguuaguagaaggcuuacuguggaaauuaacuucgguuccuugggggaagaacucuucuugacauggcuuuugucuugccucuuuagggugguaauaggaguucuucacgugaacaggagcuggcccuuaggucuuaugugcugguugagucugucugcaaaagucuucagacccuggcuauggcgguugcuucucagaaugcuguguuguuggaaggaccaauaggauguggcaaaacuuccuuaguugaauauuuagcugcagugacagguagaacaaagccuccucagcuucucaaaguccagcuuggagaucagacugacaguaagguaauaaggaaauguuaaguuuugguggcuugucaugcuuguaaauauuugcauuaaaauauugcuuuugcuaagggaauauaacaauaguuauuggucuugcuuauaacuguuggggccaaccuauguaaaccucaagugccuacuuacuuacaccuaccuauagaagauuaacaguuaaucaaaggauguagcauugccacuacagguaugguuuuucaguaauuacuuuaucuucuuucugcagaugcuuuuggggauguaucgcugcacagauguuccuggagaguuuguguggcagccuggcacccugacacaggcagccacaaugggccacuggauccuucuggaggauauugacuaugcccccuuagacgugguaugucaucucaggaaauucauugucccuuaauauauuuuccugucuuggaaaagcauuuuguuaauagugauucuggugaugauuuaaacaaaaauguauuugauuagacguacuauguugcagguacuucaugguuacuuaccugaucugauuugcgguccugaauuacuugacugguuucuuguuugauagagauuuucuauaaaauuuugguugugcuguuuccuauaguaguugaauaugugaccaguuucauaguaguauuuuccucccuuaauugaauaugagaucaacauuuuccaagaacaggucugguuuggaacaucucagccauguuacauguacauugagaacuuugagauccugcuucuuagugguggcagcuacagaggagugggcugaggacaggugaaggaggagaugauguaauaagagugugcuugccuuuguuuaguuaagaaaaauaugcuggauuuguauuuugguuuguaaaaagaccacuucuguguguaagaaauuagccauugagacaauccauguugccuuuguauucugaaaagugacaaaaaauguauugcaggaugaaauauucuuccuuuggacagaguuuucccgagauugguuuuaauuuucuuuuucuuuuuuuuuuuugugagacagagucuugcucuguugacccggcuggagugcaguagcacgaucucggcucacugcagccuccgucucccgggcuccagcaauucuccugccucagccuccugaguagcugggauuacaggcaugugccaccauggccggcuaauuuuuguauuuuuaguagagacgggguuucaccauguuggccaggcuggucacgaacuccugaccucgugaucugccugccucagccucccaaagugcugggauuacaggcgugagccaccgcgcccggccuuccuuaccucuuuauucuguucuuaucccauugucuuagcacuggcuuauuuugucuaccuaucucucuugccuuuguuaccugaauaguguccuuuuuggccguuuuuccucuagucuagcuccuuuccaaauugcuacacaguugauuuucuaaaauaaaaaauggaauuauuucuuuucuucucagccuaaaagccucucgauaacucuuaugaaaaaguucaaagcccuuagcucagcacaggaggccuuuuauuacuuaccucuaagccuuacaucuuucugcugcuucuuacugcacauucuacccuacacauaacagaauucuugugccauggcuuuuagguuuaucaguuuuuuaaaaauacacuugcauacuucugccugaaguguauguaccauuucuguuucaccaaaccugguuaauuucugcucauucuucuuuaagguuuagcaaaugucacuaccucugggaagacuucacugcccugcuucuaaaucauucuauccugauucagaacccccuguaucuuuauauaugacuuuguauacuccugggguacacugauuaugcugugugggaauuugcaugccugcccucucccaucagccucuaggcucuaaagccuugguccugucuguauucuugugucuugcuugguugugauccacaggaggcacucgugaaugucgaguguguaaauugugcuggaguguaggugauucagacguucccaccugcauacugaccccaguuuggacuaugagagcugacguuuccuuuaagggugugucugucauuuugagagaggguuguuuuguuuugauuauuucugucuuaauagcuuuacuuuaucagugcgguuguuguuaucugauuuagguuucugugcugaucccucucuuggagaauggagagcucuugauuccuggccgaggugacugucugaaaguggcaccuggauuucaguuuuuugcaaccaggagguauguacuaguaaccuuucuguuuucacucuggagccacuuacucguaagucugcaugcugagccagagguccuguaauagaguucucugggucuacuucaagcaagguuaguuggaagugauaacaggucuaaccuucucauuccugauuauuuuuaaugaagauaauuuauaaaauaagaggucccccccccgacuuaaaaauaaguaaccaguuuaaaacacuucaccuuauuucauguuuuaaaaaauaaucagaggugagguuauuguuagauagcccaggguuugaguccugacacugcuacuuaguaccuauguauaccuuggcugguuaugaugggguuaauaauaccuucuucaaaugguggcuguaaagaauaagugaaaugacuuguacuaaagaccugucacaauaaaugcccaguuaauggcuagccaugauggugauaaugauagguagauuucaggcaauugaaaaauuaauuggauauaagcaugaacaaaggcacaaaaacugagcgugcuuaguauauauuccugccuacauuuuaaaauuaccugaaggcagugguuuauuucuuacugcuagucuauaccugcacagcuucuucaaugucuuuaaaugcccaugagugaaacuaacaucauucuauaguuaaugauuauauuaguguuuaccucaguuaacauugacuucugcauggaguguggagcuaacccgauaguauucaaggaauaccucccuagacccaauuacucuuuuuuuuuuuuucuugaaauggggucucacuguguugcccaagcuggucuugaacuucuguacucaagcagucuucccagcacagccucccaaguagcugagacuacaggcacaugccacugugcccagcugacccuguuacuuuuuuuuuuuuuuuuuuuuuuugagauggagucucauucugucacccaggcuggagugcaguggugugaucuuggcucacugcaaccuccaccuccuggguucaagcgauucuccuaccucagccugccagguagcugggauuacaggcaccugccaccacacgggcuaauuuuuguauuuuuaguagagacgggguuucaccauguuggccaggcuggucuugaucuccugaccucaugauccuccgccuuggccuccugaugugcugggauuacaggcgugagccaccgugcccggcccaauccuguuacuuuuguuuuaaacauuuauuuauuuuuuagagacaguguuuugcuuuguacccaggcuggaaugcaguggcuugaucguagcuuacuguaaccacaaacuccugggcucaagugauccuccugccucagccucuugaguagcuaggacuacagggguacaccaccaugccuggcuaaaaacaaauuuuuuuuauuauuauuauuauuuuagagauggaaucuugcugcauugcccagguuggucuugaacuccuggacucgagcaguccucccacuguggccuccuaaguguuggaaugacaggcaugagccacuguaccuggcacuguuaguuuugauagaccuugauuuuuuauuuuauuuaauuaauuuuuuuugagaccgagucucacucugucauccaagcuggagugcaguggcaugauuuggcucacugcaaccucugccucccggguucaagcgauucucgugccucagucucccagguaucugggacuacaggcacgcaccacgccugucuaauuuuuguguuucuaauagagaugggguuuugccauguugcccaggcuggucuugaacuucuggccucaagcaauccaccugccucagccucccaaagugcugggaggugugagccaccacaccugucuuauuuuauguuuuuuuagagaugaggccucaauuuguugcccaggcuggucuugaacuccugggcucaagcgaucuuccugcuuuggccucccaacgaccgacaugagccacugagccuggcugaccuugauuuuauuuauagagauagugaaguucuucccugguagauucaaacacuucccagaaagaccugggacaucguggaaagauguuagacaaacuugugaucugauaaacuugaauucaauuuucaguucugccauuuucagucacaguugaguguauaagggccauucuuuccuucucuuccauuuaugucagaagaaaagaauggcaucuuccucucgggacaguugugaggacuaaguggccuaugcauaagcauguaccuuccccagaguguauguuuaauguauauuccuucucuacuuuuuucucuucuggaaauuuuuaaugguuuucaaguacuguagcuucugguaacaagcagugaacuuaauguuaaugcuaugagccuuggauuaugcuuucucuuuccugaaguuauuuaugccuuaaggaagaggaaccugucauugaaauaaaaacauuuaccuuguagaauuauuugcagugauuugaaaauauuugguuaaagcacuaucacuacuacuuaggagaagagccaaacauggguuaacugucagccuuucauuugucaucugcccuguaagcccaacaguguaguaucuggaaacagaagggauuaugaauauuuuuccuaugugagacaguguacagcaaguaauauccagaggcacaauucaggauuaaaauuuggaauuuugugugacuguguuuuuuauuuugaaacguagacucuugagcuguggaggaaauugguaucgaccgcuaaacagucaugcuacuuugcuagacaaauauuggaccaaaauucaccuggauaaccuggauaagagagaacugaaugagguacgugggucuuggaaaguaucaaugcuggccaggugcaguggcucccgcgugaaauaggaaauaguauaauaaaccaccagaacccucaucaaccuaaauuuugcagucugugugcuaguauuuuacuguauuugcuucaucuguuauuuuuucugggcuaauauauuugaaagcaaacucccagcauacaucucuuaaaauuuaauggcauuuucauauauaaccacaauaacauuauuauacacaauaaaaugaacaguaauuccucaguaucauugaauucuuagauuauauucaaauuuucccaguugucuacagaggaucauuuuacuaaguugauuugaaguaaugucuuucacacuuaauggacauuuugaucuaggcauuaaugagaauugagguaaaucacuuuauagguuuucuacauugauucaguuucuaguauugugguuauccuagaucaguaagaaguauauuacacuugacuccguucaugccccacuucccuuuuaugucucacuuggaagauuucccuuccccagugcuuuaucuaggagaguggcagacaaagcauugucaguggucauucagacauggaagagaugcuuuucccuuuauugauguagguauauagguaaauaugugacaccaaacaaacuucaaucuuuuauuuuuauuuuauuuuauuuuuuuuuaaacaguuucgcucuuguugcccaggcuggagugcaauggcgugaucuuggcucacugcaaucucugccuccugguucaagcaauucucaugccuuagccucccaaguaccugggauuacaggugcccaccaccacuuuuggcuauuuuuuuuguauuuuuaguagagaugggguuucaccauguugaccaggcuggucucaaaacaccugaccucaggugaccugccugccuuggccuccuaaaguguuggcauuauaggugugagccacugugccuggccacaaacuucaaauauuuuuuccuacauuuucuuuucuuuuuuuuuuuuuugagauggagucuuuuuaugucgcccagaacaguacucuguggcacgaucuuggcucgcugcaaccuccgccucccauauucaagcgauucuccugccucagccucccgaguagcuggugcaugccacuauugggguaacccacccccaauauuacaacauagguucuuucuauuuuccauaaguguuggcuggcugagaaauaaagagaaagaguacaaagagaggaauuuuacagcugggcugucugggguggcaucacauauugguaggaccgugaugcccaccugagcuucaaaccagcaaguuuuuuaaggguuucaaaaggggaggggguguaagaacagggaguggguacaaagaucacaugcuucaaagggcaaaaagcagaacuacuaauaaggguuuaucaaagaucacaaggcaaaaggcauaaagcagaacuacugauaaggguccaacaaagaucacaaggcaaagggcaaaagcagaacuacugauaaggcucuauguucagcggugcacguauugucuugauaaacaucuuaaacaacagaccggucugaccacaaauuuaccagggcggaguuuuuuccccacccuaguaagccugaggguacugcaggagaccaggguguaucucgguccuuaucuuaaccgcauaagacaggcauucccagagcggccauuuauagaccucccccccgggaaugcauuccuuucccgggguauuaauauuaauauuccuugcuaggaaaagaauuuggcaauaucuucccuacuugcacaucuguugauaggcucucucugcaagaagaaaaauauggcucuuuuugccugacccugcaggcagucagaccuuaugguugucuguccuuguucccuaaaaaucgcuguuauucuguucuuuuucaaggugcacugauuucauauuguucaaacacacauguuuuaugaucaauuuguacaguuaacacaguugucacagugguccugaggugacguacauccucagcuuaugaagauaacaggauuaagagauuaaagacaggcauaagaaauuauaaaaguauuauuugggaacugauacauguccaugaaaucuucgcaauuuauuuuccucugccguggcuccagcuggucccuccauuuggggucccugacuucccgcaacaugccaccaugcccagcuaauuuuuuaauuuuuaguagagacaggguuucaccauguuggccagguuggucucgaucucuugaccuugugauccacucaccucagccugccaaagugcugggaucacaggcgugagccaccacgcccagcuuaacugauuuuauaucuuauuauuauuauuauuauuauuauuauuauuauuauuuuuugaggaaaggucuuacucugucacccaggcuagagugcaguggugcacugcaguggugcucagcucacugcagccucaaccucucaggcuuaggugaucuucccagcucagccugccagguaccugggacugacuacaggugugugccacccugcccagcaaauguuuuguagagacagguuuucaccguguugcccaggcuugucucaaacucuuggacucaggcaaucugcccacaucagcuucccaaagugcugggauugcaggugugauccacuguacccugcuccuuuuacaugcuuuucauugagaaauuacauaauggccuuaccagagcuguguuugaaauuaaauaguaauuuaagaauucuuuaaugaauaaauucuuuagaguugguugcuuauauuuugguuacuuggagaaccuuuuaacaugacuucuaccgcugaaacuguauuguagauggugagauugcugguaacugaguucuggguaggaagaaaaucaucaugauugagugaaauaggugggugggaacaggagugaguaagggggaaguucuuauuuuugguaaaguugacaaaauuucuuuucauuuuuauuuuuauguuuuauuuauuuacguuuuuugagacagggucuuguucugucaccuaggcaugaucacugcucacugcagccuuaaccucccagucucagaugauccucccugcucagccugcugaguaccugggacuacaggcacacggcaccgugcccauguuuguauuuuuuguagagaugauguuucaccauguugcccaaguugaucucaaauccugaauucaagcaauuccucugccuugguuucucagaguguugggauuacaggugugagcuaccgucccccagugaacaaauuucauagagaaauacaauuuuuggcugaccaguuucagcaguaguuugugugcuuucaaaaauuaccaugcuggcuguuaaauuuucuuuuuuuucccccucugucagguucuucagagcagauauccuagccuauuggcagugguugaucaccugcuugacauuuauauccaacuuacuggagagaaacaucacucuuggagugauaguucuguuggaugugaacaggcaccugaagaaguuucagaagccagaagagaaaacaaaagaccaacccuugagggaagagaauuaucucuaagguacuggacuaaacaguuuuuucuuuucuuucuuucuuuuuuuuuugugagacagauuccugcucuguuacccaggcuggagugcaguggugcaguuuuggcucacuccaaccuccgccuccuagguucaaaguucuuaccagcuagaaguaaauagucagguuuugaaauuauagguugcuucauggugucagaucccuuuuucagauuuauaauuaaugacugggaaggcucgauuaggguaauguuuuuaacuuuaaaaaauaacuuuuaaagaccaacuugggaguggcuccuaacauaauucuuucacugaaugcccuuuucugacacuuggagucuuaaauaagucuucuuggauuucgcuaucuaugacuucugugccacucuguguucucagugguugacuuccccuuugagaagugagaauuagaaaugggcaucuccucaggcuaggcgcgguggcucacgccuguaaucccagcacuuugggaggccgaggugggcggaucaugagaucaggaguucgagaccauccuggccaacauggugaaaccccaucucuacuaaaaaaaaaaaaaaauacaaaaauuagccaggcacgguggcaggugccuguaaucccagcuacucgggaggcugaggcagagaauugccugaacccggguggagguugcagugagccgagaucacgcacugcacuccagccugggcaacagagugagacucugucuccaaaaaaaaaaaaaaaaaaaaaggaaauggcaucuccucauucugaucugauugguugcuccccuccuuuccugcuaccuugucuggcauggauggcagagaguaaugaguugguaggucacuuccuggaaugggugaagauugggaacucuuuuuguuuuguuuuuaaauuuuacacacaaauacaaagaggggaaggauugagaacccuuacugguuucccaaauaccuuuuaucuaagcauugucagaagaaagaagaaaguuaucagguaugcccagacuuaagugggucaauaaauucugaugccuuugaugucuuuggccuguggucuuuucuuuguuuuuucuuuucuuucuuuuuuuuaaagggaucugcugaauugguguaauaggauugcccauagcuuugacaguucaucuuuaucagcaucauuaaauauuuuucaagagguaagauauaguuuuccagucuuuuuugucuugguucuguaaggcuguugacuuccguuguuauuuucugucuuuugauugccaucagacuuuuuucuuuuuuccaaguaugguuuguuauucuuuuuuuguuuuuuuuuuuugagacgaagucucucgcucuuguccccaaggcuggagugcaguggcgugaucucaggucacugcagccuccaccuucuggguucaagcgauucucuugccucagccucccgaguagcugggguuacaggcaccugccaccaccccuggcuaauuuuuguauuuuuaguagaaacgagguuucaccauguuggccaggcuggucucgaucuccugaccucaagugauccacccacgucggccucccagagugcugggauuacaggcgugagccaccgcacccggccugguuuguuauucuuagcuaguuaaaacucaacuaacguggcauuaaagcuaauugaauguaauacauguuuugugguuuuugaaacaaauuauuauuaauuucagaagaaguauaguuugauauagaguaaaacagguagugaaauuaaagguaaaaugaaagaaacucccggguaauaauaaagcaauguuuguuccuacauauaauuucuuagucuguuugauaaauuuguaacuauccgaucccucuacuuuucucaguagggcugguugauguugguugacugaaccucuuuguaagacaccauaaauccaggauggguuucugaugagggugguggacucuucugacuaauucaucugggguccauuguuauuaucuaugaugggagcauguaugugcacaggacuuaaccauucuaguggauauuauuacagaagaccaaaucauagcgguaaagguggaauaagaacaaaaggaguuggauguucuuuuagaaguaacucuuuuaaacuauacuaugguaaccagaggaauuguucucuucuacucuaaaauauauuucuacugaauuugagaccagccauuucaaaugaguaggguauauucuuuugagaacuggcaaauuguuuuuguccagcucuuuuccccccuuauuccaugcagaccaaauaccuuuaugaaauaucagguauuagguauuauaauuuguauuagguauuauaaauaaccuggagauuuaaauaaagaaggugugcauagauuauaugcagauucuacaccuguaaaauuuuuuuuuucuuuggcuuauuuuaguacauacugacacaggcccuauaccuuuuuuuuuauuuauuuauuuauuuauuuauuuauuuauuuauuuauuuauuuuugagacauagucucgcucuauuacccaggcuggagugcaguggcgugaucucggcucacugcaagcuccaccucccagguucccaccauucuccugccucagccucccgaguaacugggacuacaggcgcccaccaccacacccagcuaauuuuuuuugcauuuuuaguagagaugggguuucacccuguuagccaggaugaucucgaucuccugaccucgugauccacccaccucagccucccaaagugcugguauuacaggugugagccacugcgcccagucacccuaugccauuuuauauaagggacuugagcaucuucagauuuugguuuccgugagagguccuggaaucaaucccccaggaauauguagggauaacuguauuauaauaguaaauccuguauuuuuaauauuaauguuuguaacuuuagauuucuggguauaaguuuuccugcuuauuacugaauuuuaggggugccauuauuugggucuuuuugcaucuuguaaacugacuuuacuuagaauuauggcuuuaaaauauauuuuaauuuuaaaaggacuagauucuucuuguuaaaaaacaauagaaaagaugauggaagaaacuuaacuacuaacucuaccacugagacgaaagcaauuugcaguauugggggccuguuuucucuuuuuuuuuuuuuuauuaguugagacaauacuguauauuaaguguuguauucugaguauuucaacugucaggacaaaaauauaaaauacuuuuaaaaaggaugaaaaaauagaucagauuguaacggcccaacagguucaccuugcccacugccuagacagagacaauuuaucaugacggaauuugcaauaaaguaauucacacagagccugcuguaugggagaccaguuuuauuauuacucaaagcagucuucaagagagcuuaaugaauacuaggcuagccauaugggaaauggaauuguuacucaaaucaaucucccuguuaacucagaagcuaggguuuuuauggauaauuuggugggcaggguacuagggaaugggugccugcugauugguuggggaugaacucauagggauguggaaaauggucuuguauacugagucuacuucugggugggguaacugagucaggugggguuaguuaguugcuggaaugcaaaaaucugaaaaucaccucaaaaggccaauuuuaguuucuacgauagugguguuaucuauaggagcagcuggggaagucacaagucuugugaccucuggccacaugacuccugagcacuaagggauuauagaaacuacaccuacauuuuagcagaauucaggccccucccauaauccuaaucuuguggucuuucauuagguuucggucccugagcaaagaggggguuaguuuuaggaagggacuauuaucauccuugcuuccaaguuaaacuauaaacuaaauuccuacuaugguuagcuuggccuaugccuaggaaugagugaagauggccagccuaugaggcuuagaaguaagauggagucagccauguuagauugcucugucauaaucuuugcaaaggugguuucaaucccacacucaugguguccuuuacauuguuuuaucucucauauuuucuguaaauagaaaauacaaaaaaugcuugaugaauucaaguuuaacauauuugggguacaguccauuuuuggugguauuuuauauuucaucacaucagaagacauaacugguuggcucacugguaguugcuaagauugaguacuagguuaagauaaugaccaugagguauugcacaccuaguguuucccuugcaguuagaaagcagucuuuugauauuaccucagcacuauaugagucaguucuccuugaaccauguacccaguggucaacacuaauugcucuucuuugcccgaagcuaggauuugcaaagugggguguuuuguuguuuguuuuuuuuauuuggcaaguauuucaauagucaauuauuuauauuuauugguguccugucuuuccauuauggucagguccucaguccuggguugguaccuuauuugcacucccuucauuuuuagagaaauguuccugcuggauuuuguguuucucccucuuguggccaggaaaaugauguucugugauuaauauauuauuuuaaaaaucagucagcauuuaccuugguuauuuuaauaggcucuagacuguuucacagcaaugcuuucugagcauacaagcaaacugaaaauggcagaaguuauuggaagcaaauugaacauuucuagaaaaaagguaugugugcuguuuuuuuacuucccuguugaaaggaggcuaggauuuuuugcuugcuugcuugcuggucucuaguccuuaguuggaacagcuuuugcagugguaccucuuuuguaaaaguuggugcuuuuauugcagccucucgugggcauacaacucccaaauggcgcgagugcaauggcgccaucucggcucaccacaaccucugccuccuagguucaagugauucuccugcgucagccuccugaguagcugggauuacaggcaugugccaccacacccagcuaauuucguauuuuuaguagagaugggguuucuccauguuggucaggcuggucucaaacuccugaccucaggugacccaccagccucugccucccaaagugcugggauaacaagcaugagccacugugcacagccauguuccacauucuuaaaaggagcuuccucauguccugugucgucuucaguguuuuagugagcauuuauuuuauuuuguaggcauuagacucaggaauguaacuauguuuuaguaauaccuuugucuauaacuuaaugcagaguuuuuccaucuuuuuuauuauuuucccuuauuagaaaaauuggcaagagacugagugugguggcucacaccuguaaucccaggacuuugggaggcagagguggguggaucaccugaggucgggaguuuaagaccagccuggccaacacugugaaacccugucuuuacuaaaaaaauacaauaaauuagcugggugugguggcacaugccuguaaucccagcuacucgggaggcugaagcaggagaaucacuugaaccuaggaggcagagguugcagugagccaagguugugccacugcacuccaacgugggcgacagauccagacucuuucucugauaaaaaccaaccaaacaaacaaaaaaaaaaguugcaaagaguaguagcagugaauaccuguauacucacuacuuuguuucauugcugacauuguuaauauuuugccauucuuguuuuaugucaaaauacguauuuugggaggagggauccuuucagcaguggcacuggugucuagaaaaaugucugggcucaucuugaagcagauaucugacauucucaugugaauaaugacucuaaaagaucuuauggcaggaauuacaguaguagagauuuuuauaaggcuucugaaauaguugggaugguuuuggcuggaggucauagaacguccuacugaaagggacuuaaaugauacauauguuaaucaugagaaagaagaaugaaaccaccaugaauauucauuccaccaauauucauccucucuuguuguggaaggacucacuuuucccagagcaguuugcuucuuucacuucugccccaaaccugaacaaaaucuguguucuuuggagaagagaggaauggcuguuggguagacauccaggagcaucugccacagcucuuuuugcuuuggcuguagucagauguaccaugauuuccuaacauuauguuagaaauuuaaagcagaggagagcauagcuagagaagauuucucugauuuuuuuuucuuaccuuuuaggugaggacuuacuguucacuuucucuauuggauauaucaguguguucacuccauauauagguagggcuuauuugaaaaguaccauuuuagggaaacaugauaaauguugugaaaaacauagaaguuuggaaaaugaaaaaagaaauuucuuuaugaaaagccaacucaacuaucugggaaguagagaauaauucuuuguagagugcuaauuugagggccaaaauaagccucuggaugaggaaauauuccaaaagcauguggauuuuuacucagguaaaaucuuaccuccuacaggcugaauucuuuugucaacuuuauaaaccagaaauugugaucaaugagcuagauuugcaagugggucgagugcggcuucuacggaaacaaagugaggcuguucaccuacagagguaaguagggcucuaaacuaagcugccaacugugggguuuccagaaacuugacagaaggucuagcucagccucuugucuuugugcaaaacacaugucugaacugugauaucuguaguaugcuauaugggaaggagcaguguuuucccaaaguauguucugugaaauuagauaucaauaggugaaagaggugaugaaagucauuaaagauuuggcacuaccaaagaugaauuauugauuuuauucacugcaguguauuuagugaaguaugccucaguuggaagucaggcuuaugucuaacauuagucuguaaauuccuagaaggcugggguuauauaagauucugagaucgagguaacauuaaauacuuauuacaugucugacuuuguacuaagugcuuuacauauuuucucauguagugguuguaauaauccugugaauuaauauauuaguauccuagggcugccauaacaaauuaccauaaacuuggugguuuuaaacaaugacauuauucuuucacaguccuggaggcuggaaguguaaaaucaagguuucgacagggccaugcuccucccucugaaggcucuaggggagaaugcuuucuugccucuuccugauuucuuucuuucuuuucuuuucuuuuuuuuuuuuucuuuuuaagacagagucucacuccguugccuaggcuggaguacaguggugcgaucuugguccacagaaaccuccagcugccugguucaagcgauucuccugccucagccucccgaauagcugggauuacaggcaugcgccaccacgcccagcuaauuuuuguauuuuuaguagagacgggguuucaccaucuuggccagguuggucuugaacuccugaccucaggugauccaccugccuugaccucccaaagugcugggauuacaggccugagccacggugccuggccucuuccugguuucuuuggcucccagcaguccuugguguuccuuggcuuguaguuguaucacucuaaguucugucucuguugucauguggcccuucuuccuuguguguguauuucuuuucuucucuucuuuuuuuuuuuuuuuugagauggagucuugcucugucccccaggcuggagugcaguggugcgaucucagcucacugcaaccuccaccuccaggguucaagugauucuccugccucagccucccgaguagcuggaacugcaggcauccaccaccacgccuggguaauuuuuguauuuuuaguagagaugggguuucaccauauuggccaggcuggucuugagcuccugaccuugugaucugccagcuucggccucccaaaaugcugggguuacaggcuugugccaccaugcucugccuuguguguguauuucuaugucaccaaaucuuccucuuauaaggacaccagucauuggauuuaagacccacccuaaugcaauaugaccuuaucuuaauuugauuaaauuucuucaaagacccuauuuugaaauaaggucacauucauaggaucuggguagacaugaguuuggggaaagauuauuaaccuauuacaacuagguacuguuguuacccacaucuuacaggugaggaaacugaggcuaagacacauuaaguaauuuguccaagaugagcuaacuaguacagguagucuugucuuauugaucuuuuuaaucuccagagccuagcaucguaucagaugugugaguauucaguguuugcagagcaacuaaauucuguaauuuuuguauguuguaagauuaucugguauagcuugaagacaguuacugugagcuguuuucucauccuuguuguugaaucuggaauauaugguuucccagagcaaaacuaggagaagcuugcagcgugguuuuuaaacucuuuuuuucuccuucccagggagaaguucacuuucgcugcuacacggccguccucuguucucaucgagcagcuugcagugugugucagcaaaggggagccuguguugcuggugggagagaccgggacuggcaaaaccucuaccauccaauacuuggcucacauuacagguaaucccuagaggaaauaaaucugcccccagauauuucacacugacuacuuuuuuuccuuuuuuaaaaauacuaaauccaaagaccacagaguuuaaagagugccagcaccccacauguaaucucugccuggaaauaacuacuguuaauagauuauuauuaaauuauuucauuuccaaucuaugcuuaugcaaauacauauacguauagauuuuguuuuauuucaaaacagauaugggauuauguucuacauauugcauuauaccucauuucuucuuuuuauuuuuauucuuuuugagacagggucgcacuguugcugaggcuggagugcaguggcgagcccacagcucacagcucacugcagccuugaccucccaggcucaagugaucuuccuaccucagaucugagguaggaagauagcugagacuacaggugugugccaccacgccuggcuaauuuuuaaaguuuuuuguaaagacgaggucuagcuauguugccuagguuggucuccaacuucugggcucucaugauucagagcaaaggcacauuugaaaauuuaccuuauugcugggcgcaguggcucaugccuguaauccuagcacuuugggagccugagguaggaggauugcuugagcccgggaguucaagaccagccuggcaacaucaugagacccugucucuacaaaaaauuacaaaaauuagccaagucugguuguauaugccuguagucccaggugcucgagaggcugagacaaggaucacuugagcccaggaaguugaggcugcagugagccaugauugggccacugcacuccacccugguugacagaacaagacucugucucaaaaaauaaagcccuaugccauauucccacagccuuaaggagcacacuggauauuaucggucuuuaaauuuuuggaguaacacuuuugcacuuucuuuauaaaaggccaccguuugaggguugucaauaugaaucaacaaagugauacugcagacuugcuuggaggguaaguguggcuuaaaauuuuuuucuuauuuuuguguuuauugcuugagguaagaaauacuguuuucuuaguguuaacaaccacagguucuaggaugcucgaugcaauagaaaaagaguuuucucagauaaggcuuuauuggagcuuuuggcaggguaccagggacacaaaagagagaauucuguggcuggccccaguaagacaggaaaguaauuuuaaggggcuaaagugggaaggaagugauauuuaagcauguagaggcagggaacuucuggcacuugaacaguuugauaacgugcuucuucaugugucccaugucucagcauggguaugauuuuuaguauagcaaugaagcuaaggcaaaggaucagucauucuucuggucuuguguuugugcaggaaaaaggguaaacucccuugaguaagauuuaaggugugaguugcuuauuuuaguuuccucagggucccaccaucaguguguauggugcuuugaauaagauuuauggugggacauugcucaucuuagucucucuaaggcaccuugagcaagauugcaccuuaccccccaaccacagcaagguauuuauuugaauuuauugaggagcucauggguguguagauguuucucuucauuuuaaugaacacuugaggcccuuguucucaaaggucauaugauggaagaaggagaaaaagcaggcaaguauauaaucaauuaauguuuguguauacaguacaguugaucuaaaguguaaguucugggccaggcguggcggcucacaccuguaaucccagcacuuugggaggccuagaugggugaaucacuugaggucaggaguucgagaccagccuggccaacaugaugaaaucccaucucuaccaauaaauacgaaaauuaguugggcaugguggugugcuguagucccagcuacuagggaggcugaggugggagaauugcuugaaucugggaggcagaggcuggaguuagccgagauugugccacugcacuccaggcuuucuaccuugguuuuauuuuacuuauguuuaguugguuguuugaggaacuuggcaaucuguucuuauuaauauauaugauuuuucauuuaagcagacaugucuauacugcuguauauauuuaccuuuauucuuuuuuuuuuuuuuuugagacagagucuugcucugucacggcuggagugcgguggcgcgaucucugcucacugcaaccuccggcucccacguucaggugauucuucugccucagucuccugaguagcugcgacuacaggcacacaccaccaugcccagcuaauuuuuguauuuuuaguagaaacaggguuuuaccauguuugccaggauggucuccaucucuugaccuugugauccaccuaccucggccucccaaauugcugggauuacaggugugagccacugcacccggccucuuaauucuuuuuuuguuuuuuugggaggcaggaucucguucugucaccaaggcuggagugcaguggugugaucauggcuuagcacagccuugaacuccuggguuuaagcaauccuccugccucggccuacccaguagcugggacuacaggcauaagccaccaggccuggucuauuucucucuauucuguaucuauaugucuuuaguaauuucauaccauuaaguaguccuaacauaaauggcauugaucuuguacuaacugaacauggacuggguccuucucuucuacugugaauuuguaguguuauguuagccauugcaaguuguuuuaaauauagugaguaaacaggaguacauuugugaugcaaauugaugacacgaaaagguuggacucaaaguaugauuaacuagaauuugguuuuggugccaacuuggugaauagaauauaucuguuuuuccuuguuaguaggucagcaucacuuauuaaaagaaaacgcuacuuacauuuccauuugaaaagaucacuugagccugagagguugaggcugccgugagcugugguuaugccacuguacuuuagcugggaugacaaagcaagacccuggacaggaucuagcucuguugccuacgcugguuuugaacuccuggccucaaguaguccugcuucagccuccugaaguguugagauuacagacaugagccaccgagccuuuucucaguuuuugugggguuggaaaugugccuuguuuucuguacucuuauauuacuacaaagagauuuaaauaaaaucuuuuaacauauauucuguuauaagugaauaggugacucccuuguuuaagaaucauuguagaagaugagaauaccaaaaaguuuuuaaaaaggcaagggaauggagaacaaaauucagcuguggguaaggagaugggauagggaaaagauaaauauuccuauccucaggccguguugcugguuucaucuguuuuauaaguuauguuaaauauauuuugcauguguccaguauguuaaauaauaaccugguuugcaaauucggaucuuuuuuuuuuucuuuaagauagggucucacuuugucauccagacuggagugcagcggcauaaacaugacuuauugcagccuugacuuucugggcucaagugauccuuccaucucagccuccugagcagcugugggacugcaagcacaagccacuacaugcagcugauuuauuuuuaguagagaugaggucucacuauguugcccagacuggucuggaacuucugaacucaaggaaucuucccgccugggccucccaaagugcugggauuauaggcacuguagcuggucuuggauuuuauuuauuuauuuaauuuuaacucuuuuuuuggggggggacagggucucacucuguugcccagccuggaguaccauggugcccucauaguuugcugcagccuguaccuccuaggcucaugugauccucuugccucagccucccgaguaacugggacuacagacgugcaccaccacgcuuagcuaauuauuuucuauuuuuguagagaugaggucacacucuguugcccaguguauucauuuguucucacacugcugauaaagacauaccugagacuggauaauuuacaaagaaaagagguuuaauugacucacaguuccgcauggcuggggagaccucacaaucauagcacaagacaaggaggagcaaagucgugucuuacauggaugguggcagucgagagcuuguguagggaacuccccuuuauaaaaccaucuaaucucaugagacuuauucacuaucaugagaauagcaugggaaagacccacccccaugauucaauuaccucccaccugucccuugcacaacacgugggaauuggagcuacaauucaagaugagauuugguuggggacacagccaaaccauaucacccaggaugaaucuugagcuccugagaucaaguaguccuccccagucaaccucccaaagugcugggauuacaggcaugagccacuguacuuggccuuuuuagauuaauuuuaaaaacuuuuaaaaauuauuuuuguuuuuuuuuugagacagggucucugucacacaggcuggagugcaguggcaccaucagggcuuauugcagccuugaccuccccggcucaagcuauccucccaccuaggcccuccugaguaguugggacuacaggcaugugccaccauacccagcuaauuuuuuuugaacuuuauagagaugaggucucacuauauugcccaggcugguccccugagcuaaaaugauccucccaccuugaccucccaaagggcugggauuacaggugugagccaccauccccagccuagguuuuugagagaguuuugcucuuguuguccaggcuggagugcaauggcaugaucuuggcucacuacaacgccugccuccuugguucaagcgauucuccugccucagccucccgaguagcugggauuacaggcauguaccaccaugucggauaauuuuguauuuuuaauugagauaggguuucaccaugcuggucaggcuggucucgaacuccugaccucaggugauccaccugccucagccucccaaaguccuggaauuaacaggugugagccacugugcccugcccuagauugauuuuugaagcaauuauuauuauggguaaagauacuuuauaaaaauaagggccuuagaaaccaucaaauuauuuacauuauagcaaauugucuuuugcucuuuguuaguguccauuauccauuaccuccuugguuuuauucuuuugugcuucuugcuuuuugauuaguguuggcaugauaugucuuuuuccuucauuuaauuuuaaacucguuuuugucauuuuauuuaacaugggcuucugguaagcagcauguagacccucacauuaccuguagguagagacauaaauuugaagaguugcggguggggacagccaaagauaauccuugaaaaagaguagagggcauggaagacuuagauguggcagauaaaaucacuccagaaagagaaagucuagcacuaaagggcaaaauacagagugcauguucauagcacuuacuauagggaaugggcuucagaggggcagccucugagggagaaacagugauauauugagaaggaccgguuacccuggagagcuuggcaaugaaagaagaaaaaaaauagaggaaaauuaaagauauuguagaaauaguaauaaagcagccaauccucaucuuccuugccacccacccauagaacagucuuuaaaagaaacugcccagaagagcauauggcaggagcaugcaauuugaacucagaacccuguccaugacaugaagagaaauggcuuaucauucuaauuacucagcauguacauuuuauauucuuuuuacacuuuuuguuguuucacauguuauaauuuuguguagccauucucacaugaaugcuuacaugugguuccaguguauguaacagauauaagcaaaguuauuuuccaugaaggcagguguuauggaccuucuuggcauuuaaguggcucccaaggugccuuucugcagaagacgguuugaaaaucuugcucuuuaguuguuugguuguuuguaguuuauauccucaguucucugaggugucagguugguucccguugaauauuuguguugcaguugcaguugauuuuguuuuguuuauucuuuuuugaaauguauguuuuuucaucuuuucauguauugaaauauguauugacuuaagggcuuuagguaauacugugcucagcuuuaaaugaaugagcuuuccuuuuuuuuuuuugagauggagucuaacucugucgcccaggcuggagugcagcagcgugaucucagcucacugcaaccucugccucccgggcccaagcgauucuucucccucagccuccugaguaccugggauuacaggggcccgccaccaggcccggcuaauuuuuauauuuuuaguagagaugggguuuugccauuuuggcuagcuagguuggucucaaacuccugaccucaaggcauucgccugccucagcgucccaaagugcugggauuacaugcaugagccacagcgccuggccugaaugagguuuucuuuaaggaacucagucuacuuugaaauauuaagcugccuuuuucauaaauucaauagaucaauaauaacagagacauuaauaauuguauuaauuaucuauuaacucucuguggcagucauuaugugccaggcacuguuuugaguccuuuuucuguguuaacuuagcuggucuucuuaaaaccaugugagacaacagacuguuauccucuauauuuuaaacaugagagaacugaggcaaagagagauaagucacuuauucaagaaaauggcagauccaggauuugaaccuaagcagucuugagugucuguguucuuaaccauuacucugcuucuucaguuaacuuuggaucccauuuauacuguuauuuucaggacuagcaauuuuggccaggagcaguggcucaugcauguaaucucagcacuuugggaggcaaaggugggaguauugcuugaggccaggacuucgagaccagcuugggcaacauagugagacuuuaucuuuagaauaaaaaguuaaauaaauaaaaagauuagcaaucuuauuuaaaugacacauauauuuuguucaauuucucaccauuuucacuguugucguucuaguuuaucuacugucuaguccacugcguuggucucuuaucuuugcuucuacuccuaaucuuuuuauagucuuuuuuguuuaggaguuacaaugauccuuuaaaguacaaucagauaaaguauaauuuuuuguguguguguguguauggcauagucucacucugucucccaggcuggagugcaguggcacgaucuuggcucacugcaaccucuguucccggguucacgccauucuccugccucagccucccgaguagcugggacuauaggcgcccgccacuaugccuggcuaauuuuuuuuguauuuuuaguagagaugggguuucaccauguuagccaggaucaucucgaucuccugaccucgugauccgcccaccucugccucccaaagugcugggccaccgcgugagccaccgcgcccagcccaguaaaguauaauuuuuuauggagacaaggucuugcuuuguaacccagucuggucucacucucuuccucagguuccuccacugaacuucucaguccauuuaggauaaaauacaaagguuuagaauaaaauguuugguuuguauagcccuucauaaucugacagugguacuucucugauaucaucucucaccuuccccuguguugcugagcuccaaccacuuucuucugcuuugcaccuaaaugcuugcuauuucuucuguguggccuccuugcacccacagauaaugcuuagcucacauccuugcuugacuuagguauccuucaaauguccccuccucaacaaagccuuuccugacugugauacucaaauuaccaaaacucacaucacccauucagcuuuuaccuuacauuauguucauagcacuuaagcuacuacuugaccuccugagcuugaacaagccucccaccucagcuucccaaguaacugggacuacaggggcacacuggcaugccuggcuaauuuuuauauuuuuuguagagacaggguuucaccauguugcccacgguggugucgaacucuggagcucaagcaauccaccuguuuagccucccaaagugcugggauuaacaggugugagccaccgcaccuggccuauugucacuuucauuugauuguaagcuacacaggaguaagaucuugugggucuuguugauucaguggcuaacacguauagcaggugcucaaaaaaauuuuuauaaagggaugaguucuugcucuguugcccagacuguaguacagugguguuaucauagcucacuguagccuagaacuccugugcucaagugauccuucuuucuuagccucccaaguagcugagacuacaaaugugcaucaccacaccuagcuaauuuuuuaauuuuuuauggagacaagaucuuggcuuuguuacccaaucuggucucaaccuccuggcuucaggggauccucccgccuugaccucccgaaguggugggauuacaggcaugagccacugugccuggccucaguacauuuuuuguuuaauaaauggacuaaagaaaugccuauacuaauguauuagugcuaugaguaagugaaagugaguuugauguuccucuucaacuuuuuuucuuuggaacuggacucucagauucagaugcucaguaucaggccauuggguuuuuacucaucucauuguuucucccucacuaggccagugagucagcaguaauccaucaguucccuuacguuuguugugaaacauauuuugguaccuuuuaaguucucaacuuaaauuauuuuucaugaaaauaagauuuaucucauucuuccugaauuguaaugguaugccauacaaaauuggguacuuaagauuuucuaggaauaacuagugccucuuagacaucguauguuuaagcuagagcaauguuuuucaaccuuuuaaaaaauuaucucuuaccucccccaaauauucaaauuuaaguuaauuuccuagcuccuuagccagaggaauuuaaugcuaaggaauaacaaagaaucuaaauacuaagaaguacaaguugagcuuuggaguaccacaaaccauugcaauagcuaagauuuuuuuuuuuuuuuuuuuuuuuuugcgugcccuacccuaauuuuuaucccauugaaagcaauaucauuguugcucucuccuacucuucguuuuccuaacugauaaugugugggcuguguuuaauuuacauaaguaaaucaauuucagauauuuauuuuuccuuggauuuuggucaaccuuaaugaaauauggaugguuuuuuauuaugcccuauacauauuuauuuagacauguugguaaaauaaaugaugugaauuuuacuauucaaguaggacuuucaauuuuuuuuuacuuuuauuuuuuugagacagggucuggcucuguugcccacgcuagaguggcaguggcguguucuuggcuuacugcaaccucuacuuccugggcucaagccucccaccucagccucccaaguagcugggacugcaggugugugcuacugcaccugacuaauuuuuguauuuuuuuguagaaacaggguuuugccauguugcccagggugggcuugaacuccugggcucaagugaucuggccaccucagugucccaaagugcugggguuauagaugugagcagccaugcuaggcuaguuuuuuucauaacacuguuuaucuaauaauaguuuuuaccuucauuaugggcccuucaaaugcuugcgaugggggaaaauauuacaauuuaaaacuguaacguagauuuuaaauauuucaguaguauuucugacguuaauuaaaugaaaucugagaccuacuccuguuuucugagccaugcuuucuaacuucuguuaacuucagaaguuugugaaucacauuuaccugugucuguuucaguuauaaaccgguggaccauaagcuuauuuggcuacccuuacgggaggcauuugaggaacucuuugcucagacauuuuccaagaaacaaaacuuuacguucuuggggcacauucagaccuguuacagacagaaacgguggcaugaucuccugagacuaaugcagcauguacacaagucugcuguuaacaaggauggaaaagacagugaaacugguaaggaugugacccaggcugccaugggggagggcauggggcugggcuuuaguuaacauauuaguuuuggggaagaguaaagcgauacaaauuggagcuuucuaggacuuuggcagaagugacuaauugugaaguauugugccccauuauucacguauuuccacaaaaacaguugacugguaaugcugaugugcaaguacuauuuaguggucaguaaggcacauuuccucagaaaaagcuuauuucuaaggagcuagauucuauagccaagaggcuuuugcuggcuuaguuuacuucugugugguuccuuaucuguaaagcaggaauaaaaauaacuaguccagaggguuguugugagggauaaaugaggcaguuaauacauauauauucauacaugugggcuaauuagugucaugucuggcauuuuguuagcauuauacaaguuuuuagacuuaguguuuuguguaagaugcuuaauuuuuguguguuuuguuaauuguauuuguuuguuuagaaguuguauauauuacaauucaaaaugugugcugaauucuugucuuucuuuuuuaggguuacucauaaaagagaaaugggaagcauuuggucuuagacucaaccaugcccaacaacagaugaaaaugacugaaaauaccuuauuguucgcauuuguagagguauuucuguuuuuguuauuuagcuuaugggaacguugauuuuaugcaaaacaauguuucaggcagguuacuauuuuguauugucuuaaugaaauaaugauuuugggggaagauuuugaaaaguguccuucaugguaauuauggcaauuauaagaucuuaaugagcaccaucauuauuuaaauaaaaauuuuaaaaguacaaauugauaaauuauaauuguauauauucaugggguacaaaaggguguuaugauuuaugaauacgguauggaauaacuaaagcuagugaauauucaucaucucaaauaccguuuuuuguagugagaacauuugaaauguacugccuuaguaauuuugaaauguacaagacauuauuauuuauggcauggucgccaugcuaugcaauauauaucucaaagggaagaaagcuuauuuuuuucugucuaauuaaggcuuuguacuuucuuuucuuuuuuuuugagacagagucucacucugucccccaggcuggagugcaguggcacagucucggcucacugcaagcucugccuccuggguucacgccauucuccugccucagccuccugaguagcugggacuacaggugcaugccaccaugcccggcuaauuuuuuguuuuuguauuuuuaguagagacgggguuucaccguguuagccaggaugaucuugaucuccugaccucgugaucugccagccuuggccucccaaagugcugagauuacaggcgugagccaccgcgccuggccaaggcuuuguacuuucauuacucuguacucccuaacucuccagccucugcuaacuaccauucugcuggcugcuucuuugaguuccauuguuuuagauuucacauauaagugagaacaugcaauacuugucuuucugugccuggcuuguuucacuuagcauaauauucucugguucuauuuaugucauagcaaaugacaaaauuuauuucuuuuuucaagccaaauaagauuccauaggauuccauuguuuguauauauguauauauacaacauuuucuuuauucaucuguugauggagacauagguugauucuauaucuugacuauugugcauaguggugcaaugaacaggggauugcagacaucccuucgacauauuguuuucagauuuuuuuugggaauaccuggaagugagauugcuggaucuauuacuauuuuuaaagaugcaauugaugacagcuagugaacucuggauucuuucucucaccaugugugucuccggggaaagaguguguggaugugagagagggauuuggacccguucacuucauugccccaauuuuaaucccagggcauggacaucucuacuguuugcuguccugugacccuguaggaaggaucaacuugguuaaauauuuguggcuuggucauuuaaaaaaaguuuguuucugugacaguccuuagaugaagcccuagaggaagcaggagucuuacuuggugauguuuuaguaacagagaaggucuacucaaccauacauuauggguguggaaaauuuggucaucagaauuauuauuauuauuuuuuuuugagacagagucugacucugucacccaggcuggagugcgguggugcaaucuuggcucacugcaaccucugccuccuggguugaagcaauucuccugccucagccucuggaguagcugggauuacaggugugugccaccacgcccagcuaauuuuuguauuuuuaguagagacgggguuuugccauguuggccaggcugguguugaacuccugaccucaggugagccacccaccuuggccuuccagagugcugcgauuacaggcaugagccauugccccgggccccagaacuauucuuuuuuuguuuuugagacggaguuuugcuuuugucacccaggcuggagugcaauggcaggaucucagcucacugcaaccuccgccucccagguucaagcgauucuccugccucagccuccugaguagcugggauuaagggugcgugccaccacgcccggcuauuuuuuguauuuuuaguagagaugggguuucacuauguuggucaggcuggugucgaacuccugaccuccagugauccgcccaccucagccucccaaagugcugggguuacagacaugagccaccacacccagcccagaauuauucuuaauaggauuauuucuaaaaccaauuaaaucuaggaaauagaauuugaagagauaacaccaguguacuaaagccaagggauguugcauuuuaaucuucaguaggugugaaaggcaguguaugacaaucacuaaacacucugggauuuagacauuugucuaaucuugguauagccugacccuauauuuauuuugaguuuuaauagucacuugggugccuuuaaagaccugacuacaauguaagcuauuuaccugaccauccacauaaugagaggauuuaguuuauugcaucucucuguuaggcucaaagauauucccuugaccuuuuuggacauuuaaaaaauuaacuuggccuuaacucugccuaucugcugucagccaguuaaaguauaggcccaucaaguaggaaagauuugccccgccucuauuucuaacccugcuugcauaacuguucuuggcaagugugccuuuauuugacacauuguuaacauuuuauuuuaucuuuuucuaggguacauuagcucaggcuguaaagaaaggagaguggaucuuguuggaugagauuaacuuggcugcuccagaaauacuagaaugucugagugguuugcuugaaggaucuucuggaucccugguguugcuggaucgaggagacacagguagcacuugaaucccuugggauuugacuuggugucaagcccuguggccacuuuagagugagauuuuuuguuguuguuguuagaaggaugacaugggccucccaauggaauuuguucauucuuuagauauuaauuuucugcaaagugcauuaaaguguugggugguauggggaaugcaaagaagaauaauauaauuugacaagguguuugaguuguggauaauagacacacuuauaaaauaacaggugaaugguugauaaaagauaaauaacagugaauaaacauaccgcaaaagacugcaguauaagauuagauugaauacauaggucuggaaaguuauuucagugggguuucagaaaagacaaggauggugugagcagccagcaucaggcuggcugggccugggguucuguggaauuagauaaucauaccuuuguugagaauuuguaauuuucucuuaacagagccacugguucggcauccugacuuccguuuauuugccuguaugaauccagcaacugauguaggcaaaagaaaucucccaccaggaauaagaaacaggugaggguuugguucuuggagacuuuccuuuuuugcaacagguucuugcucuguugcccagguuggagugcaguggcgugaucuuggcucacugcaaguccccgguucaagcaguccucccaccucccaccucccaccucagaauccugaauagccgggauuaugggugcaugccaccacacccagcuauuuuuuuauuuuuuuucugagacagagucuugcucuguugcccaggcuggagugcaguggugugauuuuggcucaccacaaccuccaccuccuggguucaagcgauucuccugccucagccuccugaguagcugggacuacaggugcaugcuaccaugacuggcugauuucucuauuuuuuuuuaguagacacuggguuucacuauguuggccaggcuggucuugaacuccugaccuugugaucugccugccucagccucccaaagugcugggauuacaggugugagccagugcgcccggccucaaguuuuuguauuuuuagcagacgugggauuucgccauguugccuaggcuggucucucacugggcucaagagaucugccugccucgaccucccacagugcugggauuaccaagacuucguuuuuagauucucuuuauuuauagauugguaauauuaauguaaccggacuuuagagcaaugcuugaaauugccgcugauagaggaaucuuuauuaccuuauuugucauauuccucugcucucuguaggugguaggcauaugggaaucuucagaacacuggagaauuuuucccuuuguguuaguaugacaguggauauuguugaaaauaaaaaucuuuccuuccucagguaaucuuuuggcuauuagaaaaauuucauaacacgauauaacaggaaaacauauaccaguauacgcauauuuuaggaacacaguccucuuugggugaggcuaaugauuugaaaaggccuuuaaaguuucuuuuauuuuucgccacuaagcacugacaugaacaagguacuuaguuguugguguuuuauguauguaacauuugggaaaaaauaaauuaaaugaccagauuuauuguugguaaccguuuacuucauuuugaauuuuaaaauaguaacuuuauuagauccucucucuucauuauaaagcaauaaaagcuuguuagggaagcuuuagaaacuacauuaaaguaguuguuuucucuucaaccauuuugucuuugaugaugagggggcuuguuuuuuauugcacuuauuuuuuuaaauaggcgauuaugauaaaaaacacuugaaaaugaggauaauuaauucuuauuuuuguaucuuuuuuuuuuuuuugagauggagucucccucugucgcccaggcuggagugcaguggcgcaaccucggcucacagcaggcucugccuccuggguucacgccauucuccugccucagccucccuauuagcugggacuacaggcacccgccaacacaccuggcuaauucuuguauuuuuaguagagacgggguuucaccauguuagccaggauggucuccaucuccugaccucgugauccaccggccucggccucccaaagugcugggauuacaggcgugagccaccgcacccggcuuuuguaucuuuuucuucuuguaaggacuauacguagaagacuuauugcauagaagaagcaauaaugguauauuuuugguaaugguuacauuauccuuuaauuaugcuaaguuucuauaucagguugaaagacauuuuauacuacaagcaguuaaaaugagcugacauagcuucuucuguuucauguuuuucuauugucaacauaguuauauuaacuuccuaaaaaguguuuauuauguauuguuuuacagguucacagaacuuuauguagaagaauuagaaagcaaagaagacuuacagguucuuauuguagauuaucugaaaggauugagugugaacaagaauacagugcaaggaaucauaaaguagguucccuuuuguaugucuuuauaagcucuuucucugaacaugaaaaugugcuacucgugcacacacacaaauauguauucuuuuuuacuucuaacuugagaaaacugauggcaggauuauuauuuagauucucuuguaaaguuggaaccugauaugaacuccuuuagguuuuucuaaggaaauuacauagaaagcuaugaaucauuaccuaugagaagauauaaaccaucagauaaugcucuccugauuaccucuauauucauagcugaggguuugaauucuuggagauguacauggcuugcguuuugaaucugucuugaagaagguugcuuuucuauuugcaauauuuauacuagcuaugugggauguaaggagaaaaggguuaauauaauugauugugucagguuuggaauuaauggaagcuuagccuaauaaauaauagaguaguuacguggcuugugcuuuaauuugagacuguuauuccuguuuuuuguaugccauauggacaacaugcaaucuuuugugucagacaaccucaauucuaguauugguucuaugagaaacuaauugugucauucugggccaguaacuuaauuguguguucuccagaaagaaauacaacauguaaaaggauugaaauagggugauauuaauguuuuacuguguguuuguguauuuuuucucuuccuuaauacaaauacuuauugagugcccuggugcugugguuauagcuaugaguaaggcagacaaaaauccugguucuucucauugagcuuuaauucuagaggagucagguacuguaauuuuagguugugauaagugaaaacauauaaagcugaguaggguguaagaaaaugaagacuuggaguucuauuuuuuuuuuuuuuuuuuuuggauacaggagcuuugcuuuguugugcaggcuggucuuaaaccccuggccucaagugauacgccagccuuagccucccaaagugcuggaauuacaggguugagcuacagcaccugguccugaaguccuguauuaaauagauuagucaacaaggcauguguuuagaaugcuucagaaugguuuaccacaacacacccuaaauuggaauacuuuuugguagccaagaauauuuggacaaaaguguaaauacguauaguuaagauuccagaugcuaaagguaaacuuuuauaagugccuuauuuuaucuaaagagguagauaaaggauaaaauuaggcacuuauaaaauacugauaguacaaguaguauauauuccauauauuaaaaacucaguuccaaaacauagguucuuucuacacaaaaauauuuugaaauauuuugaaaauauuuugaaaauauuuguguauuuuugcuaucuacaaaaauauuuuguuagguagcaaagaggcaagauaaagcucauuugggcaggaacuugaauuucaucugugaugcaugcauacuugguuucauuugaucuuguggugcuaauugaucaugaauuucacaaagugcaagaccuucauguuucagucugaaacuuuucccauccugucaucaucuggacuucuaaagugugguagugacaauaguaauggccaucguauccuccugcuuuuuaacguuuugucaguacuaauuauagccauauucguagccuuucaaaacaccaugcguuguuugccaugucuuuguucauccccauuuuugauugcauaggaacuuucuuugucccuuaagcuugaacagacucuggaacacagaagcuucucaccucucuuuaucaguaccuuuuugcuagaggaauugcacauugcacuucccaguuuccccaaggaaauagauagguguucauuuuuuauuuugaaagauaucucugaguaugugaaaaguagguuuaaaagagacuaagauauuuugaugcaugccccaggaaguugugugcaugaucauuucugaucuaaaaaauguccuuuggguuuucuguagagaauugauaauacuggauacuuauuaguaaauaaaauugccugaccuuuauucuauuuguagcuucuacacagcuuugcggaaagagucugggaccaaacugguggauggcacuggccauagaccucacuacagccuucggacucugugccgggcccugcgauuugcagccuccaauccauguggcaacauucagcgcucacucuaugaggucuuucugaagucucuuugacuggauaugagcuuaauggauggguucaugggaaggaaggaauagggaugcauaugccagguugccugugcuuuccaguuagucagaucagcccauaauaccucuuaccagauuuaccuugcccuuuuaaauuaaauauuuuacuuuuuauuuuaaaauuuuuauuuuuaauuauacauagagacagggugucacuguguucccacucuggucucgaacuccugggcucaagcuguccuccugccuuggccucccaaagugcugagauuacaggcaugaaccaccgugccuggccuacccuucccuuuaucuaccaccuuacuauauuuaaaaguugggaagcagcaucacccaagagguuaaauuuuguucuggaaauaaguuugguuguauugcagaagguuauuuagcauuaugcauauuugucuuuucuuucuaggguuuuuguuuggguuucuuaacacagcuugacagggcaucacacccaauaguucagaagcucaucugucaacacauugucccuggcaaugucaagagucugcugaagcagguauguucuuuuguuauuuuugacuuguuacacuugaaaggcugaauuaccaaauuuucagcuguuugguuuuuuuuuuuucacauaacuuuuuaauuauaaagguaaucuguugcaaaaaguuuaaacauuacagaaacauauguuuagauggugaaaguuuccaauaagcgugcucuuuggagauuuaaauacuguggauaaucuuuccagauaaauuguauaauguauauauuuuauuuucuuacauauccaaauuuugauauguauauguugauuuauugagguaaauuguaaaauuguaaaaaauuguaauaugcguuuaauguaagugggacugucuuauaagaauauuguuuuuuuguuuuguuuuguuuuguuuuuuuuugcagauagagucuugcucuguugcccaggcuggaaugcaguaguguaaucucagcucacggcauucuccccuuccguggcugaagugauucuccugucucagccucccgaguagcugggauuacaagcgcaugccaccaugcccagcuaauauuuguaauuuuaguagggacuggguuccaucauguuggccaggcuggucucgaacuccugaccucaugauccguccaccucggccucccaaagugcugggauuacaggcgugagucaccgugcccggcccauaagaauauucuguagcuuuccuuuuuaaccuaucugaaucuuggauauauuuuuguuuuuguaccagaguucauugugacaugccuucuaagggccacauagcauuucacuggauggguacaccauaguuucacuauuugcauaguuuaacuacacaguuagguauaaucuauaccuucugauugaugguugggucuuuuuugaggaggcaguagugggggcacuguuagaaacaauagccguuuuggauuuggcaggaaauuacagaauagcaugggacugaaagaggcugagagaaacuugcucacaaucaacauguaaauuggcuuguuuacuuguugauugcuuauucauuaggaagagagagcccuugggacuuggaguuucuuuggacucagccuuuuaaaaaaucguacaaguaacacaugcguaaauacuuucgguaaauuguaaaaacauugaguaaagacucagguuugcuuuuaccauuauuguaaucaaauaccagucucuuccaguuggucuuuuuguguguguaugccucagggugugauagaaacuuaaaaagauccuuccuccccucccccuauugcuucucaacucaacugaggaggccuuaaaagcagggccuagacguguagcuugaaaucuggggaccaaaugcucuagaagaguacuuuuccauaguuauagauuugaccaccauuuaaccauuuuuuuacuuauaaaaaugggaauuuguauaaucgaaacuaauaacuuaaaccauaucucagcaaagugaugccaucauccacaauauuauccuuaaugggcuaguugcucugaaaagucagguuuacuuuuaaugucuucuaggcaauccagaguauaauagugcaaaaccuccuuccuuacuacaacacuggcccuuuuucggggaacaugguuuauaugaaauucauguuuuugauaaaaauaauuggagugggcauuuugauaugugagagaagagaacugguacauaaaccuucugggaauuuguuuugauucagcuuuuuuccaaacccaccuacuccacuucaguuuuaaaaccaauauauaacaccauuuuguucucauuccucauaauuuuauguucauauuucauccaguuuuaauguugaaaguaugcagaacaagacagcuuguucaacaaguggcuguuuuccuacuuuaugcccuucucugaaagaauguacaacuguggguuauuccuugaacuucugugucuuucagccuauuccagagccaaaaggaggucggcuuauccagguugaaggcuacuggauugcggugggagacaaggagccuacaauagaugagacguacauucugacaucuucugugaagcugaaccugagagauauaguccgaguugucucugcagggugugugggcuuuuuucucgcugccccgaacuugauacaggcauaggcauugaugacauuuuggucuaacuuccuuaacuuucaaagagcuuuauucuuauucauuggccaacugaacaauuacuuacaaaagucaguacuauaacuuuuuccugguagaaaacuuuguuucuaguugugcaacuuuggagggagcacuauggaugcagaugauuuuaucuaucuuuaaaguuaucuuuuguuauuuugcugauaaauaccacagauuauucaguaaauggcuaaaaguucuacuuacaguuucuuacaaauguugccagcauaguuggaauugcuuuccuuaguauuuuuugaggaauaauguuuacaaagauacuucucaguguauaggaauaaaaauguucuucugcuucuugcauuuuccagaaauguaaaaaggggaaaaaaaaggaaaaaaaaaugcucuuuuaaugaugcuguuaaaugaugucgucauucuuuuaaaaaaaaaaaaccaaaauaauacuuggccaggugcaguggcucaugccuguaaucccagcacugugggaggccaaggcggucggaucacuugagcccaggguuuugagaacagccugggcaacacggcaagacucugucucugcaaaaaauacaaaauuuagcugggcuugguggugcaugucuguagucccagcuacucaagaggcugaggugggaggaucacuugagccugggaggucgaggcugcagugagcuaugauugcaccaccauacuucagccugggcaacagagugaaacccuuugucaaacaaaacaaaccaauacucaguucugguuucucagcuuuguaauuuuuuguuguuuuaaguugcuuaauuggcuaaucuuuuacagaaccuauccagugcugauucagggagagacaucaguugguaaaacaagccugauccaguggcuggcugcagcuacuggcaaccacugugugcguauuaauaaucacgaacacacggauauucaggaguacauugguuguuacacgucugacuccucagggaagcuugucuuuaaggaagguaggguuaagauuccauuccauggacauagguguuuauucuuucacacacauuuccuuaaguaauauucuucauccuuuccaauugaggcacauggaccuuugcuguaacagccggcuuuucuugaugccugagcuaagauaguuaaggggugaugcauaaggugcuggcuuucuuuagguucugcuaaucuugcuggcuguauacaggacuagggccaauuuucaagaggggaauugaacugcugcuuuauuuucuaggaauucagagaaugggguuaguguuagccaaaaggaaguugggaauagucaacagaauguggugauuuaaaugaaauuagacugcaggggaaagauuacacaagaaauaugagguauuuucagccuuggcuucuuuucuguggggaaaaaagggacuauuuuaauugaaaauuguuccuccuugaucugcagugucauaauuuguuuugaggcaagacuagcuacagaaaguaauuugcuuugaaauuugaugauaaccuaggauuuguugauuuguacauaaugcauuuuaaaacuuuguacugauuuauacacuaguucuugcuguuuguuucuuccuagguguucuuauugaugccaugagaaaaggcuauuggauuauuuuagaugaauuaaauuuggccccuacugauguguuagaggcgcugaauaggcuguuggaugauaaccgugaauugcuaguaacagaaacacaggaaguuguuaaagcacacccucgguuuaugcuuuuugccacccaaaaucccccaggacuuuauggaggcagaaagguauguagcauuugucuccuuccuucaauuuguuaacacaucagauaguagauuuuucguaguaagaaugaaauguuuuuacuucuccuuuaauauuuuauggugaaugucagagccuccauauuggaaauuaaaaggcaccuuuuacugcauucuuccugugcuuugucuagguccuuucuagagccuucaggaaucgguuuguggaauugcacuuugaugaguuaccuagcuccgaguuggaaacaaucuugcacaagcgguguaguuugccacccuccuauugcagcaaguugguuaaagucaugcuggaucuucagguacuuaguuucaaauggaauguauugauuauacuuggugaucaaaauuucauggcuucuuuuguuagaaaaaagaaucugucuguugauguauuuuuccaaguagagauuuuuuuuuauuuuuuauuguuuuuaauuuuuuuauuauuuauuuuuugcaagacacagucucacucuacucuccuggcuggaguguaguggcacaaucauagcucauugcagccuugaccuccugggcucaggugauccucccaucucugacuacucacuccuuaguagcugggaccacagaugugcaccgucaugcccggcuacauuuuuuuuuuguagagacaagguuucgccauguugccccggcuggucucgaacuccugggcucaagggauccacccaccuugaucucccaaaguuuugggauuauaggugugaaccacaguucuuggccuucaaguagaggucuuuuaaaugcuucccaauaauauauauuuuuaguuuuuuuuuuuaaucaaucaacaauuuuacaucauuaaaauuuuucugauauuuacauaugaggauuuuguauuuguguauaauauugaagcauuuuguuuagaauguaauuuggcuuagggaaaacugguuuuugguuuuuaaauggauauaguccuugaauggacauaauuaaagagauccauucuuuguggcucccccuagucaacugcaaagcuacagcugaucuuuaaaaauuccauuuaucuuaugggguuaaaaguuuucuuuaucagaaaguauacauugucaaacuucuuuuuagaaagcuaauaauaaugaagacuccuaccauuaugguuccacauuguuucacuaaucuuccugcaucuuugccaccauuugcauuacuuuuuguuuguuuuuugagacagagccucacucugucgccaggcuggagugcaguggcgcuaucucagcucacugcaaccuccgccucccggguucaagcaauuccccugccucagccuccugaguagcugcgacuauaggcgugcaccaccaggcuuggcuaauuuuuugucuuuuuaguagagacgggguuucaccauauugaccaggauggucucgaucuccugaccuugugauccgcccgccuuggccucccaaagugcugggauuacaggugugagccacugcgcccauuugcauuacuauuaaucaucuuuuuucuauguggcauaagaaauguggaauuccauuuuauguucuuaauuuaaacaugaauuugaacauuuuuccucagaauauuacaaguuauuuucauuaaaaaauuaaucuuuuuuuuuuuuuuuuuuuuuugagacggagucucgcuuugucgcccaggcuggagugcaguggcgcagucucggcucacugcaagcucccccucccggguucaugcgguucuccucccucagccucuggaguagcugggacuacaggcacccgccaccacgcccggcuaauuuuuuguauuuuuaguagagacgggguuucaccauguuagccaggauggucucgauuuccugaccuugugauccgcccgccuuggccuuccaaagugcugggauuacaggcuugagccaccacgcccggccaaaaaauuaaucuuauucaguggaaugaaaucauuuaaaugggagcauaaauuuguuaugaauuuuauaugcauuguacuaaaaacuuaccaugcauugcagcugaugccccuuuucauuuguuuugauacuucaacaguccuaucgcagaaguucuucaguguuugcuggaaagcagggcuucaucacccuucgugaucuguuccgaugggcugaaagauacagauuggcugagccgaccgagaaggaguaugacuggcuacagcauuuagccaaugaugguguguuuucaaucaaaugcucucaauauauaguuauguuaaaugucaaacuuuuuauuaaaacaaaucuugccucaaauugugauugauacauacauuugacuagguauuccagagagccuguuucccuccaguucuaacagcuuuuguaagugaucuuauuccugcaggccuccaugcuaauaaggacugguugcuaagguuuucuuacucuuugcuucagguagccacaugugggagucaggauauggacauagccucuuugggaguuaggcaaaugguugaugguagcuuugugggccauuuuucugcagugucaccacagguagucuggcuagugcuuuacagacauacagaaagcugauuugucagaaaacaucagcauucugagagaaaaaaauuauauaaccugagacucagguuuuguuguuuuccuuuaaugcaugggaaaaauuuguuacuguuugugauaggauacacaguguuuuggaaucuucugauuugaaaagugcugaugauaggauacaaaguguuuuggaaucuucugauuugaaaagugcugaugauugauuaaugggcuaguuaauaaguaagaagaguauguaaaacuaguacaagagauuuuuucucuacuuguaaagaauauuuacauagaggaauacuuuuuuaaaaacuuuuuuucuuucuuucuuucuuucuuucuuucuuucuuucuuuuuuuuuuuuuuuuuuuuugagauagagucucccucuguagcccaggcuggagugcaguggcacgaucucagcucacuguaaccucugccucccgggucuggguucugguucaagcaguucuccugccucagccucccaaguagcugggauuacaggcaagcgccaccaugccuggcuaauuuuuguauuuuuuguagagaugguguuucccauguuggccaggcuggucuuaaacuccugaccuugugaucugcccaccucagccucccaaagugcugggauuacaagcaugagccaccaugcccggcaaacuuuuuuagugagguguaacaaacaguaaagcauuuucccauguaaaguaucaccuagaccaagauuuagaauauuuccaauaacucaguaggucucuugacaguggagguaaucacuacccugacuacugucacuacuaauugacuucugucugauuaucacuacuaaucugauugaacagcauuuugccuguccuugaguuucaccuagcugacaccaugcaguauguacuuuuuggguucuggguuuuucacuaaaccugaugugagauucagucaugccauuauguguaucaggacuucauucuuuuuuuucuuuuucuuuuuaugugguaauccacuguaugacgacaccauaguuuguuuauccauucucuugguuauggacaucuggaucauuuuaauuuuuuaguuaugaacaaagcuucucugaacauuccugcuuaugucuuucgacacacacauguucauugguguuuggggauacuagaagucauauugcugaggcauagggcagguauaugguuaauuguaauaggcuguccuaguucuucagauuucuaccucaccagccgcguaugagaguuucuauuguuucauauucuccauaucccuugguguucccgguagacacuugaugauuccucuccuccuuuuccuccuccuccucccagguuauaugcuucuggcaggucgagucaggaagcaggaggaaauugaugugauucaagaaguccuugagaaacauuucaagaaaaaauuguguccucaaucucuuuucuccaaagaaaauguucuaaaauugcugggugaguaggccaaaaucccuagaggaauaugauuugaguuguacucauuagaaucuaaauauuuauuuuuccuuggauagguaaauugucuacucagauauccacauuggaguguaacuuuggccauaucguguggacugagggcaugcggagacucgcgaugcuagugggaagggcauuggaauuuggugaaccugugcugcugguuggagacacuggguaaagaucugugacagugacucaugaggguucauuucaauuccauaggauuacuugaguuaucacugaagaacucaugaaaguauuaauccccccuucuuuccuccuuccucuuuuuucuuuuuuuuuuuuuuuuuuaagaagagacuaagagugggucgggggcugggggagggauagcauuaggagaaauaccuaauguaaaucacgaguugaggggugcagcaaaccaacauggcacauguauaccuauguaauaagccugcacauucugcacauguacccuaaaaaaaaaaaaaagaaacuaagaucuguuacuguuuaguuuccucuaccuucagacuagguucuuuguuaauggaaaauaauggcuuuauuauuauuauuuuuggagauggggucucacucuguuguccaggcuggagugcaguggugcgauacggcucacugcagccuugacuuucuggacucaagugauccuccuggcucagccucccagguagcugggacugcaggcaugcaccaccacacuuggcuaauuuuuaaauuuuuuuguaaagucagagucucagcugguuguggugguucaugccuguaaucccagaacuuugggaggcugaggcaggcggaucacuugagcucaggaguucgagaccagccugggcaacauggcaaaaccccgucucuacuaaaaauacaaaaauuagcugguuguguuggcaucugccuguaguccuagcuagucaggagguugaggcagaagaaucgcuugagccugggaggcagagauugcacugagcugauaucgugccauugcacuccagccuaggcaacaggagugaagcccugacuaaaaaaaagauggagucucacuauguuguccagacuggucuugaacuccugggcccaagugauccuccugccuuggccucccaaaguguugggauuacaggcaugagccacacuguaccuggcaagaaugauuuuuugcuucauugcauugagggcaguuuuugucuauuuaguucuuuuaaacagugagauucauucuauacguguguagagaagagauaaacuagugucucuugaaagucugucaagucuauaaggauuagauuucuuuucccucucuugguggugguuuuuuuuuuuuuuuuuuuuuuuuuuuuaagaaggcauuccgcucuuguuacccaggcuggacugcaauggcgugaucucggcucaccacaaccuccgccucccagguucaagugauucuccugccucagccucccaaagugcuaggguuacaggcgugaggcacugcgcccagcuggugauuguugauagaacuagguuggaguuugugcaguacauaccuucuggauaagaauaugggagagugcagucguguagaggggugccaugagccugggguugagguuccacauuggccagcacuguuuacugcugcagugagacucccacagugguucuucucuuuugcugaggggggguguuuauggauguguauuugaaacacaugccuuguuaaucaguugcacaucucuaacaggugugggaaaacuacuaucugucagguauuugcagccuuggcaaaucagaaauuauacucugucagcugccacuuacacauggagacaucagacuuccuggguggccugcggccagugagacaaaagccaaacgacaagguuuguccagcagcaaguguuccuguuauuuuaaaaaacugcaguuagcugugcaugaguuaguggugggguuucuggagcuggguucugguuugguuaaaugugcauaucugcagauuuucucuggucuacaagggccuucacaagcauucuggugugcaaguucuaucuccuguucucagauucuuacuuuccucagaaugccuacuucaccccuggaaacaccagccagcugcauguauauugucuguggagccaccugcccuuuaauuuuccccacuuuuucaaauuauaggaagaaauugacacaucaagacucuuugaguggcaugaugggccucugguucaggccaugaaggaggacggcuuuuuccucuuggaugagaucucauuggccgaugacucugucuuggaaagacucaacagguacgugccugagagguuugccuuguguuugauauuuuuguuggugugauuuuuuuuuuucucccugagacaguguucucacucugucaccccaggcugcagugccgugucaugaucauaguucacuguagccucaaacuucugggcucaggugauugaugugauuuuuauagauauuuaaucuugugcacaguaauacuucucauaggugcaccuuaguaaaugcuugaaauuauugauguauuaccaugucuuuuggcuuuagcauucaguguuuccuaaauuucuagguuuuuuuugcuaucaauaaucagaacaaugggaucguggaaugguagggcuaaaacaugagccaaagucaaaacuauuuuuuaaagugaauuauaucccuacucucuuaauauuuugaaagaacuguagucagaauccuagacccauggcuauaagccaucaucagaccucagaccaauaugaaucuugauguaguaacacccauuuuuucuuuugagguauaguuuacauaucauaaaauguauauuucagugaguuuuaguaaguuuauaaucccaugauggguucuucuugcaagcuauaugcauagaacugagucacugaguuagugguauugcaguagagaaauaauuuaguaguugcagagcuagccaaguggaaggacaggaguuuauuacucaaaucagcuuccuaaaaauuuggaagauagggguuuguuuguuuauuuuuuuagacacagucuugcucuuuaucccaggcuggagugcaguggugugauuuuagcucacugcaaccucagccuuccaaguuugauuguugugccucagcuucuugaguagcugggcuacacaugugugccaucaggcccagcuaauuuuugcauuuuuaguagagaugggguuuugccauguuggcuaggcuggucuugaacuccugaccucaggugauccgcccaccuuggccucccaaagugcuaggauuauagaugugagccacugcacccguccuggaggcuaggguuuuuuuguuuguuuuuugagacagagucuacuucugucacccaggcuggagugcagcgaugcgaucuuggcccacugcaaccucugccuccuggguucaagccauucuuuucauucagccuccuguguagcugggacuacaggcaugugucaccacucccagcuaauuuuuguauuuuuaguaaagaugggguuucaccauguuggccaggcuggucucgaacuccugaccucaagugauccuccugccucugccucccaaagugcugggauuacaggcgugagccacugugcccggccgaggcuagggucagaggccuagagaauggggaaugcuguugggacaggguugaaaucacaggaaguugagcuaucuuuuugcccuaaauaaguucaugggaucauaagaccuguugagccacuucuugguauggguuuccauuccagguggugcuagccguuuuaucagaaucagggucugaaaaguaccuuaaacacuaaucuuagguuuuauaauagagauguuaucuuauaggagcaauugggaagguuaugaaucucgugaccucuggcuguguccugagccguaauuuuaaccuuuugguuaguuuuaugaaggagggguuaguuuugggggggcgcuauuacuuuucuuuuaaaguugaacuguaaacuaaauuucucccauaguuuacuuggccuauacccaggaaugaacaagggcagcuuggaggcuagaagaaagauggagucaguuaggacagguuuuuguguuuuuuuuuacugucauaacuuuuuguuagacuuuuuucucacucauaauuuuugcaaaggugguuucaagcuuugcaaccaucacaauuuaguuuuuguguuuguuuuguuuugagacagcauccugcuguauugcccaggcuggaguuuagugguacagucucagcucacugcagcuucugccucucggguucaagugauucuugugccucagccucccgaguagcugggauuacaggcgugagccagcacagucugcuaauuuuuguauuuuuaguagagaugggguuucaccaucuuggccagguuggucuccaacuccuggccucaagugaucuccccaccuuggccuuccaaagugcugggauuacaggcgagagucacugcgcccggccuacaauccaguuuuacaacauuuccaucauucaauagaauccuuugugugcauuacacuaaauuucugauuaaucucuuuuuugucucugcagauuucuuuucuggguauuucagauaaaaguucucuucucuuacuuugcauugauguuuugagguucauuccuauuucagcacguauuauuaguuuguuccuuuuugucccgaauaguauuggauauaccacauuuuguuuauccauucaccagucaaugauauuugaguucuuucuaguaguuggcuauuaugauaaugcaugcaauuuauuuguuuucuuguaaguuauucauuuuuaagaccaaugccuuaauaguuuauaaguugaaaaguuuuuuuuucuugaucagaaauagccauuauuacacagaaauugggauagugagucauuuuaaaauuugugauaggaaaccauuaacuaaaguaaaaauucaguagaaagaagauaacuuuuuuuuuucuuuuaaagagcauugaagauuguaaaacagaaagauuguauaagcccuuuucacuguucuucaauuuuucuuuuaguguccuugaaguagaaaagucucugguauuagcugaaaaaggcaguccagaggacaaggauagugaaauagagcuguugacugcugggaaaaaauuucguauucuagcaaccaugaacccugggggugacuuuggaaaaaaggagguaaaacuuuacugaugcacauuuucuuucuagguuuugaccucagcuuacugguacucguaaauauaguauguaauaauggauuuggaauuuuauguuagguaaaaaguggguaaaaaguguaaaaacucaaaaauauuuuaaaauaauuauuggguuagaaaaaaauucugacacaaauaucuccuuauuugauaucucacuuuguguaugugccugaaaugucauuguuacagucacuuugccuagcccuuuacauauguuacccugagaaagcucacaggagcucugcaagaaaguuauuauuguaguuuuauggaugagaaaaguuggaucugaaauuuaaguuuaaccucuguuuuuacaguccacuuucuuaaacacaccucugcuuucaugggugguuuuaaagugacaaaaaagucacaaccaggaacccucuucugguuuguagauggagcuuauuuguucucguaaggguuaugugugucacuuucugacugcugauaaaguaaagggcagaggguaguuccuauguucagaggguuguguucagauauauuugggaaccaacaaccuuguugguuuccagcucaagaaaccuuucaguggagaagucagcacuauguguuggaucccagucuguuaaaguuaggaagagagugauguaacaggucagggaugaugagaagaaacagagggguugaucuuaaauaagacaauuaagaguguugguaauuugguggguagcugaaaugauauauugggccuagguuuccucaguaucauaagaugaaaauugucucuaugcuucaagauaugcucugaagagagggaauaaaauacauugcauucaaaauauaaaaacuggcuucugggcaaguagaaaugccacagagaggucugauuucaaguuuguguauauuagcuuggcugucagauuaucuuaucuuguuuuccucaagucaaugcuugcugacuuuuacccaagggaaaguuacuuuuuaguuucgcaugccuaacaagcagagcaagguaggaugcuggacaccggagguacugguugucuaugauacugaugagguacacacacguaugcuuuauuccugggccucugugguagaccagauagaugaucaucaaguaaaaggaaaguaauuacaaaguaaucagacaaaccaauaaugaugcuuauguggcauugcaaacauuugugaauagugucaacugaccuuguggugggaaaaggaaucuacaggggcaaaggcccuaagacuggaguggcuaaacaauuucuuguuauucaagagguagaauauauacuuuuuaaaaucacacucucauugagcuauguaaaagaaguuucuuccuccuacaucagacugcccuucucugugggaagacagguguuuauuuucucugaaguauuauuuagguaccugaugcaaaguaaagguaaaguaaaaggaagaaucuuugccugaggggaagaguucagauuugacugggacuggcuggaauccugcuuccaccacuuagucuguaaggccucuggaccacgucuauuaagaaagugaugaugauacuggaaggugucauggaauauaaggagucaagacaaaguacaucuucaauuaauuauaucugauaguagaaauaauuuuuaaaaguguguaguauuugcuggacuuaacagcuaacaacauucuuucaagacuuguuuuccagcuuuccuuacaguuuuaaaaauucacauugaaguuuuguguuucuuauagcugucuccugccuuaagaaaccgguuuacagaaauauggugcccucaaagcacaagccgugaagauuuaauucagaucaucagucauaaucuucguccaggauugugucugggcagaauagauccuaaaggugagaguuugcagguggugaugguaguauugggucauagaaggguuuguguugggaguugagggaucucuuacaggacaucagcccuguguguauaugguguguuauaagaagaaaggagauagguaaaugaaacaaaguagacaaggagaauauuacuauucuguuaccuucuguuaaagugucccaucuucauauuuucaucauuaccacuugacacaauggcuguagaauuucagcugcauuucuuuaguugucaucaaugaacauguuauucuuucacuuuauuuaaaaauuuuuuuggcuagguguggugguucacaccuguaaucccagcacuuugggaggccaaggugggcggaucacuugaggucaggaguucgagagcagccuggccaacauggcgaaaacccaucucuacuaaaaauacaaaaauuagcugggugugguggugggcaccuguaaucccagcuacuugggaggcugaggcaggagaaucgcuugaaccugggaaguggagguugcagugauccaagaucgcgccauugcacuccagccugggcagcagagccagacuccaucucaaaaaaaaaaaaaaaaaauuaggcugggauugcaccauuguacuccagccugggcgacagacuccaucucaaaauuaauuaauuaauuaaauaauuuuuauuaugaaaaaucucaggcacaaggaaaauagauuaguauccauaaucuagaauuaacaauuuaaaauauccaauaaaaggcaacacuccuaacuauaugguucuuuuuguuuuugaagccuguauugguuugauguaugcauauuuaucuuagacauucaauggaauaaauuuagaacccagaucugguuccaagacuaaauacauaguuuuuuggaucauuuuuuauauucuuaaagaauauaaaaaaaagauaucugcuucuuggaaauuggaauucauggcuauguuucacuuuuuaaaggugcccuaccacacauuuucuaaaaugaguagaguagcuguagagagcaucuaaucugcauggaacccauucucaccugugguguuuuagggacgacugauucuuuagucaucugagcaaagacuucuuuuuaggaauggcccacggugaacugccacauuuauagguacgcacacugcugcuugaauggccagaauuccccaugccuuguugaacuuccuuuuuucucuacagucucuaccaauaucacagucacccaguggcauaagaauugacuaagccuguaguuaguugucagacucauuuggagggcuuguugaagugcagcuuacagggccccacacccaguguuucuuauucagcaggggcagagaauuugucugucuaacaaagccucaggugaugccacuaauacuggucuaaggcccaggcucagagccucagaacucagaacccaugacucuugugugcuguuugcagcagcacauuuacugugagaauuccaguaaaagaagaaguauaauacagacuuuucugggggguuguggggagacaaggucucugucacccaggcuggagugcagugguggaaucacggcucacagcggccuugaccuccugggcccaggugauucuccugucucagucucccaaauacuuggcacuguaggcaugcacuaccacgccaggcuaauuuuuguguuuuuuuuuugagagaugggguuucaccauguugcucaggcuagucuggaacuccugggcucgagugacccgccugcuuugcccucccuaagugcugggaacuaggcaggagccagaagaccaaagcaggccugaagacagaaaucguuaaccaagcaugguuugucuuuugggucugugucggggcuggauuccuucaggaaguuaccuuuucaucuccuaugggcugugcuuauuccuuuguuauuuggauugugauaagaaugacagaggguucaguugcugucacgaccaugcuugcugcaucaccagugugcuccaugcaagcaugggagcccugaggacuuaccucugagcccacaccuuguccuuaaggagcuuguuuacuccaggcuuucuaggcuacacagcagcagacuucccagggaggcauuagagaccuugaaggggagcauggugaauaagggaaguggcuuaauaauucacagcaguuauauuuucuagaaauagaucaggaaggcacaacauaaaaacuucuuuaaaaaauugugaaauauaaaacaggaaacuagacaaagcuuuuuguuuuuagauuuucuuuaaagauaguuaagauuugaugaauuuauuuauuuuuuugagacacagucuugcuauggugcaaucuuggcucacugcaaccucugcuuccuggguucaagcaauucuccugccucagccucccgaguagcugggacuacaggcaugugccacaacgcccagcuaauuuuuguauuuuuaguagagacgggguuucaccauguuggcaaggauggucucgaucucuugaccuugugauccgcccgccuuggccucccaaagugcugggauuauaggugugagccaccaugccuggccgaauuuaauauuuuaacuaauaguguccuucuaaauugaauucugauccuaauuguaguacuuauauuuauuguauuaucuuaaugaguauauaaauaccacuguggguucuacuuaauuucucuaguauuuuuaguucacaaaucucuguaguaauauuauccauauauucacaguaugaccaaaacaaaagauucuaaaagccagucaugguaguacgugccuauaaucuuagcuacucaggaagccaaggugggagaaacccuugagccuaggaguuugagauuacaaugaacuaugauuauaccauugcacuccagccugggcaacagagugagaccccaucucuuuaaaaaaaaaaaaaaaaaagguucugugauauugauguguuuaaaaaaaaaaaaaauugaccugugaaaggcacaugaacugcuuuuuacaaucucaaacuuuuguaaacaauacuucuguauuacauugguuaauguaccaaguauugguacauuagucaauacuuuaaugaaccauucuguuucauuaaaacaaacuauuggccgggugcuuucuuucacaccuguaaucccagcacuuugggaggccgaggagggcagaucacgaggucaagagauugagacuauacuggccaucaugggaaaucccgucucuacuaaaaauacaaaaauuagcugggcguuguggcaggcgccuguagucccagcuacuugggaggcugaggcaggagaaucgcuugaacccgagagguggagguugccgugagccaagaucacaccacuucacuccagccugggcaacagcaugagacugucucaaaaaaaaaaacaaccaagaaacaacuaucauuuacaaugauuuccuuguguuauauucuaaaaguggagauaagaaacuguauaguucuccuuagauaaggucagauugcucuccagaaagaugguaucauuuacaacacugccagcaauguagugaaugugccugcaugccacagucccuccaucagggaguucucucucucucucucucucucucuuguuuuuuuuuuuuuuuuuuucuucuuccuuugagacaaugucuggcucugucauccaggcuggaguacaguggcacaauauugacucacugcaacuucugccucccaggcucaaaccauucucccaccucacccucccaaguagccaaguagcuggaacuacagacgugcccaccauggccagcuaauuuuuguguauuuuguagauacaggguuuugccauauuggccaggcuggucugaacugggauuauagauaggagccauggugccuggccucauuuuaaaaaauauagugaaauccauuauuuuauccuuauuaguuuagcagagguuuaaaauuuccuugucuuuuguuauuagugacauggaacauuguuuguguuuuauuuuuauuuuuauuuuuuugagacagagucucacucugucacccaggcuggaguauaguggugccaucuuggcucacugcaaccucugccucccagguccaagcaauucucgugccucagccacccaaguagcugagauuacaggcacgugccaccauguccagcuaauuuuuguauuuuuaguagagacgggguuucaccauguuggccaggguggucuugaacuccuggccucuagugaucugcccgccucagccucucaaagugcugguauuacaggcaugagccaccgugccuggccuuuauuuuuaaugaauuaaucauuuugcauuugguauucauuaugucuuuuggggugauacuuuuuauuacauuuuucacagguuuuaauauucuguuaccuuuauauauuuguuuuaaaaauacauaugugaaccuauuucucucugauuuuguuucuuaaauggucaaaauuuaauuucuauuaauggauuuuuucauuuucauuuuuuuaauuuaccuggaauuuauucuucucugaaguguagaucuaaguacuaguauuuacuaucuaguuguugaaauagcauuuaauuuguuuccucauuguuacuggaauuuccccuuugcuuugucauuuuaagcucuuuuuaaagaguuuuuuuuuuuuuguaaucaguauucuuccaaccaauuacauuucuucuaaaucacaaucuauauagcuuuggaggcuguauauauauauagcuuuuggaggcugcuuuauauuauagcagugcuuccuucuaaucuuuucuuucuuuuuaaaauauucuuugauauucauacuuuagagauaaaugucuacuguuguugacuuaagacguuuuauaaaguacucugcucaauuuaauugggauuacuuugaaucuauauauacuacuuaaguauuuucuuuauuuagagacaaauauuaucugauaggaaauugugauaauuagaauauucaacuugauucaugaaacaaaauuugugaacccccuaauuugcugaauucugauugcugaauagauguaaaaaaaaagaaaaaagaaaaaaacuugaaugcaugccauugaaaagaugacauucuuuauugcauuaaauggaaaaaauaaauuuauuuaaaauacaaguaaaauuauaagauauaacaaaauuugcauauuuucuaaaauaauuauaauagaaguucaaaacuguguccgaacucaaaucaaaugaauauuucuuugagcaguuuucaggucaguaucuaaaacuauaacucccaagguuuuguuuuguucuuuggauagggauggacugcuauugaugaauccuuucagaauuugaucaaagcugcaggcugcuuuuguuagaaacagcauuuauguacauucauucacagaacuuugcuuagaaggagcagagaccccuuuuaggccauuugugugccccugguuaugaacuuuuguucugggaucucccguuaacagcaaaugcuuuuuuuguuucuuguguuuagggucugacauaccugaagugaugcuggauuucauugacuggcugacccaccaagaguuuggcagaaaguguguggucaguaucagagauauccuguccuggguuaacuucaugaacaaaaugggggaggaagcugcuuugaaaaggccagagaucaucuccacugugacaucuuuuguccaugcugcaugccugguguacauagauggaauagguucagguauguugucugguagcugguggggacaaggggcucguauagaggggcauaggaaaaggagcaagcccaggccucugacccagcuauuuuacugaaucacuucucagaacauuucuaaaacucagaauggcuuuccuuuuguuuguacucuuugaaaggugauuggcacacaggauacacugcaacuucucaaagcugguagaccagguacuuaacaaacaugaaguggugauuaugaguagaguaaagacugcugaaaugucuuugcuucugaagcacuggcuuuuuuuuuuuuuuuuaaauuaaguucugggauacauguguuaggaauaaugcuuaaaauuguaaagaaauugaacacuuaaacaaaggguuuuuagcaaagcaauuuuauuuuugugcagagggguguuuuuuuggccaguugccaugagaguacacuugaacaaagggcacgagagccuuuauuuuugaugcaaguuuuguuuuuguauuuuucuuuuauuggccgggguuggguuguauaauuuaaacucauuuugguuggcuagacauuugaauuuuuuuagauaagguggacauguuaaagaaaguggagaggaagggggagggguguuuguaaugaguuagaaaguuaguuuuuuuuuuuuaaauaaggaaaggaaugugagcugguauugauaacgccugguauuguggcaugccugggcauuuaacaaaggaaaaaaggagaaaaaggaaaagguggggggggggggcgguacuaugaauuaaagaauaaaagauugaucagauuauuugaagagaaaccgaauaugcggguuuguuacauaaguauacaugugccauggugguuugccgcacccaucaacccgucaucuagguuuuaagcuccucaugcauuagguauuuguccuaaugcucucccuccccuugccccccauccccugacaggccccaguaugugauguuccccucccuguguccauguguucucauuguucaacucccacuuaugagugagaacaugugguguuugguuuucuguuccuguguuaguuugcugaggaugaugguuuccagccucauccaugacccugcaaagaacaugcacuuauuuuuuauggcugcguaguauuccaugcuguauaugugccacauuuucuuuauccagucuaucauugauggacauucggguugguuccaagucuuugcuauugugaauagaagcacuggccaauguuuaacaugaguaguaauuuuuugauaaugggccugaauauuuuaaguuuauuuuaaugucauaaaaaucacugugguuuuucagccaugaagauuugaaauauaaauaaaaaugguuacuagugccauauuagguacuguauguaggcugauuuaucacugagugacuagagugcuuuacugaaugaucugcugcuuaauugauaauccauagauugugggggaugcguguuggacuucuuucuuaggacugcuuacacuagaaaucacauuuaggcugcaguuuugcugaggccucuuuuuuccgggaaccugugcuagagcuccugcuuaaugguggugaagcuugguguuguacuguugcuucauggacugauccucugucuuuuagggguaacuuccucuggguuugguacagcccuuuuggcacgaaaagaaugucugaaauuucuaaucaagaggcuugccaagauaguacgacuuacagaauaucagaaaaaugaguugaagauuuaugacagaaugaaggccaaagaauucacuggaauagauaaccuuuggggaauucauccauuuuuuauaccaagggguaagaaugauuuuuaaaaaaugaauuuuccuuuucuauagaucauagauacuuggcuuuuauugugacuuaguuuuaauguguaauacucaugauuauauuugcacuaacugaguuagauucugacuugagaauaaccauaauugugugaaugguugaaaauaccugacuggcauguaaaaauagagggaaauagagacuucaaucuauaaauagauugucuuauacagugcuuauuuuuuuauuaguugguucccacauuaggaacuuuccuauaguaaagcucuaaacucuacuaauguugacaauaaacuuuuaaguggcuugcaaagaccuauuuagccuauaauguaucuuaacuauacaaccucaucaucuuuuacagaaacagguuuugugaacccuugaaggcugguaaugugucauuccugauccggucccuggcaucugacauuuaggccucacagucauaggcacucagaaaauuucugauggaugagugaaugauuaaaugggaaaugcaguagucuaggagauaguggguuuguguucuaauucuuucucucuuucuaucuaacuagauugucucuaccaaguauuuaaaugaggcaguuagauuagcuacuucuaaggugcuucuacuuuuucaggauguuguuucuguagcagagucaucuguuucuugucccuccgcccucucuauguuaaugauugaugaaugccugaaguauauggaguugcaguggcaauuacugggguuucaguggugaacauaaccaguccagguuccauugcccuugccccuguccucagagcuccaucucuccuuagcaguauucucucuucaucccugaugggcuguauaaucuaaccaucaaaucccuucucuaagccaccaucauaggacucagugcuccuguguaggagauacaugcuaguggccuagaacuggggugguccuugcuucugcuaccaagggugagguaauaaauguuuuccuagccucacucccuucaaacugguguacaaaaaaaaaaaaaaaaaaaaacgaaaacaaaacaaaaacuucuuccaagagacaguggcacaaauguuaaauauuacaagacuguuauuaguccugcauaucaguuaacuuacagguuaaggacacagugugaauuguuuugguggccaaaaacauuggaugaaguugauuauguggaaccauguggcccauaugccuagcuuacacuugguuuuuaggaaaguaacuaugaagguaaauuguacaaguacauacagugauucaggguguagguugugaaaggacagguguguguuugcauguacauguauguguauaggagauggagagaucuguguaguaggcacuguugaagaaaacguguuauuggauauuccuuuaaagcauuuuauggaucuaaaaguggggaaauauugaaauagggauugaacauuuucacugcaaaugguauuucacuaacugauaacccaugugguagauuuuuaaaaucuugaguugaugcauacaugugauuugaugaugucccgcuuauacaugacuuuacuuuucuccacuuaaggaccuguccuacacaggaauaauauugcagacuaugcacucagugcagggaccacugcuaugaaugcacagaggcucuuaagagcuaccaaacugaagaagcccauucuccuggaggguuccccugguguuggcaagacaaguuuggugggagcauuagcaaaggcuucaggaaauacccuuguuagaaucaacuuaucagagcaaacgguaagcucggucauccuacagcugauggagauagcuauagauaguaaugucugugucaauuuauauuugccuaaucagaaaugauuacauuaucaguauccucaaauuuuucuuuucuuuucuuuucuuuguuuuuuugagacagagucucguucuguugcccaggcuggagugcaguggggugcaauucuccugccucagucucccuaaucacugggauuacaggugcccgccaccacaccuagcuaauuuuuguauuauuauuagagacaggguuucaccauguuggccaggcuggucucaaacuccuuaugucaagugauccaccugccuuggccucccaaaguguugggauuacaggcguaagccauggcgccuggccuguauccucagauauuucauaucauaauaaagcccacagcaacaugaccuuccaaacuaaaucuucuuuggauuuguuaauugcugacaccuauaauauuaauucucucuggaugcuuuauucuaauucucuuucgagagagaauuauccacuuugguauuuauuguaauauaaccccaguuaauuuuuugcuuaaauuuuuuuuuaaaaagugguagaaauaaaaugacuuuuaacaaucuaaggaaaauaugguacagaugacaaauugaaugagaauccuuuggaauaggauuuuguuuucuuuuuuuuuuaagccugucaauuaaauuccaaguacagccaauguugagaacuguuaaucuagagcaccagcucaaauugauugauauauggaacauguugggaaaguucuugggggcauguuugggcuccugguaaagagagcugggauugguuaguucuaucuuggguguaggaaggaagaguaguggugccagccccaaguauuuaucauuucagauuuaggguguuagaauccaguugauuuuuaaaguaauaauggcuucuuuccauuucuuccccuuucaaaggacaucacagaccuguuuggagcagaucuaccuguugaagguggcaagggaggagaguuugccuggcgugauggccccuuacuggcagcuuugaaggcaggccauugggugguguuggaugaggugaggggccuguuugucaugcccaagacggugaucaugugugugaggagcagucauccuuucacagcuccauuucacaauccauuucucaguggaagaucccgcugaugacuuuucucuaaugaaaagauccucuguaguuuucuuuaagaaugaggaaggucacuuggcagaauacacaaaaagaggcccuuguacauaaaaccuacaaacucucccacuguuuaaaguuauccuucagaggaaaacugcaucgucacuaguuuagucucugacaggcuugccguuucugcauuuauuuuagaggcauuuuauaaauagcgucaaccgcuucauguuuuauuagugcaccggagagacuaaggaaagacauacaaaaugaccuacugaaaugaggaaacgauccguuaugugugcauaugggguaaauuauucaucagaagaaagagcagaguaugagacaugauaaauacugaaucucugacaacuagagauauggagcugggucaguuugggguguacaauauucaggaaaaggcuagaaauauuuguggagcugaaaugauuagagugauguacgugucacaggugagacuuuggacacaggcugcaacaggucccccagguucagacuccugggucugaucaucagagagggugcugugggacuccugucugcugagcugcuuucugccuuuuauucuugggauaacaaggagagggaauuuuuuuccauuuuucagauuuuuuuuugaacaagaugucugauagaauauauauuagccaggaaaagagaaagccuaguuuuaaagcugaaggcuacugaccauacuuaguauuuaguggaauugcauauuuaguggaauugcauucagggacgacaagacauucuagauuuauaaacacauuuaagagcggccuucuguuugggaauauacagaaguguuugugcuuuguggugcuuguguaaacaugacacuugaaauucuaauguagugugcucugauuuuugccuguuugcauuuuaauaacuuguauuuucccgaucuccuuuuucuauguuaccaacaaaccacacaugcuucacaucccugagcucugaacuacucaucugaagaccuacauucagcucuuuucauccuggcacaagagccccuuguaauuguucuuauuuacaaaauugguggaaaucagcuguauuaacucacuuuauauccugacuuugaaacccguuggagauuuuguucaguguuugagaugggaaaguauuuaaagaguuaacaaaccuuaucuauucucuacaauuaguguuacaugucuuuuucuuuuucuuuucuuuuuuuuuuuuuucuauuuuucuuuuuuuuuuuaggcagagucucagucugccgcccaggcuggagugcagugguggguucucggcucauuguaaccuccuccucccagguucaacugaaucgugaaucuccugccucagccaccugaguagcugggauuacagucaugcaccacaaugucuaaguuuuguauuuuuaguagagacaagguuucgcuauguuggcccgccuggucuugaacuccuggccucaagugauccaccugccucggccuuccaaaguguugggauuacaggcaugagccaccacuccuggcuaauuuguguuacacaucuuaaaaacucagauugugaaaaugaaauaucuguguauuggcaaguuuuucugcaaguuauuacuuacagagcagguuaauauagguuauauguaauggauacaguuuaacuuuugagaagauucuuaacuuuaaaauuuaauuugagcauuuauucaguuuaaagauuauuaauauauguguguauauauacguguguguguguguguguguguguguguguguguguguauaaaauaccagacaaaaucucuaacauacaugggaaauaaagaauaauagaauuggaccagguacaguggcuuaugccuguaauucuaacauugggaagcuaagguuggagaauuacuugagcccgggaguuugagaccauccuggacaacauaacaagaccuuggcucuaccaaaaaaaaaaaaaaaagaauuagcuggaugugguggugcacaccuguggucacagcuaugcagcaggcugagaugggaggaucucuugagcccuggagguagagguugcagugagcugugauugugccacugcacugcagccugagugacagagugaaacccugucucaaaaacaaaagcauaauagaaugaagacaaaccaaccauaacucagccaaaaauacagaagguuaucaauauuguuugaaauucccuuucugaagauaacucuagcuuuauuugcugcauauuauuccccugcuuuuuguugcaguuguauaauauauuugagacaaauuauguacuuucuucuuuaaauagcuuaaccuggcuucucagucuguauuggaaggacucaaugcuuguuuugaccaccgaggagaaaucuaugugccugaguuaggaaugagcuuucaagugcagcaugaaaagacgaagauuuuugggugucagaaucccuuuagacaaggaggugggaggaaaggcuugcccaggucuuuccuuaacagauucacucagguaagauuugcuguugccauagagaccaaagauagacucggaggggauaagacuacuauuaugaagccuuuaaggauauucacuaugagaauuagagaggaucagcuuaaugauccucuuucuuguccuuauaugaucaauauuaaugugacugauucccaucauugcuucuguccuucaucuuuugcccuggaagacuagauguguuaucagcuggaagaaaguaagguccccagccuuuucaggauucugugacugcacucugggaugaaguccaaucuuggaccuuuucaauugucccucugaucuguugaaauauauaagaaaaauuuuuauugaaaauaaugcauuuuaacuaaagaaaagaaagaacagaaaacuacuaugaagaauaaaaauccacuauuccccagucagucauuauuaacauuuugguaucuuaugccuuuauucuuacuugcagagggguaccuguguauguguaugcuuacuuguuuuaacaucaguuuuucagaguuuggccaauccagagguuuggaaaugucucuagauuucuuuagugucacugucucuuaugauuaagaauuggcugaguaucuuuuaagaauguuuuauuggcugggcaugguggaucaugccuguaaucccagcacuuugggaggccaaggcaggugaaucaccugaggucaggaguucgagaccagucuggccaauauggcgaaaccccgucucuauuaaaaauacaaaaauuagcugggugugguggcaggugccuguaaucccagcuacugaggaggcugaggcagcagaaucucuugaacccgggaggcggagguugcagugagcugagaucgcgccauuguacuccagccuuggcaacagaaugagacuccaucuuaaaaaaagaagaauguuuuauugagaaaacuuucaaacauauggaaaaauuggaugacuuuuauagugaauacucguaucuaccacccagauuuaaaagcauuuuacauuauacauaggaaauuuuuaauaacauguaucuuuuuuuuuucuuuuuuugagauggaaucuugcucugucgcccaggcuggagugcaguggcgugaucuuggcucacugcaaucuccuccuccugggagcaagcaauucuccugccucagccuccugaguagcugagacuacaggcgcaugccacuaugcccagcuaauuuuuguauuuuuagugaagacaggguuucgucaugcuggucaggauggucuugaucucuugaccucaugauccaccugccuuggccucccaaagugcugggauuacaggugugagccaccgcacugggccucuuuuuucuuuaauucacuagaauagaccuuaaaaacaaaaccucuacucagcuguauuuagaagauuuuaugauucuuuauucucaaaacacaaaaaaagaaauuucuauaacugaaaauuauauuucucauguauuguuacuugguauuaaagauuuugcauaauaagacaugguagucauuucuaguguuugguaaagagaaacaaaggcauuucuucauauuauuuuuggauuucuaggucuucguugauccccuuacaguaauugacauggaguucauugccaguacuuuguuuccagccauugagaaaaauauuguuaagaaaaugguugcuuucaauaaccaaguaaguaccuacacguauugguuucuuuuuuuuucuggcuguauuugaaccaguauuuuuucaacauagaguucuaccaaauuaucaggaucucuaacuaaaaaaaauuacuuugaauucuacagguuucuaguggaagggacacuauguaguggaggcuuccaguaauucauuucuguauugugacuaccaguguuaaugcuuagaggauaagccaggcauuuggaagucuugagaaagaggcucugaaucaagccuguuaauuuuuguuucagauuacauaugcuuuuguaguacauuccuaguacuuaaugcagugccuaguaguaagcagggcauguuucccaaucaggauguuuucuuucuagauugaucaugaagugacuguugagaagaaaugggggcaaaaaggaggacccugggaauucaaccuccgggaccuuuuccgcuggugucaguugaugcugguugaccaguccccuggguguuaugauccuggucagcauguguuuuuggucuauggugaaagaaugagaaccgaagaggacaaaaaaaaggugaguuucacgcuugguauuuguauuucuuuccaucugaaaguugauuuccugugggugagaaaggacauacacuaauugcaagccuuuuuuuuuuuuuuuuuuuuugagacuggguuucacucuuguugcccaggcuggagugcaauggcauaaucuuggcuugcugcagcuucaccucccagguucaagugauucuccugccuuagccucccaaguagcugggauuacaggcauaagccaccaguuccggcuaauuuuuuguauuuaguagaaacgggguuucaccauauuggucaggcagaucucuacuccugaauucagaugauccaccugucucagccucccaaagugcugggauuacaggcgugagccaccacgcccggcuagcaagccuguuaaagcugcuucaaaauuuaaaaguuaaaagaacagacuaaacguucuccuaccuuggggucucacaauauagaguagcuugcuuuagaggacauaauuugcuuaucuauccaaauccccaugaucacauaccuuaaagcaguauugcccuccaguaguaaagaacuaagucuucaccaucuuuacaggcaccaaggugagaagcaggaggaggcagacaggugauacuccguagaagaggaaguuuuucuguuuuguuuuguuuuuaaauaaaugucaaauuacaaagcauuuugucuagaaaguauaaucguauaaagagagaauauucuguguuuaagugaaaauaaaaauaccuguuuguaaaacuagaauucccacuguaaggaauuguaauaacgugugcauuuuaguuugugguauuuaaaauccugucucgcugaaugcucacaguagcuauaggcaggaggugcugucauggcaucuuacaggugaagauccaaggcuuaaaguuauggagugucacagguagcagagccagcuuuccaguuuaggcccucuccaguuugucugcuguuuccuucuaguaaacuucacuguuugaaaauaaaugaauagauacauagaugcaugcacuagaagcaguaaccuccuuguugaaaugugaacauguggcuggcccauagcacaugugacuuucacagcccuuucauucugcuacccauucuguuuguucuuauuuuuuuucuuuuuuuggauugcaaaaauuuauuaaaauuggagacauuguuuuaaucuucuugugccaugagacuccaucaggcggucuacaaagaccauugggaggcugaggaucacuugagcccagaaguuugaggcuguaguaagcuucaaaggccgcugcacuccagcuugggugaggcaagacccuuucaagcaguaagcugcaugcuugcuuguuguggucauuaaaaacccuaguuuaggauaacaggucugccugcauuucuucaagcaugaauucugaguucuuugcuucuuuaaaacuugcuccacacaggguagucaagccaacucuccauaccuuuaaaagguaugacaggaacugucuucauguccuuacccaagcaagccauccacggauaaaaacguuaccaggagcagaaccguuaagcugguccagacaaguuggacuccaccauuucaacuucagcuuucugucuaaugccugugugccaauggcuugaguuaggcuugcucuuuaggaccugggaagaaacaauucaguagcuauucucaucccuccuuugggacagaacuguccauaaggugcuauccagagccacacugcaucugcacccagcaccauaccucacaggagucgacuccuaccucgaaaagcuguucuuauuuuuuuugaggcagggucugacuuuguugccuaggcuggaaugcaguggcacaaugccggcuuaauguagccuugaccuccugggcucaagggaucuucccaccccagcccacugauaagcugggacuauaggcacaugccaccaaggcauggcuaauuuguuuuuacuuuuaauagagauguggucuugccguguuguccaggcuggucuuguacuccugggcucaagcaaucuuccugccucagucucccaaagugcugugauuacaaauggagugagccacugugcccggccacccagagcuucuuuagugugguauucagaaucuaauuacacacuaacucauuuaucauacguaggugacuuucaaucauuugauuaggagaaagucuuaguaguuuuuaacagcuuuauugauauauaauucacauaaucagcuaguauuuuaauuucuucauccacuuauaguauauuaauuaugaccaaaacacaugccaguuguugaaugauugauuagucaggugcugggucauugugguauguggaaguuuuccaucacucuuccaauucaagguuauuguaauggaccuuauagguguuuucuagcgggggagacaaggucaagaaaaauaauguuauagaaggauaaagucuguaaaagcuagaagaguccaguugaauggaauuuugauuuuauaaagcuaaaccaaagagcuagauugggaauuuuuuuuuuuuuuuuuugagauggagucuugcucugucgcccaggcuggaguacaguggcgugaucuuggcucacugcaaccuggguucaagugauucuccuggcucagccucccgaguagcaauauuuguaauuuuaacccucugguagaacaucagggguuggagauuauauacuuuaguguggaacaugaggucauguaucaccuggacucauagguaggugacaggaacacuuuccuaugcugcuuuuagucucacaguccaauguuugacacugauuaugauuuuaucuauauuauuuuuauuuuuuaacuucauuguaguauucaauuauguaaguauugcugcuuuuuagaaauacuauuuuguauacuuuauuuauuuuuuuucuggcuuuaauuuucccuacuucugugggcuaaauuaauguuuuuuauauaccucuauccgccccccaccauuacucuuagauuuuuuagagauccaaaauaaaagagucaacagaacauuuucuaauagcauuacugcuaaugaaaggauaacaauguaaauaauugguuagaggaauaaauuugguuuucauaucuacauaaauguuuggagggauaacauguuuuuuggaggcugacuggcuuagauuuaaaaucggucaccaaccaugggcaaauucuauaacucuugugagugcuguugucuauauaaaauggacaugguaacuauuuugcauggguauaaagaucagaaauaaucuaccaaaguacuuaauacaguguuugguacauaggaggugguuaaugaauggucauuuuucuuuauaaucuucguauuacuguucuauccucuuuuuagguaguaucuucaaugaugaaagcaaacaacucuuuuuuugucucuagauuucaauacuacaguguccauggcuucaauuuaauuuauggugcauuguuacuggaaucucagauaguuuggaauaugacugcuauguucucaaucucaaauuuacuuucauuccaaagaauuaaauaaaugcagucaauccuuuuuauaagagaaaauucaaaaggauaagggaauuguggccaguguuuuuagaauagugacucuuaucacugugcuuguuuucuagaaaguuugccuaagaauuagguggagugauuuguguuuucauugcauuaucuucuuccuuuaggucauugcuguauucaaggauguguuugguucaaauuccaacccauacaugggaaccagacuauuucguaucacucccuaugauguucagguaaggagacuaggauaauccucuauccuuugacauuuuuuaaugguuucuucugcucccacuaccaggcacgcuuauggaaaucucacuggcaugucuuuucaguugggcuacucaguccuuucccgugggagcuguguuccucacccgucccgccauccccuguugcuccugcaccagucauuccaaccccuggagucaaucaugaagugugugcagaugagcuggauggucauccuggucgggccagccucugugggcaagaccagccugguccagcuucuggcacaccuuacuggccacacauuaaagaucauggcuaugaacagugcaauggauacuacugagcugcuggguggauuugagcagguaaccagucugccuucauauuuucuggcaaagcauaauaaaccccguggucugacugagagucuucugaguuggugaugaguacagauaacaguauucucugacccuaugaugaguucauguccucuggaaauuacagguugaucuuauacgaccuuggaggaggcugcuagagaagguggagggaacuguaagggcacuguuaagggauagccuccuuaucagugcugaugaugcagaaguagugcugcgagccuggagucauuuucuucugacauauaagccuaagugucuuggagaaggugguaaagcuaucacgauggagauugucaacaaacuagaagcaguguuauugcuuaugcagcgacucaacaauaaaaucaacucauacugcaaggcagguauguauauuuggaucucuguaucaggaacuuaccauugcuuauauuguguccauuuacacguaauagauuuacaaauguuuuguauuaauuuaguaauuauuaacaaucagaacuugugggaaaguuugaccuagaaaguaaaaugaagcugagguaaaguauucagaauaguugauccugaaaaaucaaauaggaaaaaaauugguuacguugcuuuaugguuuauuuuguguguaaucaccuauaaugauaaaacagcauguaaaacuuuuauuauuacuggcuauuuuuuuacucaauaauuucucaggaaauugagcauuuuuaaacugaagaauaggagucugaauucauaggauguguuuauucauuuguguggagauggaggaaauauaucauccuguaugccauccaauuaacauggaaauuucucucauuuuguggugccacuuucagagugguggugagcaugcucuuagggaggauucaaccuaaaggcccacaggcugggucugucacuaugcuugucauucuuuauuuccaaagccugcuuguaacugauuacaaaguguugauuccuuauagccgaagaaaucagacaucccacuucuuggccagcaaacauuuuaucuguggcggugggccacucauuuacuuucuucauuguugauuugaucugucauuucucacuuuaagccugccauuugaacuugaaauccuuuacucauucacucuaauuauaaaagauauccgaugcagucaugugucauauauuuuuaaauggguauuguaaaacucaccauugaguuaugaauuucuauuauaaacacuauacugaauauauguacuuuuaaucaccgugacaacacugcauuauaggaaggauuaucuacaucuaauagaugaggaugugaauauucaaagagacaaaauuacuugccuacaguuuuacaguuagcaagugguuggacuaugguauguuaagucuaaaccucguuacucccucaucuuuagaaguagaaauccaauguguauuaccuugugauaugaaaaauggucauaaaacaguuuccaaccaaaaagaucaacugaaaaauuucgagggaagggcuauauaaacuauaaagcauuuggcaaguaauuaccaguuauuacuauauuacuauaaucauaugauaugcucauuauaaaggaagcccaguuugcacugugugaaguuauagcacuuucauuuaguauaaaugcacugauaggugggaaacguccuccuucugccauuugagaaaccguaauacagaaaaaucauuugccaccucuaucacccuagagucaacccugaguagcuauuaauacagagagccauuaaaacguauuuucugucuuaaacuuaacuuuccuaucuguguuuaaacagaagcaaaacauucuucuauuuauucuuuuaugaaaucuuaaaaaccuuggcuagaaguaucaagcuuccuuuucauaaacuuaauucuuuguuugaaguuaagugcuguggauggugauucuucccugugacauuucagaguuugccaaacuuguugaagaguuccgaagcuuuggugugaagcuuacgcaguuggccaguggccauagccauggcacauuugaauggguugacagcauguugguucaggcccugaagucuggagacuggcuucugauggacaauguuaacuucugcaaguaagaaccuuaugccuaaucagugguccaacuugaaauuugggauaugcuugucaaaguagaaacccagauagaagugcugguauuuugaagcuacuguuuuucuuaauuacgcaagcguccucagccauauucuguagacuucucccuguggugaacagugguaauucgucaucagacaguuauaagauuucagcucuguaugauaauuuucagccaaagcaaaggcuaacaaaauuggauuauuuuuccuggcaauguccuuugaguuaggccuuuuaauuuaauaucagaagucuuccuuuuguuaggguuucuucagugcaguuuuuucuaaugcagggucugacacagggcaggcauuuauuaaauggccaucagugaugcagcaauucaaccauguaucauucuugaucuugcaguaagguaaaggacaagugugaaacuauuguacauauacaguuaacauagaagcuacuacaaguuagaugaugacuauuucuucacggagcauuuaucugaauguuacaaauugaaauccagcugccuuaaauggauuugauaauguugagggauggggggcaggaaaggaaaaagugaaaagguuauagugcaaggaacuuaucauuuucuuuaauuucauuuauucaaaaauaucuuguguauuuacuguguauaaggcccugggcuaugugccuagggaagcgagaaggaaaaucaauggggaaucuacuuuugaaagagaucacuguuguaucugggugaaugauugugccgaaaggaaaugugagucaaaagcauuuggagccccgugcauggaaggaaagaagagucaaugcagcaugucagccuauccaccaucugaauucugucucugcagcccaucaguguuggaucguuugaaugcuuugcuugaacccggagguguccucacuauuagugagagaggaaugauagauggauccacucccacgauaacaccaaaucccaauuucagguauuuguaucucuuacauuucugccucagaaucugacagccucaguagcagagguagacguucaguaggacuuccuuauauauuuuauuuauaaacugaaucauggagaaguucacccauuuauuaauucacuuaacaaauacuuacugaggcuuuacuauuugccaggcauugcugggcucuggaaacacagcauaaacaagaggggcaagguccuugccuugcauuggugacgaaggugggaagcagagauaccagucaugauccuuuugcaguaauuuaggcaacacaucacaguggcuuagaugaggguggucagauggguugguuugcugauggacauguggguugagaaaaagaagaaucaaggaugacaccuauguuuuuggcuugaguaacuggguaaaugggguugccauucauugagaaagggaagacugguaaaggagcagguuuaauguggggagggucuaccgggaaucagcuguuuacuuucagacauacaucagagguguaagauaacuagauggagauguugaugggcauucaauauaugaauccaguuguuucaggagacuacacuugcuuccuguucugcugucuguaggugaguuagaauaaugaauuaguacagccuacucuggggaauaucugaagguuaaauuuuuaaaguucucagcacuaaagguacacuggauauaucauacacaguuccuuaggaaaguagguuuagagaaaaucuuuugcuauauugaugcaugcuagaaguaaaagauccuuggugugaauucugugacaaugagccacauaggauuugcccucacugacugaugcugagcuacaccuuugguugcacugggauuuaaaaucauuuuuuucuuugaauugcuauuuuucuagacuuuuccucucgauggauccuguucauggagauauaucccgagcuaugaggaaucguggacuugaaaucuacauuucaggggaaggggaugcaagcaccccagacaaccuggauuugaaaguucugcugcacagccuuggauugguggggaacaguguaugugacauccucuuggcuuuacacacagagacccggagcacuguuguaggugaggugcuugacuuuugggccuuugcagaguuuuagucuucaagaaauuuaugucauuccauuggacugcucaucaaagauuucguacauuuaguguauauagaaauuaucaggaaagcuuguuaaaaauguggauuuccagacaccccaagagauuggguucagcagggcagggcaaggcacaggaaucaguaucugaaagacgcuucuuaugucauucugaugcaaguaagcagaggcuaacccucgaguaauuccacuuuacgcacugagguuuaugaaguuugcccaucauuucuccagggucaucaacagccucuugaaguuggaauaaagaggaaacuuugaguuguuuaaagcagacagguguuacuuuuucuaaacuuucaauuacacaaaaaggaacaagauaauaaaugaaguauugcuuguuggauaacuacucuguguuagguaccaugcagauuguuuauuuaaucuuuuuuuuuuuuucuuuuuuuuugagacagagucucacucugucgcccaggcuggacugcaguggcgugaucuuggcucacugcaagcuccgccucccagguucaugccauucuucugccucagccucuccgaguagcugggacuacaggcaccugccaccacgcccggcuaauuuuuuuuuuauuuuuaguagagacaggguuucacuguggucucaaucuccugaccucgugauccgcccaccuaggccucccaaagugcugggauuacaagcgugagccaccaugcccagcuguuuauuuaaucuuuacauuaguucugcaaggcauauguuuucauuuuucagauaagacucagagaguuugaguaauuuaucaguuaauaauaacagcuggaauuugcaaauaggccuguuggauuucaaaucccauggucuuuuaugagguuacacucaacuugccaccuucagugugugucagcauuagauuaaggauauaugugaccagacuuuaucacaucuauaaaugagucccccauaauaaacuacagacagccauagagaaacaggggagauaggaauacaaagguuccuacagguccuuugugcccucggaggacucuagagucuacuuggaauguuuuguaaaguaaguauuugggugggguugacaggaaggagguuugaugggagggcagaauuuauccauuuucauuggagauuuuaaagacucuauuguuuauagauggcaauuuuuuuuuaauagguucuccaacaucuucuguaucaacucuaauccagacagccauacuaauuguccaguaccugcagcgagggcugaguuuagacagagccuuuucugaagcaugcugggaaguauaugucuguucccagcauucaccagcaaaccggaagguacuaugaaguauugcagaauguuucuaaguuguaauacccuacauucuugaguacgaggaaauuauuuuuaaagguggcaacccagugaccuaagagaguugaccacugcaguuugcucuaauagagaucugguauccagguacuuuucuggaaaauagcuugaauguaaauauuccuuuuuuuuuuuuuuuaaacuuacaugucaucaggaaaaguagaauuugacuuguguuuuucauugaagaguguauuaaaaguuguugugagguggucgcauggacuauuauuacuuugcugguuuuuggggaauaucacuuuuauguugguaccacuguauuguguuuuugucuccuaccagcuuguacaggcuuuacuggagaaacauguuucuucuuugcgagcacaugaaaccuggggagacuccauucuuggcaugggacuguggccagauucugugcccucagcucucuuugcuacugaagauucacaccugucuacaguccgaagagauggacagaucuuaguauauugucucaacaggaugagcaugaaaaccagcagcuggacaaggucaguggagccuucagcuugugucucugguuucuuggcugguuuuuauuuuugcuggaaauggucaggacacaauauauuuaacuggagcauucuguggccauuuauuguguagcugucauaguuuuauuguucauugugauauugcucccuauugauuauuuauuagguauguuuuaacuuucuuccucugugggagacucuccuuuucucucuuaccuuugauccaauauuugugaaagagguuuucucaguuauuuggaaugugaaauaaaagguuauucuaguacugaguuuguucauucaaaugaauuucaggagucagccuuuuaccuugcaagacuuagagaaaauuaugcagucccccagcccugagaaccugaaauucaaugcagucgaagugaauacuuacuggaucgaugaaccagauguuuuggucauggcuguuaaauugcucauagaaagagcaaccaaucaggauuggaugcucagaguuaaauggcuuuaucauuuagccaagaauauaccgcaggggcuuggugaguagaacagcuuaauuuguccacugaugugauuuauauacacuuaugcuauuuaagugccucagcagcuguguuaaucugugacuacacuguuaaaauuacaguugggaggucuccuaggaagaaauuuguggucuagcauuacuguuaaggagcaagucugccuguagaugugucacaagauaaacuuuuguuuccauguuauccuuagcauuucaggauauagucaccuuccuaacaaauucaaaaggaaagcauacuguauuauuuuacuuuuuaguuuugaacaucugcuuuuugugcuguacuacugcuacagaaccauucuauaugggaaagguauuaguuuugauaaaugcauuuccucuaaaaguauauaagauucuaaucuuauuuuaguuccagugcuccauguugucacacuuggaguugucccuugguaucugugggggauugauacaaggacucucccucccccacccagggacaucaacauacguggacgcuaaggccccuuauauaaaaugggauaguauuuucauauacccuacacacauccuccuguaugcauuaaaucaucucuggauuacuuauaauaccuaauacaauguaaaugcuauguaaauaguuguuguaguacguuguuuuaaaauuuauauuauuuuuguuguauuuuuauuuuuuguuuuuuuaaauuuuugaauauuuuugaucuguaguugguugaauuccacagauguggaacccucagauauggagggccaccuguacuuucuuuguaguucuuucguuuuaagagaggacaaagcaacaauaacaacauugcuugaauuguaaaguacagaacauggaauuuguugguggagauuaaguaauugaguuuacaugagccuuucuacuucaugagaauuugucaauaagcccauggauguuuauaauauuuuguaacacauguggucaucugucuaaauauauguagagaauuuuuauaaauauuuuuaucuguauuguccuauaugauagccacuagccagccagagagggcuacuaaaauguaaauguagauuagauuuaaaaaaauaaaaaauccaguccuuuaguugcacuggccacauuucagguccucauaugugacuagugguuauucuaugcagcuguagaacauuuucaucacugcagaacguucaauuggauagcacugcuuuagagucuaacacugguuucuccuuccuccacagaguccauacaaauucauuuggaagccagugcugcaucucucaggaauuuuuacucacauucccucucaggugcagucaguaauguuuucaaaauauuacaaccaaauacaacagguaugcacuuuugauuucuagcucucagcacuguuuuggaaacuuaucuuuugacuuuauggggaaaagaucugaccuguuagaggucucaacauaacgguauuuuuuagaagacucaugauaugcagaagcaaauucuccuucuuuuuuuuugaaauuucuuuuuuuuuuuuuuaaagggacagggucuuacuaaguugcccagggucuucuugauauucuggccucaaacaauccucuugcuuuggucucccaaacuguugggacuagaggcuugagccaccaugcuuggccugaaacuauccauuuauccuccagcuucugaaggaggcugaugauaugccauggaguaaaaagaaucuaggaguuggaacacuaggcccugguaccaacucugccacaaacuggcuugguagauuuuuggcucaucauucacugucucugccuguguuuagaaacuaggggaauuaagcucuuauuucucugaggugccuuccacccuuagcuuuguguugucuaccaguaucguuaguaggaagaguuucaaaccacgagauauuugacuuaaaggaaaguuacacagggucauuuaauuuaggaaaauauaaaccuuuaaugauagaugcggugacuuguaccugugguccagcuaccugggagguugagagaggaggauuguguaaguccaggaguuugaggcugcagugagcugugauagugccacugacugcauucuagccugggcaacagagccagacccugucucugagaaaaccuugaugacgaaguuauaaaaccauagugauaacagaaauagacaucuaagauaucugaucaaaggaaguauucaagauuaauuuuuuuuaaauaaggagugagagaauaaacauuuccuagaacagaguaauauuaacuugauuggcacaagcauuaaugaagaaaaugggcauuuucacaacaccagauuuaaaauuuucuaccuccaucuucauuugauguugaucaaaauauaccacuggccauuugguuuagaagaaaauaugcaugaugcuuuugugcuaaauaauuccuuuaugugcacuaaagaucauggagugaaugggaagaaaucaaacaauagagaaaaauacuuugcuagucaaguuguggcugaacuaaggcauggcuuuccacuaugagaggauuguaacuuuuacaaacacaguucuacaguagcagcuuucauuuucagcaggcaucgcuuguccucuguuggaacacauuagcuccaacuguccuuuucaguuuuguagcccuuuuaucuuacugaguguuggaauauggguucccuccuuaauguaccugcuguucacaguauguccuggguagucuggguagucuacuauaugguggaugcuuuuaaaacuuaaagugcuccacugaaccguccugccagccaccuucaaauuaauguuacccuuuuuugugucuugccucccuuccuuggguuuucacaacuucuggagaaugucagucuccuccugcugcuucacagaaguugugucaggugugagccagaggauuguggggcagcagcagccacauucugauuauagagaauuuguuuuuaaguuuaaaaaacugcauuguuuucuuaaugaaaacagauagugagguguauuuauucauuuucugccauguacguauuuuuuuuuuuuuuuaagcuaauggugaccacuguguaauuuagcccauggauuagugugaucucaggaagugaauucauugguuggaauguuguauucuaguagggauuaccuuuauauccugcauugggaugaacuuucaggacauacagauacuuugcauuugguaaagauagaguguaaaagcuauuaaacccugcuauucuaguauuaugggaugaaacucaugguauuuacugguucaaccucuuccccaucaugauucaaugugcucaaaguaaaacaaugaaaauauucaacugaaacuucccaggcaaggaguuucuccaauauuucugauuuuuguuuuguucuguuuuuaaacuagaugaauuugugaucccucuggauccccgauggaauaugcaggcucuggacaugauuagaaauuugauggacuuugacccacaaacggaccagccugaccagcucuuugcccuuuuagaaucagcugcaaacaaguaagugaaaccugcugcucugggcacuguuugccucacuggcuucucggauuauaccuuuccuaagaaucugucaaauagcuuauguguguugaauuuugugaaccugagaaguugugggguguuggacaugauugccuuuaucauacgauaaucauauuuucuacuguuuucuguuuuuuguuuugcuuuugagacagggucuagcucugucacugaggcuggagugcaguggcauaaucuuggaucacugcaaccucugccuccuggccuuaagccauccucccaccucagccucccaaguaccugggacuacagguacauaccaccacaccuggcuaauuuuuguacuuuuuuguagagacaggguuuugccauguugcccagacuggucuuaaacuucuaagcucaagugauccaccugccucauucucccaaagugccgggguuauaggugugagccacugugcccagccugguuuuuguuugauucccagcagcuccucccauuuucaccuacuuguuuuuacuugucucuuccucagcaaucucucuguccacaucauuuccuguccucaaauguuggagacauaauagcaccuccauacuuauguacacacucacauaugaauuuacuuaauuuucaaagugaauccacaaguauaguguguaccucagagggugccuugcaagcuaccagcccccuacuccucugcuccaccaacuccuccauuucuaccauggccacuuugaagaguucacggugcaguuugucagaucgugacagaccaaggccugggagucugccuagacccagcuuucuccauccaucgaucuuuccuuucaccuuaguaguugucacuuucaucuccaucucuuuaguccaagauuugcagaggcaggagaggaauggcaggaugaaggacccugauguuccaaguguuccagcaaauagaggauaugauugaaaauguuauuaaccgauagcuauuuguuacguuuuuugaaucucauuccaggacaaucauauaucuugaccgggaaaaacggguuuuuacugaagcaaauuugguuucuguugguagcaaaaagcuaagagagaguguuuugagaauguccuuugaauuccaucaagguaagaacauuuaccuuuuguguucucuaauuaagcaucugauugcauaauguugcuaaaguugagaggcauauucagcagcugcuguuguuuacugguuucuuuuaaucugcuggccugauuuuaaacauguccccuuacucaauaguaaugacuaacauuuacugagcacuuacuuugugccaggugcuuagcuaaaugcuuuuuauguguccuugaucucauuuacuuuuuguagccaccugugauauagguccccauguuguuagugaggaaacggagacacggagaugcucaaggucacgucucuagcaaguaacagagccacuugaaaacuaggucugucagcugaaaaaguacauauucauaagcauuuauuauaggagggagcauuucucccauguuuuuuuuuuguuaauugaaaagauaguugugcuuguuggaaaaaauucaaacuauuaaaguauaaaaauugaaaaaguucaucuuuacaucagcuacuguuaguaauaguuucauuuauguuuucucauaucuauugguauuaacuaucuaucuaaacauauguacuuaguuuucauuuuauacuuaaauacuuguauaaaauauacauuuuuuucuuuauaaucugcauuuuuccgugagacauuauuuacaucuguagguauacaugccucauuugcagaguuuaauaauacagauugaacaucccuaauaugaaaauuugaaaucugaaaugcuccaaaaucaggaacuuuuugagcacugacaugaugccacaaauggaaaauuuuauaccugaccucauaugaugagccauagucaaaaugcaguccaaacuuuguuucaugcacaaaauuauuaaaaacauuguaaaauagaaaauuuggacuauguguuuccccaagauaccucauuauguauaugcaaagauuuccaaaaucaaaaaaaaaaaauugaaaaucugaaagacuucugauucuaagcauugcagauaagagacacucaaccuguaguaggcaaagaauuugcuuuugcuuuugcucucaaaauugaccuuuguacuggggauaacauuuaaauucuagauuacaguuuauuuugaaaauguccagagauuauuuuaaaucugaugaaauguucucauuuuauuuauguugacucucagauccagaaagcuaucacacucugccccaugaaauuguggucaaucuugcugcuuuuuuugaacuuugugaugcacuaguccugcucuggguacaguccucccagggaauggugucugaugccagugccaaugagguaaggaacugcaucuuguuuuauuuuuaaacaacaaaauuuaucuuucuuggcauaaagauucuuagggcuaagacuaacuuuaguguuguuauaugcccaauauuauuuaagaaacuuauucuuaacaguuuuaaauauaccuauacacauauuuaaaaucuucauugggguauaauuuacauauuauaaacugcauauauuuaaaguguauaagucuugacauguauacaccugugaaaccauuaucacagucaagauaaugaacauauccaucacccccaaagguuuccucauucccuuuuuguauuuucuucuuuccugcucccacccacaacgagguagccauugaucugcucucuuacuguggaucaguuguauuuucuauacguggaauuaugcaguauauauacuuuuuuguuuauauucuuucacucagcauugugauuuggagaugcauccaugugguuucauguaucaguaguucauuccucuuuauugcugaguaguauuccauuguguggaucuacuacaguuuuuuuauucgcucaccuguuguuagauuguaacaguuauauuuuaauccacuuaaguccucuuagacauuauugucacauguggauuaaauggaauuuuuaauccagauuauucuaguaagucuaguaaaguagagcagccagucuuaaacuuuuugaucucugccucuauacucuuaaagguucucaaaaacuccaacgauguuauaucugucaguuuuuacauauuaagaacugaaucugaaaaacauaaaaaaaacccauaaauuugcuuaaaaauacaguagcaaagaauuucacguuaauaugaauaacuuauuuucaauaaaaaauagcaauuucuaaaguaaaauuugagaaauguggaacuguuguacauuccugcaagucucuguaugucuggcuugugaaaagauggauucuuguaguauguuguuugggauaaaguuuaugaagaaaaacuggccuccuauaguuaggagguuggaaaggagaggaauauuuuaguaaccauuucauauaauuucaaauauucuuauuugauggcacaccaaaaaugacaaguaguuuuguaaggguuauuugcaauggaaaaucugagcaaauaaucagugaacuucuuguguuaaaauucauuggccacggccaggugcgguggcucacgccucuaaccccaggacuuugggaggcugaggugggcggaucacgaggucaggagaucaaggccauccuggcuaacacggugaaaccccaucucuacuaaaaauacaaaaaauuagccaggcaugguggcgggcgccuguagucccagcuacucgagaggcaggagaaucgcuugaacccaggaggcagaaguugcagugagucgagaucgugccauugcacuccagccugggggacagagcaacacuccaucuaaaaaaagaaaauucauuggccuaguuugcaccuuggauagacuuugacccugcauuaguuuauagcucgugcacugguaacuuggaaaauacuguucacugaguuggcacauuucauucuucaauauaaauaaguaaaaagucacacuugugaaaaaucacaaaucucuucagaaaaaucguuaccaggaagucaucaaacucuguuuuccagaauuuuuuuugagacagagucucgcucugucgcccaugcuggaaugcaauggcgugaucucagcucauugccaaccuccgccuccuagguugaagcaauucuccugccucagccuccugaguagccaggacuacaggcacgugccaccacacccagguaauuuuuguauuuuuaguggagacgggguuucaccauguuggucaggcuggucuugaacuccugaccucaggugauccaccugcgucaaccuccguaaaugcugggauuacaggcaugagccacuguuccuggccaguuuuucagaauucuaaguuuugcuuaaaagcugaaauuuuaucauggcaacauauauccucaauuuuuuuuuuuuuuuuuuuugagacggaguuucucucuuguugcccagacuggagugcaguggugccaucuuugcucacugcaaccucugccugcugguuucaagugauucuccugcuucagccucccaaguagcugggauuacaggcgcgugccaccacgcucagcuaauuuuuuguauuuuuaguggagauaggguuucaccauguuggccaggcuguucuggaacuccuuaccucagaugaucugccugccucagccucccauaaugcuggauuacagguaugaaccaccgcaccuggccucucaauuguuuuucuugaagugacagguucacauugauuuucaauacagugucugucagauagucauaauuugccugccaguccuucuuuuuuuguacuauuaguguaaaugucaucauagugaaaauggcaaauaacaugauauuaugaaaauagcuuugacuucauggaaccacuauaggaaaucacuaaucuagaaacaauguuacugugaaaaugcauuauucaaagagccauguuggagacucauauuaccugauuugcauugcaacccuguauuaaacaaaaccguaugguauugucuuaagaauagacauuuaaaccaauaaaacagaggauucacagauagaccccccccccuuccccauacauggucaguuauuuuuguuuuguuuuuuguuaaauaugcaaagguaauuuaauggcaaaaaauggucuauucaguaaauggugauggaagaauuagauguuuauauaaaguaaaaugagccuagccaggcacaguggcucaugccuauaauccuaaguacuuugggaggccgagguggguggaucaccugagguuaggaguucgagaccaggcuggcuaacauggugaaaccccaucucuacuaaaaauacaaaacaauuagcugggugugguggcaggcgccuguaaucccagcuacucaggaggcugaggcaggagaucacuugaaccugggaagcggagguugcagugagcugagauugcgccauugcacucuagccuuggcgauggagcaagacgcugucucaaaaaaaaaaaaaaagggccuuuaccccuaccucacauuauauguaguuaccucaacauggaugaaaccuuuaaaaauagaacugacacuaugagcuggcuaaaagaaaacguaggagaagaucuuuacaaucuaaauauaggcaaagauuuuuuaggauucuuucuaaaugaaaaaaaauugauaaauugauuucaucaaaauuuaaaacuucuauucuucauagauaccuuuaugaacauacugugagagaaugaauauacugggaaaaacugcuaacaaaacacauaaauuccauaaacuagcuauaauacaaccuaguuuuuaaaaugagcaagacaucugaauagaauaucuucuuggaaguucuaugaaugcccaguaagaacuuuaaaaauugcagugucaucaguuaucaaagaaauguaacuugaaaccgcagugcgguaccauccaccagaauagaauuaaaauuaaaacuaaaguuaaaaucauuaacagcaaguauuggcaaagaaaugaaacaacugaaacucuucuacacuucuggucggaguacaaaaugguacagcugcuuuggaauacaguuaguaguuucucauaaaaucuauacuuugacccagcaauuccauuuucucuaauaacuucaugcuucaaauacuaagagaaaagaucuucaccuccucugucugccuuacuguuccuacauauauuccaguccagucuuagacuuuugguguauguaaauugagcauugauuagcaauuauagccuauguugugugucuuuucccgggagauguuggugagcagucuugguucacuuuguuuuuauuuuucuucuugcuuuagucuuucuucaugccaucuuaucuaagagacuuuguuuuuagaucuuagguucucugcgguggcgggaccgguucuggacuguggccgacacaguaaaaguagaugccccaggucuggcccuucuugcccuccauuggcacuggguuuuaaaacaucugguccaccagaucccccgacuucugaugaauuaugaagacaaguaagauucauauuuagaguaauaaugucaaugauuacagauagauguuaaggauaagauuuggaaccgaaacuguuucuucuugcuuuauuuugguuuauucccuuggcauauuggugaauguacaauuaaaagaaagaaagaaagaaaauauuaauggcuucucuuacugucuagcauuucccccuuuccuuauuuccccugugcccuuguucuccuuuaaagauauuacaaagaaguucagacugucucagaacauauucagaauugucuggggagccagacugguggcuucgcugguauaaagaaguugcagaaguuccugggacgaccguuuccuuuuaagguacaccuggaagcauuuaguaaauaaaagaaaugugacuacuacuucugaaguccuuuuggaacuugggaacugacauuguauaagauuaauccuugucuugaaagcauaacucuugcaguuuuccuuuggcaucugggggugauugguuccaggauucuccuuggauacaaaccuccaggaaaguccaagacuuuuauauaaaauggcguuguguguguauauaaccuauguacccuuuauaucaucucuaaauuacuuacaguaccucauacaauauaaacgcuguguaaauagugauuauacuguauugcuuagguaauaaugacaagauaaaaaaguccuuaugcguucagcacagacgcaaccauccauuuuucccccugaauauuuucgacccacgguugguugaauugaugcggaacccgcacauaacaagagggcaggcucuaucccaugaauccuguuuaguaauuugcuacauauuaucaucuuacuuauuccugagacuguuaaggcuggguagagaguuaacuuuauuaccacuguaaaaucucuugacagcaacagaaauaaacaaguccuuuguuuucuggaaacauuaagaauauaucauaaauuuauucugagaccuguauaggcuacuaaagaaaaccacauuugugcucuauaguaugcucuuguggguguuguuguuucaggacaagcuggugguggaguguuuuucacaacugaagguccuuaacaaaguccuugccaucagggagcagaugucugcccuuggggagaguggauggcaggaagacauuaaccgucuccaagugguugcuucucaguggacauuaaagaaaagucuccugcaagccuggggacugauccucagagcaaauauuuuggaagaugucagccuagguaaaauauucuagcacuuggcuagcugacagaugcucugaaaauauccucuugcugguaguuaauaaguuuucccuuagauuuuucuuuucugggugaugugagggguagaguuuauauaccuuuauauaagugucaggcauaggacuaaauuucacauauauuuuuaauuccaucagaaucauguggguauuaauaucauuucacagaugagaaucucaaagcuuagguuaaggagcuuaacucugauuagcucaaguuaagcuugcagucacauagcagguuguugagaaucuagaggcuauacucuuaaccauugugcucucauacaacauuugucuuuuuguccagaugaauugaagaauuuugugcaugcucaguguuuagaacugaaagccaaaggacucucacuugguuuucuggagaaaaagcaugaugaagcuuccucccugucccauccagacuugaccuccguaauccaccucaccaggaguguucaguuguggccugcaauggaguaccuggcuaugcuuuggcgguacaaagugacagcugauuuuauggcacaagcuugucucagaagguaaaccaugcuuucaguuguuuuccuugcgggaacuuuuuuucuugauuauucuguguauccuauacccauaaacaaaccacagacuugauagggaugguuaccgaagcagagggaagugauuugccacuuuggaaagccaaaauuuauugaagguuuuuuuuuuacuaguuuugacucuacuuuaaaagucaccgagaauuuuaucaguagaguuguucauuuuuagauaaauguacuguaaguuuuauguuacaccuucccuaauguagcagcuuuccaguaguucauugauaguccauaccccacccucucccucuuuauuuuuggaacagaugcagcaaaaaucaacaaccccagauaaaugaggagauaagucaccucaucucauuuugucuuuaucacacaccuguuacaccucaagagcuucgagaucugugguccuugcugcaucaucagaagguaaaaaucacaauaagacauaagccuccuuuacauuaugaguugguuagauuuucuuugacagacugguugggaaacauuuuauuuauucucaaaauuccauauuggaaaccucagguuuuuuugaauugccucuuaaagggaagaauuuuaaauauucuuuuauaguaauuaugaggguauauuacaacucuuaucacaggaguauucauuugguuuccaauuaaaugagaugaaaauauuugcugcuuaaaaucucccaauugcucaaaaauauauugugagaguguuuuuuauacuuuuuuguacuuuuccucucuaauaaauugaauaugaauacugguacacuccuguuaauagaauuucauuaguacagcuuuaaauaaaacuguaaacaugucacauuccuugaccaaguugacugggguggcagagaaacggaaaaauuuggauuaauaccuuuaaacuuaugacaguuuuagaugggccuuagaagaaagaagaccuaauaauuuauggagucuuucucagguauucucuuaccuaauuauuccuuuauuucuaggugucuccugaagaaauuacaucuuugugguccgaguuauuuaauuccauguuuaugucuuucuggagcaguacugugaccacaaauccagaguacuggcuaauguggaacccuuugccugguaugcagcagagggaggcacccaagucuguuuuggacuccacauugaagguuuguuggucuaaaauuauaaaaaauguuugauaguggcaaaagaguuucugaauggaucuaucaauaaacauuuauuccuagcauagaguggugacuaaacaggugauugcaacacuuuacuuucugcagaauguuaaauaaguguacugucaguaaaaguauaccauguuaaauaauuugugaaauuuugagauaagucaaaaaagguuuuauugaaaaagucuauuuuuucuaauuaaaacauuuuucccacuauaaaacauuuaaacagugcagauauauguauauauaauacagaauucauuagaaauauccacucuguucuauauccuucuguuuacauauauuuuuauauuaaauacauacguaaacaagaauuaaguacacauauauguaacagaaauguguaugucauuccagcuuauuuuuaaaaguuauuccauuguaucaaugugcuugaauuuauuuuaaucacuuucuuaccgauaaaguguugaaguuucuugcauuuucucccucuuccuauaauaagcaugccacauugacuauccuaguauacaucuuuguccacuuguuggagcauuucuaugcauaaguuguuagaauuagaauugaauccuuggucagagugucuacacauuaaaaacaaaauuaugguuauugccagacuggaaaugugguuuuugcuuuucacuuuuuuaaagaugugaagagccagugaagagggaaguccugaagucuuagaugaccacagugagguuuaguuuccuuuaacauggagaugaggaccuguucaucugcuugcuacacuagcuguuauaaacauuuucaauuguuucugucauauaguuaaaaagaacucauuugcacuucuuugauaagugugaagauugaacauauuuucacguuuacugauccccuuuaguucuucucugaauuuucgagucauaguugugcuuuuuuuuaaaaaaaauuguguuggucaggcgcuguagcucacgccuguaauccuagcacuuugggaggcugagguggguggaucauuugaggucaggaguucaagaccagccuggccaacauggugaaacccugucucuaccaaaaauacaaaaauuagcugggcaguaguggugugcgccugaaucccagcuacuugggaggcugagucaggagaaucgcuugggccugggaggcagagguugcagugagccaagaucgugccauugcacuccagucuggguuacacagugagacccugucucaaaaaaaaaaaaaaauaggguuguucagcgucaguuuauuauugaagaucuuuuuauguauuauggauauuaagccuuugcccaauaugaguuggaaguauauuucuaguuuucugucaucucucaaguuuguuuucuuauaugucacaaguuuuauaauuuuuuucccuccaaauaugccagucccuucuacuuauugacuuuagugucaugcuuuuaaaaaauuucuuccuccaucacuucgaguucaaaacuauuuuccauuauuuucuccuauauuuuuauuuuauguucaaaucuauuucaucaguauauguuguuuuaugauauagggaugcaaauuuuuucuuuuauacaaacagauccaaaagcgauguaauaacaucauuuugacuaauuccuccuuuccacucucaugugaaaugccuuauugccccaaauguuuuuggauuuaccugaacucuauuccauucuuuugcacuaucaaaauggauuuauuguaaaacaccccucaaagccuuuagugauaaacuuuggaucccugaggguuguauggcauuauacagaguugacuaucacacacauuuggcugucacccuuugacaacccuuugcuguggacagcuauuacugugucccaucuaacagucuaaggagcacagacauggcauauuuugucccuggcucuuacaucugucucucacuccuuuccuugcacccugaguuggcucuuauccuccugcaguguguuucuuucccuucugcaagaaugugcucucugauucccagguuugcgggcuuuccucaugcauuacuaaagcauccauugcucauuuccuagagcauggaguccacuuucauuuaagguauacuaaccuguucuguccuucuaggccagucucugagugaugcuuaccuguuccaagcaaccugaacugucuguuucuuuccucucagguucccuaaugcugcuucuggaaauugucuuaauuucuaaaaguuauugacucuucucuuguccuuuagggccccggcaaucucaauagacccauauucucuaagugcugcuuugaagucuuaaccagcagcuggagagcaagucccugggaugugaguggccuccccauucuuuccuccucucacgugacccuaggagaguggguugagagaacucagcagcuccaggacaucaguucgaugcuuuggacuaacauggcuaucucuucaguagcagaauucagguauucccucgcccuggaagcagacuguaaaguuccugucuuuucuccacagcauggagcagagacccagugagaacuuccuucuguaguggcuaguucugguguuugaagugaggguauuuucugccugaaucagcauguuuucaggcuaccgugagcuggcugguucccaugucaguuuuaagcauauugugaucaagagggugaacuuaguaaaccaaauaagaccaugugagaacagaaauucaccucuacauauugaugcugcauucugugguuaucauuucuugagagaauuauacuguaugaaaaggaaugcuuuuugauacaguacaaaccuuucagugcuuucuuuuuguccccacagacgcacggauucccaacuccaggggcaggugcuguuccggcaccuggcaggccuagcagagcugcucccagagucccggcggcaggaguacaugcagaacugugagcagcugcugcuugggagcagccaggccuuccagcaugugggccagacacuuggggacauggcuggucaggaggugcugcccaaggaacugcucugccaguugcucaccucccugcaccacuuuguuggugaaggggagaguaagaggagccugccugagccagcccagcgugggagccucugggugagccucggcuugcuccagauucagacauggcuuccccaggcacgcuuugacccugcggugaagagggaguacaagcucaauuacgucaaggaagagguaugggaggcaagaguauggagcaugggcuccuucccugacgugcuggguuugcuuauuguauuacuccuuuuauucccuuuugggugcucagaucaucacaagcaugauauugcauaaguugccuuaugacuucccaggagucuguuuuagagacuguauuuuccccuuugagaguuguccugacuauacucaugcucugggaggagcccuuccuaagguucugagaucucugccaauaggugcaaugggcagagggcagguagaaaaccugagccauugucagaaauagugguaccucucacugucucuggacucucucuaccugagcuuaguuuuggauauuuggguuuuuguuuguuuguuuguuuuugagauggagccuugcuuucucguccaggcaggagugcaguggcacaaucucggcucacugcaaccucugccuccuggguucaagcaauucucugccucagccucccgaguagcugggauuacaggaacccgcuaccacgccuggcuaauuuuuguauuuuuaguagagacaggguuucaccaucuuggccaggcuggucuugaauucugaccucaagugauccacccgccuuggccucccaaagugcugggauuauaggcaugaacuaccauggccagccuggauuuggauauuucuuuagauagaauauaguaucccuauauccuaggaauuuuuaacuuauuggugcuugcuaucuaaaacucaagaaucaaguagaggcugggugugguggccucacccuguaaucucagcacuuugaggggcugaagugggaggagcaguugagcccaggaguuugagacuaaccugggccaccacauaguaagauuccugucucuacaaaaaaaggaaaaaaaaaaaaagcugggugugguggcaugugcuuguaauaccagcuacucacgaggcugaagcaggaggaucacuugagccugcggggucaagccugcggugagccaugacugcaccacugcacuccagccaggcuacagagccgagaccuugucuuaaaaaagagucaaguugauuuggguaaugugguaucccuugcuauuugaaguuuugaaccaaguucaggaacuaaauacauuaagaugaugguauguuaguacauauuuugaagaaggaaaauuauauuaguuggagugaaggcuaagcuccuauagcagagagacuaaaaaauucagugguguaaauaagaucguuucuuuccccucacagcucugaugugagugguguagauuaauggagcagagccaccucuccuugggucauucaggaacccagauuccuuccaucuuguuccucuacguguccccaggacauuguccucaugugcauggucauagcugggacacaguggacuaacuucucucuuuuccauuaguuacaccaacugcagugugaauggaagacccggaaccugucaucccagcugcagacuggaagagaccuggaagaugaagucguugucagcuacucucauccucacgucagguaacacagcagagugauuauuuguuuuggggauuauugacucuccuuuugauguaauguaguuauggugugaguagaagugauaauauacaccucuaaacuacauuagcaauuagaugccaaagcauuguuuauagucaggaaaaauaauaugccuugugaaaggaggagaggggggcuauucaagguguguguucacauggggccaagauguuugaagccaaaacuuagucucagcauagaagaaguggggugugauaguaugcacuauauuucucugcuauucuuggcuguagguguguuacuaggaaauaugguacggguuggggaucccuuauccaaaauuccugggaccagaaguguuuuggauuugggguucguuuuuuuucuucagauuuuggaauauuuauaccaguugagcaucccggaucugaaaaucuggaauccagaauacuuuaaugagcauuuucuuuaagugucauauugucuggcagucaaaaaguugggagcauuuuggauauuuggauuugggaugcucagccuguauaguguaguagguucugaguuccaguccuacuccugaccuuugguuuuagacauuggguagaucacuuaauggcuuacaucucaguguccauaucagcauaagaaggguaauuguaguuaucuacuccagugagucaugaugaggcuucaguaagauaugcaucugagcaccagcaacauacaugacacaguaacugcuguguaaauguuauccauuuucauuaacuaauugucaguauuaucacaacugagaugauauuggaaauauuauuucgcagcagcugauguuucuuccuucgguuuuccuagcugaggauccaaucuagauuugcugcucuucuucugacauaauuggcauauuguguuaauuucccguuaggcugcuucgccaaaggauggaucggcuggauaauuuaaccugucaccuguugaagaaacaggccuuuagaccccagcugccugccuacgagucccugguucaggagauccaccacuacgucaccagcaucgccaaggccccugcuguucaggaucugcucacacggcuucugcaggcccuccacauagaugggccacggucugcccaaguagcccagagccuucuaaaggaggaggccucuuggcagcagucacaccaccaguuccggaagcggcugucagaggaguacaccuucuauccagaugccgugagcccacugcaggcauccauauugcaguuacaacauggcaugaggcugguggccucugagcuccacaccucacuccacagcaguaugguuggugcagacaggcuggggacccuggccacagccuugcuggcuuucccaucggugggccccaccuucccgacuuacuaugcucaugcagacacuuugugcucggugaagucugaggagguucuacgaggccuugggaagcuaauccucaagcgcucaggaggaaaggagcuggaaggcaagggccagaaagccugucccacucgggagcagcugcugaugaaugcucuccuuuaccugcgcucccacguguuaugcaagggagaguuggaccagagggcccugcagcucuucagacaugugugucaggugagccaucucugggaggccugcccugcccuuccuccugcagagagccagguucacagcagggcggccugcaggacauuagcaugccuaguagauacacagugucguuggggcgugggcauuuuguuuucuguuccuucuuuuucccuauuuaacuaucauguuuggggaccuuugccucucaauuuuuaagagauuaaaaaaaaaugagagcggccuuuauuauacacuacauguguuuucucccaguuugucaguugucuuuugccuuuuugguaauuuugccagguacuuaugucaacuugcauuaagauguucccuuauuaauaaaaguaauuugcucucauuguaugcaauuaagagaauacuaaaauuucuaaugauccuaccacuuaaagcuguauaaacgcugcuaacauaccagguaucccauuccaggcuugcuuguauguguauauauauuaauauuuaucuguagcuguaugucugugacacucuaaauuauuaaaaauuugucccaguggcuuacaaauuuuuuuuuguaguagcagcagcuuuuaaaaaauacaaaucuuagcauaguuaacagaaaaaaagaguugcuccgguuaagguagauucuaauccccaccagggccccugagacauguccuuaaauugcuacaaaauguacaacaaaccacuaguaaaguuuauucuauuugauaacucuguuugcuuuuaaaaacuucauguauagugauuauuuuccuguuauucuguauucuucaccugcuucauauuuagugacugccaaguauucuauuguauguuuaugacacaaguaauuuaacuauuuucuuaucauugaacauuuacauuuguauauacuuuuacuguuuugccaaaaaaacaaaaaaaaacaaaaaccaacccaaugccacaguaaauagucucacagcuauauauuuggauacaaauuuuagagaucaggauugcugggacaaagauuaaacacacuucuuaggcuuuacaugcaaauuaccuuccuagauggugggugcuuauuuccucaaccucagcaguaccggaugguucuuuaaguuagaauuuuugccaguuuaaagaucuaaaaucuuagaagugguagggaauuucagaagugucugguaagacacauuccaguuuugccugauuggugcccuuugaccacccagucccuagucuaaguguuucuuuucugaaccccuuggccagcuccuuggggugccacccagguguugucugaaccacaacccucucauggccaacccugagucuguccuuguuacaaagcaccuuuaccucuugacaggaaguucccauuagcuguacuguggcaaguuuuacaccuucaaaauuacaaugacacagcaggggggauuuaggaaacugguugcugaggcuacacacuuggaaaacaaaacccauuugcucuuuauuccauggaauuuaguuucuuggauguuggcuuuuauuuguuuuugagucaugauacuuucauuuucaugagaaauuaauagcaaaucuugccuuugugaaugccucagcaaagaaagcucagcuucuuucugucugugugacuuucaggaaaucaucagugagugggaugagcaggaacgcauagcccaagagaaggcugagcaggaaagcggccuguauagauacaggagcaggaacucuaggacagcccugagugaagaggaggaggaagaacgggaguucagaaaacaguucccccugcaugaaaagguagagcagugauggcaggguguguuuuggaaugaauucccuugaugccauauacauucccucugauggcuuucucucuuccucuuuaucucucucucuguauguauguauuuuagagacugggucuugcucuaucacccaggcuggagugcaguggcgcaaucauagcucacugcagccucaaacuccugggcucaaacaauccucccaaguagcugugacugcaugugcaugcuaccacacccugccguuuuuauauuuuuuacagagacagggucucacuaugucacccaggcugucucaaacuccugaccucaagugauccucccuccucggccucccaaagcacagggauuacaggugugagccacugugcccagccuguagucuuuuaaaauauauuuuaauacauauauuaguccuauuucauuuuuucagucauucuuaugcuuuuuucuuucuuccuuuuagucugauuagaaguagauucugauuuuuaaaaguucaauugcucuaaugcuauuuauaggacuuugcagauauuuuggugcagccaacguuggaggagaacaaaggaacuucagaugggcaagaagaggaagcaggcacaaacccagcucuccucucccagaauucaaugcaggcaguaaugcugauacaccagcaauugugucucaacuuugcucgaucccucugguaucaacagacucugccgccacaugaagcaaagcauuaccucagccuguuucugucuugcuaucagacuggggcaucgcuugugacacacuucuacccccugauggguaugguaguuuacuuuuguuaugccccugggaaaugaaagcaaaugcaaauagaugcuguugcuacucuguaacaaucacacucaugaauuuccuguuuucgcauaauuccuuauuggaguuuccuuggcuuaaagaacugaagcugauucaagaaaauugauuuaggauucuguaauaagauggauuuucaucaguguacaaaugggccaagaaaaagauggauuuuuauuguuuggauccuuuggggugagggauuaagaaaauaaggacaaggacuuaauuuaaauguguacguguauguguuuuuuuuuccuuagcauuauuucugcugucaaauagccuuagugcuuuugaaaugaaauaacacauaccugggagcaaccaaucuuguagaauaugguuuaauaguugguucauugcaguuuccuacaugauuucuuggcauuauuucauagaaguaggaaggaggcuuuaaguuuccuuucuguuuaccuagaauagguauaaaaacugggaauuuggaugcacugaguuaaccccuacaccauuuguuuauaccuaggcaguuucugacuuccucugcacauuccagaaacuugagagcuuuagguagcuacuauaguauuaggauuacaguucucuaggccaauguugcuuuaggggagaauagcauucauuagucccaauuaguucauuguugcugauguugcugaugcucuguuucucaggcuggagugcaguggcacaaucucagcucacugcaaucucugccucccagguucaagcaauucuugugccucaggcccgcaagaagcugggauuacaggcacaugcaugucuggcuaauguuuguauuuuuaguagaaaagagguuucaccauguuggccaggauggucucaaacuccuggccucaagcaaucugccugccucggcuccccaaagugcugggauuacagacaugagccacugcaccuggcccuguugcugacaucuuuuugacauguugauagaucaacuuacugaauucacugacuuuaccgugauguuaacuucacaggaguugaacugaaugaccgacucuugggcagccaacuuuuggccuguacccucucccauaacacucuuuuuggggaggcacccucagaccugauggugaaaccugaugggcccuaugacuucuaccagcaucccaauguuccagaagcacggcagugucaaccugugcuucaagguuucucagaggcugucagucacuugcuacaggacuggccagaacacccagcgcuugaacagguagggcagcuguugaggaaggagugcucacaguacugagucugcaaugaggaugcagccucaccauuaucccugggggcacccacuugcacauauauacauauaaacaaaggcuuaaagaacugcaguucaaugagauguuacuuacuaacugcaggaugaacacaccaguuuuguauuucucuuguguaaaugauuggggauucuguuaauuuuauuuguuggucaggaguugcugaccacauaauaaaaugcugccauguugcucuguuuuuuuuuucagagguguuuuaaaaguagagaacuggggggaaucuucuggucaggacucucuucaguacccugugacuuaggaucacugguauuccuacugagauacccaaaucuuuauuucugcagcuccugguuguaauggacagaauucguaguuucccacuuuccagucccaucucaaaguuccugaauggcuuagagauccuucuggcaaaggcacaggugagcuaauaccucucuuccucauuuuaguugguggucaguuggcaaaagauacgucuuguggcaccuuuguuguuagacagaaaauuauaguuugggcuagaaaaagguaaacauccuugguuuuucuggcauggggugagaucauugcaagugaggcuguugccccuguggugagggcuagcugccuugccuuuuauccagugggaugcaguaucuaccgguaaugagggugcacuccucccagccuuccaggugggccuucauuccaacugagugcccacauacacgguuccccucagugcccucauggccucuaaguuagcuguugccuccccauuggacagaaaagggccgcaugucuuuguucuaggucagauagcaaagagcacgaauucaggcuccagucuauaaacacugugcuuuuuugccagccucuaaacuuggcucugguggaguucugucaugugaacagaaagaacuugaagcugauacacuguaaauucauuccuacaauuggugcaaguuguuuaagggcccaguagucuucacucaagcaaaguucaagauguucuugaggaaggaggugauuauggcauugaauaauaucuguaguaaauuuuaucuuuguuucuuuaggauugggaggaaaaugcaagucgagcuuugucuuugcggaaacaucuugauuugaucagucagaugaucauucgguggcguaaacuggagcugaaguaagugacucuccuucccucuccuaaacuuagguuguaagggcuuuugucuuuugguaguuuaaauuucuuuaggauuuauauaguauuacagcuacagaaugugcuuuucaguuauuaaucacagaguuaaaaguagggcauuaaaaugaccugaauacaguccagacaacagcauauauucuugagggaggaaacuggguggcuccuccaucuccauuugggaggagagaaaugugagcauguagcuucugcaucuuugguuucagauauuucaaauagguuuuccuaaaugccuccuuggcuucuucucguuucagcugcugguccaugaguuuggauaauacuaugaagcgccacaccgagaaauccaccaagcacugguucuccaucuaucagaugcuugagaagcacaugcaggaacaaacagaagaacaggaagguaaugccuagcaguacauuuccugcccacuuagagcuucccggcuaaauggagugcugcaaaguguaggauuuuccugcucccgcuucucccgcuacauggcuuucaugggaaugccucccauuugacuucaugauauuucugagaggucagccaagaaaacuguaaaucgugcuuaucuaacugagagaauaauaacaaaagugugagagguuuaaaugucuucuccaaaagucuagagaaccagucguaggauaagguuuccgucuucucuauguccaugauagaagucaaacugaaagcugacuuuuugguagguaguagccaacaugcuugaaugaacagucuuuuauuuuauacuugugacaagcaccuuauaauucauuuucauaauuugcugugagugcauuuaacacaugcucuaugugcagcugcuacuuuuauuuauuuauuuauauuuguuuuuuauuuuuuuuugagacagaguccugcucuguugcccaggcuggaguacagugguacgaucucagcucccugcaaucuccgccucccaggcucaagugacucuccuacuucagccuucucaguagcugggauuaccggugcccaacaccaugccugucuaauuuuuguauuuuuaguagacacgagguuucaccauguuggcaaggcugguuuugaacuccugaccucaaaugaucugcccgccuuggccucccagagugcugggauuacaggcgugagccaccacaccggccuguuacuuuuaaaucagcuuagaauuuagccaugguccuugcuugagagcuucacauugugaugucuaccucuuggccauccguaguaucccaaauagauugcgugcauguuaggaauagggagucauggucgaaggaacauauauauuuuucucuuugaauuuuuaaagaugacaaacagaugaccuugauguugcuggucagcacauuacaagcauuuauugaaggauccucgcugggagaguuccaugugcgacuucagauguuacugguuuuccauugucaugucuugcugaugccacagguugaaggaaagggugaggauuuuuuuuuccuuuccuuugacauugcacgacuaaaaugaguuaggcuuugaauucucugcaugagacaggugccuuguugcacgcuagguuuuaaacaagacacauuuaguuauguuuaaugcgauucacauuagauauagagaagaacauucaaagugaggugcagaugguuauaaguuuaguacugacuagugagcucuggcagagguaaauugccagaugaagaucucaggaccuaccauguugaggcagcacaucucucugucuagacauuguaaauguccugcuaagcugcuccuugauccaggccauuauuaguuucuuucauccagugagagcacugccagccaucaaggaacugcaucuaaaacugcccgcugucaaguacuaucccugaucacagcaacugggauaaaagucucacuacaagaugaguauagauuguacaugaaugagcauuugaggugaacugcuuaauaugccaucuuuuaaaaaaagcucaguuucugcugauuuuacaauaaguuucacagaaggaauuugacauugugauuuuagaagaaccuaggaguacaucaucuucaagaacaaaagugcaaaaaaacaucuguuacaagcagaagugaaaaauaggggaguguugacagccugcaucucugggaaaugcuaaacucagacaggaucccuaaauaaugcaccugugaaacucacuguaaucucauggcauagagaguaaugaggaagggucaucacugaaauaugaaggccacagcuggcaccaguagcacaugcagcaagugugguauuuuuguuuccuuuucauuucuuccagauucacuuugcaguguucuauggaauuuguaccauuauuacaagcaauucuuugaccggguccaggccaaaauuguggaacuucguuccccccuagaaaaagaacuuaaaguaagaugaacagcugucaugaucacucuugggaggacaaaaucagcaaauucucuuucguuaacccuguuauccauuuaacacugaggcagggaccuaggggaauagaggugagcauugccaccgcuagggaggauggcaauauguacaucgguggcauuggcuucuuuugucaccugcagagugugugagcgauugguggaguggccagucagagccuccucagaggacugccacagaaaucuguuuguguuccccuggucuugcccaggccugucucccaccucagagcuaugccauguuguguugguccacacacuacugaauuaccaugggggaaggagggaccgcucuuuuugauauucucagugguuguggaaccaaccaugguacaagggacaugacuaacuuggugguuccuaagcuggaguauaugucaggugacuuaaugacuguagcagcacucuuuuuuuuuuuuuuuuuuuaaaucacuuugagaccaaaacauuuguuguuuuuguuuuuguuuuuugagacccagucucaacucuguugccuaggcuggagugcaguggcacgaucucagcucacugcagccuuugccucccggguucaagcaauucuccugccucagccucccgaguagcugggacuacaggugcaagccaccaagcccggcuauuuuuucuauuuuuaguagagacgggguuucaccauguuggccaggauggucucaaucuccuuaccuugugauuccgcccaccuuggccucccaaagugcugggauuacaggugugagccaccgcgccuagcccaugguuucuuuuuuagacuuguuuuacuuguucacugacacacaguccuguguuugggauagagugagcucuggucuuugcugaacagaaaucuagaaagaaacagaaugacacuagcuuuauaaagccauuucuugaacaucauuuaucuuacaggaauuuguuaagauuuccaaguggaaugaugucagcuucugguccauuaagcaaucuguagaaaagacacacagguaauccaucuuuuaaaacuggagacaaccaaaauagaauagaauuuugugugguagggagcaaaacgacauaguuaccauaaccuaacuuaauauuaaguguguuaaacuucucaaaaaauaacaccuugauuguuuugauguugcuuucaacaccacccccuucuucuccaagcaaagucuaccugcaguaaggauuagugugccuugagacaaagcaggcuaugucucaagucuucugccacccacuagcuguauacuuugagcaaagcaaucccauucuuucuggcuuuaguuucucuucuagaaaaggaggauaacaguaccugccauacuuuuucucuuaaaaauaaaacaacuauuaauauuuaaggagagcauuguauauaaaagguacaggguauuagauuauguauggaugcaugauaauguauuuuuuauaugucuucacuugcuaauccaguuuuuuucuucuuaucucugucauuaccuggggacaggacacucuuuaaauucaugaagaaauuugaagcaguccugagugaacccugccggucaucccugguggagagugacaaggaagaacagccugacuuuuugcccaggccaacagauggagcugcaagugaacugucuuccauucagaaucugaacagggcacugagggagacccuguuagcccaaccagcagcugggcagguacuugguugugggacagugcuggcuuauucccaagccagucaagugggaucuguguuuuaugugcaaggcaugccucaguacuagacaagaaaaugccuuugaaaucuuguucuuuggacauauauagcauguauuugccugacuucccugcagaauaaggcaaaaaaucuugggguuuuuuuuuuugcuuuuuuuugagacagauucucgugcuauugcccaggcaugauuauggcucacugcagucucaaccuccuggacucaaaugauccuuccacgucaaccuccugagugcugggaccacaggcacaugccaccaugccuggcuauuuuuuuuuuuuuuuuuuuuuuuguagagaugaggucucacuuuguugcccaggcuggucuugaacuuuuaguuuuuuuuuuuuuuuuuuuuuuuuuuuuaagacagagucucgcucaggcuggagugcaguggcacgaucucggcucacugcaagcuccgccuccuggguucaugccauucuccugccucagccucccgaguagcugggacugcaggugcccaccaccacgccuggcuaauuuuuuguauuuuuaguagagacaggguuucacuguguuagccaggauggucucgaucuccugaccccaugaucugcccaccucagccucccaaagugcucggauuacaggcgggagccaccgcuccuggccgaacuuuuagucuuaagugauccucccugccucggccucccaacgagcugggauuaugggcaugagucaucgcacuuggccuugcugcuuaaaauuuaaugucagccugugagaaauaauugugcuuuuaccugugaacauuucaucugcuaugagcaaagauuugaagcaucaguuuaagaauaugccguugaagcugccugugggcuaccacaugaggaagcuacugcacagggugugaauaugugccgugaugugcugguuuauagcagaugcugauuacugugguguaaauacuccuauuauggccaauuucaagcaccaacaguuaagauuuggcuugcaaaauuccugaaaauuuaacagugauacaucuugaguuagcaggucuguuacagaauggauguuccugcuucauguccuuggguguggggagcuccaggauuggaagacaccccucaggagaguaauuucugggcaggcguaguggcucacggcuguaaucccagcaccuugggaggcugaggcaggaggaucacuugagcccaggaguuugagaccagccuaugcaacguaugagacccugucucuccaaaaaaaauuacuuuuuaaagaguaauuagcuuugucuucuuacuguauuuccuaccuggggcucacagaguuaguaaugaaaguccuuaagcuauuuuuguuauuuuagugguucaaaacucauaauagaaacugagcauacagccauaagauggcugcagagauaugauauggcuaccaaauuuauuuucuuuugacuguauuugucagcucacugcuucugucauucugaucaacaauuuugauuugcuaauaaugacaacauaggaguuucagguuauuccucaaggaaaaaaaaaugaaaauaugcccuugauggacgaaagcucuucccuucauauaacaucugaauuccugugucugaggugcgguggcucaugccuguaaucccagcacuuugggaggccaaggcaggcagaucauuugagaccaggaguucgaaaccagccuggccaacgugguaaaaccccaucucuauuaaaaauacaaaaaauagccaggcauggugaugcaugccugcaaucccagcuauucgggaggcugaggcacaagaaucacuugaaucugggaggcggagguugcagugagccaacaucgggucacugcacuucagccugggugacaaagccagacccugucucaaaaaaaaaaaggaaagaaaucugaauuccugaaauuuaaacuguuaauuagggguaacuggucacaggaguaggaccaguuucgccuggcugcugugucugagaaacacaauguggcucagcaccuuaagggcagcagugauauuauucauucuacucuguucauaauucagaacuggagucuccuuguggcuaucauagcaagcauugcuggauguaggggcauggggguccuucaguuauaaugaucucauauggagcaguaauaugguuuucuaaauauccacaguaugucucuuuuaauuuuagugaugcuacauuuguucucuauuugcugaacuagggauguguuuuugugugcaacaguuaaauuuaguucccuugcagggacacugccugucauucuuggcagugaggcuaaccugucuuuugucucacaggccacaauuccagaguggugucagggcgcugcuccuuccggcuuggaaggggagcuucugcgucgcuugccaaagcucaggaaacgcaugaggaagaugugccugacguucaugaaggagagcccccugccucgccuuguggagggccuugaucaguucacaggugggugccagcauccaagucaaggguggaucuuucuguuuuccccaguggcgcaggagggcugagaauguggcaacuguguccuuuuuugauaccuuguguaguguugaacaguugauugaauaagcaagugggcuuaaaaacccacagagcucagaaacaggagccuacugagaacacacaaucauaauuuucacauugucguccucucauguaacuuggcacugugccaucuuuuaugagagccuugucuauacuaguuccuguugguugguguuaccaguaaaggggcacagagguggauuucccagugucuaagcuguccccacugucaaaaaguugucucacuugaggaggauucauccccauccucuugcuuucuucacuucagagaggcacagcaguuucauuucucaggcugucuuugcucagggaaggugagagcgaagaucucauaguguaacacagcaauagcugggaagggaacccagaauuuaauagaauguuugggccccuggcagccucugacuaccuccuucaccccaucuaccccccaacugcagugagugugcugucagugaggguggccugccuuuaaugagguugcaucuaaucucagggagcucuuccuuuuuaaaacuugucagccguugcucaaggugacucaggccuaggggugggggugaguggaauacagauccauuugcaucuccuggagaggggaugcgcugcaggaugcaaagccucccucauccucuaacucucccacacugucugaugucuuugguguccuugugcucacuggugacugccuauauuuggcugguagugcugccuuaauauaguaccacagacuggguggcuucagugugaggcuaaaaguccaagaucaaggugucagcaagguugauuacuucugaagccucucuccuuggcuugcagauggccaccuucucacuguguccucccguggucacucuucaucuguguguucuguguccugaucucuucuuuuaaggacuucagucagauuagauuagagcccauucucauuucaccuucauuaccucucuaaaggcccugucuccagauacagucacauucugaaguucuagggguugggacuuuaacauaugaauugagggggaagacacaacccagccuauaacacugccugcaacagggaggcggcacccuuguguuauugguacccacguguauucaggaaggcagcuuggugcuauauagaaagaacuugggcuuuggaguaagguaggccaguguucaaguccuggcucaucuacucguucaccacauggccuucagauagugacuagaccucacugagccuuucuugaagucuguaaaauggagcuacaaauaggugcuucugaaguugugcacaugaaaagagaauuuacgauguacuagcuacaaguggaaacucaauacauauuauauuaaucugaaauuuccuucaagugauuauaaauuucuaguauaaugcacugcacauaguuggugcucaguaagugcauuugcuugauugauuauaaaaccccuaaauacaaaagaaugacugcugcuguucggguuguuauugucaagagauuugaaauccuguguguuauuuuucuauuuccaugcaccuugaccaguuugguuaaaacacuuaaugagauuuuaccaaaugcuagggacuauguuaaguacccaggguauaaagaugaaugauacuuggccuuuguucuccagaaggucccugguguuggguaacaaacacauuaccagaccccugggauuuucuuauugucuccccuccccgccuuguuuucccuuacaggugaagugauuuccucugugagugagcugcagagcuuaaagguggaacccucugcagagaaggagaagcagcggucagaagccaagcacauucucaugcaaaaacagcgagcuuugucagaccucuuuaaacaccuugcaaaaauugguaagguucucacuugaaacccaaugaaauguagucaccaacuuuuagggagagaaaugacaugacugauuuugggggaaauuccauagacaguugagaugguggacaacagaagguacaggcaagguuuccagaugucuaagaguuccacucacaugcaggaaaauccuaugaccagccauccaugauucccaaauauuucccgcuuuguaugagguuucucggaaucuauauuuuuauuuauuuauuuaauuaauuuuauuuuuuugagacugagucucgcucuguugcccaggcugguuagugcagcggugugaucucagcucacugcaaccuccgccucuuguugcccaggcuggagugcaauggcgugauuuuggcucacugcaaccucugccuccuggguucaagcgauucuccugccucagccucccaaguagcugggacuacaggcgcgugccaccacacccggcugauuuuuguauuuuuacuagagacaggguuucaccguguuagccaggauggucucaaucuccugaccucgugauccacccgccucagccucccaaagugcugggauuacaggcgugagccaccgugccuggcagaaucuguauuuuuaaaauuucugucaccacgugcuguaccauaugcuugcagcauagcauagagagcagugcuucucaaacuugaacgugcaugugaaucaccuggggaaucuuguggaagugcagcuacagauccuguuucaguuggugugggugcagccugagagucugcauuucuaacaagcucucaggugaugcuguuuagaagacuuugcuuugaguagcaggggagaggggggcacauccauucucuacuaagcaucuuugcuuaaagaaaugcuguuuauuuccuagguuugucguaucgcaaaggucuugcuugggcccguucaaaaaacccucaagagaugcuucaucuucacccauuagaucuccagagcgcauuguccaucgucagcagcacucaggaggcugauucuagguuugucuguuuuuguuuuguuuuuucccuacuuauaaauggagcaaguaauuuagaacuccuuguccucauuugcacauugcaaaaauagggauagcaauaccacuguggcuaccacuuacaaaagugccuggcucaggaucugacuccugauggacauucaaaugaaagugugaggcugggugcagugguucaugacuguaaucccagcacuuugggagucucaggugggcagaucacuugaggucaggaguucaagaccagccugaccaacauggcaaaacccugugucuacuaaaaauacagaauauuagccaggcaugguggcacaugcuuauaaucccagcugcucaggaggccgaggcaaggaguaucacuugaaccugggagguggagguugcagugagcugagauuacaccacugcacuccagccugggcggcaaaguaagacucugucaaaaaaaaagaaaaaaaacauuuauuuucuuucucuuucuuccuugcauucaccucuccauucuucuucuucuucccuuuuuuuuuuuuuuuuuugccuuuugauuuuccugaggucuacuugcuucauuugaucauacauguggaaaccuauuagaaaaugguauauuuuuaguugcucuauauacauacacuccucauaaguucuaauauguuauugaauuugcgaguccauacacuauugagacaggcagagcuaccucuguuuacaacacagcagaggauguugugaaugaugcuuugcaugaacuggguauaguacacauguguguuuuauuugcucccagggcuuuaaauuugaauucaacagaacauuguagaaaggggaaauuuuacauaagcauucuuuuucaggaaaauucacgaagugggcuugcauucccauucagucagcagcacuguagcugaauaguaguuuccuccuuuugauaggacacaugcucuccagcuuacuugagcccucaacaaccccugugucuuccccacguugaggucagcugucacugccaugcaucauuguaugcuuggcuguccuuaguccucuuauguuauuugccuggccccuguaggcaucagaguuuaugacccccuagccuccacugccaagauaggaagauuucauugaagaaaccauguugucagcauaauuuauuuccccugauacuuccagugcugaguuaaguaaaggacuaaugagugccucacugaaugauuccucauagaaauaaaccuauucagacagcugacucuugguuauggccaaauauaccaauaucugaguuuucaggaucuggggugggagagcgugguuuuaauuaaguaaacaauguugauaucuuuuccaggcugcuuacagaaaucucgucuucaugggauggaugccagaaguauuuuuaucgcucucuugcacggcaugccaggcuuaacgcagcacuagcaacuccugccaagguagaaugauagaacaugagucuugcaggggcucagggaaagcccuuguucuguucaucccagggcuguauucucagaccuuguuaagugauaacagccuguuaguggaacugagcuuuuugcaguacauccuuaaacuuaaaauauaaaucaauguaauuuugugcaaaaucagaacaccuuaaauaaauucaguuacacuugccagcaggacagauuuucuuaauguuuaagaaaaauuaaaaacuucaaauugagaaugccaucuuuagaucuuucuucccuuugugaauugagaaaagaccacuaauaaaugcauuuuggaguuaaauccaguuccugucuauggaaucucaaugaucugugcaagcauaauuggagaaacacugcucaaaaaaaugaauaugucaccucuagaguguggcaugucugacgcuuauaguagaaacagcuuucuagaggcacaucugugggugauguuugucagcagccccuucagcauguuuuuccuucuucugccaggaaaugggcaugggcaacguggagaggugcagaggguucucagcacauuugaugaagaugcucguccgacagcggcgcucccugaccacgcucagugagcaguggaucauccucagguaucagcugaugaguugggcuuguggcaugaauugggaagaauuagauccaagucagcucagaguugcugcauguggggagaggaauaagacaugcucucaauugugaaaugaauuuaaggcccaaagaggcagguaggguuucucccagcucugccccuugcuuucagugauaugccucuagugucccucucccuccgugcucugaaccuccugagaauauggagcugcagagauuucagggcugugucaggcagugaaaauuguuaugggugaacuauaccugugucuggaaugaggauauacauugccaaaaguccaugugggccaauaguuaggcuucuguucaugguauuagggugagauggucuugggcaccgaugagauuugagucugcuucuguuacuuaggcuuuggggaucccccagauggcaaucugagccauacauggaggcuccucaauggaaacaaauaauuaagagaugaggacaguuaggaagguugucgucaucuguugaauggauucguggcugaaggacaguauuuccagacuauucacuuuagcuucagguauuuucugcuccauucauuaggguuuauuuagcaaaguacagcacauuuacuagauaaugcuaguugaagucacuguaguggugugguuguguugugauacuucuccugaaagacugagggauggguuuaaguacuuugggaggcauuuuaacagacuuuuuaccuaucugggggauucuuccuucuugacuguaugaaaaagcccaugcuuguucagaaacacaaauuucuuuuaaaacaaugugguaaagugguuuaaggugccauucauuguguuuuucccauggguuucucuguacaggaaccuccucagcugugugcaagagauucacagcaggcugauggggccccaggccuaccccguggccuuccccccucaggauggcgugcagcaguggacagagcgccugcagcaccuggccaugcagugccagauccugcuugagcagcucuccuggcuccuccagugcugccccaguguagggccagcuccaggccauggcaauguccagguacuggggcagccuccuggccccugccuggaaggaccagaacuuagcaagggacaacuuuguggaguagugcuggaccuaauuccuuccaaucugagcuacccaucuccaauaccuggaagucagcugcccucugguugccggaugcggaaacaggaucaccuuuggcaacagucaacuacgagauuaacagagaugcuaaaaaccauuaaaacagugaaagcugacgucgacaaaauuagacagcagucuugugagacucucuuucauucuugguaagugugucuaugucuuuacacuucucugugugcuuagguccuuauugugcuuaucuaaauugggggugggaagggaagggugugaacagaaagcagcagcuuuuagacagcccuggaaccuagggaacucgucgguuugggggauggggugggguggggauagggggugucaucugcagguucugagacuucagcggaaacagcguuagcaaaaggaugccagacaaagcccuaaauaauccacagggagagcaaaucacauccugccauuuguggugguccaaaauaaaagccuaucacaccaaauacuaaugauaauggaauaucauuaauggaauaaauuuaccauuuauuggaauaaauuaauggaauaaauuuaucauuaauggaauaaauuuaguaauuuauuccauuacuaaaccuagguguuuaguaauagaaucaaauuaugaaaauaauugugcuucaguccucuguuacucaguggaccugcacagcacuuuguggcauguguuuagccguaaaccuucagcuaugaugaguucuaccuugcauaucuuguagugguugcagggagggguguguguuugugggaacuguaaugcauuccuuucaacauuguggcauuucuguugcaggaaagauuuugaaguuugcucuucugcgcugaguugcuugucccaggugucaguucauuugcagggccuagaguccuuguucauucuuccagggauggagguugagcaaagagacucacaaauggcacuaguugaaagucuggaauauguaagaggagaaauuaguaaagccauggcugacuuuacuaccuggaagacccaucugcuuacuucagauagccaaggagguaaggaauauuguucagucagggaaugaaaguccaguguagaaaugaugucuuauagauguaagucucauuguccaaaagacacauuauauuuuggucuacauguaccuguccaggguucugaggcagggaggugcgguugaaauccacagcucuuaacuuuuuugccccauuuguuuggaugccuguuacauacuuuguaacacacauaggaaggcagcaucagcucacugucuguuuucccuuagauugaaaaagcuuggcacugauauuuggacuaaguuaguguuuauucauacugucuuaacuguuauuuuuauauuuuuuacauuauuuuaguaaaaauguuuuaauacaagguaauaaacuuguagguuuaucgaggcaaggaauuugucucuucuuuguaucuggcacagcuugacacaguggcucaucaauaaaugaguauuuuuaaugauuuccagaggcacuaaagcaaaugauuggugucuuuuguuuguauguuuguuuugcaccauguuaccugcuaggaaaucaaauguuggacgaaggauuuguggaagauuuuucagagcaaauggaaauugccauccgagccauccucugugccauccagaacuuagaagaaagaaagaaugaaaaagcagaggagaacacugaccaagcaagcccacaagaagauuaugguaugucugaaaucaggcagaaauuaguuucaugccugauuuaauuuuuguauuugaugauuuauuucuguggcuaaauaguuaaggauggauguuagaaacagauaacugcauggauagagauaaaaggauuuguuuucuguuauucaucauguuguuauuuucucugaaugaaugaggcagcaggcuuugagagacugcaaucaggacaucuaacaaaacucuuagaggaugacuucugggccgaugugagcacuuugcacgugcagaaaauaauuucugccaucuccgagcuguuggagaggcugaaaucguacggugaggauggcacagcagcaaagcaccugguaacuaacuguucuuuacaaacuucuuccucuucagaaugcacugagcaaaggcagagugggcuuuacuucccuccacguagauaagugccagagcaggccucagugccaaaaucacuaagaacuuggucucuuuauuuauacgugcaaagucauugacaagcuuugaagagcuuagggcuugcuagcuaauuguuagaugcauaggugcagaaaugcuaaccauucagaauauccauuauauuaggauucuuucauaucuuauucacauacucccaaguaucugauguuacugauagacgauguuaucaacugaggcuuagcagccauccuguguaaccaccauucccacuacaauaagcgaacagaguaagcaguuguagucuuuacaguaaguccagagaagcaacuuacuuugcaggacauuguauguuauucuguagcauugccuccggugcuaacuuugaaucagcagaauuuauuuauaaacauuuuauuuuucuuauuuuauuuugggacacggucucauucuguugucgaggcuggagagugugguggcaugaccauggcucacuguagccuugaccuccugggcucaggugauccucacaccucagccucccagauagcuggcaguauaggcaugcaccaccaugcccagcuaauuuuuaaaguuuuguaaagauggguucuggcuauauguuuuuuuuguuugguauuuuuuguagaaaugggguuuugccauguugcccaggcaacaugaacuugaacuccugggcucaagcagucuacccacuuuggccucccaaagugcugggauuaaaggcgugagccacugugccuggccaacauucuauuuuuaaaaaaccaacauuguuagccaaaggagacaucgguuugagauuguacuuuugugacgauauauguaaaugaagaaaucucagugagcuguguguauugggguggguggagguuacaaacacauacauguaacuugccauuaguacuauuuaguacauucacaauguugugcaauuaccaccacuaucuaguuccagaauggaaaccugguaccugccaagcagugugagcaggccuuuuguuuuguuuuggucucaguucuucagccaauccuguuccuugcuggugcgccuggugccgguccucuccagcuacucagaccucguccucuucuuccugaccaugucuuuagcaacucaccguaguacugcaaagcugcucucugugcuugcccaggucuuuacagagcuugcccagaagguaaggacuguucacauggugcacugugagcagcagggacccaaguaaauuucaugucauuagucuuuggugugauaggcuuuuauuuuggaccaccacaaauagcaggaugugauuugcucucccuguggauuauuuagggcuuugucuggcauccuuuugcuaacgcuguuuccacuaaagucucagaaccugcagaugauaccuccuauccccaacccacccuuucccccaaacugacgaguucccuaaacuccagcgcugucuaaaagcugcugccgucuguuaacacccuucccuucccauccccaauguaaaucuucagauaacucuugaacuagaguuguaggauaaacccuuaaggcuauuaaguuuucuuuuaaccauguugguguaauuaugauuaaaugauaaugggccuguuauuauuagaguguuuuucgccuguugugguggcucacgccuguaaucccagcaguuugggaggcugaggcggguggaucaccugaggucaggaauuugagaccagccugaccaauauuaugaugaaaccccaucucuacuaaaaauacaaaaauuagcugggcgugguggcaugugccuguaaucccagcuacucaagaggcugagacaggagaauuguuugaacccggggaggcggagguugcagugagccaaaaucaugccauugcacuccagccugggcaacaagagcaaaacugcaucucaaaaaaaaaaaaaaaaaaaauauauauauauauauauauauauauauauauguuuuuuuggagacagagucuccaaaauuguaauuguaauuguaaucuccacgugauuacaggcacgugccaccacgccuggcuaauuuuuguauuuuuaguagagacaggguuucaccacauuggccaggacggucucgaucuccugaccuugugaucuguccaccucggccucccaaagugcugggauuacauguguaagccacugcgcccagccaguuuuuuucuuuagcagggaagucauuuguucauucagccauguacccgguauugugaaaagcacugagguuguagagauuguagacccuccccuugaaacucaggggcaguagacagugaaaucuaacagcaacaugguguggguaggucuagucauagagauauccagcucucggucucucuuaaccucaccaagccucaguuuccucauuuguaaaaugagaucugccuauacuaauaugcauuuuugugagaaccaccugcauuugaguauauaaguuuuguuuuuguucuuagcauucuaagauuuucuccaagcuuaauacagaugagauguacuugaggaagauaugaauuuacaaacugaagauggggucuagauuucuuauaaacaauuaagaguucuuaguuccgagucucugaaauacuggaaagagguaaaaaguggaagccaagccuaaugccuuguaucaagaggauaaauauguuuaucuguaguaaugauaaguaacaguaauaauaauaauaauaaaaaguaauaauaaguaaaagaaugagucucagguuucuccgccucuggugggcaccaggccagccuuaacauuccauugcuucuuggagaaaacacuguauacuaaagauaguggcaggaaaaugugugguucgggugccuugagauuuggcucagcuggauuuguccauuuguaccguagcuuuugucugacaggcuguagaaugacuuuggccuuucaaaccuuugucuguugcggguaggaaugguucugauaugugcagaauguugggagcccuguggcuaucccagacguagcagcugcaaugauauacucugguaagggcaucugaaacucccuccuauguggucguauucuuugucuauuucugaaugucucucauuuaaauaauguaguucaaugggaaaauuaagcaaguaagccaaacuguauuuuccuaucaacauucugagaauauauguccuaaaaguggguuuggcuuguuaaaaauuuuucuaaguguccaaauuguauucauaucuuuucugaguaguucaagggaacuugagaguagguuagacagugcuaagauaauagaucuaggcuguaauuaaagcucuugauccgcaggaagcuguuucuguguaaccaagucauaauuaguguuuacugguuugggaucuuaauuccuugcuaauuagcagcuuauuuuuuugugcauucccauccucagauauaucuucauaguauauauuuucucuuacaaaauuaaacuuucugauugagagucacuacuacuuuuucuuuuuacuucugcucagcaggcuaguauucuucucagguuauuuuccuguauaaaauaguuuuuuucaacauuucacaguuauuacuaugucugacuguguucucuccagagccuguucugcccuuacucaaggacuuuuuccaaaauacuguccuucuaguauacuucauuuagguuuuugucuuggcaaagugacaaaugaccacaugccagaggcuucuacaaagucaagucauauguuaaaucugaugucaagcugugaaacugcauaacuauuagcaccaaagaggagaagaaugucagaagucuccuguacuuccagcggauuuaagauaaugagcuagaaaaagaauucaguauguguuuaaauuguuuuccuguggcaagaaugaaaucuccuuuuaaaauugcuuuugugccuaauuguucacuuccuuuuucuuuuuucuaagggauuuugcuugcccaaagaauuuauggaagauucagcuggagagggagcaacugaguuccaugacuaugagggagguggaauuggagaaggcgagggcaugaaggaugugagugaccagaucggaaaugaagaacagguacguuuucacauagguauacaguugacagaagaucacucucuuucuuuucaacauguaaguuacacauaaaaaugguuuuuacuagguuaauaauuuuuaaucugugaucuacagagcccuagauauauuggugcuucggcaguggguguaaauaaaaagccuaaaauccacaggaaggaaccuggcaacuccaucauugguuuuggcuauaauuauggaggaaaugauuuuuacuuuuuuuuuuuaaaugggcagauauuuacugaugauuuucuagaguauuuuugauaguauuuuuaagcauaaaaggccuggcuaucuuaagugauaauugcauuaaacaauaaugccaaaauuugcuguuaauagguuuuacuguuguauaucuuuaaggcauagaguguuuuaaaaaaucuguauccuuuuuugguuggaaucaagcaaccuucugaacuauucagaugcugugaacuaagauuguuacauugcuuggauuuuuuaaaugccugucucauuugugagugauuuauguguauuggguguaucacuuauauucuaaguuaaaucagaucagaaacuuguauuuaagguaauuuuauaguuauuaaaaauaaaggagaaaaccaauucaaauucccucccuuccuuggcagagaaaacuggaaagcaauuaaaagccaaaagaauaaugcuaguauuuauguuauggagcucuaauuuuuuuuuuuuggaccuauauuguccuuagauaauugcuuuguuauuuuggccuucuguauuucucaaaucuaaaucaguguauacuacuuuucuaguagaaaaaaaaagucaaaagcaaaagcaaaucuaauagaaaaguucacacaaaaaacauuacauggaauaaaaagcuuccagaacaauuugguagugucugcugaauuuuaaauuauguguauucauugacccccaaauuccauguuuucuuauagaaaugcuagugucaaagauaaauagguauaugaguguguauauaugucuacacauggauauuuacuacagcauuauuuauauggugaaaauugugaaacaauccaaauauucaucagaagagaauuaaauuauggcaccauccaugcagaacaaugguaaaacuauuaaugaaguagaaugagaugguuuuguauguaucaacauggaaauaaccuaagauccuauuuuuaagagaugaggucuugcucucuugcccaggcuagagugcaguucuauaaucauagcucacugcagccaugacuuggacucaaggaguccuccugcauuagccucuugaguaguugggauuacaggugugagccaccacaccuggcugagauguuuuuaagaagagauguguuuuacaggcugggugugguggcuaacgccuggauuccuagcacuuugggagaccaaggcaggaggauugcuugaggccagaaguuugagaccagccggggcaacauagggagacacugucucuauaaaauuaaaacaaaacaaaacaaaaaacaaaacccagccuggccaacaugguaaaacuccaucucuacuaaaaauacaaaaauuagcugggugugguggcaugcaucuguaaucccagcuacucggaagcugacgcaggagaaucaccugaaccugggaggcagagguugcagugggccaagaucgugccauugcacuacagccuggacaagagagcaagaccuuguuucagaaaaauaaaaaugaaaaaagcagauugcauaagucuguaaagcaugaucucuuuuuuguuuaaaaagauguugggaggcagguauugguaacuaucaccuguaucacuuaaguauauguugguguauucauagaaaaaagucaaagguucaccagaauguuguugguagucauucuuugagaggcuucgaggauggagguguuauggggaaacuuguuuuuguuuguuuuuuuguauuuuggagacagagucuugcucucuccccaaggcuggagugcaguggcauagucuuggcucaacugcaaccuccagcucccggguucaagagauuuucaugccucagucucccagguagcugggauuacaggcgcacgccacaaugccaggguaauuuuuguauuuuuaguagagacaggguuuugccauguuggccaagcuguucuugaacuccugaccucaagugaucugcccgccucagccucccaaagugcugggauuauaggcgugaaccaccaugccuggcuauuacuuuuguauuuuaaaaaggacuucuuuuuuuuuuuuuuuuuuuuuuugaaacggagucuugcucugucacccaggcuagagcgcaguaguaugaucucagcuugccacaaccuccaccucccggauucaagcaguuaucccgccucagccucccgaguagcugggauuacaggcccccaccaccacgccuggcuaauuuuuguauauguaguagagacgguguuucaccaucuuggccaggcuggucucaaacuccugacugcgugauccacccgccucagccucccaaagugcugggauuacaggcaugagcuaccgugccuggccuuaaaaaggacuuucaaaaaucaaccauaaugaaagagguaacaaucacaaaacuuuuugccccaaauagcacaucaauuauauagaaacauauaaauuaggcugggcucagucgcucacaccuguaaucccgccacuuugggaggccgaggcaggagaauugcuugugcccaggaguugagaccagccugggcaacauugcaaggccacgucucuagcaaaaaauaaaaaauuagccaggugugguuguaugugcuuguggugccagcuacuggggaggcugaggcagaggauugcuugaucccaggagguugaggcugcaguaagccaugauugugccacuguacuccaggcugggcaacauagugagacacugucuaacaacauaaaaaauaauuuuuuauagaagaaauauagaaaccaaggaagaaugaccaagauucucuugggccacugucuuucagcgauaauagugacaaaaauaguauuaaagaauuggauaauaaaagauugaugaauuuuuuauccuacaaagaauauauauucuugcaaaugucucugggacuauuuuuacaauucccaauaagaaaaccugaacaaaauucuauacucugauuaaaacaaguggaaacuaacuccagaaauuuuacaaauuccauguggcugucucuguuguuucucuuuuuuuuuccucucccagauauauuuuuacaccauuaaccuuggcauuuauaucucacagcugaagcaaacauugguaaaguuucauuuauuuauguuuaauacuucuuuauguagguggaagauacauuucagaagggucaagaaaaagacaaagaggauccugauucaaaaucugauauuaagggcgaggauaaugccauugagaugucggaagauuuugaugggaaaaugcaugauggggagcuugaagaacaagguuucagauuaucugucacuucauucuuguuuuugaaagcauaaauauuuuauccaggaaauuacauguuccuaauaaggaacccaauauaaucuuuugaaacaaguugguuacugugcuuaagugcaaaugaaaaccucagcagcugcaugugcuaucaccaccuccacugaggcagaagucccuggugucucauagauucuucucacauugauguuuuagcugccucgugugcuagaugcaguggcucaguagugaagccugaaaggagaugaucccuaauggaaaagggcuuucaacaaaaggcaaauuguucuguaguguuuaaaauaccuuuuauuccuaauuagaaaaauaguagguguuuguuguagaugauuuggaacaaacauguagaaaagaaauagauccccccucaggccuaccagccauagcacuuaauaaauagugguauauuucuuuccauuuauugcauguauacccacacagaaaccauauaccguucuguagucugcuuuuuucuuucuuucuuuuuuuuuuuuuuuaagacggagucucgcucugucccccagacuagaguacaguggugcaaucucggcugacugcaagcuccaccucucggguucacgccauucuccugccucagcauccugaguagcugggacuacaggcgccugccaccacauccagcugauucuuuuuuuuuuuguauuuuuaguagagacgggguuucaccauguuagccaggauggucucgaucuccugacaucaugauccgcccaccucagccucccaaagugcugggauuacaggcgugagccaccgcacugggccugcuuuuuucauuuaacaucuuaugaacauucucccugucauuaaaaauuauuugagaauuugauuuuuuaaaguacaucaucaucugucauauguuuguaccauaauucagcccuugccccaaauuucuguccaauuggagauaacuguaucuuacucuaaaaugaauaucuugcagaaaugaaaguugaccuuaguggcaguuggccuaaggcacauaggauaugaccuuuugcaaaguauacccugugcaaagacaaaugaagacaauucugauugagaccugauuuuagguguuggaaaaaaucauagcaguauauugaagauggggaggacccauggaaaccaccuaguccaaccccaucauuucagacauaaaacucagguugcugagucccauaauggccauucccccagcaccaaaaccagacauccucauagguauuuccuuacucuuuuuaccaucuguucacacauuauagacuuccuuguaccucuacuuugcaaaacacaguaagacuaugucaguagaucuaaaggcaucugcccguaggguguguucuguagaaaaaggcaauaaaucucagguggggcccuugcuagggaagcggguccacaccucucuuaaauacacaggacugggucaguuuggagaucugccuaagcucagugccuucccuuucagaagaggaugaugagaaaucagauagugagggcggagaccuggauaaacacaugggcgaucucaauggugaggaagcugacaaacuagaugagaggcuuuggggugaugaugaugaggaggaagaugaggaggaagaagacaauaaaacugaagaaacaggaccaggaauggaugagguaauucaaagauuucuccccucccaaacaagcugagaggagguaaucugcccacaaccuaccauucucugucauuuacuucucuucuuuuucuguauuuguuuuguucucuuuuuucuauuccucuuuuucuuuuuucuauccuaucuuauugauuacauucagagcuaagaguagcuugaccugagucaucccauguguuaugaaggaggaugaacaagacccugugcagauguucuaagcugauucuccuauaggccacugauuuuuuccagcucccagcuugggagaacuccagggcugaguguaacacugcaacagcccagggugaagcaaugaauuaucaaacucaccccaccauucacacacuuaauaauauugcugcugucauggagaccugcacuguuuucucuaggucacggauggcacuuuaucagccauccaugggauagguccaauaggcagaaauuaugcaugucuaaaagucaacccaugcagaagcaguuucuuggauugagugugaugauuguuuuuucuuccucugacauuuaggaagauucugaacuuguugcuaaagaugacaacuuggauaguggcaauucaaacaaagauaaaagccagcaagauaagaaggaagaaaaggaagaagcagaagcugaugaugguggacaaggugaagacaaaauuaaugaacaaauagaugagguaaugaagauuugaaacugauccgcucucuugacucaaggccagagcucuugagcuguauaguucucaaggugucucaagauauuuuuuccccuguucgucgacugcucucccauuaccucauaaaagaauaugcaacagaggcucuuaacaggacauaaaauauauaacuguugguuccugacaggguaguccacauguugucugggcucaugcuauagaucagaagcuaaaaccugugaucccuuguuuauuucuucuuguaaguuucuucgagauuaaguaacauagcaccauuuguccuuggauaaccugcacagaaagugaaaucugagauuccaacaugaaaggucuaaaaauaaaauacuaaugugugcagauaauuuuagggaauagauauuguguucucucacaguguaaauacuuagagcugauuuuaugggaauucuacuuuuuaaaaaaauauuuguauuuuuauuuuaucccuguugucuccauugucccaaagagggacuaugaugaaaaugagguggacccuuaccauggcaaucaggaaaaggugccagaacccgaggcuuuggaccuuccagaugacuugaaccucgacagugaagacaagaaugguggugaggacaccgacaaugaagaaggagaaggugcgucuuucagaaacaaagagaccgguuagaacucacauuagugaacaguaauugauuucucuuuugaaagcuagcucagugucauggccaggugauaaaucacguuugguaggcucaaucccagucugagaaaaugguuugccuuuccuuuguaguauuucucaugugauuaucccuacagcucaucaaccagcagguauuucucaaacuacugucauguccuauucucgcuuuuggcacugcuaugcccugguggugcuucacacacagcacugucucuucacagccauuacuguguaucccaucucaugggaugguguaaacgcugugcagucuggguauaccaagcugucguggaguccaguuauagcuuuuuuagggaaaugaugguuucaguuauugauugucauguguagugaggaaugagacuaaauaaucccaagagaaaucgcauggcauaugacaguauuucgugccuuuguuguccauuuuucaacccuagugaauccuuuagggaguguuaucugguauuaguugaaagcauuguguuggaggugccccuguaacagagggccccauuccugcugcugcuuaaucagacagaaagaugugagcuggccucgcugauaaaugagucaguuacauaguuauaaaaucuauuuuaaaaaauguauauguauauuuuuauaaugcuguauuagaacaaaaauagcaaguuacaaaggaauaaauaagaggugccauuuauguaaaaauuaauuuuggaaucuaguugcaaacaaagucaauuaccaagaaagcauaaaauuaagaaaauuaaaauccacugagaauguaauaugcugucugcuuuuaaauagccagacucguuuuguaacuaaggaacaauuauuuaaaauuguuugcuaauuaaauaauagauaaugggaaaaaaaaacccaguaggcugguugcagaggcuugugucuguaaucccaacacuuuggaaagccaaggugggagaaucacuugagcucagaguuugagaccagccugaacaacauagugagacccugucucuaccaaagaaaaaaaaauuaguugggcauuauggcacacaccuguagucccagcuccucaggagcugaggcgagagacuugcuugagcucaggagguugaggcugcaguaggccaugaucucgccacugcacuccagcuugggugacagaacgagacucugucucuaaaaaauuaaaaaauuagccaggcgcggugguucaugucuauaaucccagcacuuugggaggcugaggcgggcggaucaccugagguugggaguucaagacuagccugaccaacauggagaaaccccgucucuacuaaaaauacaaaauuagcugggugugguggcauaugccuguaauccuggcuacuugggaggcugaagcaggagaaucgcuugaacccgggaggcagagguugcagugagccaagauggcaccgcugcaugccagccugggcaacaagagcgagacuccaucucaaaaaaauaaaaaaauaaauaauaagaguuauuuuaagaauuugcuaauaacugauuuuugaaguguccaaaguauagaaaaucucuuuugauaaaacuuuuucaaaauaagaguguuucuauuucagugugaguuguauuuucuguauaugaucaugacauccaccaguuauucacaaugauaauugagcauuaagcugccauuuccauuggccuaaaauuuuccuauuguguuuuuuuguuuguuuguuuguuuauggggguuuuuuuggguggauuagcuauuauuuuuuaaugaaauaugccauuaaaacaacuguauguaugaguaugguuuaaaacaagggugggaaaacauuuucuauaaagugucagauauuaaauauuuuuggcuuugcagaccauaagcucucgauugcaaacacucaguucugcuguugcagagugaaagcagccauaggcaguacaaaacggaugggguaaacacagaauauauguugcuguguuccaguaaaaacuuuacuuguuuuuggagacagggucuugcccucucacccagacuggaguacuggggcaugaucauaguucacuguagccuugaccuccugggcucaagugauccuccugccucggccugcugaguagccgagaccauagguguaugccgccuugcauggcuaauuuuuuauuuuuuguaaaagauggggucucacuaugaugcaugcccaggcuggucuugaacucaagugauccuucugucucagccucccaaaguguugggaugauaggcaugugccacagugcccagccaguagaacuuucuucauagaaacauguagaggccagauuuggccugugggucacaauuugccacucgcugguuuagagaauuguaauaagacaaaacuugcauaaguagcucccagcuuaagaaaucauguacguuucaaaaauucugcacuccuccuuuuuguuguaucuauacagaagagaauccuuuggagauaaaagaaaaaccagaagaagcaggucaugaagcugaggaaagaggagagaccgagaccgaccagaacgaaagucagaguccacaggagccugaggaaggccccagugaagaugacaaggcagaaggggaagaggaaauggacacaggagcugaugaccaagauggagaugcugcucagcauccugaagaacacucugaggagcagcagcagucuguggaggaaaaagacaaggaagccgaugaagaagguggagagaauggcccugcugaccaagguuuccagccccagguaucaugagaugucuggcuuuuuauguuaaaaauaaugaggaagaggagaagucaccuuauucccauuagaaucccuuuuaggauacuccuccaucaacauguggcacuuccgaggaguucuagguuucuguuuuaagacccuuagugaggaguggggaagccugcuuguugcaaggucucccaccuuaugcuguucccccagagcauuuaaugcuguguuugauuucucugccgaaggaggaagaagaacgggaggacucugauacagaggagcaggugccagaggcuuuggagaggaaggagcaugccuccugugggcagacugguguggagaacaugcagaacacacaggccauggagcuggcuggggccgcaccugagaaggagcaggggaaagaggugaucagugguuucacugcagccgccagcugccucuuaguagggucucuucucccuguccgacaucacauucuguguagcauuaguugguuuauguuugguuauuuuguuguuuguuuuguuguugacaucuaacagaccacaucucauucuuuaagcaacgcgugacugaacaguuauuuuuuaaagacagggauacauucugaaaaaugccucauucagcaauuucgucauugugcgaacaccauagcguguacuuacacaaaccucaaugguagagccaauugcccuuaggcugcaaaccuguacaguauguuacuguacugaauacugcaggcaguuguaacacaauguaaguauuugugaaucuaaacauggaaaagauauaguaaaaacguguuauuaucuuacaggaccaccagugcacaugcagucuuuccuugacugaaacguuguugugugguacaugacugcuacuuauuuuuauaugccucccaggacaaaccccggaauaucggcuguauuuaaguggugugcauaauaagaaaaaguuguuagacugguagcucuagaugggagaaucagguucguguuguuuuucagaaagcucuccaggaaggaaacauggaauuuagacuucaggcaauguauaccuuuaacgguguuuugcuuuuccuugcucaucaucagguuucuaaacgucuaauuuaaaaagcagauaacuuuuucauucuuugaucugguggugauguguucugauauggccacaauucagguugcugggugcuauggaaagaacaugggaugucaacgcaggaccugcugguuacaguggugauucuggacaacuuuagucucuuugaguccuaguucuuacugacaauaacaaccauuuauauugcuuauaccguaugacuaccaccaccacaaauauucauugagcacccauuaggugcuaagcauuuucaguacuucagaaaguccucucuauguccccaugagauagaugauauuguacuauuuucuucauuguauauuugagaaaaauaagccucaguaaaguuaaaugacaaccucaaguguacauagcugguugaugaugaagccugguuucuaauugaggucuguccugucuuuggagugagacauaauauuccugcaaagaacuaagcagccuuacaaaggccccugagagguuaacauaaggucuguaccuagacacuccuguuucugccuguaggccaggccuuaguuacggugaguuccagggcaggcagguaggcaggagugauuauaugacugagaauaaaggacagcagugagagaaguuguauucaaugcagcacaguaaccagggacuuguaauagcuucuuucaccucauucuuuuguggcuuggauuuccuaggaacacggaaguggagcugcagaugcaaaccaggcagaaggccaugaaucgaauuucauugcccaguuggccucccagaagcacaccaggaaaaacacacagguuucuaucacuccucagcuaaacuuaggugaaggcagcauguagaaaaagauguuccaaacguagugcuuuaaaaaaaaaaaaaaaaagcuauacuccugguuuuuuuguuguuguugcaucagauaugauagcagccuuggugagcagaccacgaccaugggguuuacccagugggaucccgucacggcuucuucccugccugugucucuccccgaccccugauuccggccaugaagucuuaagagccaagugcugugugcggcugcccagcacaaaccgucucacucuuuucauuguccauaggcuuuugcuuuuuuaagaguaaguuuuuuuuuaaguaggguauaauuuaugcacgugaugcaaaauuaguguaaaaaaccaauccccuaaaagccuacauccuauuccuguccccaagggacccuccucagagcaaauugguguuaccaauuccuucuuucagagauauuuucugcauauaugacauauauggaugugugaaaguguguuucuuugccuucauuuuagauauaaaaguauaucauagagauuguucuauguaaguauauagagucccgguucuuuuuaauagcuguauugaauuccauucuuguauggcuacaccugauuuacuuauccuguccccuauagauggauauuauguuuacuuugaguccuuuugucaugacaggcaaggcucugaugaauuuccuuguauuucucagaguuuuaagaggaaaccugggcaggcugacaaugaacguuccaugggugaucacaaugagcgugugcacaagaggcugaggacuguggauacggacagccaugccgagcaggggccagcucagcagccccaggcccagguggaggaugcagaugcauucgagcacauuaaacaaggcagugacgcauacgaugcacagaccuaugguacgguccugggaaagcugcugccuuugcccacugagcucucuaugagagcuugugcuaugugaccuauaauaaugauacguauuugugggguacagugugagguuuugauacauguauacaauguuuaaugaucaagucaagucagcugugccuggcagcugauuguauacacuuauaucaggggagagaggaaauggcuuuguaaacauaagaaaugugcagaaauacaguuuguuuuugguacaaagguaucuguaaccaagugaagaugguuaagauuucuugguuuaguauaaacucuuuaaauauccuuaaauauaauaguuaaaaauaaguuguucacauccaaaccccgauaucaggguuucuuaguacuggacauuucuuucuucuuagucaccucuggauaggucccugcacugacaggugcuaugaauuugaaauauguguuuucuccauaagugcaaaagggaggaaaaaugucucagcaugaggucauuggucagucuccccuucugguucucuuggugacuucaguuucauuccuaauauguaaacuuauauugagaauaaucuaccauuuaggaugguacgaaaaugacugcucuacauuggauuacauuuuucucuccuugaucccacuuaaaaaaaaaaauagagcaguagcuaccauguauugagcuuuugcuuugugccaaaaaacuuuucugagccuuugcugcgugaucauaaacuuccucaacuaauccuaugagcuagagucucucuguuguauaguuaaguacacugaggccaggugguuuaagaacucacucacgcaagaucacaaugcugggauuccuauucgucuuucugugccuuguuuucuacuacuuuuuauuauuuuuaauugaccuauaauaaugauauguauuugugggguacagugugagguuuugauacauguauacaauguuuaaugaucaagucaagauaauuagcuuaucuaccaccucaaacauuuaucauuucuuuguguugggaacauucaaaucugcucuucuagucauuugaaaauauauaauaaauuauuguuagagucacccuauagcccaguuaaacacccuauuuugucaaaugcucaggagcauuugacgguguacuuugaguucauacuguagggcggaaggcagccagugucacauguauaguuacauuauauccucauaauuucuguaggggguagggaacaggcaguucauuaugucaauaggucaauaggaaaucuugugcacagacaagucuccaagccacauagcuggucaguggcacaacuugcaucacuagcauuuuggaagcuagaaugacagaaaccauacccacuuauuauuauuuuguucugcaaagaccuaggauuuuuaugugugggugcgugcuuuguugacagauguggccagcaaagaacagcaacagucugcaaaagacucuggcaaagaucaggaagaggaggagauagaggacacccuuauggacacagaggagcaggaggaguucaaagcagcagacguggagcagcugaagccagaggaaaucaagucgggcaccacagcacccuugggugaguccugcuagugaacaaacccuucccaggcgcucugacuugaaguagucaguucucucucacuauaaucuagucugguguucaguuccauguccuaauccauggcuuagaugaaugaauugccuauaauaauuucacuauauuuuguuugggaccagaaaacaaaaauauggacagcgguggguguugcaggacaccauccuuuaaggaguccccugaaacuugaauuucuggcaaaaucucaucaguuuuuaaaaaauauguagaagaaaccagaauaguacacuuacuacagcuaugaugaaaagguauaguauuagagaaaugauauuuucaauuauauaaaaguauaugcuauuagcauaaaaugcaguaaaauauuaaaagaaauagaaugaggaguuucccuuucauagcuaaccaaguucuauuaauuacuuggcaaaaaaaauagcuucaucagcaauggaauaaaugcaaauucaaaagaacuugccaaauucagaggcuuuuucuucugcuuaguuccuguccucucaggagcguuagaacuguuagaacgguugacuauccuaugugacaagccaggcuuugccucucaccucacaaguugaagcaaauuauugaucuuuucuuugccuguuuccucuucuguaaaauggaauuguggcuuuuaguuuuuauuucugucaaaguuuuacaugcauauaguuucaagaaucauacaguuuuacaaggcuucuuaggacaacccaaaauuuccccuauuucccuuuccaagaacaucugccuucaacaucaggugaggaggaggggaguuuagagaguaaggguuggcaaugagugucucagagagaaagaaccucugaaaucaacauguggaaauguguuggagagugaaugaaugaaguuugauuaauuuucaggauuaacaggcaauagcaaaggcuuggucagucaucaggcuaauauuauaaguaaaauuauguccuuaaaugaaaauaggcuuugaugagauggaaguggagauccaaacuguuaaaacagaggaagaccaagaccccagaacagacaaagcccauaaggagacagaaaaugagaaaccagaaagaagccgagagucuaccauucauacagcucaucaauuccucauggacacgaucuuccagguaguaaaacucacaaauuacugcauuaauauaguguuaauaaauuaacaaaauaaaauuuuaaacugguuuuaaaucuuugucuuuagaacuuuauggaacaucugguuguugagggguuucauguucuuauucaaaauuuuuaggaauacuauugguaugauagguguucuucaagcacgugauacuguuccagcaauuaaucacagggucacagugcccugaccugucugugauggugggucugguccuuggccucugggacucacaucccacuuuucuaaccauccuuguguaaggaaucuucaggacaauuagguuugugaugguuaaguaaaaaaucuuuggcuuagugccuguauuuaugaagagcuauuuaauuaaguucuugagcuaagaguuugacuuauuugauuaaucagauaacauuuucauuauugaugacuuaaggguguuuggguuuuguuuugcuacaguggcuuuauaaauguuuaaaguuuucuuuauccauauugucucucuaagagggaagcagaaugcuugucuggcaucuucucauugugccacuguauuugcugaauuaaguuuugaaucucaggagcauuugacuauguacuuugaguucauacuguagggcggaagacacccagugauacuaaguuggugauuccaaccugggccaccucuuaucuauggcuuuuucuuuuuagcccuuuuuaaaagaugucaaugagcuaagacaggagcuggagagacagcuggaaauguggcagccacgugaaucuggaaacccagaggagguaagucacugcucacuguuuuuuucauaaaauaucucgacuuuuuuuuuguuuguucaacauauagcaaacuuaauagguucuuagcaauuaccuuaacaaaaaggaccaggcauauggagaauauaauuacaauccuaaagccuacagaucuguccaucaguuucuggcugcuuugcuguuagaucuauagcuuaauuaaaacagaaauuggugugcuuaauuccuuuaauuucuguugcuggcucuguaauggauguuaauaguugugacagugguugaaaaaccgggcaagagucuaugcugugccauccuaagaagaggccagcuagaucacugcuggcugacuuaacgugguaguguggauuaaccagcagucuuauuuuuaaugacuuugcaucugaaauuuacuguauuauauacacauuucacuuuuauaucuauugucauaaucacucccaccacauauauguauucagugcucugccauaguuggcagaaaaaucauggggcuuuguguugaguguguugcuggagggauuugcccuuagcauuuuuacuuuuuuucauuuuuuugagauggagucuugcucucuugccccggcuggagugcaguggcgcaaucucggcucacugcaagcucugccucccggguucaagugauucucgugccucagccucccaaguagcugggauuacaggcacuugccaccacgcccgacuaauuuuuuuguauuuuaguagagacgggguuucaccauguuggccaggcuggucucaaacuucaggugauccacccgccuuggccucccaaagugcugauuacgggccaacuuuuuucuuuuucuuuuuuuuuuuuuuuuuuuugagacggaaucucgcucugucacccaggcuggagugcuguggcgcgaucuugacccacugcaaccuccgccuccuggguucaagcgauucuccugccucagccuccugaguagcugggauuacaggugccugcccccaugcccagcuaauuuucuguauuuuuuuuuuuuuuguagagacaggguuucaccaugucggccaggcuggucucgaacuccuggucucaagugauccacccgccucggccucccaaagugcugggauuaccaggcauuagccaccacccucagcuggaaggagagacauuuuuaaucaaguaaauuacaugguagcuugcugggagaagauuuaaagugcuucuguugagaaaguucaugcaggucauuuucuaccacuuugcuuaaagccugcaucuugcuagaagacuugguuggcucugacauucugaggguaacuuacauuuuguuguugucacaggagaagguugcagcugagauguggcagaguuaccugaucuuaacagcgccucuuucacaacgguuaugugaagagcuucgucucauauuagagccuacccaggcagccaagcugaaguaagucuuccccucuggaaggccucacagugcccugagaagacggcagcuucauugauucuguugaacgcggcaccuaaccauuuauagugccagcuucuaggcugccgcuugugccguacaggcaccaguaugcuguuccuuacccuguuuuccuauuauugucucugcacaaaaguuucugggugucuguauugaucaccuuguuacauguugagcuauucacuugcuauagguguuacucaccuagaucuuuucaaagauguccaaaaucauuccuauuuagugcauuuuuuccuaauuuuuaaaaaugugucuggaaggaccuaauuauuauugccacauacguguccaguuuuucuggcuagaggucaagaagauccuuagucgucaauugacagaaacacuucauugugccagguuccuaguuacuugcuauugguuuuaagguauuauugugauuuuuguccuuaauaaaaauucucaggaauuaaaaguuguuaacuaauuuuugcccccauuugaauaaauagaggagacuaucgaacugggaaacgacuaaacauacggaaagucauuccauacauugcuagucaauuucggaaagacaagauuuggcuucgaaggaccaagcccaguaaacgccaguaucagauuuguuuggcuaucgaugacucuucuaguaugguagacaaucauaccaagcagguaaggaagagaaaugcaguggcaguuugauaggaaauuaacaucaagcuauguuccaugggccaccaaaaugcuuuaaauaugauauggcuaaugcuuuaaauaugauauggcuaaaacauuuugaaauaccuguuaggccuguuuugagaaugugauaaccaucuuugauaagaccuaagauuuaaagaguucaaaagggcaauuuuaggaugucucagauguguuaguuucuuacuguuguaggucuuuuacauuguuuuguuucuugaccuugcuguuuguucuuaacugucuaguugcagaauaaguaaaucugauagugcuuguuuugcagaaaaugcaacaguguacucuuaaaaaaaaaaucaaaguuuucagauauuacugcauagucuuagauaguuuagguagguaucuaggauacauuucuuuuauaucugaaauuauccagaguuauuguucuaucagugcuaauauuaaguuuaggagccuuaauagaauuacuuauaccaccauuacagaugccaaagaguguuuguuuugggcagugaugcuguuauacagcaugggcuaauaagcaaccuaaaauuuguauguucugcuggaaaaaguuaguguagccucugaaccuggguucauaucccagcuccauuuauuaacacaugacuuugggcaacuuauuucuuaguuaucaguuucaccuucugaaaagugaggaauauauauauuuacaagcacacauagaauaguaauaaccucauacuugcagaauuguuaugaagauuaaaugaaauaauagauguagaacacucaguuugcugcugcuuuugucauauugcaaaugguaaugaaauuuucugauauaguucuacagucugaucugacuacauauauaugaauggauuuuaaauugguuuuuaaaauuuuuuaccuacaagagguuacucuucauguagguccaaaaaagaagaaagaaaaauucauggaccauauuucucaaggucacuuucuuucuuuuuuuuuuuuuuuuuaaagacagggucuugcucuguugcuuaggcuggagugcaguggcaugaucauagcucacuguggccucaaccuucugggcuuaagcaguacaguccucccacuucagccuccugaguagcugggaccauaggugugugucaccaugcccggcuaaauuguuuuuuuuuuuuuuuuugaagacaggguuacaggguuucacucuguugcccagguggcucacuguagccucaacuuuccugggcucaggugauccuccuaccucagccucccaaguagcugggaccacagauguggggucuugcuguguugccugggcuacucuugaauuccuggacucaagugauccucccuccuuggccucccaaagugcugggauuacaggugugagcuaccacgccuggcccucaaggucacuuuuuauucgaugucuacagcagaccauuccuaucaguguaauggauucuagguuucaacauuugugguaccaggccaccaaagccuuuggguuuguugugacuauaguagccuuacugauguuauuccucuacuugccaaacaaaaaaauguuuucuuugggaaucuugaugcaaaaaauaguugagaggcucugguuuagaggauauucugauuccuaaaaucauuaacuuucuaauucacagcuugcauuugaaucuuuggcugugauuggaaaugcucuaacccuccuggaagugggucagauugcaguguguagguaagguugcuuuguaauuccuuuaugaaaacuuuucacaaccuguuugguuauuuugaucacacagccaaaaaauaacuccuguuguauuugguuuuccucccccaaguuuuggagaaucuguaaagcuguuacacccauuucaugagcaguucagugauuacucugggucccagauucuacgucucugcaaauuccaacaaaagaaaaccaagauugcucagguaagaggaugaaauaaaaugucuucugcacaguuauuuuuaaacugguguagguuggagggagaacauuuuuauuuuugagacaggaccuuguucugucacccaggcuagaguacaauggcgccaucauagcucacuauagcuucgaacucccgggcucaagcaguccuccugccucagccucccuaguagcuaggacuacaggcgcaugcuaccaugucuggcuaauuuuuauuuuuuguagggacagggucucacuuuguugcccaggcuggucuaaaauuccuggguucaagugauccucccuucuuggccucccgaaguguugggauuaccaccaugcugggcugagaaccacccuccaccgcauacaguauuaggacagggauagucccaaaccucagccuguguaccacuggaauagaagcuuccuuagcauccauuauaaaacaaggugugacuucuuuuucucaguuccucaaggaucacuugacuuugcaucauugguuuucuagcucccuacuuuuuuuuccgaguaguuuggaacauucugcaaaaacaaacccaucucccauacccuuaucagcugggccaagaccuauuuuucucccucauuaagcuuagagaagaaaugauaugaaguaaagccagugacuuacuuaagagaacaaaaguucaaaacagcaugggaucauauuucuccuggguccugcucugauucaguuugcuuuuucuaggcugcccuggacauuuuguauuuucuugccuucucuuuugcucaguuguuuucuguucuugaaagaagacagcuguuugguuuauuugagggaguauugauuucuuaugccccagggaagcacuucuuuuccuuugggguaucuuccagaacucuaguggguuauauguuagagaaacgucucaccugugcuugagaaugccuguaucaucuaggcaugguggcucacacuuguaaucccagcacuuugggagguugaggugugaggaccgcuugaggccagguguucaaaaccagccuugucaacauagugagaccucauuucuacaaaagacaaaaauaauuauccaggugugguggcacauaccuguagugcuaguuacuuggcggcaggcugaggcagagcccaggaaucgaggcugcagugagaugagaucgugccacuacacuccagccugggugacacagugagacccucucucaaaaaauaauaauuaaaaaacagaaugucuguauccaaggauccuccuuuuuuaacuacauacggccagaagggacaguuaguugauggucuguaaaccugaggugguuaucugauaaucacuucaaugucagaaauacuaucagucucuuugacaaugagaagagcauucacauaguuuucuaauugucuauuccugguuccgguuuaguuucuagagucuguugccaacauguuugcagcugcucagcagcucucgcagaacaucaguucaggugagcugcaugccuuccucuucauuaacaaaaugcuuucuuguacucuauauucccaagcugcuugcuucagcucaguguccccgucacuguguuuuaauagguaugcuccacaggaaaagacauaaauugauggagcugauuuuuacuuauuuauucauucauucagaaauuuuuguugaaccuguacucaugaggcuuauaaucaaugggggaucuagacacuaacuaguauauacuuacuugaguucagauuuauaagagaaaggagcaagguguguguggaauuaaauauaaaggcuacaauuaacccuugaauaccacagguuugucuguacagaucaggucuacuuacacauggaguuuuuccaaccaaaaguggauugaaaauucagcauuugagggaugcaaaacccgaguauauggagggccaacuuuucauguaugcggguucuccagggccaucucuggacuugaauauguguguauucugguauacugggggugaggggguguguguccugaaaccagcccccugcaaguacuguauucucuaauauuuuaauaacagaggaaaguagagaaggacauaauauaaaaaccagcuaauccaaccacauuuacuuugggggcuugaaacaugccaauuauuuaguucuuuuccaaaaaucucucacuguucucaguguaucaugcagaagcuucagauuuugauggaagcaaguuauucacaccugucaacauuugcuaaaacagcccacccucaacucauguacuauauaaucuuuagcuggaaacacuauguagcaaaaauuuuaaaacauuuuauucaguguugaguguuuccuuucuauuuguuuuuguuuaaacaagucaaauuucaagggcaaaaaaauauagaaauuagguacaaggaauuaacagaaaucuaaagaugauuauauguaacgacugaaauuuggaagacacaguuccagauuucugauuuggccacuuucuucuaaugcccuucucaguacuaucauuuuuaaaguuuauagccauaaacuaguguuuuaauucucauguacaguauguugcucuacaauuugaaguugagcagaacuuaacauuucuugaagcacuauugagaaauucuucuauacugacagaagcuuacuuaguaucccuuauuaugccuugucucugacucaagcauucuaagggauagaucucaucagaggucccuuagguuugugcccagaauucaucagcuuuagaggucuguuuagcuuuaauaguacagagaaagccuacacuaauuuguccuacuuuggguaguugugaguuauuaaaaauggcuguucauuuuauucccuugcuucgucuuauauggucuacagaaacugcacaacuccuccugguagucucugaugggcgaggccuuuuccuugagggcaaagaaagaguccuggcagcaguucaggcugcccggaaugcaaauaucuuugucaucuuuguuguauuggacaaucccaguucacgggugagugacuacuaaaagccaccuuuucuggagguaaaguggggauucccuucaaccuguucaaucugaaauauggccuggaucacucagucauacugagaacucccagcauucauaguauucugucaaguaccauuguaggcacuuguaaguauuuucucuauuaaucuuugcaauaagccagugagguagggaucauuauucccacuuuacacugaaggaacugaaacacauagagguuauagguaaugagugggagagccaagauucagaaugaccauccucugugggucaucauuucccucuaugcaaagucagugcagguauugcagccuugauaauggguacugaccacuuugaaauggagauuagguguugccacacuuaacuuaugucucaguagcuccucacagcaagaagcaucaaucaucuuagugaaauaugccuauagggcaguucuguuccagggaagcauugucucugugggucacauuaaggccuugauaggaagguaaagauuuagugugaaugauuccaaguggaugauggggagacaccacuguagggaaagcagauuuuccugucuaucccuuuuccuuuuuuucaguguccauccuccuggaaggggcacucagaaagacaucuaccuccuucuuaguagaguucugaaaauucucuuuuacuuaguaauaaaagguagguucauaugcaggaauaagacacaggagauguaaaaguuagcaaaagagaucacagaagagcuagcuaaggaugcugguuuaaucgcugccuccccauuucaaaaugucuuuuguugacaggauucuaucuuggacauuaaaguaccgauauuuaaaggaccuggagagaugccugaaauccgauccuacauggaagaguucccauucccauacuauaucauucuucgagauguaaacgcacuuccugagacacucagcgaugcccucagacagugguuugaguuggugacagccucugaccacccauagaacagaaagaagaguccaaagugagacuuaacuguggucagaaggucacauugcuuacccaggugcucccuuuuggacaacuacaaaaaauuuuauuguaauauuuuuauuuuacaacgugaucuuacagccuacagaaugcucucuggcucccggcuuugccugggcugagguuuuuauaccaaaccuggaagcagcagcaggugccugaacucguaacuagagaagaguuauccuucuucccugccuuggaagcccuggccugggaggaggucauaccccaccguuggagcccagcugccuguuuucuuuugcaggggaucugggcaccugugccuugaggagaugcugccaggagcaugggacucugacaguccuuuguauaaaggacuaaagggagcugcccuuuugacccuguucuaagcucugccuugccaagcccauagugugugcccaaaagcugucaaguggccaagacagcucguuucuggag

SEQ ID NO: 191354 - RNA, 6532 nt, Homo sapiens
gcuccugcgcgcugaggcuccggcggaccucugguggacauggcugcuucccgcuuacccccagcgacgcuaacguuaaagcagguaccggcgguucucugccuuccaaagcagcuuaccugggucugagcuggauucuccaucugucccuauccccaacggggcggguuccgggguccugaugcggcgugcgcgcccucugagauuggcccgaugccugcggggcggugcuucgcuccgcggggccugacgggaggcacuggcugcuuccuugguuuggugcgaucgcgugagacagcgucaggcgcuugauuucccugagucccggugccucagcugcccagugcccacgguaaaagucuauugcacugagcuguggcaaacagcaaaugagauuaccaaagauuugaacaacuguuaauuuagaaaaagugcugucguuguaauaacaacuucuaggagaccggcagcccuuuucagcccgguaggcagcuccugauuuuuuaaugguucuuagguuugacagagcaguaagcaaaaagaucagaugaaccucgugaugcuuucuuuaaaacaucuuuuugagacagggccucacucucgcccaggcugagugcaguagcgcaaugaaggcuuaccucagcuuagaccuccugggcucaagugauccucccaucuuggccucccaaagugcugggauuacaggccugagccacugcaucuggccaaaaaaagaaaaaaaaaaguuuuucuuugccuuuuucaaaauugaccaacgagaaguacucugguuacagcuugguuugcugaaguagaacuuuccaggcuggcgauugugcaguaguaauugcuauuuacuccucccuuuuacaguucguaagaaggcaacaaguucuucuccucuacagaaggauuuugcaaacaauucggcaaguuccaaaugauucugaucgcaaauaccugaaagauugggcaagagaagaauucagaagaaacaaaagugccaccgaagaggugagaacaaaaucauggugaggacagauccuaacccuuuuuauugaucagugaauuuuuuuuuuuaaguuuagcagacaucuuggaauauagugccacugagcugguauaucuugaucauugcuuguaauguuaccgauuuuaaauuauuauuuuaaaauuuaguauuuuaaaauauguagauaaaagaguaucuacacucuucagcaucaucacuugacuuuuauguuguacauuuuauauguauguauguggaacucuuuuagcuuuucuaaaaggcagcaguuccaauagguaguauugguucuugauuuuaacagauaaaaugguauagcuauaccuuguuuaaccagguaaaacuauaaccagauuucacuuuauucuacaggauacaauccggaugaugauuacucaaggcaauaugcagcucaaggaguuagaaaaaacacuugcuuuagcaaaaucuuaacuauagcauuauucugaaggauuuucaaagucuccauguguuuuguugcauuuaggauuaacaauggacaacacaaagcccagucuuacuauuuauauguacaguauuuggugauagagagcaaaggaaaaacacaucagaacaguugccuuaacacugaaaaacauacccugcauuuugaaaauguuuauggaugucucagcaguucuuaaaagaagaaaaaaaccacuaacaaauggccaguagaugcuggacacaaucauuagggaaguguaaaucaaaacuacuaugaggucggguguaguggcucaugcuuguaaucccaguacuuuaggaggcugugguagguggaucacuugaggucaggaguucaagaccagccuggccagcauggugaaaccucaucucuacuaaaaauacaaaaauuagcuuggugugguggugcauugccuguagucccagcuacuugggaggcugaggcaggagaaucacuugaacccaggaaguggagguugcagugagcugaggucgugccacugcacuucagccugggugacagagugagacagucucuaaaaaaaaaaaaaaaaaacaacccugagauucacauucacuagaauggcuguaauuaaaaagagaaauaauaauaagucuuggugaagauguacagaaauuacagaacccucauacauugcuggugggaauguaaaaugguguagccacuucagaaaacagacggucaguuccucaaaagaugaaacagcugcuguaugaguuagcacuucuaccccaugcccauagccauuauuuggcacuaaaaagaaacgaaggacuuauauauacuaaacauggauaaaccuugaaaacguuaagugaaagaagccggucacaaaagaucacaugaugauuccauucauacgaaauguccagaauaggcagaaagauuagugguugccuaggcuggcuguagauggaauggaguaacugcuaauggguguaggguuccuuuucagggugaugaaaauauccuacaguuagcuugugguguaggcugcacaacucuugaauauauucaaauccacugaacuguacauuuuaaauguaagguaugaauuguaucucaauaaagcuguuauuaaaaaacucuugagguguaggacugaaaguauacugacaccaggagauacccuggaacuuucucgaaaaauccugcauuaucccugaggguuguucagguacguucuucagaugugucauaguuugauagagaacucaucaaaaagaucaccacugggaaucuagaucuuuguugaaaagggaagagaaagagaagcuuaaugagcacauugaagcacuuaccagaaagaagagggaagacuucuggaugaaaccucugugaguaccuuaacauucacauggaaguaguaaaaauaagauucugggugcaguucuccaaugacaggaaaaaaaacaaagagaauuugaagaauacgucagagacaaauacauuacaaccaaaauugacuucaaggcacuuuugaaggagaucaaauuuauaacaaaauaauuuagugaaagugaaagcuuguggaagauguuggaaucauccauccugaaaauugaagucuucuguuuaucaacagaacagcuaagaagcuaaucuaagaaugaccagcaccugaaagauguagacaacauuuugcagaaugauaaaugguauccaguacuggacugugucugagaggcaucaacugaauguggauguuaaugaccuggacugucaggguccaccucuaccucccagagccucagagcccacaagacaaaauaauucugaauacuguuccauggggguaaucuacuaauucaaaaugccugccugugccaauuuucagguuuuuauguagauaaguauuaguuaaccuguugcaaaaugaucugacaaacagaagcauuugugacguuucugaacagagaacacuuuggaaauauuuuuugugugacaugauugauagauacaugcuaucucuaguaaaucuaaaaucuugaaacucaaaaucauccuuuuauggguguagaagucagugauuuaaugaugcucuuccuaacaguggugugcauggaaagguuuucauuaaagagcguaugugguuugcauuugcaagauucaacuagcacagacuccaagaaaaccuaaguuuuuuuguuuuuuaaagcagguaaggccgggcacuguggcuuacacaaguaauccacacacuuugggaggcugagguggguggaucacuuuaggucaggauuucgagacuagcuaggccacuagcuagccuaaccugguggcacgugccuguaauuccagcuacucaggagggcugccucauauugaacccgggaggcagaggcugcagugagccgagaacacacuacugcacuacagccugggcgaaagagugagacucuugucucaaaaaaaauaaaaaagugccaucaaguuagaaguuuuaaauucaugguacaagcauugccauagaugugccugcaagaaacacacagaugacuuuuuuuugagacagggucucuguugcacaagcuggagugugguggcgcgaacauggcucacugcaaccuugagcuccugggcucaagagauccaccugcuucagauuuucauuuagcugggaccacaggcaugugccaccaugaccggcuaauuuuuuuuacuuuucagagagaggagggggaaucucacuuuguugccaggcuagucucaaacuccugggcucaagcaauccaccugccucgguggccagagugcuaggauuacaggugugaguuguuuuuuuuuuuaaagagacagucuuaccucauucugucacccagaauggaaugacuuucuaaaauugcagaaagcagaacauauuccuugcuguuuauaauauuauagucguaucaaagggaaagaguauuucuccuuaaauaaaauuacaaauaagaaauguauguuuuacucuuacucauaaaagguauuguagaauacaaaagguuuuucaaacugguuuugucuuugauuggcuuuuauaauccacacuucaaagaagaaaugcauuuaacuuuuaauaacuuagucaaaaaguauaauguugccuugccuugcauaaccuuuaacuauugcaaaugauguuuuguccuuccccuuuguccaguauuuuccaaauggucaacaguuuaaacauuuaagcuugcacugagaaaccuugccacauuucagcaguuuuguuuugcuuuugguggagagcaccugaucgcgacuuuacagccaauguauuuacucuaaauuacacuuuuauagauacaagguaaaguguagcugggugaaggcacucaggagccauaaaauguggucaaccacaauaaauuaaaauguaagcuaaacaaaguauucacacuugcauuuuuuuaauaaggaauuuaagauccauaguaucuuuaaugcuuggaagagacacaaauucaaggugauaaaaauauuaauuagaagacacauaacaugccucaaguauaucaacacuugacuccacaaacaaggcauaaccaugaaaacaacacucccuuuauuuugggcucccaaaaucaaaaguuagaacuaauuuauuuaaucacagauauuuaguauacucaauaaugcacuaacaauuucuuuaaaaaaacacuaauacuguacaguauuucuguguuuuaguuuuucccacagcuguugaaaauuucagccuugauuugaaacaugaccugcaugacaggcuauaaguugucaauaguucuuuuucuuuggaaaaguacaguuguggcauuuacucacuuuagcagauagcuaaaagggaaaaauaaggaaaaauauacacuggaccugcaguuaaguuuuugacaaugccaaggaucaaaaacagaugaaacaacauuugcugaagaugaaaagguauugcauuggucuuaauagauguugccaucucugggugaggaugcugacugagccuguucugugucuucaucaccucuauuuguuucuucuucuacgacagaccuccaagagacaagauccauguaguaagccacacuagguccuuuugacccuucucauucuucuguagucucuucccugugacuuuugacaaaaauacucaguucacaauauuagcugccugcuucugauggguaggagguaaucaaaauacucccaccaaagcacucuauggucuagacuugauacuuaaaauuuaguuuucagcauuccucaacaaggauaccuugagguaauaggagauauuuugguaagugaaaauaauuccugcuuggaacacagccuacugaacucaggauuuaauuucuugaguauuaggcaguucucaauaaauugauguauacugaggaaugauucuaaagagguuagugauauccuguuugagaauagauuuagaaaacugaagguacucuccagcucuacaauucuguauuaggaacaauagggaaaugagaaagugccucuauauugcaaucuaaugagucucugggggaagacugucuaccugcguaguaguugagaacaagacaagcucccaaacacaugaaaaucaacuugaaauaacaucaaauucagccugggcaauaucaugagaccuuauaucuacaaaaaauuagccaggacugguggcacacgccuguagucccaagcuacuugcgagguugaggcaggaggaucacgagccugagaggccaaggcugcagugaggugugaucaugccacugcacuccagucugggugacagagcaagacccugucucaacaaaauaaaaaacaucaaauucauuccauauucagguaacagugacauauaucuacugaauuauuuuucuuuuaggaaugucuauaucuauggauugucacuauaaaaaaaagaaaaaacccuaaaacugagcuugacaaagggaauaaaagcauacuuuguuuuucuugguguccccauguuaauaaaucauuucuucucuuuggcucaa

SEQ ID NO: 191355 - RNA, 47661 nt, Homo sapiens
uuaaaaauaaaagcauaaauuaaauuuaaguagugagauuuaucaucauuuccauaaaaugagagcugguuaaucaggacaaauaaauuuuaccaaauggauguaacagggccaaugaaacagugacauacauguaugguaagcaaccucagaaacaggaaaggcuguacuuccuuuucaccaaagagacaauucugcucccagaaagcuuagcuaugaauacacuugaaaugagagcuuuaccaaagcaugaaccuaggacacaugcuuuuaaauuggcaguuaacauucuugaaagcaauggcuuaacaaugguuauuaagugauguacugcuuaaaguaaaacauggacuauaccugauuacaaauuacauccagucuguacaaguugaauacauaccauacuuuaauaaccaagacaauucagcuguuuuuccagaguauauuucaaacagaguuggcauauaacccguauguaacaauauugcugugauuuuagucauauuuaaggguccaaaauauguucacaaaagaacaguuugugaaugucaaccaguuuuugcuuuauauuccuucaaaaacauuccacccuggucauucacacuaaucuacaucacugaaaauaaccaaaauaauucacagucucaccucuauguaaaaauucuaauugacucaacagggaaaggacugcccugcuccuuuugaggaaggaaaccugcaaggcaaguucucaaucccuaaaaccaagcaaaaauguuccagugcaguugcuguagccauguauuuaggauuuguauuuauagaauuaaauuugagaaugaaacauggccauacacaucgcaauaagcugccucucauaucaaaaauacaaugcaaaaugacuugaagacauuuccaauaacacagauuugaaaaacugaacgcuuagacauaacuccugcaucuuucuuuaauuaagaagucauugccacacuuacaaaguuagaggcaguaaucuauauuagcgugugauuaaucaaagaguacacuuacuaccaugaacuugggcccuaugucauagaauuauuuuugccuuucccccaaagaaucauuugcucuugaaguaauaggcuuuuuaaggcacauuuuaacaaaaacccaucauauacccagcuuaaacauggaagcuccaaccugguuauaguaauaaauauaccuaaguaaugugugauuuaccaaauaggcuagugucucuagcuugaggauaaagucauauuagaaaacugauucuucauuugcuuauucaaagugaaacaacauguaaaaaauauuagagaauuagauuuauaacaauaaccccuaagugucaggucuguuggcaaagguccaacaggauauagcucuggaaaucagggagcccugggcuccuaaccauccagguuucggaguaggaaucaugaggaaaggaguuagggcaccuuaauuauuuuuagaaaucuccuuucaaaaugcacagaaccuugggaggcucaaaccuuaaacaccaaccagauaucaucuuaaauucaguuaccagcuucaaagaaacaggacuuggggagaggaaggagagagguuggaaagaagccacagagagaagugggaaaguuuaggcugggcacaguagcucaggccuguaaucucagcauuugaggaggccaaggcaggaggauugcuuggggccaggaguuugagaccaucuugggcaacacagugagauccugucucuacaaaaacaaaauuuaagaauuagccgggcgugguugugcacaccuguaguucuagcuacuagggaggcugagguggaaggaucccuugagcccaagagguaacagugagcuaugauuguaccaauguauuccagcacaagcaacagaaugaggccccccucuaaaaaaaaaaaaaaaaaaaguuucaaguauaaguugcuuuagggacuuuauauauuuugcuaggaccaacuuugauguucuuaggaggcucugcuuuaaaaaaaaaaaaaucucauuuucuaaugccccacaagcaugccuuagggugcuaacccuugagaugcacguaaaauuaucuacuuggaaugauuuggcauagggguagauuuaggacucuuaauuuccuguuagucuaaaguaaacauaagugaaauaauuucacagaaacaauuacacagcuaauuguaaugucucuccagccauccuuuucccacugaccuuuaggggucuucaggaugacucuucagccuugcagagcaugcugguggcaggcugagcuuggcuuaaucauaaggugggaacaaguggaguacaugaggcauguuaucaccagugagaaggagauguggaggugacaaaagugacuaacaggauugagcuccauggugggguucugcgauuuguucuauucacuauggucauggagcaauaaagaacugguccugaauaagcauuuuaaaugcagcacaccagaccaucgcacagggccaaaaguccagaauuguaucuauguuuuuuagucugcaguugccaaucacauacuuuuggaacaacuuuaggccucugauguuacuuuagcccugggugguagguacagaaaagccuccagaaacccuacaauucagugacauucuuacuucucuccaguguucggcaccauuuuggaaaucuggucccaaaguuucaaaagaauacuaaugcaacaaaaagaaauaaccucucuguauaaagugauuauagagauguguguugagguaaacagcuucauaaaaaccguugagcagggaagcacagccacugcuauagaaauuuuuagguaagucuggugcuagcauuauucuacaaaacuguuuacacccauuauaaauaggggacaguucuuauugcuccuggagcuuguagcuccaaucuguuccagcuccacugaaaaaugauuuuucucaacaauugguagcaaagauuuccaaauuuacaaaaagucauuaccaaugcaucacuuuuugauuaauuucugauugccauauagauauggacuacaguaugcauguccuugacaccaaguacagaaaaaaagcuuagaaaagucguuuuaucaaaguucaguucaaugagaaacaugaaaaagugcaaaauauguacaauuccuggcaguucucacacgggauuuuuuugacuacagaccauaaaaguuuacauuuguguaaugaaaugacaauggauuucacaucacuguuaauauacaaguuuuugcuucaaagugcuuacuuuauuuauaaaagagaagaucaagaggguugcaggaauuuuuuuuuuuuaacaacaaaucaaugguaugugucccaaucuccuucuuccucuuccuuuagugcaacauggcgcagcagccucauggauaaggucugauuucaaaagacauuccugaaaccucaccuacagcagcacucuaggggucccauuagggguggcucucuuuuucuucugcagccgauucugaaccuuucgagauuuuacuacuuucauucucaccucaaaaacuucaugaauggccuuccggaagcaaugaaaauuauagucaauuagcccuggagaagagaacaaaaauauuuauaaaugucacguagaaauaaucuccaucuuuucaugggacccauggccaggacaagccaguagggggcaguagaggauggucuuagcguaaggaccagagauuucccugggaugucugcagcuggccuucagaaauugcuauaaaucuuuaggaauuauaggcaaagucuugugaaggaagauuuuuccugaugcaagguugcagagcauagaccauauuuucaaagguuccuaugacccaaaagauuuaaagaacgacugaacugaacuuuuuuuuuaaccuuucagaauuaaagauuucuuacaauuaagagaaaucuguaaugaaaaauguuucuccccaaagggcauuauuagacugaguagaggcagauccugacuugggaucccaaagcuguguaucaaucaauaaauauuuacugaguaucuauuauauuuaaaccauucucauaagcccgagggaaagcgaagccccuaauuuuagaguguuaacagucaucucgccaacuccagcagaaauucaacaaccaaugacacucagcuuuucaguauuaaguauuuuaaguggagaaauaguaggagggaaucuucuuguguuuucagaaauguaucagugacacaaaaaauagaauaaaagauaauccaaagucuugaugagugcauuuuucaucauuacuaguaauuuguaaaaguccugagagcaacauuauguuuacaccaauuaggauaagguggucaguucuauuuacuaucuuugaauuuauuaaaauaacuagcccaacaauuauuucuaucuaucaguggaugcuucuagagccgcguccaaaggaagaauuaggauuccggccaaggauuaaauucuucaaacuaguuauacaacuaacugcaaggggagggcggggagggcaccgucucgguuuccaggagcaggaaaaccucugaguagugcccucugcugcuucugcagagagagugaaccacuagugcaguaaaaccaggagucaauuuccucaaggaaagaccaaugucacaagcaaggggaaaaguaauaaaaacaaaggagcaaaggaacgauuuuuaaauggcaauuugaauaugagaugugagagccucaagauucucugcuuuuaugugcaacaaacugucuuaaaaagcuuagcuaaaagaacuuggcucaaugagaaggguacaaugaaauacucaacuugggaaauuucagacauauccuguucuuauuucugaggcagggucucacucugucacccaggugggagugcaaggcucaaucacagcucauugcagucucaaccuccugggcucaagcaauccucccaccucauuuuugaauuuuuccuagagaugaggucucacuauguugcccaggauggucuugaaccucuaggcucaagcaauccuuccacuuuggccucccaaagugcugggaucauaggcaugaaccacuggcacccgccccuauuguucuugacaaaccuuaacuuacauaucuuugcacauuucaaaauguaacaguaaucuugcuguguuuggaauuuuaaguaaaaguucacaacugaggcuuuuuaaagacaguaaauauccauaaacaguguuugcuauuucaacccucaugaaaaguuuuugaaaauacaugaacagagacauaaacaaaauaaacacucucuucaccccaccuacaguucauaaggccccacauccuucucugguucaggaguucucaacccuagcugcacaauaaaaacacccaggcaccaggcacaccaggaggccaggcacagcacagcacuucgggaggcugagcagggaggaucacuugaggccagcaaccuuuagcccugacugccauaaagugguggugugauguugagagaaagucauuuauauuuucuaggccugaguaaaaucaucugugacaugagagggugaaacaagguguauuccugucuaucuuuaaaauuccgugaucuauuauauaaucuguucuuguuucuagcaagaugaaaauaaggaguaaaagaugaacaccauuuaauuuacaguucugaggccaaaggacacaaaaggcaauuuggucagucaugguacacacaggaaaaauacaggacaucacuaagcagcaagaaaauguaaauucacauaauauaccaguuuucaguuaacaacuuuuaaaaauacuaauacccaauauugauaagaacacagcaaaauaaguauucauauucucuucgcagcauaaaaccagaaaaucuuucugaagaacauuuugguaauaugcauuagaagcccccaaaaugggccuacccuuuugaucuaaguaauuccacuuuaaauuuuuccuuaggaaacaaccaaagaugcacauaaauauuuagugcaaaagaggucauaaugauauuauuuauaacauuaaaaucuagaaacaacauagaugucugaaaauagaagaaucuaauacaaucauuaaaaugaugugguuaaaaaaagacggugaauuggaaacaugucuguaauaauuuaagugaagguuauaaaguagaauucaucauacaaucuaucauaguccuuuuagaaaaugcauaugcaagaaaggacuggaaaaguauacaggaaauguuaagaguaguuaucugaaugagaaacaucgauaauuauuguuuuuuugcuaaauauuauuucuaaauuuucuaaaagaaucuauuacuuuucugauaaaaauaaacaauguaaauuaaguuuucauggccaaugaauuaggaaaauuucaugauauacguaagugaaauauauguaauauaaaauauaaauauuuucauauuuguauuaaauauaaaacuauauuagaauauaaaacuauauuagacaauauggccccaguuuuguuggaaggaaggaaaaaaaggaaugaaggaagggagaaaaggagcgaggguaggagggagaggaaauaagagagaagggccagacgugguggcucacuccuuuaaucccagcacuuugggaugucgaggugggaggaucacuugagccgaggaguuugagaccagccuaggaaacauggugagaccccaaucucuaccaaaaacaaaaaaaaauuccagguuguugacaugugucugugguccuagcuacaugggaggaugaggugggaggaucacuugggcccggguggucaaagcugcagaaagccaugacugugccacugcacuccagccuaaguaacagagcgagauccugucucaaaaaagagagagaaagggagaaagaaaaucccagaaauuuaacauggguuuagcucuagauggugaaauaccugguuuuauucuacauacuuuccuaaauuuucaaagcauuuuuaauuuaaugggcuuauauugcuuauaauauagaagaaaaaggcuauuucaggauauguuacuauaacauauucaggauauguaacuauuuguuggagauuuucuuuuacccaacaaauuaguaaaccauacccuauuacuaacaaaagucccuagccauaucaguaagcuagggacuucuguuaguaacuuuuguuuagauauuauagaagggggaaauuaguuuaauugcuuuuguuucaaaauaaaacugaauuugauccuaaaaaaaauuugguggaguuaaauauauucauggucuucccuuuccggaaucaugaugccaucccuguguucugaagauuuaagaaguauuuugaggcugaacagaagucaaaccaccuguuguccccuccuuuacaugggaagaacaaaagaucacacgguuaccuaagaccuucuagagguguggagcaaaguggagaccuccacccucaguauaggcugggagucugcucccugguaagagacuucauucacagccuggcaacagugccccaacuagcuucccccuagcagagaugccaaggccccugggaggaucaugggguuccacuuccaccucgcugcaaucgcagaugcaccacuagagggcaggccaguucacuggcccagaagcugacacugggggcaggagcccgccccgcucugaacuccaagccaagagggccugugacuggcaucuggaaguuucgagggcuaugcuguuguccacccacauucaacaaacaauacaugcaguagcagucugaugcuucuuuuaaugcuucuuuuaaaucacaccaaaaaguuaccuuuucuuucaaagcuuuccucucugacaaagcaaacgagagccaggaacuuugucaccucuuuuaaauaaagcacgguuguauuauuaagcuuuaugauggcuguggauuccuugucauaggggguuccugcuccaucuucuuugagacuaaauggggacagaaaccaaaacaugugaccauugagaaagaacuagaaacuguaagccagugacaagagaccggcuuuaagccacaaaaagugauaaucauaaguuguuuacacuugcagugccuuucagcaaaagagcucagaaacacacaggcacaaaaacauacacaguccucaacagucauuuccuacugacaaugaguggcugucugcagcagcugggacacucuccaggcaccugaagaagccaguugaaggaugagguuagcucuccccaccuccguggccaagggcuucuuguuuucucaccuagaauagccaggcugucaaaagcguggucugaugaaagacuaagaaaggcugaagauauguuccaaauucaaggagucuaaagagaccugaaagccaagugcuagacuggauccugaauugggaaaaacugcuauaaaagauagaauugggaccacugguaaaaucugaauaucgucuauauauuagauaauaauguagccaugcuaaauuugcugaacugugaacugguucaauuuacucucaaaugguucacugaaaagaaauagauacacaauauguauuagaaaaagagagaugcagcaaauauggcaaauugguaaaaacugaugaaucccagugaagaguuauacaggaguucauuuuacuacccuuguauauuuucuguagguuuuaacuuuuuuucaaaauaaagaguuaaauaagauauauaggucuauuuggccaggcgcaguggcucacgccuguaauccuagcacuugggagacagguagaucacgaggucaugaguucaagaccagccuggccaauaugggugaaaccccaucucuacuaaaaauacaaaaauuagacaggcaccacgugguggcgcacaccuguagucccagcuacucgggaggcugaggcagaagaaucccuugaacccaggaggcagacguugccgugagccgagauugugccacuguacucuagccugggugacagagcaggacuccgucucaaaaaaaaaaaaaaaaaaagauauauaggucuauuuaagaaaagguguggugugcagacacaagugacuuggguuugaaucucauuucuuuuauuugcuagcuaugugagcuuggacaagucgaauaacuucuuugagccucaauuuccucauauguacacuaacaguaauuauuucaaaguuuucuaaugaagauuaaaugaaauaaugcauauguagcacuaagcauaaugcugagaacauaaaauacacacuuauuaucauggcuuuaaugacugaaacuggacccucugaagauaccuguguaauaaaaguguuaugaauccuuuccucacaggcaaaggacacuucccuaaaccuuuucccccuuaccuaaaacuguacauaaauuuucugauuuauuuuuacuccccaaauuuaugaauaacugaccagaaauuugacuuaauuggaauuguguuaaaccuuaccacauucacugagaacuagcauuuauuaaagcuuacuaugugauauuaaccauucuuaguucuuaaaaugcauuauccucugucugcuauaagaauccucuaaguuucuaaggaaacugaggcuaggggaaaauaagauaacuuggucaaagcugacgauagggguaaagucaggaccucaaaccuagauauggcuaauuucaaaguuaaugcuuuaauccuguaaauacacaaggggguacaguaucaagccagauuuaaugaaaagccugaauugcacaagaguauuuuuaggaaauguagguuuuuaguuuugagaguauuuuaagcugccauauacauggccacuuaaaaguaaauugugagggugggcacgguggcucaggccuauaaucccagcacuuugggaggccgagguggaucgccugagguugggaguucgagaacagccugaccaacauggagaaacuccgucucuacuaaaaauacaaaauuagcuaggcgugguagugcaugccuguaaucccagcuacucgggaggcugagggaggagaaucacuugaacccgggaggcggggguugcagugagccgagaucaugccauugcacuccagccugggcaacaagagcgaaacuccaucucaaaaaaaaaaaaaguaaauuguggaaguucguauuuuuuguuuuuuuuaaaggauucaacucacuauaaccuaccaaaacauuaaagaaaaaccuuuuaagugcuggacaucaaauguuaaagaugcuuuaacagaauucauuaacuuccauugcacuguuuuaacuacuauauuuuaaggcucaaucucucuugcuuauaaguaauguucugagaacaagaaacugaaacauuuaacauguuuuacccaaugaagaaaauagcauuuaaaauuuccaaguaaauauaauacuauauagauauuaaacacuguuuauuaacagcauuuaauaauacaggaaaauuaucaggugguaauguuaaaugaaaaaagcaggaugaaaaauuucacauacaaaugugaucucauuauccuaaaaauuacacauggaaauaagaacaaacuauauaaaauguaaacacugacugucucuagguggugagauuaugggcuacuuuaauuuuauucuuuagacuuuuauguauuuucugcaauaagcauguauuacuuucacaaucagaaaaagguaaacauuaaacaaauuagaaaaacagacuccaccaaaaauuacaaguagaaauugaugagguuugcaacugcaaaaacuguuuuacuacucaaguuuuucaucuauaagcaaugaaaacacaugaagauagaacauauuuuaaagugugugcaugugugugugcauauaugugcgugugcaugugugugcaugagugagcacagagcugccagcuggggcacagccucagcugagagauuccugaggcaccaggucaccugauucuagggccugcuggucuccacugggcagguggggaggggcagcaaggccuccaguuacaagggcaccugcuuccucauugccuaagagggccccaggcucugcacacaacccugccuccugcugguuaacaggacuggcuuguugcugcuccagcaaacaaucugaggaaaccccagagcccacaaaccaucugugacccagacugguucuuacugaauccuguggguucucagaacacuguacuccaccacagaaaaaccaaucugacggcaaagccaggccaccuccuccuaaccccucccuccccauguuuguuuuagcuggguaaaaguaacucugauuaacaucauuuacaugaacaacuuaccacuuacagcuaaugaccauauggcacaauaaugaucaugcacauuguuaagcaugugccagauuaauuguguuguucauuguacuugauuaccauggcaaucugcacuguaaucagggugcguucaucuuccaugacuauuucaaggucauccauuuaaacgguuuaaaaauaauagaaugcuucagggcaguaaucuugggcaauaagguuuauuucuaaagccagaugucagcguuuaauuauaacaguaauaauaaauuauggcagcuacauuuauccagagucuaccagguaaaggcacguuaugagccuaaugauauuucauccucaauacaaucuuguaaguaucacuuuccauguguguguggugugugugugugugugugugugugugugugugugugucuaacaguuaacagagagaauccgagcugagugggcaaaggauuuuuaagcaauggaagagaaaaauggagacuagacucucacaaaagcugaaaggcagagcgucaagcuguguaaggcaggucacaggcagugaguaaagaggaagaugagcaaaagcuuuaccucaucgauuagaugaggaugucagauacaauacagauagcaacaccuuaacaucuuaauaagaugaacaacuaguucacaccuagucagucuguacaccaccuguucagcacauuuauaauuauguagaauuguuucuacaucggguaacauaaucaguuucccccacuccuuguuuauuuuauauuaaguguauaggaagcucuguuuucuaagaacgguauguuaacagauuuuuuucagcagaggaucaggaaucagaucugaguugaaacuccaguuccaauccuuacugauagugugagcaagaguaagaaauguaaccacucugaaccucaguuuuuucaucuguaaagugaauacacuacaguugaccuuaaacaacacagauuugaacugccuagguccacuuauacauggauuuucuuccgcuucugccacuccuaagacagcaaaaucaaccccuucucuuccuccuccucagccuacucaaugugaagacaaugaggguaaagaccuuuaugaugacccacuuccauuuaauaaauaguaaauauauucuuucuuauaauuucuucucuguagcucacuuuauuguuaagaauacagugcguaauacauaacauacaaaauguguguuaaucaaucauucauguuauugguaaggcuuccagucaacaguagacuauuaguauuaauaguuaaguuugucaggggggaaauauauguggcuuuuugacuguucaaaggguugguaccccaaccccuguguuguucaagggucaaauguaauuccugccacaucgaauaguugagaauuaaaugauaaccugggcacaguggcucaugccuauaaucccagcuacucgagaggcugaggugagaggaucauuugagcccaggagugaucuauccuggacaacacagggacacccuauugcuaaaaaauugaaauaaauaauaggaagcaugcaaugagauuagcauaaugcguggcauuugcucaauaacuguuauuauugcaugcuaacugguauauuuauuuauagauuucagucauuuaagacaaaaauguuaaaguuaaguaaguaaauguaaaugcaaaaugccugaaagguuaugaaggaaggauggcuugauuguggccuuuaagaauguuguacuuacccauaaauacaagagaugucaauaaccacaucuaucauaucacagcagagcucauagguuugcauauccaccggaguacuaucaguugcaauauaaauuuuacugaccacaucaaauagaaaugccuuuucaauuccagaauucugaaauuuaaaaaaaaaaguugccuuaaagcaacagucaacuucagaccaugucaugacuacacaaaauugaaugccauucuuaauguaaaauacaaaaugagcaaaacucgcuacuaaaaauuuaaauuguaucauuuuauuacaauuuaaacuucacugucauaaacuucucuauacuggacuugcauaagaaauaaaaaguagaggccgggcaugguggcucacgccuguaaucccagcacuuugggaggccaaggcgggcagaucaccugaggccaggaguucgaaaccagccugaccaaccgggagaaaccugucucuacuaaaaauacaaaauuagccaggcgugguggugcaugccuguaaucccagcuacucgggaggcugaggaaggagaacugcuugaacccaggaggcggagguagcggugagccgagauggcgccauugcacuccagccugggcaacaagagcaaaacuccgucucaaaaaaaaaaaaagaauucgaaugaccacaaauuauuuauuuuagguaaccaaauugagcaauauuuccuaacucguagagauacauaccugcaauuaggaaaaggccaaguaaaaauacuuuuacugacuguaaauuuuaaaauaagcuuagaaacacuaaacaaacacacucaaaauuguguagugacagaguaaacgugaguauaaccaauaggucugccucaauucaacucagcagcgccuaccuggagcuggugauguguaggguucauucagcacaucacucauagcauguuaaacuuauaaaaagcuauucaacaguuugcgucuuaucaauaaagccaaguuuuauguucccuaccucugguggggcucuauuaauauugaaugauugccuacaggcuugaauaaacccuccaauuauaccagugaagugcaggaaugcaucugaguaguuauauuuuauuuuuagagacaaguucucgcucugaugcccaggcuggagugcaguggcacaaucauggcucacuuuagccucaaacuccugggcucaaguaaguacuccuuccaccacagccucccaaguagcugggacuacaggcaugugcuaccacaccuggcuaguuuuuacauuuuuuuuguauagacaggaucucacuauguuaccuaaacuggucccaaccuccuggccucaagccaucguaacgccucaaccucccaaaguggggcgugagccaucaagcugggcugggaguuaaauuuuaaaggaucuaaaagaacacguaggaguaaucuuuaaaaguaauacuuaaaugaccuugaaaugcuauagaagcaaucggaaauaagaucuuuuucacucuugcaauguuauuuucaaauucuacaagugacucaaacaggaauauuauuuacuuacugagauaaagauguucagcaaauucuccagaguugggaguuguggaaucaguuucugaacaacuuugcuaaaagcuucaaauauugaaugaucauauaugcuugucagauaaaagcugaaagaggaaacgguauuucaucauguuuucccuuugaaugaggaacaggcugcuuaggcuaugucaaaacaccgguaaucugccuucuguauguauaguccuaacacauacaguccagcccccuucagaauuuacagugaccucgguaaaaaacaagccauuccuccccaccucccaaaaagcccgagcugugccuauucucaucugcugugccuauucucaucugccaacuggcaagcuuacaaccgcagcaaucuguguccaucccagcuuccugacauucugcaagacaauccaugccagaucaucuuuacacaagccucuuagguuguccaauuaguaacuuauauucuugauauugaagcaacuauuuuuuuuccauuucccaauuuacaaaaugaugcauguacuaccucacaaaaaaugauggaaacauuguuuuccuuugugaggauuccuauuuggauuguuuucagacuacuccuuuacuuauaauuacagauaauaucuuuaucaagaacuguaaacuuuagcaucaacuaacuacuaaaauuauauucauagguuuucuauaauguguuucucaugugaggggagaaccuuagcuuugaccauuuguuaaaaaacaaaaaaacaucgcuuucacuaaagauuagcauuagcacaugcaaagcucauuuuccccuaauccuauccaucuacagcaugaaacaggguaaaaagaagguaaauuacugcccaugccaagccaaucauggugacuccgaaccccaaacuugcuuucuuccauccuuuauugggauccuuaagggguuucuguucucaccugaggugaauuuuuucuaauccagcaucugcaaggucaucguuugcccucuggugaauaucucuuuggguuucaauuuuguggucaucugacagaccauccacuuuaugaauaaacaccucgaaguugaugucaguauucacuuuguaggcccuggucaccgugagguggagccuggccagggcuuccauguaaucauccuaggaccaaaggcaacgccugugagagaaggccgcuuugcuuccugagccucccacacacacucuucaccuggaaaccauguggcugcaaccccccgaaauacguugcaaagguuccccucaacaagcuggcuucuuauaauuccagugugaaaauuuaaguucuguuaacaaagagaggaagaagaaaggcuaaaaaaaugcagcugauuuaggcaguuaugacugagguugaugacagucauaaagaucagaguuggcugggcgugguggcucaagccuguaaucccagaacuuugggaggcccaggcagguggaucaugaggucaggagauugagaccauccuggcuaacacggugaaaccccuucucuacuaaaaauacaaaaaauuagccaggcgugguggcaugcgccuguagucccagcuacucgggaggcugaggcaggagaauugcuugaacccaggaggcagagauugcagugagcugagaucacaccacuguacuccagccuggaugacagaguaagacucggucacaaaaagaaaaaaaaaaaaaaagaucagaguugcgguuucaggaagagaaacggacccuacuccacauaagaccuuccccagaauacuguuccuccuaacuuuuccagucucuugugaacugugaugaacaauuagagauggaggcaugauacaggccacugggcggguggggaaggagcugaggagcaauuuuaagaaccacugguucagugcagaagucagcagaccaccgucugcaggcccugugccuguuucuuaaaaguaaguuguauuggaacaugcucauuugcuuucauauugucuaaggcugcuuuugugcuacaauggcagaguugaguaaguuuccucuagagaaacuccucagagacaguacagucuacaaagcuuaagauguuugccaucugccccuuuacagaaaaaguccccuggucuagaggaauugccccaaacaauacuaacuuuuuucuucuucccaugccuauauaaugaacaccuguguauuuaucucuauuuaggaaauaaaacaccuacacaaaagcccucuguguuucuccucauccucccaacccaugcuaucccucuacccccucauccucuagagacaaccacuaucccaaguuuaguauuuauucucacucauguauacauuaauacagacauauauauccccaaacaucacauauaauucauuuacauuguuuaaaaauggaaagaaauauuaaguuguguguauauuauaguuugccuuuuucauucaacacuaugucagugagauucaccuaugcugaauguuaucuguaguacauaacuacagugcauuaguuccuuuuaauggcucuauaaaacuuccuuuuauggaugaucuauaauuuauauuugccugcugauggacauuauucccauguauaugugauuacaaugauauauguacagucucauguacauguggcuuacucugaagggugacuugucaggucauagguaggagugccuugacuguaccuggaagucuguaaacagcaucugaugcuucagacccucaccaacaauugguggugucagaucucuuauugccaauuugaagggugugaacaggucuuguuuuuauggcaaaaaaaaaaaaaggaaagagaccuguaggacagaaucuaaaugccuucccccucugccccgccacuugugccuccaaaccuggaaaaaacagaaagccaauauaauuggggguguuuucuggcauucuucuaugcuccaaacaucaguaaaaauguaucccuagucucuaggcaaaucaaauauuaauuauacaaauaggaaacuaugaagagggaaaaaccgcaaauggaguccuucccauccuucacacucuacagaguuguuuagaauaaaggacaaaagccaggagcaguggcuugugccuguaaucccaccuacuggagaggacugcuugaguucaagaccggccugaacaacacagugagaccccuaucucuagaaauauauauauauauauauauauguaauuaaccagacuugguggugcacaccuguagucccagcuacucggaggcugaggcaggagaauuccuugaacucaggaauuugagguuacaaugagcuaugaucuugccacugcacuccaaccuagguaacagagugagagccugccuguaaaaauuaaauaaaaugaggccgggcgcgguggcucacgccuguaaucccagcccuuugggaggccaaggcgggcagaucacgaggucaggaguucgagaccagccugaccaacauggugaaaccccgucucuacuaaaaaaauacaaaaauuagcugggcaggguggcgcaugccuguaaucccagcuacucaggaggcugaggcaggagaauugcuuaaaccugggaggcggagguugcagugagccaagaucgugccacugcacuccagccugggcaacagagcaagacuccaucucaaaaaaaauaaaaaaaaaaauuaaauuaaaugaaaggcaaaugucggauucugggucagcagauuaagcauuaaaaacuaaagguauuacuguaugguuccacauagaugaaauucuagaaaaggcaaacuaaagugacagcacugcagugguugccuggggcugaguguuucaggggaucaccugagaaagggcacaagggaaccuuuggggugguggaaauauucuauaucuugaaggaggggugguuacaugguguacacauuggucaaaccuguugaacuguacacuuaaaaugaaugcauuuuauugcauguaaauuacaccucaagaaaaguguuauugcugucuuuaacugaggaggggaguuaagggaacaugucugugagcaaaacuacccaaugucaagagagcaucacaucuccaaagauuggaaauugcuacucuaaccucccugccaagcauauaaaauggucugauuaccaacuaacugaaaaagcagcaugcagcuacaaggacuaaaaaaaagaaaauacuugguugguuagaacagagggauugcaggugauuuuucccaucguuuauuacuuucuuugacaaauaaaaauuaagguaaaauacacugcauaguuucuacucugaaauuagaucuggggauuaugggcaggucacaagcaccagcacaggucaagaagaaacucucuuuuggauccauagcacaugugcaauggcuucaggagauauggugcauucuguaggcuggggagcggggcuggggugucaccacagaucaugggaaccacucuugcuuucauucuuuuuuauuuuaugacauucugugaggacacauuuacuccugggggauauauuuauccggcaauccugugacuguaaggaauucaugaacaaaaaauaaaaauaugaggagugagaacaaaauaguauugcuuagaaauaaaggaaaggggccaggcguaguggcucaugacuguaaucucagcacuuugggaggccgaggcggguggaucacgaggucaagagaucgagaccauccuggccaacauugugaaauccugucucuacuaaaaauauaaaacuuagcugggugugguggcuacucaggaggcugagggaggagaaucacuugaacccaguuggcggggauugcagugagccaagaucgcaccacugcacuccagccuggugacagagugagacuccaucuaaaaaaaaaaaaaaagaaagaaaggaaaggacacucaagugcuguggagacacuucccuaaaguuuugauuuuccugucagugcuucuaaucacaucccauaaagguuccugcaaacaugauuuuuacauucugcuuccaacagaaaaguauauuagguuuugaaacugcuuauuuaauuauuccuuauuuuaaauaaauuacagcauucaacaaugcuuuuccuacuguuuauuuuuaugugugguuuuuuucucuuuucgagauaaggucuugcucugucacccagguuagagugcaauggcacaaucauagcuuacugcagccucaaacuccugggccuaagugguccuccagccuuggccucccaaaguguuuggauuauagacaugagccacugugcccagccuucucuuuuuaaaaaguauaacuuuaggccaggcgugguggcucacgccuguaaucccagcacuuugggaggcugagauggauggaucaugaggucaagagaucgagaccauccuggcuaacauggugaaaccccaucucuacuaaaaaucaaaaaauuagccgggugugguggcgggcgccugcagucccagcuacucgggaggcugaggcaggaaaauggcgugaacccaggagguggacuugcagugagccaagauggcgccacuggacuccagcuuaggcgacagagcaagacuccgucucaaaaaaaaaaaaaaaaaaaguauaccuuuaaaaaaugaacuucucaaacauuccuauaucuuucucugccccacaaaaaacacccaagagaagagccaaggauaguagcaugcaucuguagucccagcuaccugggagguugaaacaguaggaucacuugagcccaggacuuugaggcuguagcggguuauaaucacacuugugaauagccacugcacuccagccugggcaacauagugagaccucgucugaggaagaaaaaaaacuucaagaaacaaaauuaaaauaaaaaacacauuuaccaaccuaaauugaaggucugccuucaauuuaaaaauaggcagauguaccuauuuucgccacauuauaaccauauuagaaacaccuaaaaauagauuacacuguaaauuugaauucccauaaaugcaaauugcuauguaagcacaacgugguauuuaaguaaguacuuacuaauccauugucuugaaaugaugagucaucugguuggaaaucuacucacccauggguaggacuacuacagcuacccaguucaacaacuacagaaacagcugcugcgugacuuagggagaaaaauggagcuuagaagagagagaugagcaugacaucccuggagccuccccuucccuacagcagugugcacacaccccauccacuccccuugagcacuaagcucccuaauuuauggugcuggcagaccugagacaguaaagcaggggauacugccaagaccacagaugggccagaaaacaggucaguacaagugggacagucaggaaagcagcugcugacagcaggcccuggacguggugcagguaacacguguuucuggguaggcccaugggaagagaguaaacugcugaucacagaucaggcauuggauuugaagucucccuccuccacaccccuaccaaaaaggaaaggaagaacccuucuaaccauuggccaugcucccacagccauacacguacacaaaugcagccacuuggaacugagaggcuuaguugaaaauuuuguuauuauuauuaaacaggcaccuagauccugaaugaacuuacgauccucucaggcauggggagucuacucagaggaugguucucgagcaugggcucagaaugauauuaucgggaauagucuuuguaacacuucagcccuaacagcucuggugcuccuagaagggccaggugugcuuagcggggcgaugcacacccgcagcuggccaaccugucucacuguggguccacaguuccagggaaagggcacaaccugaaccucagaguugguucagcgcaugcugagaagggcugaugccauuuauuuccccccagcugcaaaagggagcccuuggggagccuucaggcugggccauaugucaugggcauuuucuaagagccccagacauggauaguuuggaaagcaccaaugccccuauccugcugcacauccccuuccuaaaauguaucugccugacacacuugugguccuacugucucccuuugccuccccuuuacaccaacuacagcagaaaagccucaggauguaaaaaacccagggugccaaggagccaauguggaaugcuagaaaagaaccugauacagggaaugacucgcgacugggaauggggcucuucaaagcauaggaaacagguucccaauucuuugcguccaacaaagugaaaggagaaccuacucuggaagccuguuguuaaacuacuaaaaauaauuuuucaugauagaaaacuugguaauuuaggggauauaacuuggaaggaaucugaauagcaguaugaaugcuagaauaaaacucaccucauauccaccuacuuacuuaugugaauaaaguuucucagugcuuauaacuauauaaacagaaaacaaaaauggaacugaugccaaauauugucuuauucaagcauggauauaugaaguggaaaaaauaucaaauauccaucuucuaaagagggauauuuaucucaaauuuuacuuuuuauauguaauaaucaucuauaaaauacauaauuauauuaucuuaagcaauaauuauaauaauuuauuucagaagaaaaauuuucacaccuagaacuuuaucuucauaggaaauaauaaacaguuuaaaauguaaauuuauacacauguuuuuguugcagagaaccugugaucuuuuguagauguugacuagcgguaccauaguggggaugacauauuuggccuaaaugggccccuccaucagugagguuuccuaggucuaugauuugcugaagugucaauuguucccuaaugcucaauggguugauuguuggucacggcuggagccuuuuaacuuuggcaaagucugagagcccugaccaagaaacacuuguuugguagaaaggccuauuccagaguuuaaaaaccaaaccaaaaacauggggugggguggaggggaccggccaggccaucauaccccugagacucugagcuuuaccugugagucaaugacaaauaucagugcuccuguuccccggaagaucaucucauagucaaauguagggucaaaaaagucaaucuguccugggaagucccaaaucugaaaauugacaaaggagcuguuggaaacaucuucccggcauaucuuauuagugcucuccaagaacagaguuucguugggagacauuuugugaaagacaacuuucugaauagacgacuugccgcuucuccucaggcccaugagcaggauucucggcuucacuucagugcugaaggggucacugaaguccagaacuggagaaaccacaaaaugagaaugaaggugagaugcuuucacagagguuaauuagaggaguuucacuuccaccucaaaugugauuuaugauucacagaugaugccacucuuccaaagagugcuaacuacagucccuccacuuaaaccccaagucuugcugacuucacaaccuuaacacuuaaccgcuggucuauacuucccaccaggcaaaggggacagcuuuugcuaagugcaaaacacucaacaauagagucucgccacuucuuacaccaucccggaggccagacaccaauauaaugccacaucacaagcagggacucaggagcgugaagagagauuuauuuccuggagcagacuguggaaagaauccaggucugagcauucaggagccauauuguucucugagaagccaucacuaaagagaugcuuguugacgugaguuaugccucucuuagucacccuccucuggcuaguacucucccaagccacgaaggccuggaaaaugggccuuggacuagaugucgcagguuuggauuguguuacacagcagaugcaaaguuugugaaaggcagacaucucucaggcccacccuggcucagggcccccauccaguaagguagcuacuagccaaauacagcuauuuaaauuaaaaucgauuaaaauuagaaauucaaauccuccuccuaugauguuucuagagaagccaaauucauagacacagaauguuuucagggguugggggaaaagacgaauggggaguucuauguuuaauggguauguaguuucagcugggggaauaugagaacauucuggagauggaugguggugaggggcgcauaacagucacauuguuauguggcccucaccgccaaaaauggcuaaaacuguaaauguuaugauguuauauauauuuuaucacaauaaaaauuuggggguuccucaguuucaucguggcaaguacucaauagccacauccagcaaguggcuaacguauuggacagcacagacacagaacagcaguccccaaccuuuuuggcaccugggaccaguuuuguggaaaacaauuuuuccagggaccagugggaugguggggugguuucaggaugauucaagcugguuacauuuauuaggcaguuuauuucuauuauuauugcauuguccuauauaaugaaauaauucucaagucaccauaauguagaaucaaugggagcccugagcuuguuuuccugcaacuagacagucccaugugggguugaugggagacaaugacagaucaucaggcacuggauucucauaaggagcgugcaaccuaaaucccucacaugugcaguucacaacaggguuugcacuccuaugagaaucuaaugccacugcugaucugacaggaggcagagcucaggcaguaaugcgagcaauggggaguggcuguaaauacagacgaaacuucgcuugcucccccacugcucaccuucugccaugcagcgcaguuccuaacaggccacagacugguacaggucuguggcccgggguuuggggaucccugacauagaacauucuuauccucacagaaaguucuagaggccagcacuacaccaguuccugguaacaaaaauucaaucuuaaaauccuuugcuaaggguccuagagggauuaggcauuacuggauaaaaguaggaguuggugggccgggcgcauggcucacaccuguaaucccagcacuuugggaggccgagacgggcggaucacgaggucagcagaucaagaccacccuggcuaacacggugaaacuccaucucuacuaaaaauacaaaaaaauuagccaggcgugguggcgggcaccuguagucccagcuacucaggaggcugaggcaggagaauggcaugaaccugggaggcggagcuugcagugggccgagaucaugccacugcacuccagccugagcaacagugugagacuccgucucaaaaaaaaaaaaaaaaaaaaagaaguugguguaacagcucaaaacccuguagggcucucucuuuccuucguucuugaaacauauaguauuaauuccacaauguucuuuaguccuagaaaaccgcuuaauugguaagcagccuuccuaauugaccaagagcguguauauuucacaggaguaaaggaaguauagaccgugguucaguguuaaggcugugaagucagcaagacuugggguuuaaacuaucagaccuugaaaaagauacuuagcuuuugagacucaauuucaaaaucuacaaaauggacuugauaaugaaaauaaacaucucauagggcuguuacaauaaaugagaucaaggaccuaaaacaauuauuaaaacuaagacauucagcaaauggugcugggccaacuggauauccacaugcaaaagaaugaaguuagacccuuaugucauaccauauacaaaaauuaacucaaauggaucaaacaucuaaguugaagagcuaaaacuauaaaacucuuaaaucaaaauguuuuauuuaagaaggcaacauagguguaaaucuuggcaaccuugcauuaggcaaugguuucuuagcuaucacagcaaaagcacaagcaacagaaaaaaaaacagauaaacuggacuucaucaaaaauuuuaaaaguaaaaagacaacauacagaaugggagaaaacauuugcaaaucauacaugugauaagagucuaguaucccgaauauauaaagaaugcuuauaauucaacaauaaaugacaacccaauaaaaaaugagcaaaggaugcgaauagacauuucuccaaagagacacuaaaggccaauacacauaugaaaaggugcuccaugucauuagccaucagagaaguacaaguaaaaaccacauugagaucccacuucacaccuacuaggauggcuauaaucaaaaugacagauaauaacauguguuagugaagauguagagaaacuggaaccuucauaugccacuggugggaauacaaaauguugcacuuugaaaaacaguuuggcaguuccucaaacauaggcugggcaugguggcucacaccuguaaucucagcacuuugagaggucaaggcaggcagaucacuugaggucaggaguuugagaccagccuggccaacauggugaaaccccaucucuacuaaaaauacaaaaauuagccagacaugguggcaggcaccuguaaucccagcuacuugggaggcugaggcaagagaaucacuugaaccugggaggcagcaguugcagugaacugagauggcgccccugcacuccagccugggcaacagagugacacucugucuuaaaaaaagauuaaacauacagucaccauaugaccuaguaauuccacuccuccaaauauaccaaaaaaaauugaaaucauauauccaggcaaaaacuucuacacgaauguucacagcagcauuauucacaauagcccaaaaguagaaacugcccaacacccaucaacucaugaauggaugaaaagaaugcgguacaauggaauacaggcuaggaaugguggcucaugucuauaaucccaguacuuugggaggcugaggcaggaggguugcuugaggccaggaguucaagaucagccugggcaacauaguaagaccccaucucuacaaaaacuuuaaaaauuagcugaguauggcagcaugcaucuguaauuccagcuacucaggagaccaagguggaaggaucccuugagcccaguggcucgaggcugcagugagccacaaucaugccacugcacuacaguuugggugacagagugagacccugucucaaaaaaaaaaaaaauacaauggaauauuauucagccauaaaaaaggaauaaaguaccaauucaugcuacaauauggaugaacacugaaaauaauaaugcuaagugaaagaacagacacaaaauguuaucuauuguaugauucuauuuacaugaaauguucagaauggacagauccauagagacaaaaaguaguuagugguugccaguggcuagagagaagggaaaauagagagcgacuguuaacugguauguaguuucuuuggagugauaaaaauguucuggaauuugccaggcaugguggcucacaccuguaaucauagcacuuugggaggccaaggcagguggacugcuugagcucaggaguuugagaccagccugggcaacaugucaaaaccccaucucuacaaaaaaaaaugcuaaaaauuagccaggugugguggcacgcaccuguagucccagcuacucuaagagcugaggcagaaggaucccuugagcccaggagguugaggcugcagugagcugaggucauaccacugcacucuagccugggugacaaagugagacccuaucucaaaaaaaaaaaaaaaaaaaaucccuggaauuaaacaguggugauaauugcacaccuuugugaauauacuaaaauccauugagcucuguacuuuaaaagagcaaauacuaugguauauaaaguauaucucaauuuuuuuaaaagguuucaugaguaaauacacaaaaauaaaaaacccaguaugaaacucaaagaaggaucaagaaaaggaaccaacgucuuaagaaaagaaaaggagcugggcacaguggcucaugccuauaaugccagcacuuuggaaggcugaggugggaggaucaccugaggccaggaguuugagaccagucugggcagcauagagagaccuuugucucuacaaaaaaaaauucuuuuuaauuggcugggcaugguggcaugcagcugucaucccagccauuugggaggcuaaagugggaggaucccuuaagcccaggaguucaaggcugccgugagcuuugauugcacuacugcacuccagccuggacaacagugcaaaacccugucucgaaaaaaaaaaaaaagaauauaaaauauagagauguauauacauuaaauuauuuuccuaaauuucuuauuuccuucuuaacuauaccucaucaugucuuuuucucuggucuaaccuaauccaauacagacugaaaaguaacguuuuauuucccuauuguaaccaacaauuuucccccaaaacucuacaauugucuaaaacacuuguuaauacuugauaauaucuuaguaaauuucauuuacuauauauaauacuuugauguuugaauuugcaauagguguaggcaaacauacauauuucagauaagacaaugacugaauaaagaaaaauuaagcagguacagaugugcauagauauuacuccacuauaagcaacuccucagccccaccuuauccacccauacuuuuccaguucaacugaauccaguucaacacauugcugaugacauacaguauaggcaguaauguggaagcaaauggcccaaaaucuaaccagcuuucuucuucaucagugauuacaugcuacccagucacaguacugccauuacaagucaaucuuagcaagagcagggcaugaacugaaaaugaaacaggacuucaaguuuaaaaauaucagacagauaacauguucaucuucccuucccaugcuaacucccuaaaaauaauagaaauguugugcauaauaaacaaauaggugcacaaugaaacauggauaguuaaguuugaaacaaaaaggagaacucaaaauugacaaccaggaaauccuuaagaaacacaaagaugagauugaagagggaaucugcaguccuugacuaugaauggcagaguucugcuguagaguguagaacugguggaaucccacaacaggaaggaauaugaagacaagcaacagagucauuauuuggagaauaacagugaaaacagccaagcagauaaacucugugcaccauggcccacucacccaaacuuacccuacacacacuaggauaucuucuaggugaaagcaguaaauggaggagguugggcaugagaaggaaggcagugcccccagugcuagugaugcccagaaggacaaggaagcauccccacuacugcccucaaaguccucucaccucuccuaacucucacuacaauguguggagaagagcacuaucagagguggauacaguaccaucuucccuccaacauuuccuugaacaucaaauauucgaguaaugccaagauuauggaagacaacauagacucaacaaauguaagaauguacaccugaagaagcagaguuaauaacagaaucacagcaaacugucaagcuaaauauacuucagagacucagagauguaagaaaauauggcauucaugaaacaagaacagacaguuucagaggaagagcaguuaugaaaaagggguauauagaucuuggcaauaaaaauguaugaauguauggauuaaaaagcagaauaaacacagaugaagauggaaauaguggacuggcuagucaaagucucucaagaugcaguacaaaagaauagagcacuggaaaguaugaaaucaaaguuaaaguggcaucaggaauaagauucagaagaaccauuauuuuacuaaagaaguuccaaaaggagagaaugcagaauauggggaggaagcaacauuuaacuaaauaauagagaagccuuuccuaaauuaacaaaagauaaaacucaaaaugaacagacucacaaaauaaaauggagaaacuuaaaaacaagcccacaccuaaaaaaaaaaaucauaguguaacuucaaaauaucaaggauaucuauaggaacaaaaagagaagugaaaaaaaauuuuuuaaaucaaggauaacaauaaaauccuuagagggggaaacaauuaccuaugaaagaacuagaaaggcaucagaugcuuaucaacaacacagauaugagaagacaacagaacagaucuuaaaaagacaaaaggaaaaaaaaucugugaacucauuaauauaccaaucauauuauuuuucaaaucugagagugaaauaaagauauuuucagauauucaaggacuuaggaaguuuauuucccacuuaaucccuuugaaauaauuacucaaggauguaacuccugaaagaaaaauacacccaaaaugaguacaauguaaucagcaauggaaaacaaugaaugguaaaagagagguaagucaaagaaugcuacgguugcugcuagaaaagcauaguuaaguauuuuuuuuaauuuaaggauaaccauuucaaauauaaaugaaaauauaaauauguacaaaaaugcauuuuaaaacgguccagaaggauacacagcaaauggcaaaguguagguagaaggagaauuuaggaggaucaugaaaaggaauuugguuuuaauuuuaaaaaugaaauauauucacauacauauauaauuaaaauuggcuuugaaaaggaaagaaaaacaauuuuuaaugucuagggagucaugagggacacugaaaugggaagguggccaggccugguggugcacaccuguaaucucagcacuuugggagguugaggugggaggaucacuugagcccaagaguuugagaccagccuggucaacauaaagagaccucaucucuacaaaaaaaauuuaaaaauuagccggaccuggugguaagcaccuguagucacagcuacuuggaaggcugaggugggaggaucccuugagcucaagagauugaggcugcagugagccaugauugugccacugcacuccagccugggcaacagaguuaagaaccugucucaaaaagaaagaaacaacaauuuguuggacaugccuguggucccagcuacuugggaggcugaggcagaaggacugcuugagcccagggguuugagaacagccuggguaauagcaagaccccaacucuaaaacaaagaaagaagggaaaagaaauaacaacuuaaaucgauagaacuauaaucugucaaugaaaauaaguaaauaagauaaaacaaaauuuacaaaguaaaaagagacaacugacaugcuguuuuauguuuaauuccaaagaugcacaaguucacugaaaaccuuugauauucccuuucacuuuauuugccaaacacaaauguuucaaaauauuaaauacuccuuaaauugugauuucaacuccacauuuucucuuucaguugugcucuuaggguuucuguuuuaugcauacaauaaauauguggguuaaugggcccaaaguaguugcuugguaaauguugguuagacaaaaaauauguaaaacaugguucccaucucagagaaacuuagaaauccaguccaaacugugaguguugguguaaagacagacaaauagacaaacagaucacuggaacagacagggaaauaaacccacacuuacauagacaaaugauuuuucaccaagagguaaagccaccuccaagaagaaaggacagucauuuucaccaaaugacugauggaccaacuggacauccauaugccaaaaaaaaaaaaaauucaacucacaucaacucaaaauuggucuuggucuaacuguaagaucuaaaacuaugaaacuucuaggguaaaauauuuaugacuuugcguuaggcaaaaauuucuuagauaugacacccucccccaaaaauugguaaacuggauuuuauuaaaauaaaacuucaauacccaugaaaacuaaaauaacaauaauaaaauuuagaaagaaaagcacaacaaauacaaaaaugaagaauuuguugggacuuaaaagacagcagcaacucucaaaaaaaauaauaaaguaaaagaaaaacaucaaaugacauuguuaaguaauaaagacaagacacagacuagaagaaaguaucugcaaauaauguaucugggaagggacuuguaugcagaauauaugaagaacucucaaaacuuauuaauaagaaaugacucaauuuuauuuuauuuauuuauuuauuuauuuacugagagucuugcucuguugcccaggcuggagugcaguggcgcaaucagagcucacugcaaccuccaccucucaggcucaagugauccuccuggacucagccuccagaggagcugggacuacaggcgcgccccaucaugcugagcuaauuuuuuguagagaugggguuucgccauguugcccaggcuggucuugaacuccugggcucaagcaauccacccaccucagccucccaaagugcugggauuacaggcaugagcugcugcacccaaccaaugacccaauuuuuuuuuuuuuuuuuuuuuuuuuuuuugagacagagucuugcucugucacacaggcuggaguguucaguggcaugaucuuggcucacugcaaccuccaccuccuggguucaagugauucuccugccucagccuccugaguggaugggauuacaggugugcaccaccauguucggcuaauuuuguauuuuuaguagagaugggguuucaccaugucggccaggcuggucucgaacuccugacuucaagugauccacccaccucggccucccgaauugcugggauuacaggcaugagccaccacacccggcugacccaauuuuaaaagugaaacaagcaaaagauuugaagagacaacuugcccaagaagauuuauggaagguaaaaaagcacaggaaaagauacucaauacaucauuaaucauuauaaaauguaaaucaaaacuauaaugagauacuauuacauacccacuaagacagcuaaaauuaggaagaaucagaguaacaaguguuggcaaggauguggagguacuagaacucucauacacugcugguagaaauguaaaaugauacuauuuuggaaaacaguuuggugguuucuuaagaaguugaacauacacaccugucauacuaucccuuccauuccacugcugaguuuuuaccuaagagaaaugaaaguuuuuguccauauaauaacguguacauaaaggaucauaacaacuuuauuuguaauagucaaaaacuguaaacaccuguaguccagcuacucgggaggcugaggcaggagaauggcgugaacccgggaggcggagcuugcagugagccgagaucgcgccacugcacuccagccugggcaacagagcgagacuccgucucaaaaaaaaaacaaaaaaaaacaaaaaaaaccuguaaacaacccaaaaguccacuagcaguugacuagauacacaaauugugaugcaucucagcaauaaaaaaauaaacuauugauacacauaaccuggaugaaucucuaauuaugccuaaugaaagaagccauuacuccuuuuucauaaaauuuuuuuaaaaaauguaaacuaaucuaaucuacaguggcaaauagcguaucagugguuaccuaagaaaugaaagaggcagggcugggcacaguggcucauaccuguaaucccagcacugugggaggccaagguggguggaucaccugaggucaggaguucaagacuagccuggccaacauggcgaaacccugucucuacuaaauauacaaaaauuagcuuggcaugguggugggcaccuguaauugcagcuacuugggaggcugaggcaagagaaucacuugaacccaggagguggaaguuagugagccaagauugcgucacugcgcuccagccugagugacaagagcaaaacuccaucucaaaaaaaaaaagaaaaaaagaaauggaagaggcaguaggcaguaaggaaaggucagagggaggaagaaguaugggaaaacguuuggaagugauggauauguucuuuaucuugacugugcugaugguuucacaggugcauauauaugugaaaacguaucaaauauguguuaugucaauuaauuguuguaauugacaguuacagcugucauaaaaaaauguaaccuuaaagauaagaacggaaacccuaacaguuauaguugcucugcuaucacaucccaaacagcaaguguuuaaacaaugcaaaguggagggaaaugcuugugggccaggggagagacccaguggaucacacagauuaugaaugcagauuuaaaguacugcagaauuuggaugggguugagagaaggagcaggcaggagcuccuccagaagagggaaguccaaauguaagcaaaggcacaaugccuuacauggaacaggaaaauaugcaugcaaugagaacucauggcuaucauguaugaaggugccuacaaugugccaggcacuacuuuaggcacucuacaugcuucaucccauucaugcuccuucaagaauagauauuauuauccccauuucacaggugaagaaauucugguuuugguggagugcucaccuacagccuucaccaccuagagccuucacuaccaaucagagccuuuaccaccaaucagcugucugucacauuaaauacuauacucuaauuugcauaucucaugauuuaaaguuuacaggcuuagaaaggucaaguaacauucaaacggagggcuggcccacucauggucuaugcauucuauuucugcugugcaacacugcccccaauuaaugcaagcaaaacuccucguuaaauuauguacaagugcaaaaauauucauguguuuauaaaugccuuucuucccaauuuauacugcuagauaugggcguagauuuuaauguuucuccagcagggucuguaagucucuaugugguaugaucauccacgcugaugaccuguagaaguugaaucuccuccuccugggaggguggcgaggugacagacaccacugugaaggggggagggaguauguaugcauguuuacauacacagaaaugcugggaacuaaauacacauacagcugcaacaacacauacagcugaaguauuuccuuuucccugccugccaaauucaaucaugggccaccaaccauuaaacagcugagaaaggguggccuggaucagcaagaacaccaucaacuuugcagggacucccuaguuccgaauagaugcauuuuauuacauucagcuaggguguauggaaauacgcugugcaggcuggguacaauggcucaugccuauaaucccagcacuuugagaggccaaggagggcaaauugcuugagcccaggaguucaagaucagccugggcaacauggcaaaacccucucucuacuaaaaauauauauuuuuuuuaauuagcaaguuguaguggcucgugccuauagucccagcuacucaggaggcugagauaggaggaucaccugagcccagaaguuaaggcugcagugagcugugauuaugccacugcacuuuguaccaccaugcccagcuauuuuuuuuuuuuuuuuuguagagacgaggucucccuauguugcccaggcuggucugaaacuccuacgcucaagugauccucccacuucagccucccaaagugcugggauuacaggcaugacccaccauucccggucugggugggacauuucuacaaacuucaccggcccagugagggagcauaagucuguucuaccccugaggaaucucggggaaguaaacugcccaaggucauaugacugguauugguggagugcucacccagaaccuucaccaccaaucagcucuguuuguaacauuuaauacuaaacuguagucuaauuugcuuaucucaugaauuaaaauuuacaggggaccuucuccuugagguguucuacaaaauggcuucauuccaguugcucuucaaauccuuaagucagaacacauuagucuucauaaaaucaacuuguggggauuaaacagcaacagcauuaaauaacaauaaagagauuuaaaaacaaaaaacuagaaaauaucggagcacaugguacagcacaagaguaaaauuacggcuuggugaaauuucccuggguuuauuugcauguauguggguacucgcucagaguauaaauguuuuuuacugugggccaggguaaaaaauguaguaggccauggcuuuacaucaggaaagguuucuuauauaucggaaauggacugcugacaaaaaucuucccucuaaucuccucucacccucuccucaaguaccuccacuuaagaaccucauagagccuggguagcuuagcccagguaaagcguuaaucugaggauccaggguucaaggacaggcacuaaaaaaaaaaaaaaguccccuagaguacagcucugaguuccccaaagggucucacucuacaauaggcaugguagaggcagugagcuuaugccaggaagggaggcacuucagccucucagccuccugcagaaggcugggcuuucuccaccaacaccucccuaggcauuacccucugccucaggcuucuagguaggcaaaagagaaugaaggaugacagccccccuaaaaggagcaaucgggggacaagucuucaaaaauccgcuacaggagggcuccccuucaaccuacccagaaaguugcuguagugagaugaaauguucaagcaggcaguuuguucuaauuucaggaagguucccugaacacuggccaagugugaggcagggcugcagacacaaagaaaaacgauucaucccccagcaaucagaggggaauacagacaugacaaacuggcaauuaccaugcacggccagcuagguguucuaggcacugagagaggcucccuggaggaguaauaucugagucuuaaaggagaggaggcauggaacagaugaaugagggaaagguuguuccaggaagagauuugcaaguucaggaaacuggagguuagggaaugcaguuugaaggcaagaugaggcaacacucuguccaggggcuuccccacaauauauuuuuuuuuuuuugagacagagucuugcucuauugcccaggcuagagugcuguggcgcaaucuuagcucacugcaaccucuuccucccagguucgagcgauucuccuaccucagucuccugaguagcuaggauuacgggcgccugacaccacacucagcuaauuuuuauauuuuuaguagacaggguuucgccauguugaccaggcuggucuugaacuccugaccuugggugauccaucugccucagccucccaaagugcugggauaacaugcgugaaccaccucgcccggccccccacagcauuuagaauaaaauccaaaugccuucuuuucccccucacccaugccuguuucaucuucuccacuuguucccucuccuccagcaacacuggccuuccagaagguuccucagcucaggaucucacuuugcucuucccuccaucuagaagaccuccuucuucagcucagcccagcugcaaugucacccccacugcuaaaucaggcacuaucacuuccugggccauaacccugggccuuuuuaauaguccuuauuacuauuaauaguccaucuuuaguaugucugucuuccuguuuguuuacuuguuuuuuguuugucucucucacauaugcacaggcaaaauacaagguagcacauggcaugaguucaauacauaucuuugaagaaauuaguugauggagaggugacaggcuagcucaggagggugauacugggaaguuuggauuuuacccugaaagcacugaggaaauccuaaggauuuuuuuuuuuuuuuuuuuuuuggugggggauggaguccagcugugucacccaggcuagaguguaguggugcaaucucagcucacugcaaccuccgccucccagguucaaucaguucuccugccucagccucccgaguagcugggauuacaggcacgcaccagcacaccugguuaauuuuuguauuuuuaguagagacgaggcuucaccauguuggccaggcuggucuugaacuccugaccucaugauccgccagccucggccucccaaagugcugggauuacaggcaugagccacugagcccggccuggaaaucacuaaggauuuuaaggggagauuaauaugauuuacauuucauuaaguucacuccagaaacagacucccuugcgggucccaguauggaauuaggagguuguucuagaacacaaaugacaaagaacuaaggcacaggcuguggaaacaggacuugugagugcaaaucugugucacauuaggcaugagggacaagggagacagaagcccuggguuccugaccuggcagcccagccaccaagaagguuaggggcuuccuaacccuagcuaggcagcuagccaccaagcagcugaacaaauauuugaacuuguugagucugaggggcuugcuggucugcagcucacauugggaaaggacucagggccucagaagggagguaaaaaugugacaggcuugaagcagggaaugaaggcugcugagcuagcccaugccugaugguccuuuucccccugaccucguugggugaaagugagggcauguuugaggaguuuuagccuuggccacagcgaaacagcucaaaccaacccacuccaaccucucaucaaccugugguugccauuuacugaccaccuacauagcacacagugucaucucucaaggugguaacacucauccuuuacaaaugucaaugacaccucccaugcagauacucaucaauggccaugauguuucagucaagcaggcugaguaagcucuagggaucugauauacaacaguguaccuacaauagcauauuauaugcuuaaaaacauauuaagacagaucucauguuagguguuuuuaccacaaugacauuuuuaaaaacugucggccgggcgcgguggcucacgccuguaaucucagcacuuugggaggcugaggcggguggaucacgaggucaggagaucaaucgagaccauccuggcuaacacggugaaaccccgugucuacuaaaaauacaaaaaauuagcugggcaugguggcgggcgccuguagucccagcuacucaggaggcugaagcaggagaauggcgugaacccaggaggcggagcuugcagugagcagagaucgcgccacugcaccccagccugggcgacagagcaagacucugucaaaaaaaaaaacaaaaaacugucaagguguaaaguaccaauucaaagguacuuagggaacaucuaggcauugagaaccuuuaugucuguggaauacuauaaggcaacaaaguguucuuuaucuggggauauauauauacauauggccauggaugauaauagacuuccugauugguuuucuuuuucuuuuuuuuuuuuuuuuuuugagagagagggucucacucugucucucaggcuggagcucagugaguggcucaaucauagcucacugcagccucaaacuccugggcucaagugauccuucugccucagccucccaaguagcgaggacuacaggcacacaccaccuccaccacaccuagcuaauuuuuucauuuuuuuuguugggggauggugguuagaagcagggucucgccauguuguccaggcuggucuugaacaccugggcucaagcaauccucccaccuuggcaucccaaaguguugggauuacaggcauuagccacugagccuggcaacuucuugauuuaaaucuuuauucucuauauuuagaagacaucaauguggccuuuugccauuuuucccauauggguuauuacacacgugcuugaagaauaaaaaacgguugucauuugaagggauauuagguauugguaagcaacuucugccuuucuguaaaauuuuaauauuauauuccaaagggggcuuuuuccuauuagucuaaaauuugggcccaauggccuguguaacacaaaguauagaaaaauacaaacacacgauuuugcaguuuguagcuuaacaaaauuaaaauuguuguuaaaacaaacugaggccucagugcuuacccacaacaaacacucaauagauguuuguugggaugauuacaugaaagugacugagcagaauuugaggcuaaauuaacugaagcuuuaaaaagaaaauucaugucugacuuuggcccagaucagcacuuggaacuggguaucaagaggaucagcuuuaugccuaggugaaguuuauuuacuguggucagggacaccaaauagaccucaccucuccuccacuuggugcuaucaauacccagauuuuccagagaucucagccuucgaacuggacugcuguagaccccaggaaauucaaucacccaaggaacagcacuauggggaggggucaucaaauugagccauuaucagucuuuaacaccugaaggcuaaucacuuaauccggaauuauccaguaaccagcagagcccugucaaaaaccaacaggccuuaguaaaaaaagaagggagaaaaagauggauuagugccucgaguacaacagggcugccuggggacccugccugacugaucugaggguuaggaaugcuuacaacaaagaagaaaccagaaaucaggaaaaugggaauugaaagccaauguucaccuccuuacacagcucuuaagguuggcccugccauccuaagcucaaggaucucuacaggaagaaugagauaucauaugaaaugcacuucagaaauucuauugagaaguauuauaauuaaggagaguucucugagagguagcaucuuugaauaggcucaaaacaggaaaauaaacuauuuaaugcaagaauuaagauaacauaguggccaggcacgguggcucacaccuguaaucccagcacuuugggaggccaaggugggcggaucacgaggucaggagaucgagaucauccuggcuaacacggugaaaacccgucucuacuaaaaaaaauacaaaaaaaucagccagguguggcagcgugcgccuguagucccagcugcuggggaggcugaggcaggagaauggcgugaaccugggaggcggagcuugcagugagccgagaucgcaccacugcacuccagccugggugacagagcaagacuccgucucaaaaaaaaaaaaaaaaaaaaaagagauaacauaguggcgaagugauggcaaauggaaugguugaaaaaguacuagguuagugucagacuaggauucaagucccaacucuccauuuacuagcuaugugaccccauacauguccccuugcccaugagccuucauuuccuccucuaucagcauacacgcauacacacggacacacacacaggcacacaaggacacacgcacaggacacacgcaggcacacaaacacacuccccuucuuuuuucccaccccaagccuaggcaacgagagggucuucaguggaaugugacuauaguaagaggcucacucaaccuuaagggaaaauuagaauuucuucgcuauuaguauucuguggaaucaacaaacgcuuaagcgucuaugugcuuaugguuuuaggaagaggccccugguguguuucuauuugcagcuuucucuguggcuccuuuaaauuucugaagcuuacguugaucaauggaacuacuuauacauucaagacccaggaguucaauaagaaauuccaacccaagugggaaugaaucauaugacuaauacuacuacuaacaaaagcuaugcaaaaaucacgaagauucacuguccauuugauuaacuacuuaguaaggaaaauuaaaugcaaacagaacacauauuuuucaaaggcauaaagauuuuugaaggugauucuuuuauuuagcgugaaaacuaaaucuuuaugaaauccucucaagucacacuggcaaauaacuaaaaaacaugauaaauaccacauaugaauauuuccuuaacauauguauucaguagcaguccuaaugauaaggggagugcugggaagggaaggguguggucccuuuaaacgguauggaagggagaagggaagugccaggcagagagaagggcauggucccuggcuagggcugcacccccacaggccuaggugaggucaggcauuuccggcccaaauguugcaagaccaccguggccugccacauccccauccugugccuacagaaacccaagacccaagcaaggcagacacagaagcagcuggacgucgagaggagcacaucaguggaggaacacacaagcggcuggacaucgagaggaguggauugguggaagaagauucaagcaguuagacgucgagaggacguugggagcacaccaguuuggccggaguggucagaaaacagcugccugacuccagggaaaaaccgucucccuucuggcuccccuaucugcugagagcuacuucuauucaauaaaaucuugcacucauucuccaagcccaggugugauccgauucuuccgguacaccaaggcaagaacccaggauacagaaagcacucgguccuugcaacaagguagagggucuaacugagcugguuaacacaagcccauagauggcaaaacuaaaagagcacccuguaacacaugcccacuggggcuucaggagcuguaaacauccaccccuagacacugucgugggaucagagccccacagcuugccugucugugugcuccccuagagguuugagcagcagagcacuuaagaaucuagccaaacccccaucacacacccugcaagggggacaagcgaacuuuucccguuuuacauugguaaaaauguucugauuuaccaaugugccugcaaaaagggaaagguauucuuacaaacuuuuuaacaaucacuuugagagugcacuaagguuggcuuuacgcaguccucuauuuuauacacugagaaauggagccgaagucuuucucagaggaccacaagaggagaaggucgaccagcaagcacccuggacccuguagcccaggagugaagaaacuuuuugucugcagugucacagcagaaccaggaaaggccaucacaagagaacucuaaggcucuggcacaggagggagaacaaaaaauauuuuuuuaaaaaauaaaaggauaccaaaagaauaaaggagguagagaagaaagaaggaagaggccgggcgcgguggcucaugccuguaaucccaguacuuugggaggccaaggcagguggaucacuugaggucaggaguuuaagaccagccuggucaacauggugaaaccucaucucuacuaaaaauacaaaaauuagcugggcauuguggugggcaccuguaaucaaucccaccuauuggggaggcugaggcaggagaaucaccugaacccagaagguggagguugcagugagccgagaucaugccacugcacuccagccugggcaacagagugaggcuccaucucaaaagaaggaaagaaagaagaaaaaugagcaggaacgaagugucugugcuaaaagugaaauugauugucaccagcauuuacuaugggcugggggaggauugaauaacacagggggugaacuuggggcagacucaguuaucuuugaaagacaaaagaugaucucucaaacccaaagucaucggcucuuauccagaacuugcuguuugugccucccguuuccauuagacuacccucuaucuaguauuaaaauggaagagaucgcuaauaaaaguagagagucaguacucucugaugcccugaaucacugacacagguuuauaaaacaucugauauagaaagauacucucuaaauacaggcauucgaacaaguauuuaccuaaaguuuaacuuugggcacaucauuuuaaccuauuauguaguuucaucuguuccaacucuucuguauuuccagggccagaaggaaaucuaagagauaagcuguguccagggcuguagucaagccagcucuuuuuggauaaggcagaauuacaagaaaaggggcuuacauuuccauauacuugauccucuucuaaauacuucgcucauuucuagcucaugauagggcaguagaaaagcccccugguaucucugagccaugauuucaguaucaguauaacuguuaucucuacuuacuuccaaggaacaaugaaaaggugaauucccuaauauuuuuaaaauuauuuuaggaaaaagccaugcacagucaugcaugccuauaauccuagcuacuugggaggcugaagcaggaagauugcuugagcccacaaguccgagaccagccuaggcaauauagagagacccagucccuuccccacaaaaggcuaacauuaaugaacuaaugauuaauacauaugaauugcuggauucaccccaucuacauccuucaggaaggaagacccuggaucuuucaugccuccagaaaccaccuacacagucacuuccucagacccuaagggugcgcacaggcugcuaugaaggcaaagaccgaacuucacuggacugugggugagcagcuuacguuagccaaguuucuccuaaaaaaugggagggguuuuggggggaaaacaauuuuacuuucugauuaaauaugaucuuguaauugcuuucccuguuauuacaguuuuuaaagcacaguaauuuaucaaaagauuuaaaguccaugaaucuaaaaauaaucauuauuuuuggugcaauuguuuuuaacggccuaaccauucccuccucucugguaguuuuaucuggaguguggggauugaaggugagacucaccuuaccugcaauuaacuaccaugaaaggaagguugagaggugcccaaaucugcccuaacagaacuaaugugccugagaacacuuuugcuauucaugaauaaaauauggaguggaagccagagaagugcaauuuaagucucaccuuaguugcccuauguuuucaaacucaguacaaugugguaaaauuuacaaggcauacucgguuuaaaaauaagaccagagguuccuuuauaaguccuacagacugagggaaaugaaaauugcauuacauauccaccuuuaguccacuucucuugcacagcuccugauaaauugcuuugcaacuuaacuggcaauacuaguuggucccacaucccacccucagccucccacccaccaggguagauuucugaacuuaguggaaaaagucccacgucuccacuaagugcaggcacuaaaccaagcuauuaggaaggggaaaggggaguggggguucauuagagaaaugcuuugcuagugguucaaaguacaucuuuucucagaauaacuccuuuuuuucccuacauucuauuucuuaaguuugagaguagguaaauguaaauuuuaccaaaaauaaaacaagauuauaaugcaacacgugaaucagccuuuugaagggcacaggaagggaagucacaacucccaaccuccuccucccaauccccacuccccagaccauaucagcuggccugacagccaucaggagcaguccucgcuggaauugcugacugaggagccuaucugacacuagagagcaaauguccugacaagggauucugcaucaaggccuaaacccaaaagucaaagccagggaaaucuggaaagaacagaggccaaaauauaacggaggaagucugagaagcagaccaccuauccacugcaggcccagguggacagagaccaggcuuaagcaacguuugccgagcaaacauguugcucuucucacaauauaaauauauuuaauccuuuuauagcaagaucccaagcugaucccaaaagcccauucagaaggauuuuauuaugcgagucaccaaaaaucaguuacaggcaaguuugccuuuacguuaacagcuaaggagccuccaagucugggcucuggggaagcccuuuguuccgggaaucccaucccucaagcagggcuuuaauuucacuucaauuucaaguccccaaaucaaauuuuaaaagugcccacuuaaagaacugcagaauaaacgagggguccaguacuuuuucuggacccuccaggccucaggacaguaucaaauuacagggcuuucccuccuggauauggccccuccgcccccccacuuuuuuucuuuuuuaaaaaagagaaucccacacacacccuacuguguccaccauuucaaauaccuugcaaauacaucccuauucugcaucucuccggagucuucuaagaaucugggaggagcuaacaaauggaauuugaauaauaaugaggcgacugaacaauuuaauuacggaagguagcucuagagacuccaauaaaacggcugaaagccuuuaucuacaaaaauguggccuggugcucaacgguaagaccaauuaccgggagugcagaagacagaaagcacaaaggugcacacaucaguuuaagcaaaugaggaauuagcacaaaucaucccaagagagaaaacgcuaugaaaaagggugacuugagaggcugcuuucucaucuaccaggcgcaaggcauaguuaacuuuauuuccuuucugauucauugaaagucgugccugccagauguagaauaaugaaacuacccuagugagaaaagcuuugcauagagaauuuaaaauaaguucagugaauucucaauaaaaguucuuuaaaaaucaauagucacaaagguacuuguaucucucacacaauuucuucagugugaaacauuaaaguuaguuccuucucuuggaugcauacaguuucacugagaauaacaucauguuuaacagccgcuuucuauugaccuuuccaagugaccuuacaguaaaggaacuuuugcucgcuucugagggaaacuaaaaaaaguuuaaccucucuggaauacuaaaaggcucucaacuuccuuacaccuuaagaaaaugcaggaagcccccacaagcugaacgauugcuaaaacccgcuucuagaacaggaaaaagaguuugcuucacuauugaagcaaagaauuccccgccgcgcgcucacucccgggcaggcacugccauguccagguggugauaccgagagcagauaagguguccugacaacgguguuugcguggaucccgggaaaucugcggccucucggagacucccacaacagcuuggcgagcauccccccgccgccccgcgggucuccccagccacuaccugggugggccccucccgcggcgacgcggggcgagacugacacccgcagcugccgacgacccugccagucacgccgccgccggcugccuuuuuuuagccacgacaucugacccuggcuucaacagcaccguucugggagagaggucccagggcgcgcccgcgguccccuccccuccccaaccgccagacgcugcggagagcuuggggugaggggcgcgggaggcaccggcucugaaaggggcagaagcgcgcgcuccuccagcccagacgcuuacucccuccuuccccuuuuccaccgauccugguugccccuccgccaccagcaccgcgcucccucauuuggcagcucgaggucgggcuuuuggcgucccuccccaccccaaacccucaacuggacccgcuccccuggacccccuccaagucgguggcucgcgcacggccgggcugggggcgggaaggcgccaaggggaggaaaggggcgcgagccgaggacgcgggggccgggcgcucaccucccuccucugugccgcuguccggaucggcgucggaggagucgggcccgucuccguaguccgcuagccccaccagcucauccuccuccuccuccuccuccgcgucguccucguccugcggcugcggcuuccccagcaccuggcucaucgugcccaccggccggccggcccggggacggcgggggucccggggugggggccaagccuccuagccggccgcccgcagccuauuucugaagcggagguuugucuagagcucagcggggcccggcggaagcgggggccgcgcgucccccggcgggcggcgcccagguccgggucccgcgguucccagcgcgcccgaagcccccucccccgccccgcccgccggcggaggagucagccggagcgcggcaguuccucccggaggagggagagagagagagacugcg

SEQ ID NO: 191356 - RNA, 4451 nt, Homo sapiens
gcuuccgauaacaacacucggagcuggggcuguggcuauuuguugcugcgccgccaccgcccgagucauguuccgcgaucuucucaggcucuccuagcagcauccaucgccgccacccuaucuucacuggcuucauucaccuucuccuucucucuucguugcugagcgacaagcuuccuagcgcuaugacugucgucuccgucccgcagcgggagccgcucguccuggguggccgccuugcgccgcuuggcuuuuccucccgagguuacuuuggggcccucccgauggugaccacggcuccgccuccuuuaccccggaucccggacccccgggcacugcccccgacccucuuccucccucauuuccuagggggagauggcccgugucugaccccccagccucgcgcuccagcagcucugcccaaccgcagccucgccguggcgggaggcacuccucgggcagcgccgaagaagcggcgaaagaagaaggugcgggccagccccgcagggcagcugcccagccgcuuccaccaguaccagcagcaccggccgagucuggagggcggccggagccccgcgaccggcccgagcggagcgcaggaggucccgggcccggccgccgccuuggccccgaguccugcagccgcagccggcacggagggagccagccccgaccuugccccgcugcggcccgcggcucccggccaaaccccccucaggaaagaggugaggccgccagggggccguuggggagucgggcccuuagacggucgcggccgagcucuggggcugcagacccugcacccggggggucgggcgggugggggcgggguggggggggcggcuguuuacucgggagggaaguuuccgugacgcccgcuccauucuugcuuugggggaagaagggggaaggggaggcaugcgcuggcgcuucugauuggcucccaggagucggccaaugagaagcgccgcugcgccccagcaacagccccgauuuagaaggcuggcggcguuccaggggguuucggcguuccgggcgcgcggcggggugggggcagggacagggcccgcgggagggcugacgucagcgcgcgcuacgugcccggcgcuccggcgcccaugaaggaggcgaggccgggugggggcagcuggggaaggacugggcccggcuuucggccucccggcuaucgggagccccaguccuagucggugaaacgcggagacggccucuaacgucccgccguaggggguggagugggcuccgagcggcuggguuucguuugguuggaguugugccaaaaugugaggugcccggugugggacgcgcaguccaguuggggcucugcccgccucgggccugaccuacuuagugguuccaaguuaagaguuggcaggagccgcacaaaacugauuuuauuacuuuugccacugugguacuucguguuaguguguccagaguaaguuuucagaagaguuagcaauugaauugacuuagcccgucugauugcagugcuauugcauuaggauaaaauggauagaaguuuaaauaggauuaagucuacgaaaugauuucaaagucuugucagaauaacguuuuauggacuuaaguucaaugacuuaaucuucguaauaaugaaaugaaaaaguucccguuauuuagugaagaauguugcauugaauuagagauuugcgguuuaucugugcccuugggaaaaaauuugcccaccuuguuucuuuaaauuaucgucucaaugucucccuuuuaaaauuccacgacuuuugaaauauccgugauuaccuaaaagcuuuugugcuuguuuccuggccuguuuucuagaacagguacuaacuagggagcucuggcagugaaccuuauugacguggaaaguugugguccucuuucgugucgugucuugcuuacuaccgcguuacaaguguugguagugcagugaucuaguggauuaccuuacgcuuuuccauccuuucaagacuuccuauaaggcccacuuaaguugggaaagauuaaggugagugaagcagcguucuugaagcaguuacuaaaccagaaaggagguacacagcaaagauuguuucuggcacucguauuuggaagagagcucauuagucuuccuuacaguuguagaaagguggacuuggguuauuucagacuuuuuuuaguuugacauuuuagaacugguucacguugcauacugguaacuagcaguggugauuaacugcauuuuuaguggcgaacaagagugaacuuaaaagucaagggaaauuuaaguuuuuuguuguuuuuuuuuucuugagacagagucugccucuaucgcacuccaggcuggaaugcaguggcacgaucgaucucugcucacugcauccuccccuucccaggcugaagggaucccgccucagccagccucccgaggcgcguguuaccacgccgggcugauuuuuauauuuguaguagacaugggguuucgcuauguugcccaggcuggucucgaacuccuugagcuugagcgaucugcuugccuugaccucccaaagugcugggauuacaggcgugagccaccaugcccaauuaaaguuuuuguaauuuucagcuuuuauuuuagaucaaggagguacuugugcagguuugcuacauggguauauuucgugaugcugagguuuggaguaugaaugaucccauuccagguagugagcauaguacccaguagguccccaucucucucucaaccccccuucuaguagugccuagugucuguuguuguuccccacuauauccauguuguacccaguguuuagcucccaaauucacuuguaagugagaacuugcgauauuugguuuucuguuucugcauuaauucgucuaggguaauggcccccagcuacauacguguugucacaaagaacauaauuuuguucuuuucuauggcugugggcaaacuuaaacacaacaaaacuagauaugugauaugagguucauaacugauuuuuaucuagaaacuauauuuacuuuuguguucuugucuuuguagguuuuaaaaucaaagaugggaaaaucggagaaaauugcccuuccccauggccagcuuguucaugguauacacuuguaugagcaaccaaagauaaacagacagaaaagcaaauauaacuugccacuaaccaagaucaccucugcaaaaagaaaugaaaacaacuuuuggcaggauucuguuucaucugacagaauucagaagcaggaaaaaaagccuuuuaaaaauaccgagaacauuaaaaauucgcauuugaagaaaucagcauuucuaacugaagugagccaaaaggaaaauuaugcuggggcaaaguuuagugauccaccuucuccuaguguucuuccaaagccuccuagucacuggaugggaagcacuguugaaaauuccaaccaaaacagggagcugauggcaguacacuuaaaaacgcuccucaaaguucaaacuuagauuucagauuucaguauguguguaaaacauaauuuuucccauaucccuggacucuugagaaaauugguacagaaauggaaauuugccuuguugcaacauacaauugcaaaagaugaguuuaaaaaauuacauacaaacagcuuguauuauauuuuauauuuuguaaauacuguauaccauguauuauguguauauuguucauacuugagagguauauuauaguuuuguuaugaaaguauguauuuugcccugcccacauugcagguguuuuguauauauacaauggauaaauuuuaagugugugcuaaggcacauggaagaccgauuuuauuugcacaagguacugagauuuuuuucaagaaacagcugucaaaucucaaggugaagaucuaaaugugaacaguuuacuaaugcacuacugaaguuuaaaucuguggcacaaucaauguaagcaugggguuuguuucucuaaauugauuuguaaucugaaauuacugaacaacuccuauucccauuuuugcuaaacucaauuucugguuuugguauauauccauuccagcuuaaugccucuaauuuuaaugccaacaaaauugguuguaaucaaauuuuaaaauaauaauaauuuggcccccccuuuuaaaauagucuugacucuuugugugugacuguuucucauguuugaaugugugacuaggagaugauuuugugugguuggauuuuuuugacuucuacuuuacuggcugagugugagccgccaugccuggccauaaucuacauuuucuuaccaggagcagcauugagguuuuugagcauaguacuugacuacucuagaggcugagacgggagcaucucuugagccugagaaguggagauugcaauugagcuaggaucaggccacugcacuccagccuggguaacagacgcugucucaaaaaaaaggccaagagaaaguaagggagacaga
